United States Patent 9,487,797 (GENOMIC PLANT SEQUENCES AND USES THEREOF) - sequence listing, part 2

SEQ ID NO: 2019 - DNA, 1137 bp, Oryza sativa
cgcggttatggccgggttgagcaatgtttttcgtgattagtctcacacctctcacaataattatggatgtaatacctggtaataatttgcttagctcctgggttggagttagatctgtacagccgggtatggttgttcagaatggttgggcctgtgcagcatgggtgtgctgttcagtgttgattaaaatttctgattaatcactccactgtttttacttctcttaaaagttttgctaaatgctgcttttgcaaatgaacctatattatgccatcctttggtatctttgtgcacttgcatatttgctgtgtggcttgctgagtatgtcatatgctcaccttgcaataatcaatcaacctcagttgaagaataaggatccagaaggagaagacgtttggcttatactccagttgagctgcctgtgggagtggagccggagcttcgctagattttattttccgctgcagttttcttcatggtgaggactaagtgcctcttaagtaagtacttatcgttttagttaatttgatgaatctgtatattaaattgtcagtttgtgtacctcggctgattcctggacgaggattttatgcacaaataagttcggaaattactagtgaatttccgggcgtgacacctttttaggctgcaaaggctgtttgggttttattgagatgactggttttaatacagtcatttactcggcatgttatatgcttattttgattatggcgtgagtcatagcctaggctatttagactcatcacctgttatgttatcacatttataccacgtttgatggatctttttaagagtttttactcggattcttatcatatgtgtggatttatagatctttagagtgtttctcactcaggcctcttcatatctccatttttgatatattaaagctaaagcattcggctggatgctttattgaacgccgcatattctttgctgtatgatattcggttataaaaccactcggttggatgttgtttgcatcttgactatatgtttagttttttaactaatcacatagtcgggggctacacctaattaggtgcatctagtcgatgcacctggttttttctatttttagaccttcacagtctttgatttttggtactcgggaga

SEQ ID NO: 2020 - DNA, 1501 bp, Oryza sativa
cggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccccacatcatgtcaccatgtgcctcagtaccaccacggtacctcggaaaggagctgtgacattacccctcgcacaacacaatccaccacagtgcaccattcctggatcataatcacccccctcaaaaaccagaggcatggactccctagcgacccccgtgggcttatctccgccacttctcagtctggtgctctgcaatgaaccatgctatacgaaagttaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaagccaccattaaataatagtgaataataagttatcccaatagtgtgctaatgtttctaagcatggctaagcaattatatctaatatctagttgaaccaatatatatatagcccaactagtcaagttataatcacccaaggtatcaaggaataaagtaatcaagtacaaaagggccataacaaagaataggttaattccacccaatgacattcgaaaatagatgcaatagttgaatagaaacaatagctttaaataggatcaacatgctcaaagggttgtttgggatctgtgtgacttgccttgcaataatcggtcttcaattaatcttcttgaatacttccgacgcacttgcgaaccttcgcaacgacggaaacgacaagctaacacgcaaaacgaggaaaaagactaataaaaaccaaataaacaatacataaaaagtaaacaaacatgtagatcataattttagatgaattatgagacttgaacggcctcattctgacttcaaatgaatttattatgaattttacaagattaaatctaattaaagcccatttataaagaattaaataaattaaattcaatttatggataattttaatatgtagatctttattttatataatttttgcaacttgaaccacattaaactgagttcaaatgaattagttatgaaattttaaagattaaatcggattaaaacacttatattgattttaattgaattatgacgcaataatgaattatttttgaaaaggaaaaggttatttattgtgtcagcggctagggtttcgcagtgaaccgggtgcatagcaacggttcacgggaacggacggccgagatcgatccatccaaaacggacggccgagatcgatcggtccacgaccggctcacgggagagggcgacga

SEQ ID NO: 2021 - DNA, 1501 bp, Oryza sativa
attattgcaaggcaagtcacacagatcccaaacaaccctttgagcatgttgatcctatttaaagctattgtttctattcaactattgcatctattttcgaatgtcattgggtggaattaacctattctttgttatggcccttttgtacttgattactttattccttgataccttgggtgattataacttgactagttgggctatatatatattggttcaactagatattagatataattgcttagccatgcttagaaacattagcacactattgggataacttattattcactattatttaatggtggcttaatgatagttcacgatggtcaatcgtgattggttaattaattacttgccaactaaaacttgataatggtgggttgtgagcacatggttttgagagtcgtgctcatgacaattaaggaccggttcgcgagctactattgtgaaacattaaccgtgccaaccacaagccagcgtgggcaacggctttaactttcgtatagcatggttcattgcagagcaccagactgagaagtggcggagataagcccacgggggtcgctagggagtccatgcctctggtttttgaggggggtgattatgatccaggaatggtgcactgtggtggattgtgttgtgcgaggggtaatgtcacagctcctttccgaggtaccgtggtggtactgaggcacatggtgacatgatgtggggctgtgtcttgtgggtacagtggtacacctctggccagagtaaaactattcgaatagccgtgcccgcggttatgggcgggttgagcaatgtttttcgtgattagtctcacacctctcacaataattatggatgttatacctggtaataatttgcttagctcctggtttggagttagatctgtacagccgggtatggttgttcaggatggttgggcctgtgcagccttcatgctccaggaactcctcttctgggtttgggaaaaattgagcaagactgagtacaaccaccgtactcaacaagacacacccacaagtgcagaataaatgcaagggagtacaaaggagttatactataaagggttagggttgcagtaaacagcatttaaagatatttagttgctcaaagctattttgtaaacacgattctagaactatacaattattaatcaaggccgtgaacccacacgaacctgccttaacccaaagcctacgatgattcagaccgaactggcaacccgaccctgggtcccagctcgtcccaagccaacccaggccaaccattccaccttttagttgttaagcaggttttaagaactaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacagacggaagacgtgacatagtttccaacccatcctagc

SEQ ID NO: 2022 - DNA, 1501 bp, Oryza sativa
cacccagcgctaggggcggtgagttgtcggcgatcatacgttcttcgtggatgtctatctgatgatgaagatgacgaggatgatgatgatgacgatgggtcgcttgtttccggcgtacgattatggggacgtcggccgggttctcgagaatcctgtcgtcatctcccgctgttgtctcggcgccgatctccatcatcgtcgtcattattgcggcgtcctcgaccagtatcgcccagcacccgccgttcgcgatcgtcgtgatcgtggcggttgtggcggttatcacggtctcggtcttcgcttgaacggcctcctcgatcttcgttattgtgacgccgtgaagaaatatgacaccgggaatggttctcgttatctcgtgtgcgtcgcgcctctcgacggccattcaggtgatctcggagatcaccggtgccgcgaggtggaggggtggctcgatgaggcgattcccgctgttcagggttttcaccattagcatcgccagttggtggctgttccgggtgcgctgcagcagcggtctcttcgaacgcattgctgaggttggtcactgattcccgtagtcgttttgtccaacgtgcgagatcgtcgttcagaacgtgatcgtagggggtttccctcagtattgcgttgacggctctgatgagctgggccggagtagtcacttgattctccgcttccgcaccggtgcgcgctgacgtgccgacatcgtcgatagccaatacctcacgcggcgtactcattgtcgatgatccatagtcttcgagtaggtgcaagactgatggttcatggggatcgatgtcgattatcccaacaaatcgatctgaaatcggcatcgctcattgttccttgtcctcatccctgatggggatgcgtgactgctggaccttaggaggtggcgtcttcatggcgctgagaaagaccttgcagctcgagagatcgtgattctttgtcttgtgaataggacaatagacatcacgagttggagaggtacgctgaattccacgctctttacaggcacgaatttcagcatggacgttgagaaagacccagcatgcttgcagggtgtgtttcctggttttgtggataagacaccaggaccttgtcacctcggaagtaatccttgtcggctcgtgattcctgtcgggaagacaaggcttggccgcactaggatccttctcgggttcggacgtcgtcgacgttccgatctccgcttcggcgggtagatccttcgacatggagtcgccccgggttgtagccactgcgttctcattttcggtcattggcggaccagctgagatcggcatagtggtataaaccggaaagacgatttcgccgacttgagtccacaccagtgttgttgaagtaggaactccttagttgaggttggtgttgacgctgttgtcgacgaagctggatgtcatagtagtagaaccttgagcaccaagtccccctacctggcgcgccactgtcgacgggggatacccgt

SEQ ID NO: 2023 - DNA, 1501 bp, Oryza sativa
catcctgatccaacacttcttcagctgcgacatcaggcgcctcttgctctccatgcttggttcagcaggtatatttcttcatgaatccattcattatcaaatgagcatgcacttcatcgctatcaacgatcatctgttcattcttacagtccctacatggacacaacatgtgcatcctacattttctgtcattatccgcaaatgtgacaaattcagtgaccccctctctatactcggtagacgaacgatgcgcatagtacatccatctacgatccatctaaaatcaacaacatacaaagaaaaatatatgatgatcgatatattgagaatgaatggagaataatgtgttttttaccttgaattttagcaaaaattcgcccccccttgccctcccaaccgatttgtgaacattgaactggtcgggatggaaagcagttggcagtttgtggggtatttatagacccaacacacctcaaacgggttagattaaaaaagcccatcaaaggtgttggtcatacctttgatgggcttcaattgagttgcccgtcaaaggtattgacctacctgtgacgagccataaaaaaaatccgtcacaggtggcggaccaccacctgtgacggctcataattccacggcccgtcacaggtgagaggatacgagtgacgggttgggaggaaaacccgtcacttcctcacctgtgacggcttttccttctggcccatcacaggtgaggggatacctgtgacgggccgtggccggatgccccaccgatgacagcaaacctagcaacccgtcaaaggtgacagtcatctgtgaccaattcataggcccgtcactggtatgctgtcacagatgtagggttctggcatagtgctaacttttgattgtgggtaattcttctacaattttatttaataacttagtgactatccaataatgaatcataattaattctcattagtgccatagtagcttatgcaccttaatcaaatttactaactacatgccactagtcactagacaatgcaacagatccttcacagagttcacaagacctaagcattaaaactcactcaattcctttcatatacctgtaattttcttgatcccttctatatctctgaaatttcaacttgattccttcatttcactgttaagtttggttgcaaatgtcttttatgcccttgattatttaggtttgaatataagcttaaaaaatgattaaaataataagattaaataattagtgcagaaatttaatgcatagtacgtgcattttatgaaactaatgagactaaataattagtgcagaaatttttgacataaataaaaatgtaataaattaaaatttttatttgaaattttaatagggcaatagattttctttattgggagcattcataaagaaaatatcgtgagcattggtagtcctatctttgtatgaatgctcctcatttttatgatttttttcttaaaaaaataaatatatatttttatttta

SEQ ID NO: 2024 - DNA, 1501 bp, Oryza sativa
aaactcggtgaaaagcttcgacttccaattcttccaagctttgcccatcttatggaatgccttccgcttgagcctatcctttgctttagccggaaatgtgaaccatttctccattgccgtccaagctcgctctttctcggcttttgtgaccttgtcgatatctttatggaggatcccgaaattctcacgtgccgccagcccgcagcagttagaccatcttccaatgacagtcctcggcgccgtgggcctaccactagcgtcaacctctcttataacttgcaatgtggtcggccatatattttgtgaccggggatttctactcgacctacttgcacttgtcccgtccgacatcgacgtatgttattcctggggcgattctgcagcgcagacagaaggcaacatatgctaaggggtgctagctaaaattttgtggtcatatggtgaaaaattatcctataaattatcatgaattttggattgttcgaccgccgttgtcgagggatgactttcggcaactgtctccgtggctgggtttgcttttcctgtatccttgcaggtgttggggagggcgggtttgcgccgggcgttgtcatggtctaattttccccaaaaagcttataaatttcctaccattatactaaataacattagaaccaatgtaatacggggtatactatgaaacatatggcctcagttttgctcagaaattatgcatcaattaccatcatttgcatgaagggaaaaagaagaggaaatcagctaataggagggaaaagcaacccaaagtaaagcgtaaaaaagaaccaagtgtagatagtctcctcttatcaatccagaaaaaagaacaagtgtacataaaaaaaagaacaagtgtagataatatgttcttatgcattaaaaagaacactcattctataagagcagcagcagcagcagcagcatcaattcattttataacaatcatcaaaattcatcaaaatcaggcattcaggggcaattcttatgcataaaaaaagaacaagtgtagataatctgttcttatgcattaaaaaaagaacaagtgtagataatctatgcataaaaaaatgaataaggggcacaggggcagcaggggtagcagcagcaacagcaattcatcaaaaaagaataagtgtacataaaaaaaaagaacaagtgtagataatctgttcttatgcattaaaaaaagaacaagtttagaggtatttctgttcttgagcattcatcactggctatttaatataaggcaaccataggcagcagcatgggcaaacatagacagcaaggcatcaaaaaaaattatcatacccatggcaataatttcttaaacagcccacaattaatttatcaagcaggggcaagtgtagataataaaacagcccacaataatttctaaaacagcagcagcaagggtatataaatcatgtatataaacaacaattcatgcaattcacttattcatagacagcaagggtatataaat

SEQ ID NO: 2025 - DNA, 760 bp, Oryza sativa
ttgtcagtttgtgtacctcggctgattcctggacgaggattttatgcacaaataagttcggaaattactagtgaatttccgggcgtgacacctttttaggctgcaaaggctgtttgggttttattgagatgactggttttaatacagtcatttactcggcatgttatatgcttattttgattatggcgtgagtcatagcctaggctatttagactcatcacctgttatgttatcacatttataccacgtttgatggatctttttaagagtttttactcggattcttatcatatgtgtggatttatagatctttagagtgtttctcactcaggcctcttcatatctccatttttgatatattaaagctaaagcattcggctggatgctttattgaacgccgcatattctttgctgtatgatattcggttataaaaccactcggttggatgttgtttgcatcttgactatatgtttagttttttaactaatcacatagtcgggggctacacctaattaggtgcatctagtcgatgcacctggttttttctattttcagaccttcacagtctttgattttggtactcgggagatcaggggagaagaagtcggagtacttggattatcgttttggatcatgagagaagactatttcgttgactgtaaaggtcttaggggctactgtggagattatggataccccatacctacacggcatgtatagtccgactgggtatggggtgccatgtatagatagaatatc

SEQ ID NO: 2026 - DNA, 1501 bp, Oryza sativa
gctactatggcactaatgagaattaattatgattcattattggatagtcactaagttattaaataaaattgtagaagaattacccacaatcaaaagttagcactatgccagaaccctacatctgtgacagcataccagtgacgggcctatgaattggtcacagatgactgtcacctttgacgggttgctaggtttgctgtcatcggtggggcatccggccacggcccgtcacaggtatcccctcacctgtgatgggccagaaggaaaagccgtcacaggtgaggaagtgacgggttttcctcccaacccgtcactcgtatcctctcacctgtgacgggccgtggaattatgagccgtcacaggtggtggtccgccacctgtgacggattttttttatggctcgtcacaggtaggtcaatacctttgacgggcaactcaattgaagcccatcaaaggtatgaccaacacctttgatgggcttttttaatctaacccgtttgaggtgtgttgggtctataaataccccacaaactgccaactgctttccatcccgaccagttcaatgttcacaaatcggttgggagggcaagggggggcgaatttttgctaaaattcaaggtaaaaaacacattattctccattcattctcaatatatcgatcatcatatatttttctttgtatgttgttgattttagatggatcgtagatggatgtactatgcgcatcgttcgtctaccgagtatagagagggggtcactgaatttgtcacatttgcggataatgacagaaaatgtaggatgcacatgttgtgtccatgtagggactgtaagaatgaacagatgatcgttgatagcgatgaagtgcatgctcatttgataatgaatggattcatgaagaaatatacctgctgaaccaagcatggagagcaagaggcgcctgatgtcgcagctgaagaagtgttggatcaggatgtagagaacaccgccgcagctcgagaaggcatgttcgtaccttctcctttaggtggagagaccatagatttggacactcaatgtctatctacaatgttgcatgacaatgaagacgcagaggacaacgacagagattttgagaagtttagtaagttagtggaagattgtcagatgcccttgtatgatggatgcaagtcgaagtacagcaagttgtcatgcatgctggaactcatgaagcttaaggctagtaatggctagtcggacaagagttttacagaacttcttgagctgtttaaggacctgttgccagaggggaacaatttaccatagacgacatatgaagcgaagtaagtattatgtccgttgggcctggaggtcagaagaattcatgcatgtccaaacgactgcattttgtattacaaggaatacgctgacttggatgtctgccctgtctgtggggcatcaagatacaaacgagcaaagagtgaaggtgaaggaagtaagtcaaagaggggaggccccgcaaagg

SEQ ID NO: 2027 - DNA, 1501 bp, Oryza sativa
gagtggcaacttggatcatgttggattcatatattctcttttgtttgtcaatctgtttgttgtttgagttttaagatttttcgtttagttttctagttttgcttttgcttctagttgtctagttactccaaaatatcaaataattctattttttaagtgtataataattaaaactgaattaattttgcgctaatggcttatacttattttgcatgcccttacttaatcctcatattcatgggttgcaaacaccacctaatgtgtgaaaccagcccaccacattgggccaattggcaggcaaattccttatttctcatgacccaaaaggacaatagatgtcaaataagattgtgtattttgttttctgttaaaatgatagtgtcaagggagcagcttagaatatgttcgccaaataggttaggaaatcatatctgcatccatttcaattttttaatcccacttctcataattcatgtcgaaacaagatttcggcaatactaaaaggggtggctatcaagctgaaaaagtggatgggttaagagacaaggaattttatacaagttcaggccttcttaatcaagaagtaataccctactcctgtccggagattgatccgccgagtatattattgatcgtatgatctgggtaaaaaaacgtgcccctagagacacccggacccttccttatataaaagaagaggtccgtattacaaaatacagtccatatccctaacggaataggtagttacaaataaaatacaatcgtaaccgactaggatctcaggtattaccttgacatacaagtttagaatttaacccgagtcattttaaagatattctatctatacatggcaccccatacccagtcggactatacatgccgtgtaggtatggggtatccataatctccacagtagcccctaagacctttacagtcaacgaaatagtcttctctcatgatccaaaacgataatccaagtactccgacttcttctcccctgatctcccgagtaccaaaatcaaagactgtgaaggtctgaaaatagaaaaaaccaggtgcatcgactagatgcacctaattaggtgtagcccccgactatgtgattagttaaaaaactaaacatatagtcaagatgcaaacaacatccaaccgagtggttttataaccgaatatcatacagcaaagaatatgcggcgttcaataaagcatccagccgaatgctttagctttaatatatcaaaaatggagatatgaagaggcctgagtgagaaacactctaaagatctataaatccacacatatgataagaatccgagtaaaaactcttaaaaagatccatcaaacgtggtataaatgtgataacataacaggtgatgagtctaaatagcctaggctatgactcacgccataatcaaaataagcatataacatgccgagtaaatgactgtattaaaaccagtcatctcaataaaacccaaacagcctttgcagcctaaaaagg

SEQ ID NO: 2028 - DNA, 1501 bp, Oryza sativa
gtgactaaatattttcaattttttcacaaaatttttaaataagacggacggtcaaacgttaggcacgaatatccacggctgcacttattttaggacggatatagtattagtcgtccagatttaatggtgatgttggctctgtcacttacacttacctagtacaccctgtgtgtgtgagagagagagagagggggggggggggggcgtgcaactgcaacggcatgcgtgtgcatggctctgcgccgcgttggatcgaatcggatcctaagctagctaggcagaagcttcctgatcttgacggatcaattagcctaggtaaaagcaaggataataataaagtcagctgcttacttatagcctatctatcagctcactcatataatggttaattctttactataaatatatgatctatatgtctgtctcatagatttttttagtttctgtgcctaagccggctgtaaacttacagcccgcttctcatctctctcctcttttctatacttgctctaagtcaggccgcccacgccttcttcactgcatgccgatcgatgccgtccatcatatccatccatcgggcttaattttggtcgaaggtgcagattaaggctgtgttaatctgtgtttagatccaaaagttgaatccaaacttatgtttaaattcaaaagttaaatctaaacttagtacttttctatcgtatcaatctgtcatacacaaataatttttcagtcacatcattctcaatttcaaccaaaatttaaactttacgctgaagtaaacacaacctaattatccactcgccgaccctagctagctactcactcgcgcgaggtgtactacgtacgtacagcctacatggagtagccagctagtaactcataaatacatactgtacgtgcataatcatacatactccctccgtcccaaaaaagacaaacactggtttccgtgtctaacatttgactgtccgtcttatttgaaaaaaatataaaaaaaataaaaagataaatcacgcataaagtattaattatgttttatcatctaacaacaatgaaaatattaattataaaaaaatttcatataagacggacagtcaaatgttggcacggaaacacagggtttgcttttttttttacggagggagtacttgtatatggccgagtttggatctaaagtttttcttcaaactttcaacttttccatcacattaaaacttccctacacacataaaattttaactttttcatcatatcgttttaattttaaccaaacttctaattttggcgtgaactaaccacacccgtagctatatgtgtatgttagcatgtatacaaatataaaatcgaatgttgtgttctaggctttctagccagcttactagcagctagatatgtaggagtatacgtcatcctatacatacgtactccggtatatatatatatatatatatatatatatttatagtaaaaaggatatagaaaaaattgttcaaagattaga

SEQ ID NO: 2029 - DNA, 1501 bp, Oryza sativa
aattattataactaggtatatactcacaatttaaaaattttgaaaaatttgagtgattttgtgcattagataccatgtgcccgggcaccatggtgccccatatatatatatatatatatatatatatatatatatatatatatatatatatatatagacacacacactcaacttggtatgtaggcggcagccgtggcggagaggtaggcagcggccatctcgtcttacccttcgatctccctcccctcccacccccgaggacaatggcggcccggctgcttcccatgtcgccgccgccgctgtgtcgttgtcacccagtgggctggaccctcaggcacgtgtggggggggggtggggcggtggcacgcccaaggccgccatcgtggtcgcctaccacaagtaataattgaacctaaatatataggttctaccacaagtaatctaatcaatgaagctactattaattcgtcccgtacaaaggctgtgtttagttggatctaaagtttggattttggttgaaattggagataatgtaactgaaaaattgtatgtgtatgacaggttgatgtgatggaaaaggactgaagtttggatccaaactttggatctaaacgcaaccaaaatacttccggtgacaaatgcacttggtgtataactaacctagctcaaagtgtggaagcgtgccatgaattgaatccatgcatgcgtatatgagtcattgctatatggctatgtatagctgcctcgaaaggtcagatttattgttcgcgtcacacacacacacacacacatttatacatgtatacatatatatacatgtatatacatatatacatgtatacatgtatatatatacatatatatatatatatatatataaatttgtttggtgctccatggtgcccgggcaccattattgaaattgagtatatacccaattcaaatgagtatgaaactttttcaattacttaggtattaacattaactactttactaactagtttaaagcaagtttgaactgaatttgaacttatttttgttagattttgattctaggtatatagcatccatacatataattagttaggtatgtaatcatggattgtgaaataaagttaaatttgagttgttttgttgataagtataggtatgaatcaaattattataactagttatatactcacaatttaaaaattttaaaaaatttgagtgattttgtgcattagataccatggtgccccatatgagtgtcctatatataaataaataaataaataaataaataaatatatatatatatatatatatatatatatatatatatatatatatatatatatatgcttcagacaatatacactgttcaaaacactatttattcggctgaatactattcagtttactgtttattcggctgattactattcaaaaacactattcagtttactgtttaaattactgttcacttcgagagatattttaactttaggatctttgcagg

SEQ ID NO: 2030 - DNA, 1501 bp, Oryza sativa
tcaaacgcacccctagtgtttgtttgaggagaaggggagatacgcaaaacgaggtgagccattagctcatgattaattgagtattaactattttaaattttaaaaatggattaatataattttttaaagcaacttttctataaaatttttttacaaaaaacacaccgtttagtagtttgaaaaccgtgcacgcgaaaaaagagaaacaatctcccctacctccccagaacgaacagagccctagtctcctactactaccaattgatactagtagtactactactaatcaatactcttactgtatgattactacttcaacactggtattatactggtgttataataacatgctacgtccaaatgtaaacacttttgtgtactgtatatatgcacactcacccatataaacacatatacatattttaaaattgacaaaatcaaagcatgtatctctacctatcgacatgcactgacctgtcattaaaaaaatagttagctataaatataaacaaccgtgtgaagtttaataattgaacccaggttataggttctaccacaattaacctaatcaaatcaagctcgccttgtaaaaatacttccaatgacaaatgcactttgtgtgtgtgtgtatatatatatatatatatatatatatatagtaaatttgtttggtgctccatggtgcctgggcaccattgttgaaattgagtatatacccaattcaaatgagtatgaaactttttcaattacttaggtattaacattaactactttactaactagtttaaagcaagttcgaactgaatttgaacttgtttttgttagattttgattctaggtatatagcatccatacatataattagttaggtatgtaatcatggattgtgaaataaagttagatttgagttgttttgttgataagtataggtatgaatcaaattattataactaggtatatactcacaatttaaaaattttgaaaaatttgagtgattttgtgcattagataccatgtgcccgggcaccatggtgccccatatatatatatatatatatatatatatatatatatatatatatatatatatatatagacacacacactcaacttggtatgtaggcggcagccgtggcggagaggtaggcagcggccatctcgtcttacccttcgatctccctcccctcccacccccgaggacaatggcggcccggctgcttcccatgtcgccgccgccgctgtgtcgttgtcacccagtgggctggaccctcaggcacgtgtggggggggggtggggcggtggcacgcccaaggccgccatcgtggtcgcctaccacaagtaataattgaacctaaatatataggttctaccacaagtaatctaatcaatgaagctactattaattcgtcccgtacaaaggctgtgtttagttggatctaaagtttggattttggttgaaattggagataatgtaactgaaaaattgtatgtgtatgacagg

SEQ ID NO: 2031 - DNA, 1501 bp, Oryza sativa
ctaaatgaatttccaaaaccgcggaccggggaacgtaccgggtgtacggtttcccgctcttgcacctaaggaccgtttccttggaatttcatccgaacataagacaagtacgaccacatgggtggaatgggacacccctggctgagtaactagcttatcaggggagccttgatgccgagagacatgtgaattcatcggggtggtgtcggggaggacccctgggcttcctggcacagtatggtctgggacctaacctgttgttggtctgggacccctctcgtcggcatatggtaaacctgtgtcggctttggaaatgccttatcatgaaagcttggaggtctcccgacgtggctgatccccacgggctaggtgatccgggttagtaatgtcatgtgggtaaagtgtaccccctctgcagaggttaacaaactgttcgaacagccgtgcccacggtcatgggcggatgtgaggtgattcctagcgtagttttgtttgactactgcttgtgaaattgctgttgtggaaaggggatcgatgtttggaaaatctgcagctgatgggatcagctaggcccgggtggctgtttgaaagttgttggccgggtgccaatcttgatcaattctaaagaatgatatatttgcacatactccgaccggacgagacgcactgtctcatccgtgtcgtttgagaagcactcacttagttgttttcagaaaagagttcaaataaaatcaattgcaaaaacaacagcctttccttgaagcctgcattaaacacttatttcccatggcttgctgagtactcccgtactcacccttgctctatataaataactaccccccagttgctgaagaagatgaagcggatcccgctgacgaggagttcttccaggagcaagccggctacgttgagttttagggtttcggcctagttcccaagtcgcgtctgtgttgtttggtccaagtcttggcttccgcttcccttttgtaatgcagttgtgagctcgggatctgtccgcagcccaacatgactgtactccttctctatattaaagagacctctgttgctgtgatattctgtcttcctgtgataccagcactgtttcctgggactggtatcgattaacaggttaatttggagcgtcacgggctagttccggtcgggactagttcggggcgtgacaagggatggtatcagagcacaggcttggccctagggcgaaacccgacgtttaggacgaccctaaggatactaagttcaaaactacttgcgaaaagctaaggcttcttttggtttccttatttttaatagtttgtttctaaaatggttactgatcttttctccctctttcaaaattgtagatggcagtgaacgccagcttcagttcccacggttttggtgagggtcaccacgtcgctcagcttcgtgacctcgcccgcttccttggcttctcgtgtcccgagtacacggggtactccgtggaccgtgttccccctcgctg

SEQ ID NO: 2032 - DNA, 1501 bp, Oryza sativa
ctgagtttatgccaaacatcagtttccctatcggaagaaactatcggaagaagaaaaaaaagcacaatttcacaacctattagtatggttgactcatgtcgaggggaaaaaaattacagttaatgagaagttaattgatcacataaatttgaattgtgcccttgagccactgccatgtggggcccgcatgtcggcgcgccccctctctctctctagggtttaataatggcgcaataaatcaattaaggacttttctatttatagtaaaaacactgtggatcttctaaaattcatagaaaattcatccgagctccgtttaagcccattcaagtctcagtaaattaagaaaaatgcaaagaatccattaaaaatggttttgttctctgttttagtagtcttatagcctttttgtattgtttgctttgtatgtcgcttagattccggctctcccgacgctccggtgtactttgagatagtcgccgaggtccctccagctgcagagcaaggcaagtcatgcttgtcacttaaacatgttgatcctatattgcaaatgctctattattttcctttaaatactgcattgttttacaatgataccatgggatgtttacctactgtcttagccatactaattatttccttgttcctttgttagcttgggttgtaacatgattagatgttggactaggaatttcttagccatgcttagtgtcacgccccgaactagtcccgaccagaactagcccgtgacgctccaaattaacctgttaatcgataccagtcccaggaaacagtgctagtatcacaagaagacagaatatcacagcaacagaggtctctttaatatagagaaggagtacagtcatgttgggctgcggacagatcccgagctcacaactgcattacaaaagggaagcggaagccaagacttggaccaaacaacacaggcgcgacttgggaactaggccgaaaccctaaaactcaacgtagccggcttgctcctggaagaactcctcgtcagcgggatccgcttcatcttcttcagcaactggggggtagttatttatatagagcaagggtgagtacgggagtactcagcaagccatgggaaataagtgtttaatgcaggcttcaaggaaaggctgttgtttttgcaattgattttatttgaactcttttctgaaaacaactaagtgagtgcttctcaaacgacacggatgagacagtgcgtctcgtccggtcggagtatgtgcaaatatatcattctttagaattgatcaagattggcacccggccaacaactttcaaacagccacccgggcctagctgatcccatcagctgcagattttccaaacatcgatcccctttccacaacagcaatttcacaagcagtagtcaaacaaaactacgctaggaatcacctcacatccgcccatgaccgtgggcacggctgttcgaacagtttgttaacctctgcagagggggtacactttacccaca

SEQ ID NO: 2033 - DNA, 1501 bp, Oryza sativa
acatgtaatctctacaactagctccgtaatccctattattatttttgaaatgctacataatttatgaaaaaagaataagctctccttagcttagctgtatgcttgaaagttttctgtctcgtcaacctcacgcaataacaccaaacaccaaccatacacagctattgcatcgttcctgtgctttgttgcaaaaacagtacgtcgtcgtttctgagctttggagtagtaccgtattttgggaatttctagtaccgcggggtggtatcgtaaagtgcaaatgtgatactccagtagatcaaggatgtgtttagtttacaccaaaattagaagtttagttaaaattagaataatctaacaaaaaagtttaaagtttacgtgtaaaaatgtttcgatgcgatagaaaagttgaaagttataagaaaacaccgcgcaagtagcagcaggcgttgtattgtgtgcaggactactggcctgcagctgatactgtactgtagtataagatcaagtttaatagtatatccaactactagctctattttatttataaccaatatagtagctcattatacaatagttatatactacactattaatacatgttcctatctgtcatacacacactgcgtcttggagtccgtgctacatctggctacaaatctgtagcccgctgctcttctctcaccttatttattttcttaaaatatgtttgcagctggtttatagcatgctattgtgataaaggagaggaccactggatacacagcattgcacgcagttgaagtcgcatctggctccgtctgcttcgaatactctagaaatacatgccataccgtatagtatactctagtaccagtatatgtgtatagcctcacaaaagtaactgatgagctttgatccaagaagatcatcataacattgttattctgggcttggccggaccaatatttgttttctaaacaaaagaagaaactatacccttgtataaatgctaatacacgaagaaatattctctcctttctaaattgatcatcatataataaaattcaaaattagtcaaattgattataatataaccgcattgaaactgatttcatcataatataattaatacaacatgagagaatctgtgcatgctaaggtataattggtatagtgttttaatcgatgcatgcattgtgggagaatgtgtgcatgttgtcttgattgatgtgatttaaattatcctttgtttgtgtgattggtgttttgattgatgtgatttaaattgcatgcagcaaagagcatgcggttttaactaatttgttttttttctttttctagaaacacaacacaaacgtggacgctcataacgtgtacacacttacccttatatacacacatgcataaaccccaattataaacactcataacacggagctatctcgtaagcatctctagaaaattgggctcgcatatgttgagattcatgaagtcaccacagtgggtacatcatccaccactc

SEQ ID NO: 2034 - DNA, 1501 bp, Oryza sativa
aagaggagggcgaacacatcaccctcgggcccgacgccccccgagggtgccaggccacgtgggcgattgtgtctgcctcaagcctctagtcatgatactcccggtcccatgtcaccgacagtaccctatttacggagcacgcgtaagcgaaacggcatgtttataaacgaaaagtaatttatgaacaaaacctttatatacgtgttctttgcgatctaaaagtaaaggctgaaaaataaacttcgatgataaaacctcaaaatcagctcttgaattaaatttaaggttgaaaatttagattttagctgataagtataagtttagagtaaatagctaatttagtcctttaagtttcatcgaaagctcaatttaatccttcaagtttcattttgtccatataggtcctctaagaatttgtttttgcttaaaattatccttgggcccacttaatatgccatatggctatttatagtcaataattcggttagaaaatgtctcttttgcccttaatttgtatacaactatgcactagaaaagagaaaaccaagatatataaacaacatttgtacttcctatagtggagttgtgctcttgcacttctcaaagcacagcgacaagtaaatgttaccttgtagccatcaagggtgtcacgcccagaaattcccgaatagaattccaagcagaatgtgcattaaaatccatgtccaggaccggccagggtacacaaacgacaaagttgacatacagatccacgtcttacaaacattataaaagtcttatataaatgcagcggaaatataaaagataactggagctaagtcttgacttggattgcagcgggaacaccactccacaggcatccttgatggcacggacgaagcctactcctcggagaaaccaccatcggacgcatactcgaactctgaggattgggagatagagcaagactgagtacttcccactgtactcagcaagtcataccggaacggagggtatgatgcaatataaccaaaggaaggctaaaggggatcctttgcatcaagctggcatttataaacagtagttgaaagcagtaaaacggttatagtaattaatcaatattaactatccactgtccaatgctacaccacgttgcaacaggcccaaacatccatctgaactaatcaattccattagactaaactagggtgagactaatcacggtgaatctggtcgatcgcccataaccgcgggcacagctattcgaatagttttactctgatcagaggtgtacaattgtacccacaagacacagccccacaacacgttcccgtgtgccgatatgccaccacgacataccggaaagaggccgtgtcaggacccttcgcataaccacctctaaccaaacataccacacctcaggttttacccccactcatcgcaaggcagtgggcagtcccctctcgtgcctaggtgaatccaaaagtcgcataggccgtcgcagggcccatccgaactccat

SEQ ID NO: 2035 - DNA, 198 bp, Oryza sativa
caaaacgacgacaggaggtgacgccggcgagaggaggaaaaagaagaaaggaagagggaaagggggcttgcctccttgccgctttgggaaaaggaggaggaagcgggggggtgacgcggcagagggaggaggagctctgcctcctcttcttggaagctagcgcgtggaggggcggggccgagtcgatgacgacggcga

SEQ ID NO: 2036 - DNA, 1501 bp, Oryza sativa
ggcctgttgcaacgtggtgtagcattggacagtggatagttaatattgattaattactataaccgttttactgctttcaactactgtttataaatgccagcttgatgcaaaggatcccctttagccttcctttggttatattgcatcataccctccgttccggtatgacttgctgagtacagtgggaagtactcagtcttgctctatctcccaatcctcagagttcgagtatgcgtccgatggtggtttctccgaggagtaggcttcgtccgtgccatcaaggatgcctgtggagtggtgttcccgctgcaatccaagtcaagacttagctccagttatcttttatatttccgctgcatttatataagacttttataatgtttgtaagacgtggatctgtatgtcaactttgtcgtttgtgtaccctggccggtcctggacatggattttaatgcacattctgcttggaattctattcgggaatttctgggcgtgacacccttgatggctacaaggtaacatttacttgtcgctgtgctttgagaagtgcaagagcacaactccactataggaagtacaaatgttgtttatatatcttggttttctcttttctagtgcatagttgtatacaaattaagggcaaaagagacattttctaaccgaattattgactataaatagccatatggcatattaagtgggcccaaggataattttaagcaaaaacaaattcttagaggacctatatggacaaaatgaaacttgaaggattaaattgagctttcgatgaaacttaaaggactaaattagctatttactctaaacttatacttatcagctaaaatctaaattttcaaccttaaatttaattcaagagctgattttgaggttttatcatcgaagtttatttttcagcctttacttttagatcgcaaagaacacgtatataaaggttttgttcataaattacttttcgtttataaacatgccgtttcgcttacgcgtgctccgtaaatagggtactgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccccgaccctttgtgggttttgcgccgcgtatatgtggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctaacgcacgcctcgccccatcccgtcaggatgagagcctccaagcactcgtccctagccggagccggcgtgttagctcctggagatggcacgttggtcccggtcagatatatacc

SEQ ID NO: 2037 - DNA, 1501 bp, Oryza sativa
ttgccggttcggtccaggtaaaagaccggcatgcaatcgaatcggcagtgaaccggtcagaccgcccggttttgaagaaaaaccgctgtcaaaccggaaataaaaccgccttttgaaccggtcgaatcggcacgtgggaatgtgggatagaaaggggaagcgcgcgctagtgggggaaaaatgagggaaaaaacgcttgggtgggattcgaacccatgaccccatggggagttaactctctcccaacaaccaggctaccttgcttgttgtgttctaaacttctaatagaatgattaatatatttgattagtattgaaccgggttacaccaactattcacccggttgaaccagcgaaccattgaaccgagagcctcaccagttcgattactggtccggtctcaataactatgccgttgacccccatttagacccagaggagagatagagagaggagggtgaggtggagataggctcgtagagatcaaaagttcctcctcttatccacacagataccttgatatatattagtacgttgtgtatcagtgaataatcagaattaacagagaaaactaccgaaaggtcacaaaatcacacggttcaatccttccctttcacccggctagtagcccgaaggccttcctcctgcgttttccggtaggaataagttcaccttagatccctcaatttatcgtctagtccgattttcatcctcagtctagaaaaccggatacattgcattcccaacttataaaaccagtggaaacgaggtccctcgatgttattgactccgtttttttggctgacgtgacgcttatgtggatcttttgattaagccttcgtcctacgtggtgttgacgtgacacttacgtgacagtttgatctgaaaaaataaaattggaaaataaaaaattacaacaaagatatggggcccatatgtcactcaaataagataaaaatagtgggacccacataaccaacaaatatcttgatgaatgacacttataccccctcattcacatatataagacaaaaaaatgcgtaatgaattttttttatagataatgcatagaaatttatgtaaaacaaaagtaaattatatacttgcaagtgtatacaatagccattagactcaagtttcttttgcacatgttgaaataatgggaagtacaaatgttgtttatgtatcttggttttctctttactagtgtatagttgtatacaaattaagggcaaaagagatattttctaacagaattgttgactataaatagctatatggcatattaagtggcccaaggatgattttaagcaaaaacaaattcttagaggacctataaggatcaaattcctatccgggcggtacggcgattcaatatatgctactctcttcattccaaaatataaggaatataaggatttatattttgagacggagaaagtattaatgatgatgaggaagatacactagtctaccctataatctatctattcttttgctgc

SEQ ID NO: 2038 - DNA, 1501 bp, Oryza sativa
gatgaaaatgtgtgtatttttagaggcggtggtccaaaggcgaccgcttctatagaaatatagaaatgtgtgcatttccagaggatatggcccaaggcgaccgccacttaaaaaagactttctgcatgccatctttcacgcaggactgtctaaaaaatctttggttgaaaacatttaaatatgtaattatacggcaatataatgagttataatggaactttttatataatatgtatatgagtattaaaaacattgcatataacttgcacataaattatataaagagtaaaatacatggccggtccctaaacttatgtggtggtgtcacttaggtccgtgaacttgaaaattgcacgtttaggtccatgaacttggtttaatgtaccaccccggtccaaacgtccttcgactgtgtttgaccgccaacgtgacatgccacgtaggcaacacttttgctcttagccccctccatattacaacacgtcacatatatctcctcgtggttatatagtgacaccagaatcccaaaaaaatcctcaaattgttcttccctctcattcttctccttacatgtatagaaaatgatgtcccgattagcaattgacattgctctgcgctccaaaatgactttatccttgcacaacggacacttgatcaacaacaccttctttcggtgacttcaagacagggacgagcttggagaatccatgtagatgcctagcgtgcaagacgcactgcgctgcttcccgccgctaatccggctgcactgtgtcactgctaaccccgttgcaccgtgctgccttttgccgctaatctcaccgtcgaggccgccacaaccgctacctctcggccttcttccgctaacctcaccatcgaaaccctagccgatttagggatattttgggggatttgggttgaatgcactggtcagggcaagttatgtgcgaacatatatatggagggggctgagcacaaaagtgttgcctacgtggcatatcacgttggcggtcaaacatagtcaaaggacgattggaccgggggtggtacattaaaccaagttcatagaccaaaacgtgcaatttttaagttcacggacctaagtgacaccacaccacaagtttaaggaccggccatgtatttcactcttatataaaaattacaataaatttacactaccatataatatagttatatctagaagttttttaaaaaggttgcgtcggttttttaacgattcccttttaatgtgcctaccctcaatgtattgcatacaccgaccaggttaccagccaataacatttttacaatagtaaaaatttcaaatatattctaaatcacttaacatgtaaatacctaagagcaagtttaatagtatagccaactactagctctaatttatctatagccaatctaatagctcattcatacaatagttacatagtacactattaatacctggtctcacctgtcatacacaccctgcgtcttggagtccgtgctg

SEQ ID NO: 2039 - DNA, 1501 bp, Oryza sativa
gatggaggagtccgggaaatgctttcgccttgttgtcaagctaaagcttcaacactactcaagccttgttgccatgttactaggctcgagctccattgcttgcaccattgtatggcttggccagcgagaagcaagaggcgagagtgggggagatgagggggtacaatgaacattttatagtgctatagtggcacatctttagaatagctccattcgaaaatataacaacctagtattgaattagatacaatttagtactatgaatctagatagggttccaaattcattatactagactatgctaatctaatacgatgttgctatattttgagctgaaagatgtactccctccatacttataaaggaagtcgtttagaacaatgtttaagtcaaaccttaggaatataaatcattaataaccctcaagttgttgagtttgaaaatataaaaattatatgaatatatttgtcttgaaaaatactttcataaaagtatacatatatcactttttaataataatatttttatagaaaaaagaagtcaaagttgtgttttggagactgcgtctctgtccaaaacgacttcctttacgagtacggagggagtactttctctatatctataaaaattcaatcctaactatgaatctgaacacacatgtgttcaggttcatagctagaatttgattttttttataggatggaaggagtactttcttcatctcaaaataagctaatttatgttataatgagacattatctaatacaacaaatttagaatgttttttcttatctaggttggctaacttagtttattttagggtggacaagtatctgttaaaattattttaggctgatctttagatgttactaaaacttgtaagtctttatcacattagatgtttgaacactaattataaatattaaatgtagactattaataaaacccatccataatcttggactaattcacgagacaaatctattgagcctaattaatccatgattagtctatgtgatgctacagtaaacattctctaattatggattaattatgcttaaaaaatttgtctcgcaaattagcttttatttatgtaattagttttataagtagtctatatttaatactctaaattaatgtttaaatatagaaactaaaattaagtttctggatcccaacaccaccgacttggttcgattttcagagagctctgggcacagtcaaaactcaaatccccaatcgtaccattccacacgcttccatttattattcacccgaaacgaccctggccccccaccccccctccctacccgccgcgggccccaccccctgccatttcccaacggaatccacccggccgacgccgggtttcccccatcccccccccccccccgccccctcctcgtcggcgccaccgccgccgcaggctcgccgcctagggttccttccactctcggcgcaaggggcgtagggaggttgagagggagcgagcgagcgatgg

SEQ ID NO: 2040 - DNA, 1501 bp, Oryza sativa
atactatttaaatttaaattattataaaccacattaatttacttaatatgatattatctagctatcttacatgttattttttttattgttatcatactaaattcccgcagcaatgcgcggggtttcacctagtaacaagaatgcttgttcacaaagaataacattatccctaactggttgataaagattttagtagtataatatgtgaaggaaaaatcaatagattgatattacctctttaaaatattcattccttagtgaattaagtctttgtcatgatcagggtccctcttaccgttttcggcgcggttaccggaccacgcgtgtcggtgatatgggaccgggagtatcatgaccagaggcttgaggcagacgcaatcgcccacgtggcctggcaccttcggggacgtcgggcccgagggtgaggtgtccgccctcctcctgatttcccccgaggggggggggtcgggttgcgtttgctccggccccgagggccggggcacccccgaccccttaaagaagtctgcgccacgtatatgggataagtgagcacagctgtgctcacctaacagcatttattgcagtctggtcaagcgtgtcacgctgcatgcaacgcagtacagcacgctcttttatccggtctgtgaccggtcacagaccggtcagatcaagggtcaggtggcgactggcggtctgacgcacgccttgccccatcccgtcaagacgaaagcctctaggcactcgtctcaagccggagctagcgtgttatttcttagagatggcacgttagccctggttaaatgaataccaggcttcatcctaaccattacaggcaaggcgttacacgaagaagggcaaacatgcacgttgttaaaccgacgcgtggtggacaagaatgaccggtctgacactggtcgcatcagcaacgggcagccacgatcccacgttgcacctgtctccgtcgggagtggaggcaggtatgggctgtcccatcaaagtgtcatttggacggcaaccataccgatctccgtccataaagagaagaaaagtccagtttggaaagggaagggtgcatgtggtatccccttgaagtataaaaggaggaccttgcccatttagaaaggggttggttggttggttgattttttcccggattgagagctgagaacgggggagaagtcagctgacactttgtgactcgttcatacacagatccaccaaaacacaggagtagggtattacgcttcgcagcggcccgaacctgtatacatcgccgtgtctcgtgtttcttccgggcagacgatctttacacatacagagagagagagagcttgagatctcaccctaagcccccggccgaatcagcaaaggggggcctgcgcggtctcccggtgaggggccacgagctccgtcatctggcgcgccaggtagggggctcagcgtgtgttttctgagctctcagactcttccgtgggagccaagtttttcttgttcagcctaa

SEQ ID NO: 2041 - DNA, 1501 bp, Oryza sativa
accgggtcttttttacacgtgacattgacatggcgcttaagtggcattagaattaaaaaaataattcatttatcattcacacaaaggatggcatgcggaacccactgacatgtggggctcacatgtcatcctctctcctccctctctctctcccttccctcattcagcaagtctgccacaatcctcttcctggtggtaaccacgatcttactcccagctcgaccaaatctgaggggagctaacacatcagtccacatatccctgtacgaattctcattctcatctttattccagacattctcaagaatcagcaagaaccggcgcgacgagacattctcaaaaaaatgatagccgcgacggggatggtgtcagaagcggcgctccgatcctcgccttcggtcgtgctaccgactagccaagacaccaattattgctcatgccccttgtcacgcccaaacacctcagcatcctccagaatcgagccggtgatcaccggaccatccgaggttaggagggtgctgctcgactcgccggaccctggcttggtcagccccgccgcctgcatcagccgcccggagctcgcgcggatgtccttcagtttctggacgacggccttaagcctattgaccgactcgtccttgccaacgagctgcatgcttgccgatcttgccaatggatgaagatcctagtaggctgaccttgccgtcgttgcgggagaccgcagaagggcagcggcgggcaagcggagacggcggcgagcgggggagatgcgggcatggcggggagtgaagacggcggcatccggcggtggccgccatggaaagggcgaggtcggggatctccccgacaacgtccgccgccgccgccgccctcctacagctggatcaacggccgctgccaccgccgtcgccatggcgtgcaggccggcaattcggatcctttgcattagaggtactaatgcagaggatgaacagtaccgcacattaggggtactgtagaccgtccaatcgagaatggaaggatatcctgtagctatagtaaatagccactgtttatgtccttagatcgctgttcccctcacatggacagtgcttccctgcagtactgtaggcgatccggatccgcaggtcggccgtgtgctccgcctccgccctcgcgccgctgcctcctcccattgggagagaaagagaaagaagggagagagagaggaggaaaaatgaaggacacagggaggactgccatgtgggcaccacatgtcggtgggcccacatttctctttttgagtgactaatgaatcctatgcatattttttaattctaatgccacttaagcatcacgtcaacgccacgtgtaaagaagacccggtcaataccgccacgtaagtgccacatcagcaaaaccgccctccaaaaccgcctagagagttaaattgcaccggtttcaatagttcggggtcgagttatccggttttgcggtttagggttatggattagattcgggt

SEQ ID NO: 2042 - DNA, 1501 bp, Oryza sativa
aatccacggattttcacgtcatgactcggcttgacgtgtcgtagaaaagcaagtagccgagtcatagaagtggaatggataggcaagtgatatgtattggtagacacctggagcagaagagaaaaaagggatgataattagtttgtaagcttagcatggcaagtgatatgtattgatagatcttgtaatttcatattttatatcaattgtacaaatgcagatacccattttatttaaacaacccgcacaagatagtatgatatttctattgatatagtaggaaaaatacaagtctatagtcctggaagactatagtcaggaaaaaaaagaaaaagatagtcacaacacgcatttacgtctgatcttgctactaaaaataaaccaagcacacaacaccccagaggaatggttcttctgaatgacgctaagagcgctgccgtcatccgtcctagagaaccaggacgtggttttcacctaaagaaaccattggataggagaaacgcaacaacaccccaacaagaatgcggcgcccgtaggcgtcgccgttgttggtccgagggctaaggccttcgccgtagtttcctccttcccgtgtcaatgcagatacccaattcacttctttgatgtattgagtagctttgaaggaaaaaaatgcacacagagagtatagaaattgtaagtttataacatatggtacatttctcttagttccacactattatctcaaaaggaaatataatagtggctggtgatggctataaatattaaatattatgacaaaagatttaacttttcaaacttcaaaactgaaatttatatttcagactaggtagaatatatagaagcttcctggtggcattgctcctagctataacctgtgttgttgcgcaatgatcaatcgaaaccacaatatcgactgaacggaaaaacagtcctagaggctagagtcgcttcatttctcaattaacttccgtttttgatcgaccccttctctctacgtacagaggagtgcccaaaatgaactaaaacaatccatacccatgaagcgcccataacactccaattacatatcaacccccacacagatctgtaactagaaagtggaaactgcagggttgtgcaaaatgttcaccgaccaataatctcacacggaaattctacagcttgaaactagagaatactaccaattactaccaatcaaccagagccatcatccccaaacgtaatactatgagtgtagagtcgtagagatgatccatgaacaacacgaaacaggaagaaagaaagaacaaaagagtggaaagattacagattgaggaataagaataagtggctatataaaaggattgattgatttcggcgtgcttttctatggaagggagatgatccagataatgtcagtttgggtagtagtctcattaattggcagaacatttgcaaacctaggaatttggggggcctcggtattctcaatttggaaaaattctcgcgagctttaagg

SEQ ID NO: 2043 - DNA, 1501 bp, Oryza sativa
ttgccagatctaccccgttccattcattcgcatctcctcccccctcccatcccagcccaagggcacggacaggccagagagagagagagagacagagaggcagagcggaagggagcaatcatagcgccccgcttcctttattaggccgcgtcacccctctctccgcttttccgccggccacctcgatcgccgccccctcttccccttcccctcccgtcagcctccgatcggatcccgtcgtcgtcgtcctcctccccttctccaggtacgtaccccctctcgactcctcgatcgaagactcgccgtcgtgcgtctccccgcgcgcgcaattgctcgttggttcttcgggaatgaagcggattgggtttggtttctcgctcgacgatccgctcttgcgcggcgttgtttgttccggttggtggtgccggccattgtgtgggggagagaggggcgcggggtgggtcaggaatggtgttcgtctccggcgatccggggggtgtctaggtgggtgggttgcctaaccgatcggtgagatcggaggcgaaatgtgcgggggttgatccgtggattagctctcaatccgctcccttccgctttgggggcggtggtgactggcagctgatcagtgaccccagtggggttgggtggcgccgaatcagctttcccaatctctggttggtggctgccgtcggcacgtgctcgtgcagccaatctgatggatagaagatgattaacacgagcacacatcttccaaattggtgtgagggagctgggtgatgagatctgcatatgatgtgtttggtttgattgatctcgtaatgcagcccatgtggttgacgagaatacgggggcgattgctttgtgggcatgagtccggtggcgctgtgcagccactggcttcgtgatgagatcaatcagaatagatgggcgcatttgggtctcagtcctctgatgggtacatctccattagcaaatataatgggtactctacgttacagtgtctttcaaatgtagatgggggctcaggtagatgtaatcagcacgtcgtgtatggtttattccggtttacctgttttgatctgacttactgattcgtttataagagtgaaattgtgcgattctggtgagtcattactgggctgcatgcaattgatgatgctttccttcatgatataccccttttacgatggtttcattcaggatatgttcgttttgatcattcacttgtgtgttccattcattcatatttcccaacagctaactactctatttgttgtcttgattcgagttgattgtttgtttgaatatcattgctcttttaacatctggtctttcgatccatgtatagaagtccaaattagcttggctattttttctttctaatcttgttgacatataattttttcttccccttttcagtgtgcaagttcctattattctgtggtggagccatcttccactaccctgttttcaattaaacctttgtaaagttgctgctcaa

SEQ ID NO: 2044 - DNA, 1168 bp, Oryza sativa
acgctccccatctcgccgttctcctgcatcacctgcggctggtgacgccgcggatttgtcgaccctctcaagcgcctccccctgcttaggactttggcgcggaggaggtggaggagtacgagctcgacggcgtggattcggctccccgtcgtcgccgctcacactcggcgagatgtcgtgcgtttttccttgctcggccattaggctgaacaagaaaaacttggggcacacggaagagtctgagagctcagaaagcacacgctgagacccctacctggcgcgccagatgacggagctcgtggctcctcaccgggagaccgcgcaggcccccctttgccggttcggccgggggcttagggtgcgatctcaagctctctctgtatgtggaaagatgctcgccggcaagacacacgagacacggccgatgtatacaggttcgggccgctgccaagcgtaataccctactcctgtgtttttgtggatttgtgtatgaatgagctacaaagtgagagcccacttctcccccgctctaggctctaaatctggcaagaatcaaccaaccctttctctatgggcaaggtcctccttttatacttcaaggggataccacatgcacccttccctttccaaactggactgttcttcttctctttaatgggcggagattggtatggttgtcgtccaaatgacacttcgatgggacagctcacacctacctccactcccggcggagacgggcgcaacgtgagatcgtggctgcccgttgctgatgcgaccagtgtcagaccggtcattcttgtccaccacgcgtcagtttaacaacgtgcatgtttgcccttcttcgtgtaacaccttgcctgtaatgattaggatgaagcctggtataaatctaaccagggctaacgtgccatctctaagagataacacgctagctccggcttgagacgagttgccttgaggctttcgtcttgaccggatggggcgaggcgtgcgttaaaccgccagtcgccacctaacccttgatctgaccggtctgtgactggtcacagaccggataaaagagcgtgctgtactgcgttgcacgcagcgtgacacgcttgaccagactgcaataaatgctgttaggtgagcacagctgtgctcacttattccatatatgtggcgcaga

SEQ ID NO: 2045 - DNA, 1501 bp, Oryza sativa
caatggataagtatgaagcaattgaagaaaagtctgacagaccaaattgagttcggaggatgtgtttacctgtgattatttccggtcggggacgagcaggcccttgtactttagcaggagagctagaccctagatcgacattggcatcttttttaggaggattgtcaacttgagcttctacttcgaggatgtccttgtttcgctctgtacccgactggtttccagtcgggggctcctgattagcgtcgaccctagcttcggccgactggtttccagtcgggggctcattgctgggacctacattgtcggttgccggctgttcgtcactcaggcgatcccctgcagtcggctcggtctcttttgaaaaacctgtctccatgccagtcggttcggagtcttttctagaaggatctatgtcagatggcttcctacaagtttgagttatgctatcagtataattttaatgaatgagcgtcaatccaaggaagaccgccaaataatttgtacctagaagacttcctgatttttggcatgggacgactggatgttttcttctttgggttagcctgccttggatgttttccagtcacccctttgctgccagccttttcagcatcatcgtcgtcactcaggaccaatttcctcttacggaaatctgattggttggccgactgagtggtggtgggatgagagtcagaacggatttttggccctccactagtttggctagtcttcccacaaggagtgcggtgttgggtaatcggaggatcagacttcatcaaggtaaactcctgtatattacaagtttttagtcaacctcgcggaagataaaagcatgctttttagaaaggctgagatattaaatacataccggtggaggggggttgaaagcattgtatggtacaactggcagcagatgtgaatagctgacaacgatagcatttgagaagatcttgtacattctttccttcatgaccttaaagtcaagagagtctggatcttcacgatttggatcatgtttgccatcaaattcaaaagccgtgcgggatctctctttgattggagctagccgacttttgatgaagtgccgagtgatctgctttccctgcaaaccttgttccttcagttttagcatgcgctccatcagttccactgcctgagcagcttcatctcccataggcaatgaattccatgtgtcctggcagaccggagggagacaggagtactcggggagtgctggttcaggattctgaacgtaaaaccagtttgcgtgccagcctttgtttgaggtcttgaagggcatggagaaatacttttggcttagtgttcctctgagttggaaaccagcgcccccaacaacgcatggtttgctcttgttcggctggggcttgaggaagaagatgcggcggaacaaagcaaaatgaggtctaatgcccagaaaagcttcgcaggcatgaataaaattggcgatatgcactatggagtttggattcagatgatg

SEQ ID NO: 2046 - DNA, 1501 bp, Oryza sativa
ttttcggtcgacccagcaaagattggttctccagtagtgcttgctttaacccttccagagttgattcgaagttctcgccaaaaccaggagttcaatcatataagccctcaagtctagactaattagaaggtttgagcctatagcaaaatagtagagtcggttcattgtatagcttctgctgcaatagttagccacaattatgtaaatgctcttgtattttatgcaataaaatctcttttggagcccttgtttaaatgtatggaatggtgatccagatattattgaacatgtattaatctattcatctagggcttgatacagacatgcagacaagttagttaccgaaagctaattttgggacccgacatttgtatataactaagatgtaacttttagagaaaaccgtcttacatcagcggtaacacactcttagcattaacgagggtacagccgtacagggttcatcaatgaaaaggaaaaagatgtgcatgcaaattaaagaccgtgtctacccctgtgtctgccgtgccatcgcgcgcgctgagcccgctgctcttcgcccgcgaacgtcaaagaaacgaaagcatgcacgaatcatgaggttaatctaacggctgaaaaattgacaaatttgaagcgaaaattaacaatctatcatttatagcaaaaccgtaaaccgaattaatcgtgcgtgcatcttcggtgcaattgcaaagaatcatatgcgcataacacaaatcgtgacaaactaaactgctttacatgactagtgcacatggaaaagttgcacacgtgcacgctacaccaaatgaaaggcttggccaacaacaatatataattaattagcatcactgcacaagtaaagcaagccttgtagctagctaggcgattgcacgtacgttaattggtggactggccgccatatccgatccctttgcgcgtggtcgggaagacgaggaagacggtggtggacaggaagccggcgccgaggggaaggttggtgagcagctgcttcacgttgtcgccggcctcggggaagtagcagctctgcacggcggtgctgctgaacgccacggtcatgaagaccaacgccgtgaacaccgcgtgcacgtagtccacccaccgtatcctcagcctgcggaggtccttgaacacctccctccgccgccgctggtcgtcgtcgtcgccgtcgctgctgctgccagcgtcgtagttgaacacgaggaaacccttggccgtcgccacgccgtagtagagcttcccgtctccaccgacgaagctgtcggtgaaggagaagaagatgcaggagaggacgcacaggtagaggagcgccgcggtgaggtaccggttggacgtgaggcacgcgccgcggttggtgaacgacggtgacagcgactggaacgccagcaccgtgcccgtcggcaggagcttcgcgaggttcgctacactggacagcgtcttgtccatggccgtcgtcggcggcggtggtggagaggaggag

SEQ ID NO: 2047 - DNA, 1501 bp, Oryza sativa
tttggagtgtgagccctttctccctgataaaagttgtgtttcttggatgaatttttcatgggttggatggctatttgaataagctttacatagagtccaagaacgtcaaattctgagatccgagtcaagagatatcgccgttttactaactgttggttgtgctgaaaagtgacctacggtctgaccgtgggccataggacggtctgaccaaggatgttagccggtctgaccggcgtggtaaggccggtctgaccgtccccactggtctgttgcactggtctggtttttagtggctatacagaaccaccagagccgcaaccggtcagaccgagccgacggcggtctgaccgagccatggacggtctgaccggccactacactacggtcagaccagccaggttgagtgggctcaatgattgccctgtaacggctagttttctagccgttacaaagtagtctggtctgaccggccactctatggcggtctgaccggcagagcacagagttggggatttcgactccaacggctagttttggtggttgggggtatatatatacccattccccagcagcaagggtaggtttttggcactccattgcattatcttgaacccaagagctctcacacccttgtgcacttagtttatctagtgaggtgttggagagtgagttaagccaatccaagtgcattgcttcattgttagagctactgtggcacttgatcatcctcggcaagcatcctagacttgttactcttggaggttgccacctcctagacggcttgcggaggtgttgcccggtgacctctccgaggagattgtggaggaggcccggcgccggttgtaagtggtttggagttcaccaccttcggagtgaaggaagaactaccctagtaatcgaggcttgagtagtcctctccgtgggccggcgtgcccaccccttgacgaagggggcgtgcggtggcttcgtggttgagcagtggagttgggctcgcgtcaacggggattaggaaaccggcgagtttccgaacctcggtgaaaaatcccttgtctcttgtctcatttatttgttgcatttacatttgagcaagtttacatactagagcttatttgtgctattatcaccctaggcttgcaaaccttaacatatgctagtttctttgtgcacttacttgagactagttgatttaggttttgaattgtgcaaaaccgttctgatttacgcttccgcatacaaaactcggttttagcaaaaagttttaaaaccgcctattcacccccctctagtcggcctccttgatcctacacccgtggtccacctccactggttgttggaacgctgagagacgccttcctcagcgcggcctcaccgctggtggagtttacaccgctgcattgacatgaagctcatctgtgtcgtcccttcggaccacagccttgctgctttcgtcgtcttcctcaccgcccgtgtatcgacaccctcatcgtccgcactggtcatc

SEQ ID NO: 2048 - DNA, 608 bp, Oryza sativa
aaaaagtttccacccaagcacgagaaatataaaacattgtcaaataatatattggatgaatggaagatctacaagatattcaagtccaacaacttcaaatggacctagcgccttcatgtcaactccggtttggatgatcttgtacttgttggaaagcggtgcgtcgtcaccttttaaatgcttctggtctcatatcaaaattcatctcgagtcaacaggaatttcaaaacaagacagtttgaaactgaatttgggctttgggccttgtaatagattaggcccatctcggaagtgcctctctccacctccacgaaccagcactaatcctagctttattttcctttataaatagctttgtacgccctaaaaagaacaattgggttttgtttagttgaattttgccaagagtcattcaccttgtctctagttctcgttcgattagttgacgactatagattcagagcccccaactgttatgtgttgatttgtcggatcgattagatctatcacttcaatcgcaactatatatttgtgcttaattacctattcgcaatatttagattgcatcttatcttgttcttgtagtgttctctgatttgcattgcagg

SEQ ID NO: 2049 - DNA, 1501 bp, Oryza sativa
gtttctaggaatatcttgatttggagcatagtcttctctacttcctttgtcatcgtcgtcttcccttcggtaccgagttgtagcagcatctttcaccatgctcgtgtcttgattaggcaacaccacattagtgttgacagacaaatttcagcatcccgtcattcatattgagggttgagtctaaaaagcacattgacttctcactaacaatccaatttggcataggtccttccagtagggtgaataatatcaataaaagaaaggcaagcgggtggttgaagtgatggtgaggaaaaagataaggaatgagaaaggaggtttggaactagttgttttcttatatgtaatcatcataaaacttcatgcgttgactaactaagcctaaactctacagattgttgcctgctttatggggttttagaatttcagcagattgttcttgaaatgttggtttatattatttggcattatattaggtagctcaaattaaatatatgactggaaaaacttatcttctttgtagtgttcatatgatttgcattcaactatagacttaggtaactcaatttgtttgatatttttcagtgacattttaaatgacatgtaaaaattagaaagaatctagaaaacgttccattgccttaagtagagactttcttttgcattattaggatatccgcggtataataaaatagcaggtagtgtggaggtggtgaagaactaataccggatcatagaattccctagaaaacttacgatttttttcaaagcaagcctcatcttacttttcattctacataaactaatttgtgggtactgtaaacaactgccactccctccgtcccaaaatgctagacgttctaggattgttgagccaaattagttgtgagtgaaaatggcaattttgcccctaatttatgggattagagctaatcatgtggatgcttgagtagtactagtacacagccacatctgctatttcatggcttgagtagtactagtacactgccatatatgctacttcatggattaagggcatgttcactttgatgccaaaaaaaaccttaccaaattttggcaggatttcttatataattaccaaaatttagcagcaaactaaatgtagccactttttttggtaaatttaccaaaacttgataaggttgaaaatgacatcaaagtgaacaggccctaaactaatgcaaccagtccaatcaattcaaaacttttcactttctttatggatgcttttctaggagtttgcaactgtgtgctgttggagaagtgcagcgtcaacaaatataagacatttgcttgtgagcagaacgaccttctttgtgggacggagggagtactaccctgcaactatggaagatgcccttactcatggagtaatttttttcttaagcccctagcccctacctttgttgctattatcaaacaagtccccaacggcttaactcctccccgtccggatcccgcagcgccgcccccaccccca

SEQ ID NO: 2050 - DNA, 1501 bp, Oryza sativa
agacggagccgttggtcgagttctggggaacgccaccagaaccgttgttgctgctagcgggacgagaggcgccgctgacggtgtctgcgacgaacacggaagcagtttctgccggttgagagcccttcatgatatcttcaagcgggagctgagagcgtgcatccatgaacgatgggaatggtttctacatggacaaaagtgaatgcatgttgccaaaacggggactaagcccggtgattagctggagaacgagtgcaccatcggagacgggtttgccgaggtcgctaagcgtgtcagccatggacttgaggcaacgacagtagtcggtgacggagagctcgccttgagagaagttgcggaactcggcgttgacattgatggtgcaacattcttggttgccgaggaattgatgggcgagatcacaccaaacagagcgagccgtagccgtggccaacatgacttcctgaagcaagtcggcggagatcgtgccttatagctagccgaggacgacgcagtccatctgtgcccaatccacgtggttgaggtgagagttgtcagcgaggacgtgatccgtgagcgcgtacttgccgaagacgacgaggaagagaccgcaccagccctttgacgttgaggacaatgacagcttgagcgtggagggcaacagcttcatcatcgaattagggtgtgatgtgcactagggttcccgatctttcaaaaggttatgataaacaacgatttggacggagtcgcgacacaaatcgatccagcttcttgaacgcgcaccacgtctcctctggttatcacctgtgccgattatattacgattatactataattatatctgtcaaatatttaggagaaaatttgtcgaaaaatatataggtgataccgaaactaaatactacttccgatcagagccataccaatgccacgacacgaaaaattcctgcatacggagttctactatccaaagctacgacgtacatcgacttgggcagcgacacgtgtcgtttcgtttgcccacggaaaataaaatcgaaaacaaaaggacagaaacaagaaaactacatcgattttttaattattttttccacgcacctaaacgaattaacgacgtagcagatgcttcgccgcgcgtgcacacgtgtcgtcgtcggcggccgccggcgagcccccatggcctcctccctcctctcctccgccgcctccggcctccctcccaagccgcagccaccttcctccacccctccctcctccgcctccgcgcggccggggggcttccgtcgcttcatgctcgcccgcgccgccgcgggccgcgacccggagccgccgccgctgcccgaggggaccgagaagaggtcgctcgcggtgaggacgggggaggtgttcctggggctggcggcgctgctggtgcgcgcggggaggggcgggggggcggcggtggaggaggtggaggcgaaggacggggtggtgtgggagcagcggcccgaggacgtggagg

SEQ ID NO: 2051 - DNA, 1501 bp, Oryza sativa
aatcgctgaacaccaagataattcctatgatctcctggcaacatttatctgctagatatgttttatggtccaaatttggagctctcacaccaaactgattttctcagtataaacctcacctccaaggcctgcagagccacgcgaagctccacaccaggtgttccaccggacttgcctacaggcgcagtcctcaccatcaccttccctccctccggcgcaaactccacacattcctccaagttcttcgcaagcatcacttgcaactacattatcaccaaaaaatcattatcactgacagttagcacaactgcacaaacacaaatcgtaacaaaacccgaaaccctccggagtagaacccccatcacctcgtcgactagctgctcccagtcgttccggagaagcccgaacacgacgggttcgtcctgactagatccagatccctcgggatccaccaggagaggcttgagctcggcagcggcggcggcggcggcgagggggtcgggtgaggcgcgagcggcacgaagtcgagcggcgaggtcggctaccgaggaggcggcggcgaggtgctcctgccgctcgcggagctcgcggcgggcggcgaggaggcggtcggagagctccctgaggtcggagaggcccggggacgaggagagcggggcgagcgccgacgcgagggaggactcgagggaggaggacgaggccgaggagtcggcggcgcggaggagcgcggcggcgagcggggcgcggtgggaggaggcgaaggagagcgcggaggcgtggaggcggtcggagcggatgcggaggcggtcgatgaggaggcggaggtccggggccgagagcggggtggaggggtcggcgtcggcggtggtggagaggaggagctcgcgcacgtcgtcggccatcgccgccggcgacgaggcggtggtgggggtgggggcggcgctgcgggatccggacggggaggagttaagccgttggggacttgtttgataatagcaacaaaggtaggggctaggggcttaagaaaaaaattactccatgagtaagggcatcttccatagttgcagggtagtactccctccgtcccacaaagaaggtcgttctgctcacaagcaaatgtcttatatttgttgacgctgcacttctccaacagcacacagttgcaaactcctagaaaagcatccataaagaaagtgaaaagttttgaattgattggactggttgcattagtttagggcctgttcactttgatgtcattttcaaccttatcaagttttggtaaatttaccaaaaaaagtggctacatttagtttgctgctaaattttggtaattatataagaaatcctgccaaaatttggtaaggttttttttggcatcaaagtgaacatgcccttaatccatgaagtagcatatatggcagtgtactagtactactcaagccatgaaatagcagatgtggctgtgtactagtactactcaagcatccacatgattagctct

SEQ ID NO: 2052 - DNA, 1501 bp, Oryza sativa
agaaatgaattaaggggaagttggttggaattaattcaactcttgaaacccttgtctagcctactctttagctcatgttttcaagtgttcccgaaacataagtcaaactagttcactgcaacacttgaagttcttagacaagtctagccacatttagtagctagtaactttactagcaggtagtagtactactagttgagctcattaaacttctgtgtatgtcgttgtatagcctataaataggcaaccatgcatgtatgaatgaccgatgatatattgtccaacactttgagtgaaaaaaaacaagctagctaaatacactatcctgactcctccgcttctagcatgagctattccagtgcctctgtcccttgcgcttgataaatatttttgaaccaataggctcctccgatgtcgacgttagtgaggatggatgccattggtgtcttcctctcatcaccaaggtagcatattttggtagtccctgatcttgccgagcgtggcaagccacggtactaggggagacagctctcattggcggcacacataaacgcgagagtgaaggacaacatcgagcgggtcgttgagaaggtcgagccatgagttgcaatgaccgaggaggaggcggtggcggcaacgatagggcctcgctcgttttctcgttgacgacgtagcgatctcgatagaaaacaagatcttcatgggcaagaatggaaaatgaatctatttatagcttctaattgagggatcacatcaggtgcaactgaattttggcaatttaaccttttttatgaaacttattatacaaccctagaaaaaatttaatcgaacctagacaaagcctcagctccaaagacttggtgatgagctttatgggaccgacctctataataataaaatacatgggctatgattcactaaatgtcaagcatcatggtggtttggtgtctacttgccttccccgacgcacgtgttcaactcctctatgcccctctttttttcatttactttttttatcaaaaagcaacccgctcgtttggattcttaatgtttattatagtagccactattaaagaaaactattttattgagtctgctcttttgttttattggttctattattattattattttaagaaagaggtgagggggtcaatgctaggtcccatggtactgagaagttgggccttagcaccaacgttggcgtagtttttgttaaggctcatttgtataataaagtttgtaaaagggttaaagtgtcaaaattttcatgtgcatggtaacaacgcaagcttctaaaatgcaatacacatactatactagactagataaagtactagatgacatcaaatgattatatttccaaaaacactcagatgattcaagtatgcaaactacaaaaattagcaaacagtgaaacctcaaatcgtggcttcaacagttcgatataacattataacctcatcacatgtatgaaagacatttgcaacattgctaaatg

SEQ ID NO: 2053 - DNA, 1501 bp, Oryza sativa
taacgtcatcaatatcctcatgtactcatggaataggagtacgaggcagtgtgctagcggttttttcccaattctcaacattgggatcaaaaggcaggtgaatgcttggggcaacagaggtagtcgagcttcatgtgcagctgaggcaaatcttaagcttaaaagagatggcgagctagcaatggttgtagtggtggggaaccagaggtggagaagagagatataataaggtggtttaaatccaaaaaagataaaagtacccgactagtaaagatattgatattggatagtctattggatatagccctggtttgaagtgagaaaaagttatgtataaacataatttattttataatgtgagacggttatatggttttttgtgttcagctcacccttcttcttcgtcttcgatggccccctcaccatgaaaaagtaccacataccttccccatagcccttgtatttctatatgcatgcatattgtgttatcacaaatcaattggttcatagatatacataacttcaaagcgatcaatcaactaaagaagattaaattaccaatcatttcagaatcatgacgcatgatattgacctcattgatgaggtagagaggcggtttgcgtctcttgatcttaccgcggaggtggaagtccacgagctccttgtccgtcggcacaaagtggaagctaggacttaactgtagccgtgacaccagctcatgcttccagctcaccactagcaccgccgacccatcaccgtcgttgccgccattttccattatcggataatgtacttatgtggcttctaagttcttatggcaatcaaattgaaaaaaaaagaaaaaatatagtggggcattgctataataaactagtatttatatacgctaaaactaattgtagttattaactttttttggtaggttcttgtaaatgtttggtgtttccaagaagggaaaaagaaccaaaaagaatacttcctccatattttaatgaatgacactgttgactttttgacaaacgtttgacttttcgtcttattcaaaaaatttatgtaattataatttattttcttgtgacttgatttatcatcaaatgttctttaagtatgacataagtattttttatatttacataaaaattttgaataagacgagtggttaaacggtggttataaagtcaacggcgtcgtacacgggagtacagaggagttgaacccgaccgaggcaggaggttacgggttacctggttcgagcgacggaccgagaaaacaccgacccgagcctagggtttggccttccccatccccctccgccgcgccgcacgtgtccaccacactcccaaagccaaaggagataccccctccctcccttctcttcctctcctcctcaccgcagctatcggggagcgccgccgccgccgccaccgccgccaccgctaggctttccttccccttcccccaccagaagcttctcgccggagaaggaaaggaggaggagaga

SEQ ID NO: 2054 - DNA, 1501 bp, Oryza sativa
acaataaatggaaacagaaaacttaccccaaggcgaaaggctgtcccattgctccgacagttatcagctagatccttggtcacttgcaaagcatctcgcatcgtgttcccagatgcaatcactgcacagattatggcaccagctgatgaaccagctaacggagttctttcctaatgtaagtcccagataaagaaaccactataagaaaacttgctaaaaaaaaaagcagcagcatacatacaaaatgtatcacacgtaagtcctaaaatcacaagcataggaatgcagaatttccatgcataaaaatagcaggcaatgttaccacctagacagtacagtagcataaaaattgagagctctagccagccatggcaccaacaagctactcctactactcctactaagctaaagagaccaacacggaaattcgactgttgttagccacaatttcatctcgaaagtaacccgctcattggctaaagagaccaatgtgaattggattgttgttagccataatttcatctcaaagaaacaagccccaatagctaagcagacaaacgtaaattggattgttgttggccacaatttcatctcgagagagaaacaatctccactatcgtaggcacacggatctcacaattcatctgagcagaagctcctgtctcctactgcaaaaatcaagtacgcgttcgcgtagaagaggtaagagagatggggggtggacgcgcaccgtgaggtagcccctgtcgatgaggcactgcgcgacgccgatgtggtaggggaagagcagcccggcggcggagaagctgaacccggggccggtcagctcccgccgccgccgctccgcctccacgtcctcgggccgctgctcccacaccaccccgtccttcgcctccacctcctccaccgccgcccccccgcccctccccgcgcgcaccagcagcgccgccagccccaggaacacctcccccgtcctcaccgcgagcgacctcttctcggtcccctcgggcagcggcggcggctccgggtcgcggcccgcggcggcgcgggcgagcatgaagcgacggaagccccccggccgcgcggaggcggaggagggaggggtggaggaaggtggctgcggcttgggagggaggccggaggcggcggaggagaggagggaggaggccatgggggctcgccggcggccgccgacgacgacacgtgtgcacgcgcggcgaagcatctgctacgtcgttaattcgtttaggtgcgtggaaaaaataattaaaaaatcgatgtagttttcttgtttctgtccttttgttttcgattttattttccgtgggcaaacgaaacgacacgtgtcgctgcccaagtcgatgtacgtcgtagctttggatagtagaactccgtatgcaggaatttttcgtgtcgtggcattggtatggctctgatcggaagtagtatttagtttcggtatcacctatatatttttcgacaaattttctcctaaatattt

SEQ ID NO: 2055 - DNA, 1238 bp, Oryza sativa
ttatttcgggatgaatttatcaggacgtgacacgtaccctcgaagttgtggacgatgtggtcggcggcgtcccggacctgcgcgcgtgcgctgtcctcggttcctggagggaactcttccagcgctgcccacggggagaagtcagggtccttggcctggtagcttgccagtacgagctccaccgcccctcgggcaaggtccctcgaggatgacttgatcgtctcctcgagctcctcggggagccgctggagggtcccggccatctctgagaggcgctgggcgaggcccccctggttggcggcgtatttcgcggtccgcccgcccagaggcccgcttgccgcccggcgcggtctagatgggagacggcgtcccgaagcatgccgggccctacctcgcccgccaggcggagggcctcgacctccccggcggacgagtccagcgcgccctgcagctcggcgatggtgtgttcggcggctgcgaggcgagcggctaggtcgccgtcgcccgcggccgccccgccgctatgcgctctcgcgtccagctccttcgcccgcgcctcgagctcagcggcccgctgatcctgtgcggccctctcggcgcgggcgccttccagattgcggcgcgcctgctcctcccgcgctgcctcgcggaggaacaggctgtccgccagccgctgcgccgcggcctcggcctcctcgagagctcgttcccgctcggtgagcgcgtcctcgcggaggcggagtgcggactcctcttcagcgcaggcggcctcgtgcgccgccagtgttgcctcccggatggcgacggcggcctcgcggtccgccaggtccctctccttcgcgcgggcgcgctcctccagcaccgtggcgcgagcctcaagggcctcttcgcgctgccgggacgccgcctcgatctccgccgcccgccgttcccgggcaacggcagcatcaaggactccccgggcggcgtcgagcttcttctctagctccgccgcccggctcccgtattggaggcagaggtcgtcccgcgccgcgttgaacacggcggtggcgatgagggcagtctcccgctcctcctccacctccctggcgacctccgccaggtccctacgacgggcctcgagctctgaggtgtgccggcggtgtgccttgcggcccgcctccaccatggcctccaccgagcgccgcccctcttcgacgcgcgcccacgccgcgtcgagctccgcccgctctgcctgc

SEQ ID NO: 2056 - DNA, 908 bp, Oryza sativa
  unsure (1)..(908): unsure at all n locations
cggtgatggccgtgtgggacggggagctcaacggaaggccgttggcatcgaagaggtcgggaaggngctcctctaactttaagttagaggagctccttcccgacctcttcgatgccaacggccttccgttgagcaccccgtcccacacggccatcaccgacaccgtcatcgtcaccatcctgttccactgctcctacgtcaccggtgccaaccggctagagagccagcccttacacatcattcaaccaaatgacaacatgacttctatcaccgtgcagtttgataacttggtgacctaccaggagatcgccgccgtgagcaacatctccaaccctgacctcgtgaaaatcgggcaggagctatggatcccgttgtgccggttttccagccggcaccaatttgtcattggtgttgtgctaaaaaaaaagagaagccgtctccaagtcgagccgatgctttcgagccaacccattcaacccattccgtggtcaacaacaatcacaaatcaacgtagaccaatcacaggtcaacaacaacaatccatcatagatccatcaggaataaacaatccatcaagaactacacgagtaggaacaatccgtgcacgaacttatcggtgatgtcgccgccggaaacccttggccgcccgccgctgcctcccttggccaccgccgccaactcaccccgaccggatttgcgcgccaccggttggaggccgacggagagggagaggaaaaggtcgcccgtgcggaggccacctgccgcctccattggccaaagccaccgcacgtcgccgccaacccaccaccccgaccaccccctccctagatctggccgacagagagggagaggaagaggggaccggatctacggaggtggcgccggagggcgatggctgcgcagggagg

SEQ ID NO: 2057 - DNA, 995 bp, Oryza sativa
cctcctttttccctctcgccggcgtcacctcttgtcgccgttttggccgccagccggagcgccagctcgcgccttgaccgccctaagtcggttcccaaaccgacattgccatcctttaaacccaagcctccccctttcccttcctctcccattcgcctccgcgccattgccgccgcccccgtgctctgttcgtcgtcaccgttcgtcgttgcgcgtgtcagaggagccggcacgagcaaagacgcaaaaggggactccgggcgcgccctctccttcctcttccccagcccgaggccggagagattactcccgcgccgtcggcctctcgtcactgcgcccgccagcacggtagagcatctccccgttctccctcctcgctccatctcctccccttagactcgggtagtagcacgagtagcctccccgtagctagccggcgccgccctggccgttgccgtcgctcgccgtgtgctcgccgccgtcgccgcccgagctcggaagcaccgctcgtcgccggccttgctcggcatagctccgcccaatccgacgctagcaatggattcctatagccacgtagatgctctcgccgccgggaattggcccctcgtgacctcgtcgccgtttcccccttccctcgccgccggttgccaccgccgcaatccgccgccgacgcactccctccggcgaatccgagccgttggctcgtctccccttgtcctgtgcaaccacctggtgtgctcgctctcgcctgtatcgccgtggtttgctccgtcgctcgccgctgtcgtccgccgtccgttccggccggcgtcgtcgtctacctcccgccggcccgcgtggcagccacgtaggcgccacgtaggcaccacgtcagcgccagctcggccaaggccgggtcgagccgaccccggtcagcccctccccgtgcgcgcgttccaccgcgagccgtgaggctgcgcgtgggcccgccgcatccgcatccaccgcgaaccgcg

SEQ ID NO: 2058 - DNA, 1501 bp, Oryza sativa
taaacgtcaatgagaatacttcttttatcacattttctctgcatgtgtaaaaaacataattgagattcaatcaagtggcatataaccgctagctacttctggaatctttggcttaaaccgttcaaattttcacttagattctaaaaatttgtagatattaaatcataagctaataaatctattttttaattctaactattagttatccaccatttgcttcgaaattgcttcccagaatttcgagcttcccaaacaaaccctaagtcttttatttagcgtacgcaattattagattctactatttttttgaggggtaattaaatgctctatgcagtactctagtacaagaagaaaccaaattttcactaatccctctagagcaagttcaatagtagactataaaccaactatatacttatgtaaaggagagagaacaagggaaacgatgagtcccagctcttatgcaagagataactatacacattctcgtaaacaaataaattaattacatatagagaggagaagaacataagatacaacctggtaactaacggtcccgtcatcgtttggcttttccactaataagccaaaacagtttattagagaataaaaataaatctgtagacaaaatttttatatatatgttttttctgacttaaaagccaatgctgaaaaagaaactacattgaaaatatctcaaaattaaatttaaaaatttaaattttgactttttcttgactaattaggccatccgatgggagcctaatatattatatatatgttaactcttagattaatttatagatagtggtttgctctacttttaggctccgttcggtagtataagttcccaactcctcctcgttttccacccgcacgcttttcaaactgctaaacggtgtatttttttgtagaaagtttttatacaaaagttgcttaaaaatcatattaatctatttttttaaaaaaaatagctaaaacttaattaatcacgcactaaaacgctgcttcgttcccaaccctcgcttccgatcagagcctaaacttgctcttagatttttacacccctaatatctggtcttttcctataaaaaaaagagagaggtggagagggaaagaacaaaaaaaataattacgctagtgaagctgacaatctgaagatactctcccttccactccacgtctccacctctctcacgagtggaaaaagcaaaacaaggtgcgccgttggatgcttccccctcccccccaagtggcccccatccgtgcgccgtccttttgccgcccgcgcgggccccacccccaccaccaccccccgcgagatattttggtggcagatcacgtaattaacccccaactccctgccccttctcccccacccaccccgcgcggatataaaccccgccgcgaaaatatctcccccaccgtctcatcccagctcagctcagctctgcctccgccatttcgaagcacatcgaggagagagaaagttctagagaga

SEQ ID NO: 2059 - DNA, 1501 bp, Oryza sativa
ttctaccgcatgtatgtcgttaatgatcggatggccatccattctcgatgcattcattcgatggccattatttttaacactacgtggcccaatgtgctttcgagaaagattgtttctttcattactttagatatagaaagtacgtacaataaagttttaaggcaaaattgtatttatagtaacaaaagttttcgtttttggctttatagcattgaaagttcatcattcactttattagcatctaaaatctctttccgttgccctatcgagcaattccgtcaatttcatcatgtcaggcgtcctgcggcggtggatcgaaagttcactatttagtttattggtcatcttttaccctttttatgagaagatcaacaagagctagacaaagagcacagatcaaagtcctcaccgaccagggcaggccacatctgaattgtcccggcctaggaattgtaaggggacggccactgggcctggtgctgggccggaacagcggcctgcttcatgggggaggtggtgggccggccttggttgtttgcgtaggtggtgttgccctagccacctccgttgtttccgccggagccatcggagttgctgtggccacagccgtggtttcgcgagttgtttttgccggagacggagccgttggtcgagttctggggaacgccaccagaaccgttgttgctgctagcgggacgagaggcgccgctgacggtgtctgcgacgaacacggaagcagtttctgccggttgagagcccttcatgatatcttcaagcgggagctgagagcgtgcatccatgaacgatgggaatggtttctacatggacaaaagtgaatgcatgttgccaaaacggggactaagcccggtgattagctggagaacgagtgcaccatcggagacgggtttgccgaggtcgctaagcgtgtcagccatggacttgaggcaacgacagtagtcggtgacggagagctcgccttgagagaagttgcggaactcggcgttgacattgatggtgcaacattcttggttgccgaggaattgatgggcgagatcacaccaaacagagcgagccgtagccgtggccaacatgacttcctgaagcaagtcggcggagatcgtgccttatagctagccgaggacgacgcagtccatctgtgcccaatccacgtggttgaggtgagagttgtcagcgaggacgtgatccgtgagcgcgtacttgccgaagacgacgaggaagagaccgcaccagccctttgacgttgaggacaatgacagcttgagcgtggagggcaacagcttcatcatcgaattagggtgtgatgtgcactagggttcccgatctttcaaaaggttatgataaacaacgatttggacggagtcgcgacacaaatcgatccagcttcttgaacgcgcaccacgtctcctctggttatcacctgtgccgattatattacgattatactataattatatctgtcaaatatttaggagaaaatttg

SEQ ID NO: 2060 - DNA, 1501 bp, Oryza sativa
acaaacctgcgtttacgatggaggaagaacgagaggtgcaagagcaagtgcctcaggttgcaagcgtggaatcccagagcaaacacatgagcgtgtcttgttggtttggctcgcgaatctaatgagctagctctagctttcaaacgagccgagccgagctgggtttctagctcgttaggataacgagttgagccgagccagctcgttatcctaacgagctagaccgagccgagctgagctggctcgctatccacccctagatgtgacagggttaaaagtttttgcgtgggaactaaaccgggccaaaatcttctcatggtcatgtaagttgggtacgtacgtattccacttttaaaacaacaaggtggctgggacaacatgatattactagtacgagtaattttctttcaacgtatatatttttataaccagttgattagaccaaaagatatcttgagatgagcttcctttcgctctctacttcacacttgttcaatacggtacggacagattttaaccaccggctgcctgcaagtagtaccggtgtgtccgtgtctgctcgactgctctccctctcctccccgtcttcctccctctcccggtctccccttcggttgccgcgtcaccaccaccaccaccgggtcactgccacgtgggccccacacccccacctccgcgacctcgcggccggtgagccgcactgcgcctcccctccgctgggtacaaaccgagtgaccgatctaccacctccacccaccgcaatcccccccaatcccccccacacgccgcgagatctcccgcctcctcctccacccgccatggatctcctccgcgaccgccgcctcggcgcgctgctggtggtggtgctggtgctggtgagcggcgcggcggtggaggcgtcgatccacacctacgacagggagccgttccgggaggtggggaacgcgttcctcctctccgggggcagcgagggcgtcgtcgccgacggggccgacctcgccgcccccgcctcctccttcatcaagtaaagtttcccatcccccccgcaccacacctccgcgtctcggtggttggaaactagtatagtagtaggttctcgaagccgctgccaagggtgagaggcatgtgctgctggctgctcggtcttgaatcgcctggggattaggcgtcgccggcgctgggaatgggaaatggggggcgaggcgtcaccgctggaggatcccgcccgcgcgcacggttttgctgagtgcttgcttgattagtggcaatttaacttttgggatttttcattttggcaagacattagtgctcagtttgtgatttatgaccaaatttataattgtgttgccgatgaagtaaaattcgggttgcttagatacacctaacattgaaaatgataaaatctgcaagttgtgacccacacattgaactcggtgctcaccatgtagttgtttgcagtgttttgtgtcaatattgttcactgcagttcattttagtttta

SEQ ID NO: 2061 - DNA, 1501 bp, Oryza sativa
acaataaatggaaacagaaaacttaccccaaggcgaaaggctgtcccattgctccgacagttatcagctagatccttggtcacttgcaaagcatctcgcatcgtgttcccagatgcaatcactgcacagattatggcaccagctgatgaaccagctaacggagttctttcctaatgtaagtcccagataaagaaaccactataagaaaacttgctaaaaaaaaaagcagcagcatacatacaaaatgtatcacacgtaagtcctaaaatcacaagcataggaatgcagaatttccatgcataaaaatagcaggcaatgttaccacctagacagtacagtagcataaaaattgagagctctagccagccatggcaccaacaagctactcctactactcctactaagctaaagagaccaacacggaaattcgactgttgttagccacaatttcatctcgaaagtaacccgctcattggctaaagagaccaatgtgaattggattgttgttagccataatttcatctcaaagaaacaagccccaatagctaagcagacaaacgtaaattggattgttgttggccacaatttcatctcgagagagaaacaatctccactatcgtaggcacacggatctcacaattcatctgagcagaagctcctgtctcctactgcaaaaatcaagtacgcgttcgcgtagaagaggtaagagagatggggggtggacgcgcaccgtgaggtagcccctgtcgatgaggcactgcgcgacgccgatgtggtaggggaagagcagcccggcggcggagaagctgaacccggggccggtcagctcccgccgccgccgctccgcctccacgtcctcgggccgctgctcccacaccaccccgtccttcgcctccacctcctccaccgccgcccccccgcccctccccgcgcgcaccagcagcgccgccagccccaggaacacctcccccgtcctcaccgcgagcgacctcttctcggtcccctcgggcagcggcggcggctccgggtcgcggcccgcggcggcgcgggcgagcatgaagcgacggaagccccgcggccgcgcggaggcggaggagggaggggtggaggaaggtggctgcggcttgggagggaggccggaggcggcggaggagaggagggaggaggccatgggggctcgccggcggccgccgacgacgacacgtgtgcacgcgcggcgaagcatctgctacgtcgttaattcgtttaggtgcgtggaaaaaataattaaaaaatcgatgtagttttcttgtttctgtccttttgttttcgattttattttccgtgggcaaacgaaacgacacgtgtcgctgcccaagtcgatgtacgtcgtagctttggatagtagaactccgtatgcaggaatttttcgtgtcgtggcattggtatggctctgatcggaagtagtatttagtttcggtatcacctatatatttttcgacaaattttctcctaaatattt

SEQ ID NO: 2062 - DNA, 1501 bp, Oryza sativa
cgctcttaagccgccacttggcgctcctataaatactcctagatcgccatggcactgtttaatctcaccgtcgattttcacttaaattggtgaacccggtattttagaccattagattagatgtattattttaaaagtaatacttttcctcctgtcggtgacatggggccgagggtatcgtgactagaggtttgggtagccgcggtcacccacgtggcctgaccccctcgggggggtcgggcccgaggatgatgtggccacccctccctctgtctccccgaggggtcgggccacccctgtttcggccccgagggctagggcgccccgaccccctgtgattttggcgccacatgtatgggttaggtgagcacagaggggctcacctaaccgcatttattgcgggttggacgagcgcgccacgccgcatttaatgccgcgtagcgcacgcttatccggtccgtgaccggtcgcagtgtgtgaccggtcacagaccggtcagatcgcgggttaggtggcaacaggcggcctgtcacacgcctcgccccgtcccgtcggattgatgagagcctccaggcactcgtccctagccggagccggcatgctaactcctggagttggtatgtcagtcccggccagattcgttccaggcttcatcgcaaccatagcaaggaagtcattgtatgaagaaaggcagacgtgcggcatgctaaactgacgcgcggtggacaagagtgaccggtctgtgactggtctgacgccggtcacgtcataggcagacaaccgtgctcccacgttgcatctgcttccggcggagtggaggtaggtatgacccatcccatcggagggtcattcggacagcggccattgcaaatctccacccattaatgaaggaatgacagggttatcccctgtgtcaggcgagtgacggcactgggcctcactcaaggacaagctgtgatttagcttccaggcgaaggtgcgagccaagtttgggtcaagatagggtgagtccccacccaaaagaagagtaggtagaagtggtgcatgtggtatccccttgagatataaaaggaggaccttgcccaccgaagtaaaggacggagaagagaaaggggggacgactcggagaatacctgagctcatagaggagagaaagaggaagaggggttctagagcctgaactctcttgctctccggctctctgtaactccttcacacacagatccaccagaacacaggagtagggtattacgcttctcagcggcccgaacctgtctacatcgcccgtgtcttgtgcatttgctctctcgcgaacattccacagatcgagggtgaagaacctcacttagcgcccccggccgaaccggcaaagggggacctgcgcggtctcccggtgaggagccccacgctccgtcatctggcgcgccaggtagggggcgcgtgtgtctttctaagccctcgtcctctttcgtgtgcgccaagcttctcccgctcagcccaa

SEQ ID NO: 2063 - DNA, 1501 bp, Oryza sativa
ttttttctcttttcttcttcttctctttcttatctctttctctcacccatttgtttagtccggtcatggcgtggcagctcactgccatggggcagatcccagcggcatcggtgcgacttcagcaaaagcaaaacgcagctctttctctctctgtttttataaaaataataaaatagtgtgttcggtgtctattagctaattaccactattttacagtgttccatagttaatttatgtctttacggtatctcttagttaattgtattttttagcgttccgtagcaaattttgcctacgaacattcgtgggatttggttaactaaagagcacatttgtgcgaaaattagtaatagtggcgtcatggcatatgtgtcgtatcatatactcctccactgctatacctataaattccctgttcggtgcttactcttactcatgccgttcgtgtctcgattaacaaacgcaaataaaaacatactgacactaaaagcacgtgcattatgtctcacctgccgctgcaactcgccgccgctatcatggcgctcgccgccgccgccaccgcctgccgagcgttccagatcgaggaagccaccttcgacgccatccagctcggcttcagcaacggcagcctcacctccacagcgctcgtccgcttctacctcgaccgcgtcgcccgcctcaacccgctgctgcacgccgtcatcgaggtcaaccccgacgcgctcgcccaggcggcgcgcgccgacgccgagcgagcctccggccgccgtggcttcgggccgctgcacggcgtccccgtcctcctcaaggacaacatcgcgacgcgcgaccggctcaacacgacggccgggtcgctggcgctgctcggctccgtcgtccgctgcgacgccggcgtggcggcccgcctccgcgccgccggcgccgtcatcctcggcaagtccaaccccgccgagtggtccagcttccgtcccttgacgaacggctggagcgcacgcggcggcgagacgctggtaagtggtggtagtggcaaccccaaaactctgtgcatgtcatctccccagcatttcatcgcgtaaacaaagtgtttgtcgaattgtccatgaggaagaacccgtacgtggtcacggctaccccgtgctggtcgagcagcggttcggcggtggccgcggcggcgaacatggcggcggtgacgctggggacggagacagatgggtcgataatctgcccggcgtcgtggaattcggtggtcgggattaagccgacggtgggtctcaccagccgggccggcgtcatcccgatcacccctcgacaggacaccgttgggtaagtaaccaaagcatttttgtttttccagctattagacgacgcctcgtcgagcaccaggagacaagatgacaatggtgcagaggagaaaaaagagaagcggtagagacggagaggagatcgagtggagagtttgatggagaaatgagttggtggtggtgaagagttgatgtcacca

SEQ ID NO: 2064 - DNA, 1501 bp, Oryza sativa
aacaatatcggcttggggtgatggggagttactcattgcatcggcttgaccatattatataccacatttaattcatagacaagaacatcaagatacaacatgaacacacacataaacatcaagaacatacaaacatcaaaaacacaacatcaacataaataacacatcaatcctttatgttcctgctgccgggtgagagggcgccaccaccaccgcgcacttcccgtcgggccgctaccgcacgtcccgtcaggtcgccgcctcctctcccaccggatctggtggaggggagggcgccattggaccgtcgttgactcccctcccagccggatctagcggagggggaggcgccaccacctcctcctcccctctcgccactgccaaggaagacgtgccaccaccggatctagcagaggatagggcgccatcgggccgtcattgactcccctcccggttagatctggcagaggggaggcactgccgcccctcccatcgctactagggaggacgggtcaccgccgcacctcccatcgggccaccactgcccatcccacagctgttgggtgaacgagagagagagagagagggaaggatcgagaggctggaggtggccttatcctctccataggggtgtgggccccactgggtcaaaaatatcccctcgcatcccgtcggctcgggttgatcttatggagtcggtattttaaaaatcggcacctatatttgtcgtttttctaataaaccgacacctataatagtgccggttattttaaaaatcgacatctatattagtggtgtcggtttttctttaaaaccaacacgttcgcttaaaggtgtcagtttttctttcatccttttgaaggtgagaaaagtactataggtgtcgattttagctattccgacatctatagtgccagcttgtatgtgtcttttagtaatagtgagaccgattgattgtagccatctccaaattgataagtattagagtatatagccacccagcataccagtccaagtgcaccaggaatgtcattggtccattgtgtttttgctgtaggctactgttctccttttcctaattcttggattggctccatcaagccaactgtcctcctagaaaaggataggaggtttgaccattacccggggtggatgacaaggaagccgctacgattctacgaagcttaatttggtggtctgagaaccagggagctcaagtcctgccgaagcttaaggtctatcagtaattataaatacgaaattggtgaaaaggaaaacattgactatcatgcaacaatcacccttgcacgtgctcctatagagacacaaattaatacataagtgagagaaaaagagattaggttaaagttagttatttaaaataccaatcttataggtatataatctattgtaattctacctccattcttttttacttgtgttgtacaatgacaaggtcttcaatgcaaatgttttatcacaactatttctaaaagctatt

SEQ ID NO: 2065 - DNA, 1501 bp, Oryza sativa
tcaagtactcacgggccgaaaacggaggtcgtatggagcttcggcggccgtttgaagtcagcagtgtagcaggtggccgaattggattttggcacttggaggactcgaacttgatatcttgttgttcatccatgatgtgagcaacggatgtatccgtagtagccatggtgacatcaactcttcaccaccaccaactcatttctccatcaaactctccactcgatctcctctccgtctctaccgcttctcttttttctcctctgcaccattgtcatcttgtctcctggtgctcgacgaggcgtcgtctaatagctggaaaaacaaaaatgctttggttacttacccaacggtgtcctgtcgaggggtgatcgggatgacgccggcccggctggtgagacccaccgtcggcttaatcccgaccaccgaattccacgacgccgggcagattatcgacccatctgtctccgtccccagcgtcaccgccgccatgttcgccgccgcggccaccgccgaaccgctgctcgaccagcacggggtagccgtgaccacgtacgggttcttcctcatggacaattcgacaaacactttgtttacgcgatgaaatgctggggagatgacatgcacagagttttggggttgccactaccaccacttaccagcgtctcgccgccgcgtgcgctccagccgttcgtcaagggacggaagctggaccactcggcggggttggacttgccgaggatgacggcgccggcggcgcggaggcgggccgccacgccggcgtcgcagcggacgacggagccgagcagcgccagcgacccggccgtcgtgttgagccggtcgcgcgtcgcgatgttgtccttgaggaggacggggacgccgtgcagcggcccgaagccacggcggccggaggctcgctcggcgtcggcgcgcgccgcctgggcgagcgcgtcggggttgacctcgatgacggcgtgcagcagcgggttgaggcgggcgacgcggtcgaggtagaagcggacgagcgctgtggaggtgaggctgccgttgctgaagccgagctggatggcgtcgaaggtggcttcctcgatctggaacgctcggcaggcggtggcggcggcggcgagcgccatgatagcggcggcgagttgcagcggcaggtgagacataatgcacgtgcttttagtgtcagtatgtttttatttgcgtttgttaatcgagacacgaacggcatgagtaagagtaagcaccgaacagggaatttataggtatagcagtggaggagtatatgatacgacacatatgccatgacgccactattactaattttcgcacaaatgtgctctttagttaaccaaatcccacgaatgttcgtaggcaaaatttgctacggaacgctaaaaaatacaattaactaagagataccgtaaagacataaattaactatggaacactgtaaaatagtggtaattagctaatagacaccgaacacactattttatta

SEQ ID NO: 2066 - DNA, 1501 bp, Oryza sativa
atttgagaaaattcattgttgctttgaatcaattgaagaaattaccaccatagtgattgctcttccttttcagcgacacatattccacatatccccatcatgtaaaccacgcagatcctggatatatcttgtactaccaaacagtctcgttgacaccaccaatgtattcaacccgatgttgcccgggacttttcttcagttttggtctaactccatatatctcaactcattgtcgagtctcagatatatcatgtctccgccagataattccatatgtgacctgaccgacctgccgctaggtttggcaacggagcggagcaggtccgggttggacaagaacggccccgaccccgagccccgatttcctcactcgtccccggccctgaagaaggatgcaggtgcaacacaggacccgcccccaaccccgcagggaacccgccacctagccggggcccgcgcaacggagaggagcgttggtgaccgatcgacaagaagacgacaacacaggggcggtggtagagggcgacagcgcgcggcgtacagacagcgacagaggatgatgacacgaggcccaggggcggcgacatagggcgatagcgtgagggcagcgggagaggccgacgacgcacagtgtggggacggcgggaaaggccgacggcgtgcggctcgggcggggcaggcgtgttgcgctgtcgctaccctctcgcctctcgcgcttgagtgagaggttggtgcctggcggcgactgggaggagttgatttagagttttgacctttccttttatactatagcagtaataattgggccaatgttaatgggctttctacataaattgtatggaaaataactaatggacacctttaccgggcccccgaaggcaaacccgtgggatgaccggggccccgacccaatggacctgcgggttgaaaatctaacctacccccgtccacgcaggggacccggccccgtgggggaaattgctatacctacctgccgccgtcagtctactcgcccttctcacttgaaaactatccaaaccatagagccttcttggccttcttatggatctgttcataagtttcagcaacaaaccaccgtccattgtactcggtataaccgtccaagctctgcagtttaaccaatccatcggtctaactaccctaccggtatagtgcaaaaccatcatacacgcgcacctcacacaccttgtctcgagccgtatactcactgctagggttgaaaacggtagcagtaattaccggctgaccgggctaccgctaccgaatttgacctatcggatgcttcggaaacggtaaatgtcggaaacggaaacggtaaaaaaaatacggaaatgatatcggaaaaggtttggtaatttaccgactgttttgtgtggttacggtattatcccggtaattaccatttttacaaacatcactggccggctggcccaagttatttttctttggcccattttctcagcccaacaaaaaccctaaa

SEQ ID NO: 2067 - DNA, 1501 bp, Oryza sativa
cacatataaaagttttattcaaaaaatatttgcttataatcagcataagtgaaatgatgactgtaatggatgtcagctaccaaagcaaccagatttcaccatcacacacttaaaaggagagatatttactactatttgtcatcgggcaagtgtcaactgtcaataaaacataaaatataacattattattggttttgctagttggacgcatagaaaaaaatatatatgaccagatctttctaacaatgtcggactatcggctatgaaaatgaaaatgatgaccagtcaccttctctatctctcctcttatgtgtgacaagcgactaggttcatatagacaatctcttaagtactgtactgatgacagataatcgacttagtacatatatatatataaatcagtggcggatccagaaagaaatagcagtagggtctaagcaaagtagatcgagttacagtcccccctcctatctacatatggtaaaaaaatttagtggggttttcgtagagattctcaaagtcttcacgccaataatagggttcgaaaccccgccgcctctatgctggatccgcccctgtatataaattagaatgtgcaacaccacaacatttaagaaaaaataattatgcaccccaaaatagaggaaacccaatgatattccacataaattcctttagaaaagatatcaccccaataatgaaaaacagatatgcagaaaggtgtataatccgaacaagtttcaggagatccggtggtattgatggctcacgagctagacgaccgccgtactatgcctgacgcaagggtgccaggtcaatcaatggcatattggcatggctgccatggcatgcctgtaataaatgtctcattatctccatttacccttcccaacggctacctattcatctcaggtcctacttgagccttcaccagttttcctcatgccaaaaatggcaaactactataccatttttttccttttctcatgaacatggaaagtcaatagcaagaaagtggtaattctcaaagcaaaaactatgggtgtcaataaaaaaatttgagcattttagaaagaagcaataatatagtgagtatatttgaggaaattctgattagcacaatgacagttccaggtacaagagtccacctaccagtggtgttgtaaattcctagtcccactaaaatgattctttctgttagagcaaggtcaatagtgcagctagcagtaggctccagccttttgtcatgtctcaggtagagctaacttaaagagcaattcatataacaagctaactacaagttagctataagttgccttgattcaaacaaattaacaagcattttaggtcacaaacggattttttattttatctcctggccgatacagcgtggggcgctgtgcaagcgccggcgccagtacaagcgccggcttctttctcaatatgtgattttctttccttaatctcgttttaggctaattaacaggttttggagccttcc

SEQ ID NO: 2068 - DNA, 1501 bp, Oryza sativa
aacattgtaaaactcttcaatggactgattttgttgctgctgtaagttgttcagattttgcaacaaggagaagcgtaaggctccactttcttgagtgtatctctgtttgagatagttccacatctccttagcacttgtgtgagccttaaaacctatccgaatagccacatcaacgctcataaatatgaatcccatcacacgatcatcagcaattttccaagcctttacctttgttgcatctgttttctcatcaggaggatcatctgtgaggtgtgatgcttgaccaattgaccgcaaaagcataagtgctgatagttcgataattttgaccatttaacttaatgtctgtacaaagcaaagccccacctcccaggaaaggatcagttgttctcatcaagatcagcgcaagaagtacatcaagatcagcacaagaagtacaggaagtagatggttgtacgatgttatctgaagttctgaacttggcactagcacacagcagcagagagcagcaatagtagtagagagcagagagtaccacagcttcaggaacattcaggagtagtaccaaacagtggaggagcagcttgttgatgagggccttatccatcaatagtccatatgcacagggttgcagcttcagcttattgatgacgagcttgataaaatggcagcctgatgaggtcgatcagcagcaacaggtacggccagtgcaaaatttctcatctttcggtaaaaccagtgcaaaatttctcatctttgggtaaaattcctcattttcaagttgttcaggtggtatattgtgttaaaatatgcttatgctcccaaacgtctcatctttgggtaaaatttcttatttgaggattaaggatcatcattttttttcaaaaaaatcaaacctgagccctcaattagatacatagaaataaaaataaaacatcaaatgaaatgaaattcaaaagacacaacaaaaacatgtccaaaagacaaaaaaaatttaaaatactttagacaaaaacgaaattcaattcgaaataaagaaaaaaacccttacagaattaacaaaaaaatattataagatttaaaaacttagattcgggatcagatggtaaaatattggagtgccctgttgtcgtaacaggcttggttggggcagacacccctctcgcaacattaattagcgagatgttaccactcatcatctccctttaactgcctgaaggatcatgccctcctcgtcccacccacccgcccttttatagcctctctccctctcgccatccgcctgcgccgccgaggtgggactaaaacccccctcacgcagcagactagcacgcactagcgctgatagttagtaagacgcttatttgggcctagctctcagcccaaaggtttagttgggccgggccgagttgggctttacggatggtaaaacatgtgacacgatgacgcagttgagcgaactgcttggttgggaatggcggcgcccgtggccggccgcctc

SEQ ID NO: 2069 - DNA, 1501 bp, Oryza sativa
ttatattagttaattatacataaaagatccttattgtgtggttaattaagtgttttcatggaatatactcgtaaacaaatgttatagctagtactagcttacaaccatggggcacaaaaactaaggaaagatcatgtaaaattacaaaggatgaaatataatttgtttttttgaatgaatttgctttggtccacttctgttaccaaagatttagtccggatcacatttatcaaactttttcactttgaacaatgtaatattatccctttcttattgctttggatcatcctaaccccctttatctcttgatatcaggcgcatcccatatataaaggtgtggcctacatatagcttgacaagtttactggtatgcaagactgatgtaattaaggcagagttaggagcggtctatgtacaacaaaagtatttttttatttaattatctaaagtgaaaacattaataataaagcgtgtggttcaaagcggaacttttataacaaaagaaaatccaaaccataatttactcattcttttaattgcatttttgggcttcaagcacgtgtaagagcaaatttaatagtatagctaactactagctctaatttatttatagcaaatctaatactccatccgtcctgtaatataagggattttagggcgatgtgcctgtccagatttgtagtcctagaaagtatcacatccccaaaatcccttgtattatgggacggaggaagtagctcattcatacaatagttacatataaacatatactatagtattaatatattgtcacacctctcatactcacacaacgtattagagtccgtattgcagctggctacaaatctgtagcccgcttttcttctctctcttgtcttctctcctccacatgtgtttacagcagacttgtatatgctactgtactcgctctaattgtaacatgctgttgatgtgctttatgttttcagaccaattgttcacccttgtcgcactttccaatctaaaaaaagcttggcctgtgctcgatctatcattaaagttgtcatgtgtctaattttgaattttagaactagttttttttaaagaaacatttaaccactttggctctagaaccttgagtagaaatttgttttcatttaatttattttcgatggatgacatactactataggcaaaatttgctacaggacacataaaatttgtataattagctgagggacaccgtaaaaacgtgacattgctctaggacactaaaaaactgtgaaatttaccgaccggacgcattattttattattttccagctaaaagtgatgagatttttttcgaaatgcccagattgcccccgcatgtcaccacacaccaaaaaaaaatctccatcgtccggaggggtgtggcgagcggcagcggcacacccgtgcggcggggcgcgacctggcggcggcagcgccggtgcgacgggggcgcggccgggcgtcggcactaggcgtgacggaccgagga

SEQ ID NO: 2070 - DNA, 1501 bp, Oryza sativa
ggattgaccgtattaaaccatagtacaataaacttattttatttaaaacggtttagactcgatccatgtcctacccattcccatcctgagacgggcacggcacaggataagctgataatgtggaggccccgcgatctggcgccttgtcgttggctcttctctaatctttttgcacgctacctctgggccccacgggcaacacgcacgcaggcacgcgaatagcgggctacgtggccagaaggcaacccgatcgcgacgcagctgcagctgcgcgcacgcgcgagctagggcctagctaccgtgcaacgtggcgcgccgtgcacggcatctccgagctccaattgcacgttagatggtgatctcgaaatctgttgcacttccagcttggttgcagcgtgtgccaccgaaatcaagcacgggatcaaccagccactcgtgctagcgatctacgtgtatcaaaactaaggaacacgtagtagctagagttagtaatatttttagctacacacagaacacgagtactagttcgtatttgtcactagaagagcacactttttgcaaattgccgcccacgactatgtcacgaaccggcccgtgaatttttatcaaatatactataaccattgctaatgaaacgatagaaaaaaaaactaattctatactctatgtgctgataaagcagatctgctgactttagttaagccaaatccgcatgcagctgatcaccgagatgccacggcgccgaaccctttcctgcgtgcgtgtacgcaggggagaaccttcggcccccgggttggtggggcccaggagggggcggagcagcaaaccacgtcacccacatgactaggctacccagctggccctcgtgggaggcgcgggtggacgcgtagagccgctccggtagagacacgtgtgccggaagcaacgggtgacagcgtgactcaagaaattaaactatccgccacgttgcccggctcacccacccactctacaccggcgcttccgcaagggacccaacgaacgccattattcataggatggcccacatgtcatcctcatgtactctaacaatgatattttatttttctcggagaataatgatgatgacgatgataataactattacaattattaaaagtgaataaagaaatatagacatatgagagaatgcgtgatttttttattaaggtctcacagttacaatttagagatagcgactaaaaaagtatttgctaaatcgacgcatatctgtgaatctgtttacctgtataataacagattttgttaacgaaactgcacccaactctgtgggtacacgaaccgggtgcctcgtagcgaaacagcccgcgctcgggcctaccccgtgtatcacgagccgacacgtgtctcctgacgtggtaccctttccttccgcgccgcctccccactcatccccttccccgcaaggccttctccctcccgtcaaatcaaagcaccccgccgcacgcagacgagaaaggaa

SEQ ID NO: 2071 - DNA, 424 bp, Oryza sativa
taagcaatatagaaaaaatgcacgtgcgttgcaacaggtaaagacggttttttcagtgatatatcaagagaataagtggtaagcaataaataaattaaaatattaggatcactatacattataattgaaaatgttaatgaaaattctaacattgggatcgctatatatagattataattaaaaaaggtaatgaattttttttcttggtttttggccgaaagcatttctttcttttcaaacgtaggctagtccactacctccttcgacccacaaatggagctgtaagcccagctcgcaccgtatcgtccactatcatcttcaaccttccaaacatagtcacgtgctagtacggttgcctgtcacccaaaattggttgcggacttttaatctactcaatactctttctgtttttccaaaaatcaga

SEQ ID NO: 2072 - DNA, 1501 bp, Oryza sativa
tggatagacttggggtgggacatagcctgccgaatactggaggattggtgccgaagcgaccttagaccgccttgccgcctcgtacgcttgctgctgttcttgcatttggcgaagcatgtcttggagtcgtgtcatgttctgtcgcatggcttccatgtcggcttcggtttgtgtctcggggtcagggttgacttgggcttgcatagcggcaagcgcagtttgggccgctgccggctgcgacggagcggcttggggcaccagcagttgacttgtcgaaaggatctccgccctggtctggagtgccctcgccgccgcagccgccttcgccatgtcagccgcgttcggcacctgcacagaggtagcaggggccgaaggcggtagtgatggcgcaggtgcggaagtagatggtgctcctccatcttcggcgacaggcgcccaaggctctgctccctcttcagcggccatattcgccccagcgtcgcttttctttcgcctttgaaccttctccttttacaacttttttcagggcattcgcttttcatgggtttcgctcgaaattcccaatggccggcccagcttgtggtcgaaacgacaactgcatacgtcgaaagacgtggttactcaacagtggttgaaagtaaagtgtattgattagagaatttttcttggatccccctattacatggccctatgagactatttatagcccctattacaggttcttactactagggttttggttatacaggggaatttacatggttacccttatgaaagggacatttacatgggtacatagtgtaatagaggttcatggactcctgatgggccgttaggcgatcgtcggcccaatggcccctaggcttgatgggccgggaaaggcttcttcggccctcgcgggggcaagcttgctttggcgaagtcggctccctttgacatatactcttcgccctacatccttcgcccaagaggcctccggcttagtagagtacccgcacgatccttcgcctctcaccgtccttgttccatagtttccgccatggggggggggggcttcgccccgactaactttgacgtttcgggcttggatccccacccctcgcataaccttcggcagattttggtcgaagggcctcatgccataccgccaacaagcccctcatgggcaagggtgagattggagcttcggccgagaccatgcaacccatgtggtatgtggtatggtatgtggcgccccctttcaaccgatgctcctgccgaaacctacattgttcctgcaaataaagtttgttgtctgtgcggctggtattgacttgccgctcttcgcctcctgcggacggtgatatatattttttatttttaccggaccgaaaggaacagtaatgggccttccctttgtgggctttttactgtgtagctcggtcgatgggaatttaccgtttcgcctaccctcacgacacgtggcgctttattactggtgggtaggcgaatcgtcgccttg

SEQ ID NO: 2073 - DNA, 1014 bp, Oryza sativa
ttgtaaatacttacagaagaacctatacatagatacatatacatactagaacatgattttgggtgctttcattcgtggtggcgttggtagtaaaattgactcaaaaggtgcccatgtttgtcactcacgattgattttagcaaaacgttaagcaaattgctttcacgaatcctcgtgcttctgatttgaatttgtatgcctatttagtttgcggtgaatacctgttttgctccgaactaagtttcggcccgaaccaacaactgtactctcaagttccagcccggcccaaaagcctcgaaccgtcacgtccagaataaatttcggtgaaccttgtccatactccatagacgtgaaaccccaccagcgaatctcaaaaaaagggaaaaaaaaatcaccagcgccgtccactgctgcgagcctgcgagcgtgtcccgatcaggccaatcagaacctccaaggagaaatcaacggctcataagcatcggcatctgcagatcaaacggagctggttcaccatagtgggctctagccgctctacaccggctcgatctcctcatattacgggcgtaccgtgcgcccatgcgcgacgcgtggcacgcgctcgccaggtcgacggaccagagccgatgtgagccgcccacgtggcacgcctacgtgcaggctgatgcagcgtcgcggttgttgcgagcctatggacccggtccacgagaggatacgtgtaacaccccctcccctcttgccctgtccccttcctccaccgatgaaaagaaaacagaagcttctcttcccctctcccccaaaacaaaagcatcaaaatattcctcctaaatcaaaagaaaaacaatcaatttcaaacgagccatctctctccattctcgtgcccctcctgtctccgcgcattcctccgccggaaaccctggttcatcggcgagcggcgaggctcggggactcgattaccctgcgaggaatcgaggtcggaccgcgggtggggaaggcgaagatggcggggtccat

SEQ ID NO: 2074 - DNA, 917 bp, Oryza sativa
tgccatggccgggggggggcttccctcttccgcgccagtggcccctctgatgcctcgttgtgagctagcctatggggcccaacctcttttgtcgccgcctcgtgccatgccgccgctgccaccctttcccttcccctcctccgcctcccccacctcgccggcgatgacgaccatctcctctttgccggtgccgatgcccatctcctctgcgctgccgccgacgccctcctccacggcgccgtcagttgctgccgcccgcgccctttgctgcgccctgggcctccccgccgcggcgccgctgtccccaccgctccgtccggtgtcatgtgaatactaggatggcatgtgggtcccacatggacccatcatttttttttattttctagtgtaactggtacatgggccccactatttttattttttttcgacttgaattaccacgtaagcgtcacgtcaatacccatggaataaaggcctagtcaaagaagccacgtagacgccacgtcacccaaatccaaagacaataccaccgaaggacctagtttgcactggttttgtaagttgggggataagttgtatccggttttgtagttcaaggatgattttgtaattgggtgacaagatgagtgaccttcgatgtatttttccataattaaatacttaagggtgagtttgaggagaaggagatacgcaaaacgaggtgagcaattagtgcatgattaattgagcattaactattttaaatttcaaaaatagattaatatgattttttaaatcaacttttcctatagaaaatttttgaaaaaaacaccgtttagtagtttgggaagcgtgcgcgcggaaaacgaggtgttttctcaccagccttagtatgtactgtattggaccaataatattttttctaggtcagccactgc

SEQ ID NO: 2075 - DNA, 1501 bp, Oryza sativa
agtatagggggaggggggcaaaccgattgctggcgatcgcccatgagcctccccaacgtaattggggttatttaggttttatatccgtcgtcttcctgaccccgcggataaaaggggccaggggttcgtactattagccgtgctcctttcatattaccagcaacatctcgtggcagcctatcaggttaattagctgcacacgacgtcaggggtgacgtacgcgtccgttggagaaagtccagtcaatcgcgccgatcgggaagggaacctctcgcgatcgagttgtatatgtacgtgatgtcaacgaggagagttgttaatgtcagcgaggagatttgttaactactgcaaaaagttttcgcggacgatgttttacgcacgttggtggccagccgcttttctggtctacgcgggtctccctagctgctccctcgctaggacacttttcgtgctaaaataaatatattttttaccatctcgctaatatgaaaccggaaaaacaaaaatacctttattttattaataataaatcataatataactattttaatttatttacttccaatataattattctctacttttataaactctaatttaaaagaacactttaaaaataaacttattacagcgcggaggggtgcatagggagtatgacctcagatggtgggacagcgggtcgcgaatagccggtagacaagacaagagaaaacctgtgatgatacacaccacgacgtgtgtggtgtcgtgtcgatggaccgtagttagattcgacccgctaccgtggaggggtaaccggatgagtgctattaacttgaaaagttagctacttcatccgtgttataatatagtaatttagaatttaataggatacattctaattataagactataaatcggatagaacttctgtctaaatttatagtttaggatgtgttatattcgattctaggttgctatatccacatcagattaattagaatacacgattcggttactatagatggtttgatcggtaaccattgtggtatttatattgtctgccttttttgttacagcacatgacgacctaccagtaattaacagagagctatgtacaaacacgctacgcgcgcgaccgagactgctgacactgtatttaattattaatctggacgctcgggagagttatggacatttcgaatcctattttagttgatgcacactaatttctaaaactcagtatgtaagtatactacactatcatacactagtaattattatataaagtattttaaatcacatgcaagtgtgccacatcattacctaatagcaattattatctaaagtattttaaatatcatgcaaatataatatatcatttacaaatttgttgtatttttaaaactcaatatgtaatcaatgtcaaataattatctccatattattttcatgttatttaagtatgtacatatatcattaatataatgtataatatatattcatccacgtatctcgtagg

SEQ ID NO: 2076 - DNA, 1501 bp, Oryza sativa
ccacaaaacaaaaggggaaaaaaaaaaggggcacgagacgaatggatgcgccgtgacaccagctgcgtgcagcgtatcgcacccaacccgtccattccatatgcacgtatcgtatcatatgatataataacgatgacaatatcttactagcaaatcatcgtaagttcatagggacatataggcaatgcgagccagctgatatttatctctctctctctcccccgacctagcagccatgttcctcttatgtgtgtgcgtgcgtgcacagttcgtgcaagttgggaggagacgcttgccaatggctggagccacatgatcgagccagcgattctgattccgttggcctgcctataaataccccgaggagcgagcactgcagatgccaaggcagaggccaaggtttcttctctgctagctaactagtgggctgcttgggtggggagcccgggccggcagatatcctgtctgaaacccttaggtatgtattttccctcaaatggctggttaatttcggctccgaaatggcagttcgcatactatcatgcgaatggcattgtcttcttcgccatcacttgtataaagtcactagtgcacatgtagctttcaagaatcaagaggatgatcactgctagctagcttatgcgtctgtttagttaggccaagcagcagcctgtgttgtgttacctactcatttccaattgcacccattgcatcaggaaccttccatctttcacttgtaaaaatcttactgcatctgttttgcctgttcaaacatggattttccatgctctctcaagtgtgaagcagatcgtttgcaacttgcagttgtgtttaggagccatagtagacagggtatcaattaagcacaaaggtcatgttgcatgcatgactcaaagtttttttttccttcatttttttttgggtgggaagaaaaagtttggaccaatggttttacgccagcttttatctcctgtagcatttcacgcactttcacgttgtgttttttctccctcccgggagtcaatctttcgccgtacgtgatatgataatatcgaatccgagcccatatgtccttgaagagactgacagaattgtactttatctgaaacccggttgctcggtcggtcacaccaaactgagccaaaaaggagatccgagttagacaaatcgcgccttgtttgcataaagcggcctaaacttagatgcccatattactatcacattattctgaagaatttttgttcagaaaacaaacattattctgaagaatctcttttgcacatcgcgtgtagcaattgttcgtcagtagcttgctacgttctacagttctctgcacgagtggcctaggtagatactgtatttttttttaatatcttgtgcgaaatgggtgtacaaaagcagagtcctgaacatgtacgcactgcattgcgtgatcacagggacagggacttcgaattcttggaggcaatggcgtcctcgttgctccactgctccgacaagc

SEQ ID NO: 2077 - DNA, 234 bp, Oryza sativa
agatggccgcaacgaggtgctcggcgtggtggccgagatccaggagcggcacagcgcgcctccgcctccatatggtcgacgtcgactgtcgcccgccgcctccgtcgcctctccacacacgggtccgcccccaccaccccgcgcatcctcgctcacctcgtcgtcgccggggtccacgccggtgacctcggggaccgcttccatgtcagtgtgagcgtccagtggtcgcggcga

SEQ ID NO: 2078 - DNA, 1501 bp, Oryza sativa
tctaaattgcattttcatatgaactatagactctttttctaatatttattcattttaatttcgaattttagttatttataatttccattatttatgaattttatttctatatggactctagacatctcttctaacattttttttaatttttaattttagttatttgtaaatgtatttatatatggaatctaaacttttctttcaatattctttttttctaattcctaattctagttagttgtaaattatatttctatatcgactctagaattttttttaatattcattcattttaattccgaatttcaattatttataaatcgtattcctatatagactgtaaactcttctcccactcttccttttttttctaatttctagttttagttatttctaaattgtatttctatatgggctctaaactctacttttgatgtttcttatttttttaattctgaattttcattagttctaaattatatgcttgtagtatggactttagtctcttctttcaatattgcttatttttaattctgaattacaactatttttaggttttatttttatgtggattctatttttttctttcttctaattaatatgaaaatatctaggccatgagaatttcatctgatttttcttatttttaatttttaatttttatcatttgtaaattgtattcctatatgggcttcagacttttttcccctaatattcctttttttaattctaaatttcggttatttataaattttatttctatatggactctagaatttttttggacgcgactcccggtcgggcgtccgatcgagagggagtcaaatcggaatttattatgcaaccaaattagaattgattggaaatttcaatataattaccacgcctcgaccgaccgatctatattagctactgcatgttcagaatttcacactttcagactttcaaaccaaagttcatttagtgatgtgctcaatagtgggtaattgggctgggtcttcataggacattggtttcctaacacggtcaagtcacgattttgttgttgttttccgtttgtaacaaactcttggagtttggaatataaataatgaaagagaaccgagaaaagttgctgaaatattacgcagcaccaaaactctgtttttgcgttcgatactctgttttttttcgatttccgtcagttaattgtagcagtctgaaaaactttagaaaccaacattcagagttcagtgagagcgagtgttttaggattaggtacagaaatttccaacatatttgatgatcatgttggttactgctctatgttttagtacgcatgcacccatcttgctaaatgctaactagcgattttcttacttaaacaatcacgaatatgctaatatattccaaggttgcttccagagaagaaagtggagatggtggcgcaaggattttgagaaaggaaaaagtacgaattaccctcctaaactatcgtggtcgaccaaattacccctctgaa

SEQ ID NO: 2079 - DNA, 1501 bp, Oryza sativa
ctctacttcagtctaacgtcgtttgttcaaaatgtaacagaagtgttatatatagaagataaatatgtacgacctgtgttttttgatggaagggaaaacttcttgtgctatctttttttaccgggttgtttttttttctatgaattgaattttctctaaatttatagctgggtacactctctcatccagaacacttgatccaaaattaatcagacactcacacaacaaattgttcatcacaaaacactaaattgacgaaatgatttcacatctatattcctacaaaaagtacaccttaaactactaaattgtataccctaaattttagtttataaatccgaagccattaaaaatgtccccttaacccaaaaccacatcaaatgtttttttcacttaggcataattacttatttgtgctaaatctcttccttgcgtactttacatgagtatttataattgagataaaccctttttgctccttaattatggtcttgtccacacatgcaagtctaaattcgagctacaaatgaagaaattaaaataataaattttatctgcattgcacaaatactattcattgtctgattttattatgtttgttttagtggttgttaatcaaatttagtctttgcatgtttgtctatatagatttatgtcatcccaattggtgttactattttttttaacatttctataactatttaaatcacatgtaaataacggctgctatagcacctagttgtagaaaattcttgtctctaccatcttcctctcccttaagcatcgtctacttctatcctggccctcctactttgcccaacactagccgcacccccctcccccaaaaaaaagaaagagaatcattggatctcaatccgatcatcaatattgattgagaatatttcacgactgatttgagcaaatagtaatagattgggaaagtgattttatccctcgagggatatcctcttgttcggtgcatgccacctaaatagtcataaaaaatatgaaataattggcaacatagattaatatgaaatatatcactccacaaacatgcaaatttaaattcaacttctacaagttgtaacaaaaataacaaatatagttgtgaatgtacgataactatttttagtttaatgtactatttttattgcaacttgtagaagttaaatttggtcatacatatttatggagtgatatatttcttattaatctatattgttaattttttttaatttttttaataactattcagatgacatgtaaacaatgaggggaggttccctgtagggataaaaatccacatctataatagattgaggaatggaagggtgagaatgattggatagtacgttgtcgacaaaacaagaatctcaattgttctcatcgactgatacctttcaaattcggcctgaagctagctgacagtggcatttatagatcgcttgggtagagcgtggtatttgataagatactgctactacttctcacagtgatg

SEQ ID NO: 2080 - DNA, 911 bp, Oryza sativa
aatgcacattcagcttagaaattcgggttcgagaatttctgggcgtgacaccggcgccgaccgaccgaccgcctccgtttcccgtgctgttgcttgccaccgcacgacctgtgcccatgcccgagagagagggagtctcatcgtgctctgcattccgccccagctcagcctccgcggcgtgcagtcgctgcccggcggcgccctccaccgccgaaagcaccgcccgcaggtgccagcgccgcccctccatcagcccaccgcccgtccccacgccgccacccacctccccgcccctgtgcgctgccccgtgagagagagaatagagaggagagggaggaagaggggaagaggagtatgacaggtgagacccacatttttttagtatataaaatgttgactggattgtcacgtatacgccacgtaggacaaaactgctctggattgagccgaggtggggtaattcgtccggtattgaaagttctgggtgagtaatgtctggttttcggattcagaggggtaatttggtcgaccacgatagtttaggagggtaattcgtactttttcctttctcaaaatccttgcgccaccatctccactttcttctctggaagcaaccttggaatatattagcatattcgtgattgtttaagtaagaaaatcgctagttagcatttagcaagatgggtgcatgcgtactaaaacatagagcagtaaccaacatgatcatcaaatatgttggaaatttctgtacctaatcctaaaacactcgctctcactgaactctgaatgttggtttctaaagtttttcagactgctacaattaactgacggaaatcgaaaaaaaacagagtatcgaacgcaaaaacagagttttggtgctgcgtaatatttcagcaacttttctcggttct

SEQ ID NO: 2081 - DNA, 1501 bp, Oryza sativa
tttgtggtgttttatattttggccaaatctttatgctaagagttgaattctcataaaaatgtgatcctcgaatttttaatagacaacacctttgacttgaaacatatgtttgactaaccatcttatttagaaaatcttgtacaaatatgcttaaggtacaattaatgataaaccaagtaacaacaaaataaattataattatatatttttgaaaattaaatgaatggtcaaacgtatgtataaaagtcaattgcaccattaaaaatcggggagagtatagtataaccacataactttcattcattataaccttactatttaaaaactatgggtgtatttagttctttaggtgtaaagtttttaagtatacgggcgcacatttgaaatattaaacgtagactaataacaaaacatattacatattctgcatgtaaactgcgagacaaattgattaagcctaattaatccgtaattagcaaatgtttactgtagcatcatattgtcaaatcatggcgtaattagactcaaaagattcgtctcacaacttacatgcaaattgtgcaattggtttgttttccccacatttaataccctatgcatgtgtccaaatatttgatgtgacgtttttggtcaaaattttttgggatctaaacaaggcttatataaaaattgaaacggtaatagtagccaatactgataaatattttaaaatggaaaaaatcatttcgccatggtagcgcaatccactgaattccttattccgattgcgtgccttgcctataaatatcacctcaacacctttggttttttaaaaaggaaaaagctgcacgtacatactaacttttttcttactaaattcttactagcacagatgttactaaattcttactaacatcgatgtgtcatgctatgagtgcatctagattttttataatttctatttacctaaatcaaactgttgaaatatgattgttagtaaaaatttagcaagaataatttagtacgtgtaccggtgctcttaaaaaatcacctcaccacgcagtactgtgcagagtgcaggacttctcattttcttactttcttttcttttagggacagagtgcacgacttgacccaacctggagtggagatcagaaatcagatcgatcgtcctgaagtaatgtgcagtgcatgtattagaaaattttgaaggtaaatattattgttcgcctccgaaaatgtttacggtcaagtccacataaactaacccaaataattaactggattgagtttcctcagatttgccttctctctaacttatgttactgatatgtgggccttttacgcagcatgtacagcaccaattaatcgcagcacaaatgacttccttttttttttcattttgaaacagtccaagattgatcgatccagtgcgcaacattatatagcataatattgcgtgaattcttgatcagcaaactgccggcgatgtcttcttcactccagtgccccgacgacccgg

SEQ ID NO: 2082 - DNA, 1501 bp, Oryza sativa
aaaaacacatatgtaaaaattttatctacaaattatttttcgtttgcaaatataccgtgagatttgatgctttcaaatgcagtaatatattggcatgcaaatcgtttgcgatcgtgatgtccttctccttccacttgcacaactgatcccttttttaacatgtcctatgcatgcgcaaagctgttttctagcaaaccagcggctataactggttgacattcagaaaaacaaggacaagtagtacactgtatcctattttttataaaaaaaaatactgagcagtactccctatgtaaaaaaaatcaacttttgcagtttaaattttgtaaaaaaaaaccaacttctaccatcccacctactctcaacacataaaacgagaagttttatttcttaaataccttttacttacttatcaccgttactactttttcaataataataaggattttgattatttttacttctcactcaaattatcttgagatgttaggagtgttctttttatgggatggaggaagtaggcaactaggcatactgttaatatagatatgaaaagatacaggccgttcactgcactaggcatacaagaacacataaaacagctcgtctcaaagtataattgtgttaaacgtgagctgatctcaccgttccaaaattaaaatgaccacaaagtcaccaacatgttagtgttgcatagtttagttatccgtacagtactcgccaatcagaggttatcatgtcgtagcactattgtcaactagactggagaaggagaagagctaacggcaagtactatagttatttaagcacaatctcctagatgccatctaattttaaatgatgatgtggagaagagagtagatgagagagaggatgagccatccctcatacaagggacaacctctttacaaactttaaggaggaaggagaaaagagtgaggttgattggatgagagtgaataaaataaatatttatgttgcattgagactattatatgagctgtccttaataaattagttgatgatatggacaatattagatgtgatagtcatctctgccataaaacttgccataatagttggagacttggtggcattccgggggaacccaatccaaatccgcgacgaattcctctccgccaatacagtattcgtgtgtgccgaggagggaggcagttccacaggccaaggaacttacgtgacctccaaagtcagaggtcggaatctcccttcgttccagccatggcccaccacccttgcggcttggtgaccctactgcgccgccaagtcacccgctcgccaacaaaaacccgcgacgcgagcgcggagacggcagcgccggcctcccaccggtcgcgtaagatcacgcccgaaatctttattcattttctctccaccggttgccctctcgccgcacccaaccatcgcgccacgccgcgccgcgctgccggagccgcgctttccgctatgctataagagctgacgcgcagggcacagcgga

SEQ ID NO: 2083 - DNA, 1501 bp, Oryza sativa
actgcagtatccctgaaattatctgccattaatgtattatgtatcccctctgtgggcgactcggatgacacagcctcactgcatgatgccaccacacgcagggtagatttttattatgcctttcttttcgaccgggatatacacaaccactcacgggaaattctaccggcggccaattaaaaccctgcctaatccccaacccaacccaggcaagcaagacaaccaccgcgtgaaattctataaattggctaggggacctacttgccttggaatacgagtaagcggaggagctgaggcggcagcgaggaggcgacggcgcggcggtccgggggcggggcctgagccggagggcggggctcgcgacggcggccatgggcgcgggctgtctctcccggcgtggcgttatctgtagcagcggccagtggccgggcgggcgggcggctggtgtggggagtcggggagggaggggaggccgggagggcagcgatggtggcctggggaggcggacgggcgcaacgcaacgcaggcacgggacaagtgcggtgtggccggttggtgcgcgaacgtcgtcgcggactcgactcgcggtttgctcgcctcgcttcgcttcccacacttgcgctcaccgcctcacacgcacacggcaggcacggcacacgcgcacggtggcatcgtgctcggtgtttctgggccaagtttgcaccgcgcgatggggtaggccgtgtggaacgcaaatggtggctgcgctacacttgggctgctattccatggtttggtgggctctgattatcggtctttcgcgtgtgtatgggccgtatggcagcttagaagagaccttcgtctctctctcaaaaatgagagagtgtgcgtactggagttttacaaattactccgtactgtactacaatagactgaaatacaaagaagaaaaataattgagtattggttgacggacatactatcctactaatctactattcccttgcacgttcatgtgaggtctatttgcacacgggtttgttttgataatgctcatattttgaaactggcacagatccgtagattctaaactttgtgtatatattcaaactttaccatggatttcatagatattcaaattttgtacgcggttttttgagcgacaacagttgcagggtgttgactgactactgagtagggcatgctatgtacgtcgagtgtgaggagggggattgtccgtcgccaaaatatcacctcaactatgccgcgagaatgaagtcgcgctagttattttatactactcaactaaatcaaatgcctctctaatggtcatttagatgacgttttgtccaatactttaatttggtataatgatagtcctattttgaccgaacaaaagctgaagcttgacactgttcttcagacttcgaaagaatctgcagctcataaagccggagcactttcacatttcgagccactgttcccagcgaatcaacgactttagcaatagaaacactgatac

SEQ ID NO: 2084 - DNA, 1501 bp, Oryza sativa
cttggcgaagagcgcgtcgacgatcaaaggaattcgacttgtgacagtataccttgaagtaacttgtaggattcaagactttggtaaggactaaggaagttgaaaacttgttagtaccatcatagcctatttattgttttataagccacaaacaaaatttaattttaataaaatattaaagttaattttgtgttctttcttcttaaattttttttagccttggtggtcttttgaacttattagagatatggaaagttttacccttaaattgatttgtttctttctttatattttatagatttgttaatcttacgtgaacaattattatgtgcgatattgacatcctttactatgtggaagtaacactattaaattatttttcgccatgtttcatattaatcactgtatatatcttcacatacataaattgtttttttcaacagtactttttcttcgtgaaatacaataattgtaagcctatataggattgtgtcattatgtatcttagtttacttaacataccatttttaaaacgggttaagaaaaacagctaagattgttttcttgaggcccataagaacttcacggagcctagccaagtatcgtctcatagtcatactcgcatagtcgcatggtactgcataccaaatagaaaaagggacaagtgtcagtaatttggtgcggaataaatccaccaatcagctagcggcacatccgttaagagtattacatcgatcatattgattgtcgattagtacaccttattatatacacgaggacaagaaacctactgagtagaatctcgcctgctccaccattagcatataaagtttattttttttaaaaaaatactacctccttttcaagttataagacgttttaactttggtcaatcaagtcaaactgcttcaaatttaactaagtttgtagaaaaaaatattaacatttttaacctacaaatttattatgaaaatatattcaattattgatttaatgaaaataatttaatattataaatattactatatttatttataaacttaattaaatttaaagttgtttgactttgaccaaacttataatctgaaatggaagagtaatatctaaggcatcaacacgtttggcagctaccttccttatttatttattttttttgtcacactgcactcactggctgcacgtcatttgattatgcattttccggcccagcgatatttaattaagcatgtttttagcaaacttcttcctcgaccggcacgtccatcatcacacgtagactcagaaatctcgctcaaataaaattggttggtcggaaccagtgactaacaacaaatacatcagccaagcaggacaaactaatccaaccaaaacgatgcctctccatcgaatcctgcgggaacggaccgtttcacaagcctacttaaccaaccatgcttcgcagttgtcacagaacgtcaacagtgcgataaatgatagcaaggcaagagggaggcaaggcagg

SEQ ID NO: 2085 - DNA, 1501 bp, Oryza sativa
tttttcctgcatcgcatataatcggattcaattttttttcgccctttattttatcacggacgaacgacggaaacatattcaaccttttaagtagtagagatagagatgtgttagttaataggatggaccacctttactttaaatcctagctacgtcactgttaggggtgggcagaataagaccgaaccgaagaaccaaatcgaaaagaccgagaccgacttttagtaattcagtctcagccatcaaaagaccgactttttccgggcaattcggttattggctttcggttaaccaaattgtggcccaatagacctacgaggcccaataagcccggtaaaaacaaaaccctagagggcatcagggagggagtcacgcccgcgccgcctccaatcttatccaatcctcgccgcatcacgccgtcagcccgtcacgactccgcctccgcctgcattgcgccggtgccacccccactctccgcctccagctcaccggcaccgcctcctccctccgcctccatcgcgccggcgccaccgccgccgtgggcatccatcgcgccgcctccgtggctccgcctgatagcctccgcgccgcctccgccctccgcctccattgccggcgccgcctccgcctccatcctaccggccgcattcgtctccatcggggacgacgggaaggcagcgagcggctacatctgtggattttggcttcttgcgatgtactgtaagtattatgcttattgtttgatctactcctctgattcgaatctagtgcataattcggtcagaccgaaaccgagaccgagtttgccggtcctgagattttttggatgaaattcgatcctgagtttgcaaagaccgaaatgaccgaaaaaccaaaaaccgagaccaaatttttctgtctgaccgaacgtccacccctagccactgttatggggtgttttttttttcgctatattctcttagaactgtacatttataatttttatgctctctcaatacgaaatatcgtactacgttatgcatttgtttaagaaaattgttaatttcgaatttgcagtccagcaccttttggtacctttcgtgggatggtgggccatcgccgttctattctctgaagtcgttggctcaatattttacgagtgccaacgaagacacaggcactcatttcaccatctgacggcgatgaactcatgcaacgatggggtttctggtcatctggtgcatacacgtaacacgtcaggacaaccaccattagcatctgacagctaccctcccgaagaaaacaaaaaatttgtcacgatgtactaattggttgcacgcgatttaattatgcttgttttattacttcattaaggagaaactaatacagccaaaaccatatgcctctctcaaggatgcctcattgattctccatctgctccgttggactgttcacaaaatcgcaagcctatttaaccagcaacgcttggcacaccacgaactgcgacagtgaggcaaagagg

SEQ ID NO: 2086 - DNA, 1501 bp, Oryza sativa
cgccgtcccggctcggtagtgcctccctccagttccccttccctgctcaccctcgtcccctctagcttgcgtggtagctcggtaaccctgccgaacgcgcgtagacgccgccccaaggaccgccgccacccggcatggccccaccgccattgccgcccacccccggaggccgcctctcgtcgccggacctccacggcgccgctcagacccatccgaccccggaaatgagttccttgaacaccggagatgctcccgccgcctttaattgagtcctcgtcgcccctcggtgatttcccctttctctcgccgccggcagccgctgtcgaattccaccgccgtcgaacttcctccggcgaatccgagccgttggctcgctccttctcgatgccctcgtcactccggtgtgctccccgaagaccaaatccgtcacgcttgctccggtgaactcggccgccgtccgccgtccattcggccgcgcccccttcttcctcctctcggccggcctccttcttcttccctccgccagccagcgtggcagccacgaaggcaccacgtcggcgccacctcggctttgaccgcgccgagccggtcagccgccttctccctcccccaccctcgcgcgcgcggtccacggtgcgccaactggctgcgcgtgggccctccacctcttggtccacccgcgcgccgcgccgtgagccgcgtccgcaaaaccctagcgccctgcgccgcatgaacccttcccccatgcgccgagtcgctaactcgtgggcctgtcccgagacccagcacgatggatccggtccacccggacccatccccctctctcctcccgcgcgccccgcccgcttgggccgcgccttgcccggccatgggccgcctcctcgcgcccgcgcccggcccattggctcggccgcgccgtgcttatcccttgggccgtacccgagccgcccaaagaagtctaaatcccatccctccttccttttcttatccaaaggattaataaatccttttccctttttcataaatcaattccttattcccaaaattccacaaatcatttcctttggtcccgcgtgtctgtgactgtcaataatattcttgagaatattatttctataaattccataaaccattcctcttattccagaaattccaaataaacttcaaattcatatctcccgatccgtaactccgattgactccgttatacttccagtaattccgtaaaattgagatctatttaatggcactactaattagtctaaataggatccttcttttggtcctttgtttaggttttcgattttttgcgtatagttgcggttatcggattttcgtcgatcgcgggttttctcgaagattcgtgaagcttcgtgaagaccttgagcaaggcaagtcaccctttgatcaaattgcccctataattgaaaagtcattattattttgtttgcaacttgcattattagaatcacacacttaacttgcttggcctcggtttgcg

SEQ ID NO: 2087 - DNA, 1501 bp, Oryza sativa
aacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacccagggatacctcatgccacatagaaggatcaaatcctcacataaacataggccattttaggcgttcaccaatcaaactccaaccacctcgatcggtaattcagcaagcttctcgttcttgcattaccaggaacccggtttggctccaaccgaccccgccccggcgttcccaactattagcatgcgaggtttccctgaacagactagctacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacctatttcccaagttttcgacaaacaacggtgtatgtgggatatttggtatacgcgctcagagagcacaaataccgaggtaccacgagggtggagcgacaaggaatcagggtagtacgacctacggaaattagtgcgactactgggtaggtccgtcgatttggcacgcaaaccgaggccaagcaagttaagtgtgtgattctaataatgcaagttgcaaacaaaataataatgacttttcaattataggggcaatttgatcaaagggtgacttgccttgctcaaggtcttcacgaagcttcacgaatcttcgagaaaacccgcgatcgacgaaaatccgataaccgcaactatacgcaaaaaatcgaaaacctaaacaaaggaccaaaagaaggatcctatttagactaattagtagtgccattaaatagatctcaattttacggaattactggaagtataacggagtcaatcggagttacggatcgggagatatgaatttgaagtttatttggaatttctggaataagaggaatggtttatggaatttatagaaataatattctcaagaatattattgacagtcacagacacgcgggaccaaaggaaatgatttgtggaattttgggaataaggaattgatttatgaaaaagggaaaaggatttattaatcctttggataagaaaaggaaggagggatgggatttagacttctttgggcggctcgggtacggcccaagggataagcacggcgcggccgagccaatgggccgggcgcgggcgcgaggaggcggcccatggccgggcaaggcgcggcccaagcgggcggggcgcgcgggaggagagagggggatgggtccgggtggaccggatccatcgtgctgggtctcgggacaggcccacgagttagcgactcggcgcatggggg

SEQ ID NO: 2088 - DNA, 1501 bp, Oryza sativa
tttattgcttgagaagttaacaaacttatttccactttaacaagtcaaaggagatcaaggcgtttcatgcaaaaccctgaaaaaagatatattcgatcaaagtacacgcttccaaaccatgcaatcagatagattatattaccttaaacaaaaatatttctgcatccaaccgtgttttgaccctaaatcttctcaacaaagttcaaataataatttaaattagtgcctgagtatggattatatcccgtgagtttttcaatacaatgaggtcaaacagacttttcttcactgccctgtcctcgcataaaataaattccccgttctcaaaagttagatggcatttagtacttcatataatatgaattccttgttctgaaaagctagatagcatctagtagttcgtataaaaccaatcatcagttattggcagcgtatacaaaatttatccatattcatgctattaccagtgctcgcctaaacactagaaactattccccacacactcaacaggcattttattgaaaatctctaacttggccaaattcgtaatcgtacaaaagcagagctaagcacatcaacctacaataataaatcccacagcaaaccctataaattaagttctaccggagcacgagacgaatcacggtgcgagagctttatcactcgtctgaggattttatttctcgagacaagagagagagggggttcgccgcttaccttagggcacgagacgaatcgaagcgaggggaaggcgcatcgccacgctccagcggcggcgccccggcagcgtcgcctcgcggctccggccaccgggcgccgtccgcctcgaactccatggccccggggggtgtgagcccccccccccccccaaaaccctagctctgggctgcagccccctcccggggaaggcggccgccgcggagagctagggccccccgtatctgtggctggctgggaggtggaagcagcggttgcggcgatggggggctggtctagggttttgatttgggagggaaggccgccgcggaggaggcaggcggccggtggaaccgggcggggcggggcgaggcgcgggctacgtggggacgggggaagagagagagagagagagagagagacgggacgggagggacaacgaggagagagagagtgcccacaccggtttgcgcgatattatggaggcgggggagtgggatactggcgtgtggggaccctgtggtttagctgggacccacgtgtaagtgtgtggtccgtacactctgttgaattttttttatttataattttttttattaaaagttttacaaaaataattttccattttgaaaattgacggaaggagtcgcctaccgccctctgggaaaaatcgccctctcagagggcggcgaaaatgacgtggcagacgaccgttcgctctcgggcgacggccgtcaacgaaatttgcaggcggcccccttgccgccctccgctagggcgattttatactgtgcggggggccgcc

SEQ ID NO: 2089 - DNA, 1501 bp, Oryza sativa
gcccgaccgcgtccgtcggtgccagaggtatcgatcggccaatcagtcgcggtagcacacgagcagcgcgacgcagcggaagatgatgcggagcctcgcctcgttcccccgcgcgaccctgcagccgccaccgagctggctggcgcccctgcgcttcttcgccccgtggctcctggcgacgacgagctccatggtctccgcgcggcgcgcgctccttcgtcgctggctctctctgccgcgagagcgagtgagctagctagcaactactagcaaatgcgtccgcgcgcgagagccagctaattaaccgggcgctggcatgccaaaaaaacactttgacgacggtgtgggtgcgcgatggagtcggggctgcttgttgatgtgtttatataccgcgcggcgcgcgctagctctgatcgtacgtacacttggacggacgctggaaggttcaatgtaggtcgcgctaggcgctagctaggtgcagttccagtgcagctatcgagctgtacgtacgtgcaatgcgtacgtacgacgccttgaccgtgggtagctcatggtgagttccgtgcaaacgcatgcaccaacctgcaaactttcctggcccgatccagcaaccagatggatcatcgatacgtcggctcgtccatccggcatttaaagtcaaaccgcctggtgcttgattattaacgtccgttcgttttgttcagggaggttagaaacagtccaggatacacgatcggatcctgcagctaatgttgccatccgccatcggccatccgatgccgggtatgccgatacagccgtcaacccgcttgttgttcgtcatcgctgaccaatgcgtcgtatcgcgagccattaattaccttttctttgtaggtttgcgaatacgtcctgtctgcttccatgccttgaccgagcggcaagaatctttttctttcatctgcagtgcagtgcaatcaaccatcgatctgaacgttagtatcagttcgtcagggttgctatgatacacgtctactccctccgtcccaaaaaaaaacaaactctggttttcgtgcccaacgtttgaccgtccgtcttatttttaaaaaatataaaaaaattaaaaagacaagtcacgcataaaatattaatcgcataaaatattaatcatattttatcatctaacaacaacgaaaatacgaattataaaaaaatttcatatgagacggacagtcaaagttggacacggaaacccagagtttgtcttttcttggacggagagagtacacttccatatggttctgaaaatttaaggagcgcaactaatccagtatatatataacaagccaccggccctatccaagttactctttgactggccacacaataatacaatggtcttgtttggatgctccgagctattaaatagccctccagaatcttgctatttagaagtattaaacatagattaccgataaatccgattccataacccctaggctattttgcgagacgaatctaatga

SEQ ID NO: 2090 - DNA, 1501 bp, Oryza sativa
ggcgagcggaagctcttggcggtggtgacgacttgggtggtcgggggctcccttgtcgatttctccctacctcccttttaccactacttgttctagaagcttctggcaccttccaccacttgtatcttcctatttgttccccatccaaatatctcctatgtactagactttgctgctacttgtacggctagattgttagttgagttggtgctgagattggttgatttgggttgctagcaatctggtgtcagagctcaccaagcctaccaaacaagctaccatggcaagtgaggataaatttgacacgcttttgaggcggattgaggagttcaagtgaaggcgggtggaggcagatcagacgagcgctgatttgctatctctcaagacggtggtagaagcgtggatgaccaaagtccagaagaatgccgaagacttgcaaaattcggttgggacaagcagtccaaggtgacgcccaccatgtgtttgacaaaatgctctagctccgacgtcaagcccaattcccctattgtttgtggtggtcacgtaggccacgactgacacgacctctatggaactagtagttgttgagaatgccatccgtgcaatctacatcgacaatcgttactaagtaactcgttgatcagcgagtggaatcatgatgagcaactcgttgatgttatcatagatgaggcctttcacagtgctctaccctggaccggtgctatggggcgacacggaggattttgtccgacatgtcgcgtggaaccaggaccaaacttggttgctcgtccccaagcagagcaacgcgcaaccttgctcggtcgaatccacgcgccgccagaaaaacacgaggagcgagcgctgtgggcgtcgatgcttggccgcccgtgacctcgcgcacgcagcactcggagaaattccagattcgcccacgaaaaaatcccttcccgcgcctgcgattcatcctaccgccaccgagtccttttgcccgcgccggcatcggccttgccgccatgaggacaaaatccatggcggcctcggcatcgattggaatggcgtcggagcagctaccacccatctcaagaacccaaatctcactcacaaaggatcccccattcccacaagaaatcaaatctcattacattacacaaaaccaagaaaagattcctccactcccgtgccgagatccgacgccgagctaccaacaaaatcacaaaagaaaatcaagtcacacaaaatcacacaagaaaaatcaagaacacagaacgccgaggcgaggcggcggcgtcgaccacgctgcccgttcttgagccgccgccaagaacgttgaggaggagcgcgccctcctcccggtcgccgccttggccaggtcaacgccgagctctgccgccacgcgcaccgagatccgccgctgccaccgccacgcccctggccgcgccgacccctccctgcctccgcatggcggcggactgaagctgctgccacccctgagcagaaactg

SEQ ID NO: 2091 - DNA, 1501 bp, Oryza sativa
aacgggcagcgtggtcgacgccgccgcctcgcctcggcgttctgtgttcttgatttttcttgtgtgattttgtgtgacttgattttcttttgtgattttgttggtagctcggcgtcggatctcggcacgggagtggaggaatcttttcttggttttgtgtaatgtaatgagatttgatttcttgtgggaatgggggatcctttgtgagtgagatttgggttcttgagatgggtggtagctgctccgacgccattccaatcgatgccgaggccgccatggattttgtcctcatggcggcaaggccgatgccggcgcgggcaaaaggactcggtggcggtaggatgaatcgcaggcgcgggaagggattttttcgtgggcgaatctggaatttctccgagtgctgcgtgcgcgaggtcacgggcggccaagcatcgacgcccacagcgctcgctcctcgtgtttttctggcggcgcgtggattcgaccgagcaaggttgcgcgttgctctgcttggggacgagcaaccaagtttggtcctggttccacgcgacatgtcggacaaaatcctccgtgtcgccccatagcaccggtccagggtagagcactgtgaaaggcctcatctatgataacatcaacgagttgctcatcatgattccactcgctgatcaacgagttacttagtaacgattgtcgatgtagattgcacggatggcattctcaacaactactagttccatagaggtcgtgtcagtcgtggcctacgtgaccaccacaaacaataggggaattgggcttgacgtcggagctagagcattttgtcaaacacatggtgggcgtcaccttggactgcttgtcccaaccgaattttgcaagtcttcggcattcttctggactttggtcatccacgcttctaccaccgtcttgagagatagcaaatcagcgctcgtctgatctgcctccacccgccttcacttgaactcctcaatccgcctcaaaagcgtgtcaaatttatcctcacttgccatggtagcttgtttggtaggcttggtgagctctgacaccagattgctagcaacccaaatcaaccaatctcagcaccaactcaactaacaatctagccgtacaagtagcagcaaagtctagtacataggagatatttggatggggaacaaataggaagatacaagtggtggaaggtgccagaagcttctagaacaagtagtggtaaaagggaggtagggagaaatcgacaagggagcccccgaccacccaagtcgtcaccaccgccaagagcttccgctcgccaattgatttgttcgatgatttcctggaagtgctgctgcttcttatgtatagttgtctcttgggttcgcttggacttcttgaaaagtagatgatccactccaagttgcagcccagctggttcctattccctccgtcccaaaatataaatatttttgaactctgacacggtcttcaaaatgttactttgaccaataat

SEQ ID NO: 2092 - DNA, 1501 bp, Oryza sativa; identical to SEQ ID NO: 2089

SEQ ID NO: 2093 - DNA, 1501 bp, Oryza sativa
tggccggaggagggatgggggaggccggcgggggcggcgacggcgacgaaggcgcggggcggcggtgaagacgacgacgacggcagcggctcccctcccctctcagatccggccggggagggcggcggcggcgagccgcgtgcggcgatttttttgttcgttttttttttttgcattttcgcaggcgggccgttgccccgactgctaaaatcgatgattttcacagtcgttgtgatgcaggcggacctccctcccgcctacgaagattagttttggccacctgcgaaaattagttttctagtagtgtatgcctcacacatgtatttatgttaggcttgtatggcttctaattgagaaacaaacaatacatgtgatgtattttacatgattttcaccatcggaacaagatggcgactcatttaaacaatttgtaagataagtgactaaattgcacttatatcacaagttgtgataccacagaatacattttactcaaagaaaaatcagtgtctttatatgcataatacttcctaactattctatctatcctaaaattaactactagtcatttaggattaactacctagttatagttatattcaaatttgtaatactagataacgatattttaagatgaagagagtatacatattttcttaaattagtctaagctatttatatctgttgagttctttactactacttccacccaacatttcaaacatttcaatttgaagattgtccaagaatataagcattcatacactactgcttactctcagttaaatttatctcatcgtactcccaaccaccttttcaccctaactctctctcgttaaatgtgggccgggcactaaaatcttttttcttcaatcttaatctttgctaaataatctagaaatgttcgatgaagggagtagttagtttttgttgttatgttaacgttgataaaatagtaaattaaaaattaaaaagatgatactccctccgccacaagccgtatgttgtctcgttacggtcaaaatttgactaacgattatcctattttgatatactttttatgacgtaaaattgatgttgttatattcatatttaaaagtaatttgtatcatattgatatattagtaaagtgattgttttaaccttgtcttagattggcatgttagaattgaggagatggctatgtttttaaataatttgtggcaaaagtacaattttacccctacacgtctatatttttatggataatcatacctcttcatatttctactattgttaaataaggttatagtataaaaagatctgaactctcaaataaaattagatttgtggttcagatcgattaacttctactactagtagggagtaccatggtaggactcaaataaaatacgttatatttatatgaagtagtgtaaatgagaaaaaacttgttctaacgagcttagctcaaccaaatccgtcttctatcagtcaatctagaaggcctgggtgccaccca

SEQ ID NO: 2094 - DNA, 1501 bp, Oryza sativa
agtgtggagtgctgacgttggcatggggagctaagtaataatggtattctataagcgtatataaaggagagagagaaaaaaatcaggtcctatgacttagttcttcacatacttaaatgtagatgcaccaaatataatagaggagaggaagcgagatgagaaaaaagagatacaccattgtagctcatctattatgtaccctctctgtcccaataaaaaaaccaatccttccaggctcgtagctagaaattctttttttttacgtagtagtatatattagttgtaaaatgcgcttataccggctcctgagctgccaccgacctcgttaagcttgcgagttgcaactcggcctcgtcgagcttcgacctgccacttcgagagtaccaccggcctcgtagagctccctcgctacaccccgatcacatcaaagctcctaacctgccacccaaagccatcaccggtctcatagagctagaggaagttgacgagggataggaaataagaagatactccctccgtctcatagtataagaagttttagagttggacacggttattaagaaatgtaggtagaagtgaatgatgaagcattgtgattggatgaatagtggaggtaggtgggaaaagtgaatgttggaggtttgtgattggttgggaggagaatgttggtagagaagttgttatattttgggacaaatcctaagagctaaaaattattatattttgggacaaatgaagtaataactagtatgagcatttttggtccatatagaaatacggtatgaaaaaaactggtttaacaacacctcaaacacatataatggcataattcaaatttttaaaaataccattgacacggagccggtacaataaataataatgtttttttttcattacggtaaatttgtataccatgaatccgatcaacccaaatatattttgttttctggattattacatgacatgaacatgcatcggtagattttactaatgaatactttaattgtagtggaaattctattgagttaccatgcatttgcagctaaaacaataacaataaatgtttgtatctaaacaaccaaattgcaaattaaacaaaatagtatgattttgcggagtactacccaaatcagtagccaagaccgcactgtcagtctgtcgccctccaatccgttactcgtttattcgtatctcctcccaattattctacacgtttctttcaaattaaaatctccctaaactctgtcaaattcacggtgttttctggaaagggtggaacgctagttccgcaaaccagccaagcaagcaaacgtgtgcctctcacggcgcccatctcccgtccttaaataaacgcgtgcgccgaagctgcttctccccacaaaattttgtgtgtcctcatcccccatctcctctccaatactcgccactaatttcttctctctttctctctctctccgcgccctcgcatcgcacgtgaggcagtcgagggatagcggcgcaa

SEQ ID NO: 2095 - DNA, 1501 bp, Oryza sativa
actaatcaccacccacatggcgtcggccttgacgatctcctggcagacgtcgtcgccgacggcgagctgctcggtgatgacgcgcagggtggcgtctgaggccgagctcgccgtcgtcgtgctcgatggcgcgcagcatcaccgggctgggccacttccaccgcgcaaagccgcggaagaagcgcgggagcagcatgctggggatgtgttggggtagagctggcacatgcgcgccacgaggatagcccagccgatgccgccgaggaagcccgcgacgttggagtagacgccccgcgccttagcccagtgcttcacgcaccgcagcatggtgcggaacacggcggtctccgggacaagccgcaggatctcgtcggccacgcggatgccgttgaggctgcgcgccgtggcaaggtcgtcaaggccgcggagcaccgaccggtcgcactgaggtccactccaggttgtcgggcaccacgggaggcacacgccggcgtacacgagatccacctgcacgccgcggaacctcatctggatcaccggcaagggatgtggcggtggcgggagcggcggcggagtccgtggtggtggcgctgctgtagagagaagagatagaggaaaggggatagagatgaagatgccgagagaagaggaggaaatgaggagtgacgatgacaggtgggacccacgtgggtcccaccatttttatattattttatgtgtgcaacttacatgtgggtcccacgggttttattatttttccggatcgaattgccacgtcagtgccacgtcatatgaagacaagtcaaattagccacgtatgcgccacgtcagccaaaaccactgtcaaaaccgccaagggatctcgtttgcctggtttcgtaagttgggggacgggtcgtgcccggttttgcggttcagggacgaaaatcagactggacgacaaatagagggacctaaagtgaacttattcctcgaagaaacggggacgctccggcctcgtggcctcctcgtcgcaacgccccggaaatgtcaatgtggaccagaaattttcgcaaccaggatcctgctggaatttaaaatttggaacaagttcactcttgctccctcatcttgacgttgagtttgagtttgaattacatcaccgaactgtaatgtcagaatgttgaacccctgtctttcaaaaccaggttaaataaaatcataagacagtatgaatggctgttttgattggcgtggcatcctaatcagaaagaaaaaccatgtgtggctcacatgtaagtggactaaagaaacaagctctcgcgtcgtcttcccctgggggcggcacgggaggcggcaacccggccgcccctcaccctcccctcttccccctccgcctcgccaccgcccgagcggccgccggcaaagccggccggccgcaagggcggcggcggggcctctcacgtcctctctttcgggcgggcagggggctgtcctaggcgaagcagcggtgaccgccaga

SEQ ID NO: 2096 - DNA, 1501 bp, Oryza sativa
gggctgccatctaatgtgggtgacttacatgtgggcacgattttgtaagtaggttggacagatcgtggctggcttgcttgagtcgactcgtttcatttttgtgaagagctgagctcatgttttaattagttcgttagagataacaaaccagctcaagctagctcgcgagctactcatgagccaaacaaggtgaaggtctagagcacttgccgcagccgctggtggtttggaggctcgtgcttgttgccccgcccctcactgtactctattggccttgacctggttgtactacatgcgcatgctgccgcgtgcgctctcgccgccacttggatttggcagctctctgctctacttcccatcacgttgtggcgcctgcgctgcatgtatcgtcatccgttgactgttgtccttcttcttcccgtccaagacgacgagatgcggaggatgacgagtccctgtttcgacagaagactggtgagcttttgcgcgtcgtggagcctgttgcttcggtgaggtcggctggtgctgccaaccatgacgttctccttcttgtttcgctcgccatccatttgcgctgcccactagcccctcctactcgtgcgcgctcgtggagaagatagggcatggtgctctgcctagtagagctcgcgagctagcttgagccgagtcgagctaactcattatcctaacgagccgagtccaagcccgagccagcttgatatccaccctttgatgtgtaaggctcaaatatcaatcacttaaaattaaaggataatattacagaggattggtttccatactccatatgaatagctttcgacgagaaaaaataaaatgaagcatggatgcacgctccttgtctaaaactgtgtacaaatgaagaggagcctatctgtgcatatgcatctaggatcataaaatactttccactagccgagaaccccttttatttgcgactaaaaaagatgacaatctttcttcttttctgcaaaaaggtatgctaatatatctggcggtcgttttcctgggcttagagtatgttccctgtcaagcagtgatcgaatccataaagttttgggtaattagttttcagttctgcctttacacttattgttcccatctcctttacgtacttttctcgcctccttaattttccttgcctccttgagcgatcaacatcgatgagatcatctttagcttgccatttcaaggagaagagatttgcggctcggccataccatctctctttcagggctagcttccctggctgcacagtttttctgacgagacagaaacgttgcacaagataaattagttacttccaggtaaagtaattattaccaggccgacaactgaaccggtaaaaaccaaaacgagggaaaactccaaaaccagcgcctctatcgatcagtttggtgatgatttttttttcctttttgaaaaaaaaatcattcacaggtctagctttagaggcaaagtaagtgtactcaagtaaactaaa

SEQ ID NO: 2097 - DNA, 1501 bp, Oryza sativa
gaaacggatggctcgggccttggtgacattgtcggcctcgacgcctcggcagtcacaacaacgacgaccatatcctcctcctcccttgcccttccctctcccctaccagcggcaatagctgcacaagcacgagccatacaccccccgccccccgcccccgggtgtccagcgttggagatcaggcgaaggtagaggccaaacacgtgtggtgcagggcgcaatgggagtcatcgtggccacaccacatgatgcgacggctccggtggaggacgagcgtcacctccaagtctttcggcgttgtggcctccacaacaccctgtggagggctccaggcaccatggagacgctcgtttgcatctgttgtggctgtcgaggcaggctagcatgggatgcgcatggagcttgatgatggtggcgttggcttcctcgcctgcaggcgcggtgaggtgctctccacgcaggagctggcctcgtgctagcgatggccaaccggtgggaggcggtcgtggtggtggaagtcgcctcacacagccacaaacgcatcctctctagttgctcaccgctaccgtcgctttcaaggaaacggctgccaagctcgagctcatcagctccttttcctcctccgctgtggaccaccgacaccccttcgccgttgacctccaactaccgcttccgtctcccatgacagactcatcggtcgttgtccctctcctcatcggcgagctcctagagaagagacgggagagttgaaaataggaaagagtcgataggtagaagtccacttacattttttttggaacgactcacacgagacggtgcgaggttctattgatagagtagtaaaaaattacaagattataaccctagagagtcataactaggaaaaggaaaaaaataccaccacccacacgccgacatcgccaacacacacgcccaggagaaggctaccaccggatcggccgccgctaagcgtgaccgactgccactagaccaacaaagggcacagacgagatcgcccctgcgaaaccacggctgacgcaccgatgctccaccaccacacaagctttgccgacatgtgggaccccctcaccggcatcccccgccagctagccttcgtgcgccgaagaccgcgccacacccaccggcagctcctcctcacacctaggtcgcctcctccaccgccggcagtgcctcactacgccaaaccggcctcctctaccggacgcgcctctcgcgccaatctggcctccctctaaccgtcgcacctctcgcgccaagccggcctccatctccgccgcccacgcctctcgcgccgagccgacctccgctgccatcggttgcgtttctctgcaccaagccggtctccgacccctccatcgaacggtgccacgccggccagatgcggacgtctcccacgccttcggctagtcaaccgaggctgccatgcctccggtgaccgtgaacacggtcaccaccaccacagccgctactgccgaacacc

SEQ ID NO: 2098 - DNA, 1501 bp, Oryza sativa
aggaccaacttgaactttcccggcccgttgctctcctgcctcaccttcctcgtcccacaccaacttatcatgtgaatcagaaacctcaatttgttcgataatttctttcaggtctccccactctaggatttcttccgggccaaaggatctcctgaatgtaaggcagtcaggaccctcctgattgagatggctgagtaacagctcttgctgattacagatcctaaagatagcagggaaaagagtttttaaaggacaggtgccccaccagacatcctgccagaagctgatactctcaccattacccaaaacccattcagagccaaaactcatccacctcttgatattaagaagacctctccaaaattgggacacatttccacccttgtgttgaaagaaacctccatggactagatatttcctccttaacaactcaatacacaagctcttatcatctgattcaatctttatgatccatttggccaggagagcaatgttcattttccttgtttctgtgaaacccaggccactaaaatctttaggaaatgccatgtcttcccactttactatgtgatatttccctttaagcttatttcccatcctcctctgaggatgggaaggtagtaaaagcaatttttcccgtattgtttatcatctccgtacttttacaatttgtagacttcatttgaaatcaaacttatataaaacttgtagatctcgacgagttctgtaccttaaagttgacaaccttttcatttaagattatctaggggctaaatattcgttagaaaatctcaaatcaattttttaaaatagaatctcatacatatctatatttcaaatgacctccaatgaaaacctcaagtaagcattacaagtttttctagcaatgaaaaccggcggtgaggaactaaatccaaattaaaaattaaatatgagcccttccctttcctttagtagggtaatttttaaaaaccatcctcttaaaggcaggaggagtatacttctatacttttataaaacacatatttttaagtcaaacaaacaaataaataattcaaagcttgaaacatatgttgtttttgggtggggggggggggtgtttaagactggcccctccgttctttgagaactctttttaaaaaaggatatactctttcttcttcatagatgaaataatgtagaaaatgatgtattataaacttggataatcttattgtattttttttcctttcattaataaagttcttttactgcgggggcttcccacagtgctttggtaagaaaaaaaaagattgacccctccagtaatcatctgctaagtgattcataactgcgtagattttatttttagaaatagctatacatccgatccatatgtactggagtacttacatccgatcagtactacatgcacaaacacagttgctgcttgcccgagcccacctgcagataagcctaaccgatgattggtggatacggtatgattgtacgtgggttgtac

SEQ ID NO: 2099 - DNA, 1501 bp, Oryza sativa
cccataataaatatagccgtagatatccgtgtctaacatttaactatccgtcttatttaaaaaatttataaaaaaatttaaaaaatttagtcatacataaatcactattcatgttttatcatctaatatcaataaaaatactaattataaaaaaattcaaataagacaaatggtcaaacgttgaacgtaaatagtaaatagtgtaaaactatgagccggagagagtactactacatgcatgggccaggcggtagcaagcagtggcatcggcggcgcagcttggagaggccctctctgcttgacttcacatctgttcccttcctttgggcgcgcgcccggccaggtgcctacgaatcctcgtctcccgtacttctggagtacgactcgtggcacggtttcccgcgctactaacagtgccctcttgggattttatggcaggcgtacgtggaccaataagaaggttacagtgccttgggactttcagaatagggcgtggctaatggttttcacccgcccatcccctatacgcccctttcctccttcctcctccccttcttctctcctactacaccataaatttaaaaaaaataaaaaaaacaagttagaaaaatttatgtatagaaaaactatatataaaaaatatttgaattcaaatttaaatttaaaacgggtatgtaaacttttgacttataaactttgggtttataaattaatatttgaattcaaattcaaatttgaatcgagtatgtaaacttttgccttataaattttgggtctataaactttaggtgtataaattttagatgtatagaaatactatatataaaaatatttgaattcaaatttaaatttgaatcgggtatataaacttttgacttgtaaactttgggtctctaaactttaggtgtataaactttagatgtatagaaatactatataaaaaatatttgaattcaaattcaaatttgaatcagatatataaacttttgacttataaactttgggtctctaaactttaggtgtataaaatttagatgtgtaaactttaggtacaaaaatttactaaaatcggaaagtaatacagtgacaaaaaaggaaaccatgtggaggaggggggtgattgctaggggcgatcgatcgcccgttagcctattcgttcagaatatattaagggagatgctgtttatatgaggaaaaaattagaaaaagaaacggaatcgctataaaactttgcaacatatctttcttttaaaaaatatcgattatttagtcgctggattcattccatgattcatacacgagatggaagaaatcgcactagctagtggccgcacaagaaaatgtcgtcatcgcgtgcggtctcttaagtggaccgcatacgatgtgtttgcactattgtgtgcggtctattaataggaccacacgcgataatacgtctacgcatgtgacatggttacggaaagggcataacttctattctacgacttatggaatactccct

SEQ ID NO: 2100 - DNA, 1501 bp, Oryza sativa
gttgtcgaaacgacaactgcatacgtcgaaagacgtggttactcaacagtggttgaaagtaaagtgtattgattagagaatttttcttggatccccctattacatggccctatgagactatttatagcccctattacaggttcttactactagggttttggttatacaggggaatttacatggttacccttatgaaagggacatttacatgggtacatagtgtaatagaggttcatggactcctgatgggccgttaggcgatcgtcggcccaatggcccctaggcttgatgggccgggaaaggcttcttcggccctcgcgggggcaagcttgctttggcgaagtcgtctccctttgacatatactcttcgccctacatccttcgcccaagaggcctccggcttagtagagtacccgcacgatccttcgcctctcgccgtccttgttccatagtcttcgccatggggggggggggcttcgccccgactaactttgacgtctcgggcttggatccccacccctcgcataaccttcggcagattttggtcgaagggtctcatgccataccgccaacacctcccataaacattgccaaagaccatgtcaaatacatatgtaagagcattgaagtccatggaatcgcgtttaggttttcttccagggcccagcccacagacgtggatgtgctagatttttggcccatccgaacgagccgagtagagatccccacggcccacgatctctctcgttccctaacggcgatcattcccaatctgtgagcccttcttcctccgatcatggccggcaaacctcaccggcggccagcccgccccggccatctcctcgagaatttttttcatttttagatttttttaaaaatatttacagaaataatctatcggccaaaaaaattgcaaaaatagaccctaccgcccacctctggggcagcaagctgacgtggcaaacgggggagggacgggcggtgacggagggagggttttttgcagtaaagcccttgccgccaggggcccgaatgcaaaaaagccagtcggggccggccattttgcaggcggccccttgccgccctctggccgggcggcaggcctcgctgcctataaaaggcctgctgcccagcccccagccctcattcctccccctcaaatccagtgaaaaaaaaagaagaaaggggaggagaagagaagaaggggcgaagccctgccggattcagacgccgatttcaggtaatattcatagatcctatatgtgactattgagttaaatagtgtgtattttttaaaactttgtttgaataaatacattatatttttagggttttagttgtactaatctagaagtgcgtattgtagatatcggtaactacgtagatctgctagtttggaattaatactttaccgttgcattggcatacacaagaagatattgcgttgtagatgtttattgcatgaaagagtaatatgatctagttatttcgttgacagata

SEQ ID NO: 2101 - DNA, 1071 bp, Oryza sativa
  unsure (1)..(1071): unsure at all n locations
gcgagttgattgatgaactccatattgtacagnagtctcatcaacccccaaatgagcaggtacatcgccgtgtagaggaggtccatgcggagcgcgttggcgaggaggagcacgaggtgctcctttattcccgttgaacccgaaggtggcgctgagctagtcgaagatgttggcgcggagcacgtcccatacgagggctagcggcagcgccgggaagtctgacgcgtgcgccactgccgcccgcatctcctggacctgcagtgtcgggtggtcccagatgagcaggtacaacgccgccctcctcctctctcactggccgggcaccgccccttccccgtagctcgtcccccgccgccacctcgtgggcggcggccggcaggggagcctacgcgccggccctcccccggccgcccgcgtgccgtcgcgtcgccggtcaccggtcgccggccgccggtcgctgacgccctccttcttttccgcctcgcattgccagcctcgcagtcgcagagaacagagagagagagatgaggatgggagagaacagaggaaaagagagagaaggctgatgtggcaatgctgacatgtgtagcccacatgggtctcacgctaactcagccgccatgtggaataaaactagggtcaaaaccaccggaggatctaaagtgaacggttttattagttgagggatgtccagtatctggttctgtggttgaggaatgattttgtaactcgatgacaagttgagggaccttcggtgtaccttttcctttcctaaaacctctaggcccatgcccatcagagtgggcggtcgtcgggactcgggacgtacgcttgggcttcaagccgggagagtgcccaccggaataaaccggatcggcgcgtgaggcatcgcaacgagccgcgagcaacaggagcgaggcggcgcacgtcggtggcggggtcgctgcagatcggcaacgaggtagcggcagtcactggcgctctgtggattttaagtttctaaaaggaatcgattttgattaattgagcaagggcaaacctgagcgaaccgctctgccgcttctccgatca

SEQ ID NO: 2102 - DNA, 1501 bp, Oryza sativa
aaacagatcaggtcgtcgtcgttcgctgccggtggtggcttctgaaagcccatctgtgacagcagctcgtccctcaccagcgtgtacgcggggtccgggagcatcgtaagcgtggtaccggagtcgaagatgacgccgcccgccccggtgctccggtcgaaggagaaggtccccgaaggtatctgcacgagcttcccgccgaccgagatgccggtcagaccgacgtagtagaacggaaggtcctgaaccaccgggtttgtgagtagcggagtggacatgaaactgtcgccgttgccaccggtcacgtcggcgagggagccgaacgagatggggctgggcgcggacaggtcggacgagaggcggtagccgaaggcctcgacgttgagctgcgtgaccaaggacagcttccctctgccgagcccgacgaggcccgagcccgtcccgaaaccgccctcggagcggagcgtgcacccgaacgcgatgcccgggaacgccgcggcgtcgtcgccgaaggtgaaggtctccgtcatgaggatgccctccgtgtagtggtgcgtgtccctagcgttgccgtaggcgtagtggtaggagcagttgccgctgccgctgccgccgccggcgacgttgctgcacagtggtcggggcagctccccgcacgtgcggtcgccgcacgcgacgaacgcggcggagctggagctggtggggtagtaggacggggagccccgcggcgagcaccgcgcgcaggcgccgcacttggtccagatgaggtcgctcccggtgtccgcctcgcccgacagccccgtcgccggcgtgccgatgccgaacgacatggcgtagtcgccgctccccttcttcagcggcgtctgcgcgctctcccccggcgccgcccccgcgttggacaccgctctggcggcgagcatggacaggcgggagcgggagcgctgcacggcgcgcgtgtagttgatgcctgcgggctcgatgcggaccaaggcggcttggaagctcgcgggaggcggcgtgggttggatgccgccgtaggctacgcgagtagcggaaatcagcagtagaagcgggagcatgagagcaagcgctcccaatttggtatccatattacagagagcgtatggcttgcaaatgcatgtaatgtgttatgcatgaggtgatctggacgaatggagttcgatcgtttatataaacattggggcatggatttttatttcttccatgtcttctaaatagttattaaatttaaaaaattaacaacatatacagattaatataaaatatatcactccatgaatatacaaaactgaaatcaatttctacaaattgtaaaaaacatgaaataaactgaaaataattaacgtatattcgtagttagtatattttttatacaatttatagaaattaaattttagtttgcaagtttgtggagcggtatatgttttatagtaagaatcttgtcattttttttaaaaaaatgataactgtttaaatgata

SEQ ID NO: 2103 - DNA, 1501 bp, Oryza sativa
cgaaggctggcccccaggcgatgcggaatcgacagcgggagctgcgggaagacggcagccgctgtggccgcccgcgcatggaggagaggtgggagccagagagcgcgagctcctcctcttccgcgacgccaccggcctcaatgctcgatctcaccctcctcgcggcgttagagctccgtctaatattcttgtcgagatccggccagagtagcaccaagcccacgaggccaagctggccatcgtcccgccacagctcgatgagacgatggtgctcctcgattggtgagctcgagccggcggccagatgcagagcggaagaggacgcagagcacgtgctacgacaagtccgcccggcggccggctgtgtccggtgttctgtgttcatgtgcgctcctccatgggggaagccgccccggtgtggcgtgcaaccgcggggaagaaacaggctttcaattttttgcagcggctgcatttttcgcttgatttcgtgctaaaattttctgcttgttggaattaatgaatgggccttagcccattcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacgcgcgctcgctcgcctggcctggcagggcagggcaggcggcgcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgctcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacaatccaaaaaccttattataggcactgtgattttacta

SEQ ID NO: 2104 - DNA, 1501 bp, Oryza sativa
cacctgtcgatctaccacacatgtaccattgctccaccgccatccaaaacctccgccggagcgtaggcaccactgcaccggcgccccccgttggccagtctctgcgcgttgccaccggtcgcgcctcaccgggccactggcctctcctcccgccgcaccagccactgcctccacgccgggcagcctcgtcgcgctgcaccagcaccgcgaccgcacctccacgcaccacggccgcctccgctgccaccggccgagcctcactggcctctgctctcgccagtcgcacctcgtacacgcgctgcctccgccgctgccggccggccggctagccagccgacgctcctcctcccgccagcgccgcaccagccggctcgttcccgcgcctccacctcagcgcctgcgcctccgcttccgcacagctgcaccaccgtctccgcacggccaagccatgccgccttcgcctccgtacggccgcgccacagcctcgccctcgccggctctgcacagccgcacccgccgccttgccgcctggggtcagggctcggcctcctgctccggatccggacagaagggggccggatctggccaccccgccgcccccgcgcgcgccgccgccggctcggggcaaccctcgcgccagatccgcgcagcagacgccggatccagcagcgccgcctcgccatgtcgtttgcgctcgccgtcgcccagcgcctccgccgcctcgccgtcgcccagcgccgctgtcgccgccccgaagataggtcagggctaaggctaacgccgcgaccttgggggagaaggccccgccgccgccgtccttgcggccgcacggtttccggcagcccgctcgggcggtggcgaggcggaaggagggcagcgaggggtggtgctgcggcagcggctgagtcgcctcccgtgtcgcccctgccctgggagcgacgcgggggcccccaaaagtgatgcgtttggatgttcaagctacgtgagagtcacgatcctgcagctgttctggctgtttggataccgacgcattccagatcatcccctgttgccacttgccagagcttcgatggggcgagtggcatctgggagcaaacgaggtctatgtcgtcttgaacctgtggtgtatcgctaagtttgctcgtgtttatttggttcagtactttaccaattctttgatagtacaaaaaatagaggcgattttggcactaccataagtttataatgtcatgtactcatgtttggtttacttccaactagagccgaattgtgatactatagtgaagaatattccggattactaccaaatttaatatgggcataaccaaattagttggctccaaatattcaagctaccaaaatatgggcaaatccaaaacagcccttcataacctgtccagctgacctcccggcactgatggagtatattgatcggagtgatggtgtccgtgaaacgtggtgagctgaacgcctgcaccctgctgcaagtgttctgcacagt

SEQ ID NO: 2105 - DNA, 1501 bp, Oryza sativa
tttttatggaacatacttcctccatttcacaatgtaagttattctagcatttcccatattcatattgatgctaatgaatctagatagatatatatgtggaaaatgatagaatgatttacatcgtaaaacagagagagaagttagtaaatacaaaagttttaccaatatttttccttgctaaacgatgggatcatatgcgagcatcgattgatactttgtgatacactgataagatgcaaccgtataggcctcacgcagtaacactcaatgacggattcaccgtgaggtcgttgggggtctcgagcccccaatatcggtgttacaaccgtgaagcctccattaaaattaactgtcataatccattagaagatgacaatatagtgttcgtctcaaaatatagcaatttttggatgcatgggacatatcctaataatatgaatttagacatgcctcctatccagattcgtagtattaggatatatcatatccaactaaaagttgttatattttgagacgcaatgagggcccgtttagttccccaaatttttttcccaaaaacatcacatcgaatctttggacacatgcatgaagcattaaatatagataaaaagaaaaactaattgcacagttatggggaaaatcacgagacgaatcttttaagcccaattagtccgtgattagccataagtgctacagtaacccacatgtgctaatgacggcttaattagtcttaaaagattcgtctcgtggttttcaggtgagttctaaaattagttttttcattcgtgtccgaaaaccccttccgatatccggtcaaacgttcgctgtgacatccaaaattttacttttccccaactaaacaccctgagtagtttgttcagtttgttctgttacctctacctgttcctgtatccgcccctggtcacagtgccccttgctaaacgacgggatcacgggacttgggagcatatcgattgctactttgtcacacgatgcgagcgcacaagcctcacactgttttgttgcacgatgcgaggttcgcggagatgtgacacgacgcgtgtcccgtgcccggtgcagcgcactagtagcaaccattttttccccacgcaccgggggcaccatcttcttcagcacgcaatggcgcaacgcgagtgccacgatccaagctgacaccgcgaccccaccggcgtcgcggtggctggcacgcatgctcgccagagcggttaccacttaccacccaaactgacaggtggggtcacggggcaacaccaattcgtgggccccactggtcagtgaggcgaagcgaaacccctcccccaaatgccgtccgagatttttcttctccaccaatccatcaagcccccccttcggcataaaaagggcactgcgcgattgggaaggcgaaagtagtctcgcctttttcacagcgaatttcccccacccgtccccatcgcagagaggcagagagaatccacactccaaaacccaccgttcccca

SEQ ID NO: 2106 - DNA, 1501 bp, Oryza sativa
caccaccaccgcccccccacgtctccgtttctccgccgccgcggcgatcacaaggagatctcccctctctctctctctctctctctctctctctctctctcctcgcgctcgcttttaaatgccaccgaggcccacggtgtgggctggtccaccgcacgccgcgcccgcgcaagacgccgacgatgccggcggcgaagaggtcggcgtcggcggggtcggtgctggccctcacggtggccggacgccgcgccgcgcgggcccgcctctgcctccgcctggccgcgccgctctcgttcctgctcctcctcgccgcgctgctccgcacccagcccctcccggcgccgccttccgcgccgccgccctccgggggccccgctagggtcgccttcctcttcctcgtccgcgcgggcgtccccctcgacttcctctgggacgccttcttccgcgtgagccccaatcatccacctccgctgattttcgtttagttcgttcatttgttcgtccctgtttgactattcgattggttctgatcgaccgggtgttcggcagaacggcgaggagggcaagttctcggtgtacgtccactcggcgcctggcttccagcttgaccgcaccaccacgggatcgtcgtacttctacgggcggcagctcgccaggagcgtaaaggttcggccatttcttttgcgtgatctcttgcttctgatgtgatggcgtgtatcgacatgagacctgggtacgatttgagtagcgaggaatatggttgtgccttgcaggtggcgtggggcgaacctaccatggtggaggcagagaggatgttgttcgccgccgccctcgaggatccagcgaaccagcgctttgttttgctctctgataggtacggtacattcccccacatgcgagtgccctgttcttgctcgtacatagttcaaattttatggggagtggaccatgattaaatgttcaactgtggtctgtggctgtcagactcgtgattggtttaatagctgaaggtttagtaatggcaaatcggcaagtgaactcgtacggaaccagtttgtactttgcaggactctatagagggcattcttcttagtgatgcatttagattgtggtttcctgttgtggtgctgctaaggtttcttgagaagctctctcgcttttgcttggtctcataagtaatgttagaaaaaaaaatgcaactgtgaaggcatcccataattccgtgaatgccttttcttggtttcccttgtgggtgctcaccttgaagagtttcccatgatgagtgttacccatctctataggttagagagagttagagtgacattctgatcatattccccactagtcagtatgctttaagtctttatgttgtagtttgaatttcaattttttttatgtaccaatgtttatcatcttatagacgttttcaacattaacatttcaaaatatccttttctactgcagctgtgttcctctgtacaatttcagctacatatatact

SEQ ID NO: 2107 - DNA, 1501 bp, Oryza sativa
atttaacttcacttgtaaattaatgaacatttaatataaattctaataataatttattaaataatttataaatcctgaaacaaaaatcaggatgtgacaagtttccacataagaacccaatacgagaataatcaaaattcaaaataaaaataaaataaaatccaaaattagaaaaggaaaggagagtgcaagtagaaatacaatttaaaaatagctgaaatttgtaattaaaaataaggaatattgaaataagtttccatataagaacccaatacgagattaataaaaaactgaaataaaaataaaataaaatccaaaattataaaagtaaatgagagttcaagtaggaatacaatttaaaaatagctaaaattcggaattaaaaataaggaatattaaaagaagagtccatataagaaccaaatacgagattaattaaaattcagaataaaaataaataaatccgaaattagcaaaagaaaataaaataagagttcaagtaggaatacaatttaaaattagctgaaatttggaattaaaaataagcaatattaaaagaagaatccatataagaacccaatacgagattaattaaaatttagaataaaaataaaataatatctaaaattagaaaaattaaaagagagttcaagtaggaatacaattttgaaacaactgaaattgaaaaaaaaaataaaaacattaaaataacacaatacgatattaactaaatttttttaaaaaaattttgaaattagaaaaagaaaattaagatttcaattaggaataaaatttagaaataactaaaatttgtgataaaaataaagattattgaaagaaaagaccatctaaaacacatgatgagataaattaagtaacatgcctataaaggagtagagtggtggtggttgatacgagatataaaaattgttaataaaacaccaaatagaatcctactgatgattaaaaggagggacttcaggcaggccatgaagcaaacgtgtaaggcggttgtcgggacttctagaaagtaaaaaaaaacaaaccccaatgataataatatttaattttaaaaatctcaatgacaataaaaaggagaagcagtgggcggggtgtataagagtatagttgcagagccgccgacggttgatgggacttctagaaaataaaaaatgaattcctacgatagttatgttcgatggttagaatcacaatgacaataaagagttggcggcggacgggctgtagaggggcatagtggcatcgacgggatttctagaaaataaaaaatgaattccaacgatagttatgtttgatttttagaatcacaatgacaataaagagttggcggcggacaggctgtagaggggcatagtggcatcgtttgatgggacttctaaaaattataaaaaattaaactgcaagtccaatttttaaaggtttggaacttctaaaaagtaaaaaaaacaaatgataatcatatttgattttaaaatctcaa

SEQ ID NO: 2108 - DNA, 1501 bp, Oryza sativa
ttaaaatgcatatagtaaaatagtcatacattgtgacagtgttgcattgcattattttgcctcctctggaacagataaattttatagtttttcttttgtggaaattgcaactaattcgtacaaaattcctgcgttcaaaatgggccctaaatgggaagtctttgtttttttttatccgcctcccgactcacaaatatatgcagcagaatgttcatggcggctaatatctggtatcatctgtttcagctcaatacagagatcagcttttcatgttccgggcaaagaaaaagaacatgatttaacaggtaacagtcgcccatgccattcttgaaatcttcatatagtcaatttctttgtcaactttcacgtacactagctcgatcaaactgacaggatgacaattcacttttcttgatcagttcctgaagggaggtgtacatactagtcccgcctgaagtgcataaagccaaacatcaagaagaactttgtaaatacttacagaagaacctatacatagatacatatacatactagaacatgattttgggtgctttcaattcgtggtggcgttggtagtaaaattgactcaaaaggtgcccatgtttgtcactcacgattgattttagcaaaacgttaagcaaattgctttacacgaatcctcgtgcttctgatttgaatttgtatgcctatttagtttgcggtgaatacctgttttgctccgaactaagtttcggcccgaaccaacaactgtactctcaagttccagcccggcccaaaagcctcgaaccgtcacgtccagaataaatttcggtgaaccttgtccatactccatagacgtgaaaccccaccagcgaatctcaaaaaaagggaaaaaaaaatcaccagcgccgtccactgctgcgagcctgcgagcgtgtcccgatcaggccaatcagaacctccaaggagaaatcaacggctcataagcatcggcatctgcagatcaaacggagctggttcaccatagtgggctctagccgctctacaccggctcgatctcctcatattacgggcgtaccgtgcgcccatgcgcgacgcgtggcacgcgctcgccaggtcgacggaccagagccgatgtgagccgcccacgtggcacgcctacgtgcaggctgatgcagcgtcgcggttgttgcgagcctatggacccggtccacgagaggatacgtgtaacaccccctcccctcttgccctgtccccttcctccaccgatgaaaagaaaacagaagcttctcttcccctctcccccaaaacaaaagcatcaaaatattcctcctaaatcaaaagaaaaacaatcaatttcaaacgagccatctctctccattctcgtgcccctcctgtctccgcgcattcctccgccggaaaccctggttcatcggcgagcggcgaggctcggggactcgattaccctgcgaggaatcgaggtcggaccgcgggtggggaaggcgaagatggcggggtccat

SEQ ID NO: 2109 - DNA, 1501 bp, Oryza sativa
cttttatatctcaaggggatactacatgcaccacttctacctacttttcttctgggtggggacctaccctatcttgaccaaaacttggcttgcaccttcgcctggaagctaaatcacaacttgtccttgagtgaggctcagcgccgtctctcgcctgacaccggggatctccctgttactccctcattaatgggcggagatttgccatggctgctttccaaatgaccatccgacgagatgggtcatacctacctccactccaccggaggcagatgcatcgcgggagcacagttgtctgccaatgacgtgaccagcgtcagaccagtcatagaccggtcattcttgtccaccacgtgtcagttcagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccacctaacccacgatctgaccggtctgtgaccggtcacacactgtgacctgtcacggaccgaacgagtgtgctgcgctgcattaaatgcgacatggggcgctcgtccaacccgcaataaacgcggttaggtgagcgccgctgtgctcacctaacccacacacgtggcgccaaacccacagggggccggggcgccccagccctcggggccgaaacgggagcggcccgacccctcggggagacagagggaggggcggccacatcaccctcgggcccgacccccccccgagggggtcaggccacgtgggtgactgcagctgccccaaacctctagtcaagatacccccggtcccatgtcaccgacagtagcccccggcgttacgctagggcgatcgcccccccgagggaagcgctcgggcgtgacgccactccttagacctggtgacaggtggggccggtctccacaggcggcagaaacccagcggtcgcaaatcgcgcacatcgtcaaggaaaaaaccgaccgacaataatgagcggcttccttcaagaccgctacattacttaagtagcgcgcgaaccgggacgagctggttcgtttcgcctggagatgtgatgacggtgcatcggtcggcgagcgtagttaacgcgcgcacgatatgtcccatctcgactgccatggccgcacatccgcctcgtgcgccgcaaacgggcgagcgggattagtggaggcgtgggcgcgagagacgagggggcgaggtagtgggcgcggggatcgaggagccgggcatagcgttggcaagggtactaagacatcaaggaagggatttgtttccttcctctcgtcactcttccctttgcctttgccacttgtgctctgactctccgtttccggcgccctacccttgccatactcgctcgctctcaagctcctcctccgccggcgtca

SEQ ID NO: 2110 - DNA, 1501 bp, Oryza sativa
tccaccggcgtcaaatcccccgctctccgccattcaattttcggtcggccgccgtttcccccgcgcgcgcgcgccctggtggcaaccgtcgcccggtcgccgcccgtgcccgcgctgccgcccagtcgccgccgcgtcagccctgccacgcctacgccgtgcagccgccgaaccccgctcgcttttttgcagtcatcgccgctgtcatcgcccagtcccgacgcccccatgccgcatgcttccaaaacgcggagccagagctcgcgctctctccctcctcctttctcccaaaatggcatgggcagagctccctttctctccccttttcttctttttccctgaccagcgccattgtcacctccactgtcgcccccaccttgacccaaccgagctccccttgactgcccgtgctcggttccttcccctcgaagctccacaccccacgcctataaaaccacagccaagccgctcgcctgctctctctctctgttcttgccaccctcgccgccttgctgccgctgtccttgcctccctccgccgccgtgtgtgctggtgaagccggcgtgcgcgcgaggagctaacgcggactccgggcaccctcatcttcctcttccccggcccgaggccgtagcgatcatgccccgcgccgtcggccgctcgtcacagcgcccgtctcggctcggtagtgcctccctccgttctcccttctcgcttgccctctccctcttttagctcgcgtggtagctcggtagccctcctgaacgcgcgtagacgaagccccgccgccgcccggcatggcctcgccaccattgccacccgttccggggagccgccgctcgtcggcctccctcgaggcccctccgtcccatccgaccccgagaatgagttccccgaacaacggagatgctcccgacgccttgaatcgaaccctcgccgccccgccagtttttccccttttgcacgccgccagccgccgccgtcgcaatccaccgcccttgacctctcccggcgcgatccgagccattggctcgtcctctcttgtgccgctcgccaatccggtgtgctcccccttgaccatagtcgtcttgtcgagctccggtgaactcggccgccgtccgccgtccatctcggccttccccttcttcctcctcccgctggcccgcgtggctgccacgaaggcgccacgtcggcgccatctcggctgcgaccggttcaaggctgaccctggtccaacgctcccctgcacccccgctcgcgcgcgcgcggtccaccgcgagccatgaggctgctcgtgggcccgccgcatccgcgtccaccgcaaaccgcacgtgcgctgcgactccccctcccaaaccctagcgcgctccgcgtgcgccccgctcacggtgagccgagccgctaacaagcgggtcccactcgggaccacgcgaggtgagcccggtccatcggttccctctctcctcgcctcccgcgcgccctaatgggccgtgtctccttaggc

SEQ ID NO: 2111 - DNA, 1501 bp, Oryza sativa
gttctctgatgtaacggacgaatacatgctgttgcaaggaataaggtaaggtaggggaaattctgagaataaagtgtcactctctagagaggcttattttctaaggcacaaaagagatgcatatgacttaggccgcgttctaaactgagtttgagctgagctaatctctcattgaacattagcatgtttctcaaactgctaaactatatattttatgctaaaacggtatataaaaaagtttctctaaaaaatcaaataaatcaatttttaaagtatacaatagataataattaattaattattactacctccgttttttaatagatgacgccgttgactttttttcacatgtttgatcattcgtcttattcaaaaaatttacttaattataatttattttgttatgagttgttttatcacttatagtattttaagtgtgatttatatcttatatatttgtataaaatttttgaataagacgaatggttaaatatgtgagaaaaagttaatggcgtcatctattaaaaaactaaaggattatatgctaatgacttaggagtacatcgcttttcatgcagctaactagctaatcctaacagctatatagaacgcaccctaaacagccttttggaacaactagtttcttgttctctgttagcacttcttaaactttgaaatagtatgtttcgtgtaaaaaatttctataaaaaagtttcttgaaaaacaaataaattattttataagattacaataattacttaatttatcatgtgctgaggcttgtatcgtttcacctgccgtcgaaaattttagcctaaacacttaaacgaacttagccttaccaatacaacacatccactacagcatatacacctccagactcctgtgcacgggaaagggtcgtttcacttaacgtgcacgcatataactctatgtcgcgttcaaactaattgtttcacaagagtatctacgagataaaacccaattacctacccacgccccaacacaaacacaaactcgatcatctgactatatattcggcttttctataaatatatttatgcaaatatataaacataccagggatataatagtattgttttcactttcattagctaagtgaataaatgttatttgttgaagtttgagaaaaaaagacatcatacattaaaaacagaactagtattaaattataaatgatgaggagatttttgtttatgtttagctagcttctcaaataaccatagaaacatagagaaaccaataaattaattagttttttaaagtgaagtggggaaaggaaagtgaagagagtttttttagactgttcggattgttgttgtttttttttaggaagtaggcccggggaagtaagaacaagtttaatagtacagtccactactagctacaaattagctatagccaatataataactaatttatacaatagttgcttactatactattaataactggtcccacctgtcatacacacattacg

SEQ ID NO: 2112 - DNA, 1501 bp, Oryza sativa
ttctagagacaaccacaagtgaggtttgctctactaggactacctctaaaaactcggcacaatttctttactcacttaccttgtttccttgcggaggtgaggaatacattcacaaacttgcccgggtcaatccacaatcttgacggaaactcgcgggcgacacctaaccgtctatgagatgaatctccaagtgtcggtgacatgggaccgggggtatcttgactagaggtttggggcagctgcagtcacccacgtggcctgaccccctcgggggggggggggtcgggcccgagggtgatgtggccgcccctccctctgtctccccgaggggtcgggccgctcccgtttcggccccgagggctggggcgccccggccccctgtgggtttggcgccacgtgtgtgggttaggtgagcacagcggcgctcacctaaccgcgtttattgcgggttggacgagcgccccatgtcgcatttaatgcagcgcagcacactcgttcggtccgtgacaggtcacagtgtgtgaccggtcacagaccggtcagatcgtgggttaggtggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctgaactgacacgtggtggacaagaatgaccggtctatgactggtctgacgctggtcacgtcattggcagacaactgtgctcccgcgatgcatctgcctccggtggagtggaggtaggtatgacccatctcgtcggatggtcatttggaaagcagccatggcaaatctccgcccattaatgagggagtaacagggagatccccggtgtcaggcgagagacggcgctgagcctcactcaaggacaagttgtgatttagcttccaggcgaaggtgcaagccaagttttggtcaagatagggtaggtccccacccagaagaaaagtaggtagaagtggtgcatgtagtatccccttgagatataaaaggaggaccttgcccaccaaaaagagaggagggagggggagtgagaggggttctggagcctgaactctctggctctccggctctctgtaaatccttcacacacagatccaccagaacacaggactagggtattacgcttctcagcggcccgaacctgtctacatcgcccgtgtctcgtgcacttgctctctcgcgaacattctccagatagatcgagggcgaagaacctcacttagcgcccccggccgaaccggcaaaggggggcctgcgcggtctcccggtgaggagccccacgctccgtcatctggcgcgccaggtagggggcgcgtgtgtttttctaagccctcgtcctctttcgtgtgcgccaagcttctcccgctcagcccaa

SEQ ID NO: 2113 - DNA, 1501 bp, Oryza sativa
gatacccattagcaattattacaagccaaaactcaacatacaaatataagcatgtaagtattatgatagagtaagacccatcatctagaatgttatatcatagagttcaattacatacaagtatatgatcttcctagcatcattattatatattttaatatttattgttcctataatatttaacgtatagtcagccataaatatctcgtcacaaaacactgggtatcaccaagttgatattaaagttatgttcaaatggcacatgcctacggtttttcgctttgctgttaattacacgataatgtgaacgtcgtaatcttgattttttacataacactgcaaatatttggatccacttcattatgcaacaaaaggaaatttctgtatgatttcttattctataatgacctttgagtatacactgttcgatagaagcgtatgcatctaaaaaagaaaagggttaatagtaagtaatcaaggcgaatattacaattgtgtatctagtttgatgatatatatattggtcctatatatatatccatatcgtcacctacttgttctcctattcagatcatcatgaatttgttatactattcagatcatcacctacttgttcttatctctttgcagattaatgaatatggatcagatcatatcagattaatgtggcatatttattctttgttggtcttgaagtgcatcattaaattataaatataaatatacacagtatgttcattagcttagtttgctttaaggttctcccaatacccgtttgctttgagattcataaagcaagaaactagaagaaaatggacgatggaacattttattttatttcaccgactttgtataccacactaaaatcattttttttctattaataatatgaagttcgattaggggtgaaaaaacgaagctcgtgactcggattgagtcaaactcgtagtattaacgagtcgagccaaactgatgagcaactagagataaaaatggagcctctgagttgccatgggtttggatggactggtttcatcagttgttaagtgtgcgcgctacacgaaatcggtggatttctcaggacagtagatatgtgatgactgcactatcgtcatatttgaaaacggaagtagtaatcggcccttgcttctgtgcatttatataaatacaaatatatatctttttatgcatagcaaatatagttatcaaagtggtattataatctgactaacatgattaaatagttcaaatctcttttttcttctttaattaacgtgttaatttcattctctaccttatgagagtggtattacgttccttttctacgtctcctaaaccttgcaggcttgcagcctgatcatttctagctcaagtaataagtgatggatatcaaattaatgtgacattttcgtgagttggtttgaatggcaaatactccgtcagaaaataaacccaacctggctgacaactctatcggcacatcacggcgatacaatgatcg

SEQ ID NO: 2114 - DNA, 1501 bp, Oryza sativa
ccctgaattgtcaggtaataaccctacatcctgttggtcgaagccggtattgctcttattcatggtaatcacaccagtacaatatttgaggtagcctatctaactgttgtcgacatggcggtctgaaggtccgactcgtagtcgacaacagggtagccctcctcctcgaactcgcgcccgatggaatcagagacagtgctagatccctaaggccggcctttgaaagtaccggatagggtcgatccaggcgtatctctaatgtcgatatccggcggcttgtcttggcgtatataggcttgtatgttgtggcttctggtgggtgttgatcttctcatcgtgggtgtctccctgtcctcctaaggggcttgtatttatacccatatgtgtccccttgtccaagtagaattagggaaaccaatatggatacaatccgagtagtccttgtcgtttccatgtagaactctggttgtctttccttatccggaactccctcgaggttagtttccgtataagatatggtatgtggtggatcctgccgagatttagtcaactactattaggtatgtggtatccataaccctgacaatatgatttcatttgggtgctagccgcgcaattgcacgggccaccagctagttctttcaatgataagcaacctatccatcaacagcgaagcgattgtgatgatctcgtcaatcttaagatatatcagcttagtctttcggagatgtttataggggtaagatgtgtatgtgtacgttcataggagtgagtttgtgcccgttgtgagcgcctacatttatattatgtttctcaagataagacataaaaatgtacttgggtgccattgtcactaaatatattgaccggggatgtctaattggtgagtgttcacatgtgacctagatacatgaacatgtttgacctaattaacccacatgcatggcccaccgtgggatgttatttcaaaaagtttatgcatagaaagttaatgttagaaacttttgacggatatagaaacattctacataaatttttttgaatccaaatcgaaacccgctcacgcgagcacaaccatttgcaaatcagctctttcgatattgatcgtgtgttcatccaaacaagacaatgtaaaagtttactatattcctagaaaagaaaatctgtttttatgtgagatgctgctatacaaacttatgtttttttgaaagaagaataaaaaccttgcttcgtatatattagtattaggaaaaagtacgaattacccccccgaactatcgtggttgtccgaattacccctgaaccacaaaaccggatattcttcactcccaactatgcaaaccggacgaattacctccctcaaaccaattcagagcggttttgtccaacgtggcgcatacgtggcaatccaatcagcgtttttttaataaaaaattagaggacccgcctgccatactcttcttttcttcctctatctcttctctctctcgccgctcgcgcc

SEQ ID NO: 2115 - DNA, 1501 bp, Oryza sativa
agaatatccggttttgtggttcaggggtaattcggacaaccacgatagttcgggggggtaattcgtactttttcctaatactaatatatacgaagcaaggtttttattcttctttcaaaaaaacataagtttgtatagcagcatctcacataaaaacagattttcttttctaggaatatagtaaacttttacattgtcttgtttggatgaacacacgatcaatatcgaaagagctgatttgcaaatggttgtgctcgcgtgagcgggtttcgatttggattcaaaaaaatttatgtagaatgtttctatatccgtcaaaagtttctaacattaactttctatgcataaactttttgaaataacatcccacggtgggccatgcatgtgggttaattaggtcaaacatgttcatgtatctaggtcacatgtgaacactcaccaattagacatccccggtcaatatatttagtgacaatggcacccaagtacatttttatgtcttatcttgagaaacataatataaatgtaggcgctcacaacgggcacaaactcactcctatgaacgtacacatacacatcttacccctataaacatctccgaaagactaagctgatatatcttaagattgacgagatcatcacaatcgcttcgctgttgatggataggttgcttatcattgaaagaactagctggtggcccgtgcaattgcgcggctagcacccaaatgaaatcatattgtcagggttatggataccacatacctaatagtagttgactaaatctcggcaggatccaccacataccatatcttatacggaaactaacctcgagggagttccggataaggaaagacaaccagagttctacatggaaacgacaaggactactcggattgtatccatattggtttccctaattctacttggacaaggggacacatatgggtataaatacaagccccttaggaggacagggagacacccacgatgagaagatcaacacccaccagaagccacaacatacaagcctatatacgccaagacaagccgccggatatcgacattagagatacgcctggatcgaccctatccggtactttcaaaggccggccttagggatctagcactgtctctgattccatcgggcgcgagttcgaggaggagggctaccctgttgtcgactacgagtcggaccttcagaccgccatgtcgacaacagttagataggctacctcaaatattgtactggtgtgattaccatgaataagagcaataccggcttcgaccaacaggatgtagggttattacctgacaattcaggggcccgaacctgtataaaaatccctgtctccatctcttttaccttagtcttgcatatatcctagcaccgacgatccccataccatgcaaataccagaattgtgacatcaaacgtcgacagtggcgcgccaggtagggggattttggtgcttcaggatttcgacgagatgggttcaaaaga

SEQ ID NO: 2116 - DNA, 1501 bp, Oryza sativa
tcagctcacctcccttttgcaggacgcgtcgttttctttgcacaatttttcgtcgccccgggacccgggtgatcctatcacctcgcatgcctcgcttggatcggcaacaacgcgtgcgggatgtgccatttgagtcccagtttttatccttgatgatgaggatgatgattcagctagcgtagcgttgttaacttttccgtcctttgcagagctgtgaggctgcctgaattcagccagaagaaacgaaggccatgattgagctacgtgcctaacatatcctaggttagtgcatatcatctctttaaaagttcaatccaatattttttatttgcggggaagttaaatgacaaaaaggccgtgctttatgggattacgagcgagaggcgattctccagtaaattccgcatccgctggtcttccggaactgggctaactgtgaaccgccctcccattagagcaagtttaatagtatagccaattactagctccaaatcatctataaccaatgtaatagctaattcatacaatagttgcttactactcctttcgtttcacaatgtaagtcattttagcatttttcatattaatattgatgttaatgaatctagacacacataacatctatataaatgtgggcaatactagaatgacttacattataaaacggaggaagtatattattaatacatggtttcacctgtcatacacacattacgtcttagagtccgtgctgcaactggctacagatctgtagcccgctgctcttctatctcttcttttatctctttaaaatatgcttatagctggcttataccatgctattgtacctgcccttagcgccctgtagttatacttatacaaattctttgggtggtagcactagttggactcggcaatgttggagcttttcatttctttttaaagcttggaactacgtagtgccgtggtgcgcattggtagaacggggagtggttcgggatcgtgggggctctccgaccgcgtgcaacgtgccagtccaactccaaccgacccacacaaacacaactttctactccactacgtgaccattacaaggactcgtaccccgtcctcgctcacttgggccgttcaccgcgctgccacccgagtcggcgagtcgcggagacgacgccaccacgcgccccaaaagtcccccaaatccaccaccgctcgcgccgcccccaccgtaatccccaaccccgaacgccactcccccccgtctcgcgtgaaagcaacggccgcgatacccgtggggttgggtgacgtctcccgcgacccgatcaaatcctccgccggttcacccgcccgccacctgaaggcccggcacgcgcgcgagcccgttttatacgggaacccactgcaaaaacgccccgcgtcaccactgcagccgcgcgacgcgagggcgtggcccaaccccaaccccaaccaaaccaaaccgtcgcgcgcgccactcgctctccacctccccgcgagtgcgaggcca

SEQ ID NO: 2117 - DNA, 1501 bp, Oryza sativa
tatgatacacaacacgacagagtaggaatactacatctagactctaatcatcaatatttgacggcgtgccacatccacgtccattatgtagagtcaaacattgataaaccaaagaagcattatttatcatgggctcattaaatataatgatatatgtacaccattgcaaatttagcaatgcacattaggttgcaccatttcgaaaaagtgcctttctcccaatgtttgtatctacaacgcaaatttaagttgagcttgcatggcaatcgtgaatgtgagcgcaaaaatactcgagcaattgaaccaataaatgtttcttaatttgaacaaaccttttggttcgtacgtagaggccttatactaggttagaagggttctatcgtcttgcggtgttgtaaaccaatagaggagtcaggtaggacattgttctaaccacatgaaggaagaggtgatacaagaggcagaccaagaggtgggagagcatcatcggtcaatagggagtaagtcaagcaacagatggttttggccttatgatgaagttgtgtaccaaagaatggtgcaagtatgacctatatatacttcaaagtttcgcgctccaatctattgtgtagacgagcaaaccaaatgatgcatgtcgatggggacctaggcttggtgattgtgaaagatgcggtcctggaagagaatcagacttgggcctagctttttttccaagcccaatctagcatttgaatatttctaggtcccacattcttcacaaaaagttacttcggtgggctgatgtcgagcgtaactctatacgtcatgacaaaataagcatattatttatggcaggttcatacgtcgtacagttacaaacaatgatcgttagatcacactaatccgacggtcaccattctctcccgcctttatatatacccttcgtctcggaacgtcgtcttctaccttcagacgcacccgtccgcgccgctacactctctcccatcttatctgcccccgcacccctccaccaatgccggtaccaacaacaacgatactccaccctcgttcatagcgcacccctaccgcctcgtcacgctgcccccgctcacctcattctctcgccgccaccactcgcctccgtctctaacgcctccgctgccgtgtcgcgcgtactccggtgagtcaatttttttattttctctctctccctcctattgtcacagggccgaggatgtacctgggccgaggattacggactgccattttcggcggccgtggaacagcagtgttccccagccatccatccaccctgccccccgctccatcgcgagccagcgacggccgagatcgcctcagacaagcctggggactcccgtccgctagacccccaaaacttggcggcgcacctcggacgcacaaacccgcgcacattttcgccctaaccctcctcacccccggacgcgtccgctcccgttcgttttttggcggccgaggcccaaccccaacccctccccgggtc

SEQ ID NO: 2118 - DNA, 400 bp, Oryza sativa
tgtcaccgcccagcgcccgcaccggcccggcccccccgcgcgcgcgccgtcagccagctgccgcgggcaccgcacgcggcgcggtcgacggcgtacgaccgaccgttcgacggagcgaacaccgctttgagatgcgagtgtggtgcgcgccgagtggtggtggagggggaagggggtgagggggtgccggctatataggcggagacggccgcccgctgggccccgcggtggcaggaacccgtcgatccgcgggggagggacggacggacgcgcggtggaacattccgcgctggcagatggggcagcctggctggccggctggctagctgccttggctagctagggtttccccgccccgaccgatcgatcgatcgatcccgcgccgcgccgaggcgcgata

SEQ ID NO: 2119 - DNA, 1501 bp, Oryza sativa
atacataacctgggtgcccgaatatttgggaaacggttaactcgggtttgcgttgtcagaccatgtgccgagcagatcgtacccagcccgatctcgccttgaactcgctgcatttaagctggggaaaaatctcagattgctgctgtaagattaaccgcacatgcaaatccaagcaaaattgttcgtggaaacgatacagaagatgtgacagtgtcaccggagactgatgtattattgcatagtctcaaagagattatcagtccgatcgtttcgtttatttatttgcaaacgaaaaataatttacaaataaaacttttatacatgtgttcttagcgatttaaaaacaatactgaaaataaactttgatgaaaacctcccaaaatcaacttaaatttaaggttaaaaatttatattttaactaataagtataagcataaacgaaaagacaagtcgttacgtcaattcgccaacaaaaaaacacgggagatcgatcagtggatcacaccattttccaacgccggtgggaagctgccgctgctcctgtttgtcattagggtaggcccgcgtgaatgatagatagtactaggaaggaagctgtcatcgctgatgcggcgaagagatcatcatcaccgccgcgtccattgtccggtggggtggaccgcgtccacggagacggaggcctcgagccgtcgagcgcagatggaatcaaaccttccccaagccaagccaggaaaatccgatccacccccgacctcctccgctttcacgcaggtcatccatcccaccaactcctcacctcttcctcctccgaagcaatccaccaccggtcaattactggcataaattccaaataaaatacttattcaggttgcatattcataattccttatcttttaaataatgacacggtttactatactcttattatgatatatccaataaataaacatatttttatttttattataacattttgtaagacaaatctatatagattgttttagtgtctttaaactaaatatttttgaagttattaatagttaaagttataaaagtttagcttttaaaaaagtcaataattatgaaaattgatgagtaacactgctactccttttctttttctttataaaagtcaagaattatgaaaattgatggagtaacaccgctactctttttctttttcttttacttaaagaaaaaggaaaaaagaaatatatgcgatattggcaatttggcatcccagcgacagctataaaaggcgctccacccctcgttagctcaccagctctcccccaagagctgcttacctaacatacttttacaactccaccattgtccattgccaaaggccttcgatctcgcctcccagatctgccccgcgtcggcgaaggttggttggaatgctctctgttttcatctcgtttgcttgcttggatgtttctccccgtttgctggtttgccggcgaggtgttcgaccgattgattggttgatcgtgttgcg

SEQ ID NO: 2120 - DNA, 1501 bp, Oryza sativa
aggaccatcacccccaccatccccaaatggagcggtctcaccttggcagcgaagccggaggatgcgccgccgcgcgggcggaggaagtcgagggagcctgtggaggcgccgaaggggaagaggcggccggcgcgcgggccaccgatgccgccgccgccgcccgggcgcaggctgatcaccgcctgatccgcctgcgtcatgatccgcctatcgaagaagagaggcggagagacggaggcgcggattgggggcggggtagggttgtatcccccagaggcagaggcgttttagggcttttgcgttgcggcggtgcggcgtcgtgtggtctgttttgctatgttggtggaggggtagaacggtctttttctgtaggttgtgtcactgcgctgctcgccttctcggagggcgacgtgtcgggaggacgaacatcgaggacgaaaatgccgtttcggtgctggaaatgacggtattgggtcggggtctccgggagtgcggggaatttcactgtgaatatacacccgggacagattttttttgtagtagtagacggagtaaatacgaaattgattagaatttgttaagcagtgcgtgcacatctaaaagtagggtttactcttttttatctttaaataaataaatttatgacgaggttaatatatcatgataatacaaacctgtacagtaaattgtatagattaataatattaaaatatgtcgtatctcgtattagattttgtttttgttttttttaatatagagagtaaacggtagagagattcccaacggtagagagtaaaccgttcagttttgtggacttcggctttatatcgaagaagttttccagctgcccatcatccaattgctcttatctatgcattcatccacttacccagacgtggagccgcatgtagggctatcatcgagctgagctcgaacgagcttgcctgccttggctcgagctcgacacaagctcgagctcggctaggcccacgagctcgaccgagtatacaataatgtatattttgatgataaaatttagtaaaaacaataattttaattaacaatattgaagaaaaatattatgagaactcaagattaatatatgatgccaaaatacactaattattcatttgaatagatactaatttattctaaagttacacacaattaggctcgtgagaagctcgagcttggctcgacaaagctcgcgagcttgtagctagactcgggtttgactcgttaagagctcgagctgagcgcttgagacgctcacgagtctcgagcttttttttttacaaccctacatgcaggcatcacgcagaaccaacaaaagctagtgggcccatagagcaagagcaagaaccacacatataggcccagatcgcgggagacgaggcacccgcagcttgcctctctcagagcaagttcaatagtatagctaactactagctccaattcatctatagccaatctaatagctcattcatacaacagttatata

SEQ ID NO: 2121 - DNA, 1501 bp, Oryza sativa
ctgattggagataaaattaaattaatgcaagttcaagtaaaactatcactattaatccaagagcaagaagtgaaacataacaccaaaaaaaaacagagagagaaaagaggtttataacataacagcaccatggactgcagcaactctccttggctacagacaaaacactctagggaagcttctagaaggacaattgataaatgtccaatactctacttttaacttcacaaattacttttgtttgggcagctaccagtgagctctgatttgttttaggacatgaacatttggaaggtattctccagcaccttaaattacaacctcatttgaaaaagaaaaaaaaaatctcctgtgctcttagttgaaaaaatagccttccatgccttggcatgtggtgtgaacacatgtgaatatgtgatgcatggtcggtgacttgggacccattagattgaagttttctccattaaaaggacaaaatagagcaaaattgaatgtttagggctaaaataggatattttaaaaaatgttctacaaacaagaccagctcaaagttagaagatcataattaagtcttcacttttaaatatatgttccttcccccacacatattgcataaatttgtactgcccagctggccatgaacatgtgatagatttatacaattaaaactacacagaatttgactcagtattaatatactccttccgtcccaaaatataatgacatctagagttgggcatgggtatcaagcagaaaagtaaaataaactgagggatggttgtgattggttgagatgaggaagtaggtgaagacattaaatgagagatggttgtgattggttgagatgagagagtaggtacaaaggtagctatattttgggacaattattgaatgctaaaagtagctatattttaggatggtgggagtatgtattacccgtaggtgtgatagtatatactgcatcccttggcctcaaaacaataaataatgcacagctgtactgtctgtacattgcatgaaagtaacaactatccatgttatgaaattaaataagatggccagagaagcctacaaatttcagcagtggatttttatttagagtggttctttagtaaaatcttacatgctcccttatgtgcacgagagacttagcacatactagagcacactccagttcataagatcggagcttacatgttgagggcatttgaagctttcagcaatgaaatttgtggtatcttctgctgcacaagtcaggtggaacaattctccacatctactaaccgaacactttatttcttctccaggatgaataatcttagaacataatcgacattcaacctgtgcagagatgaacatggcatgagctgctaagcaaacaaaaaaacaataacaaaaactagtgctgatgttgatgtaagcctgcttttactgcaggatttacacagaatttcataggaaacagtcccttcattaatcaatttgacatttgtttattaat

SEQ ID NO: 2122 - DNA, 1501 bp, Oryza sativa
cacctcgtgcgggccccacctgtcatacccaccgagagagggagccgtccagaatcagcccgccagcccagccagcctggaaggcaagagaagaaaagaagaaaaaaaaaaaggaaaactccgtgcacgcggtccacagcccaccccgggttccccctgcccccacggcggtggaatcggcacgcgaggtgggccccacatggcggcgcgggtccagtgaaccacgcctttgcacgcgagacctcctcccccgcggcctccaccaccaccccactataaatacacggcgaagggaaggcctccccttctcagcctcatcttttggttggtttcgttttggtattcccatacactttgtttctcttccccgtctcgtggtcgagagaaaccgagaggagagagagggagaggagcgctgccgattttccggagggggagatctttttcttctccctgaaggttcgagatcgatctgcgacgaggaggagcggggaatcgtaactttatttccgaggaaattgtaagatctcgcgcgacctgtttgttcttcttggtgttcttctgcctagttacttcgtttgttttatgtttgatctatagtcttgatgatctgtgaagactagttgttgttttcggtacggatggtaggaaaggtattttcctttgtttaaggaattgcaagatctcgcgcgacctgttcttgatgttctgtctagtacttcgtttgtttgtttgatctagtatgttagatgatctatgaaaagtagttattttcggtacgaatggtaggagaagtattttcctttgttggcgtcaaaatataatctttaatcactcagtcttgtgaatggtaattctgaattcatatttttcttttctgatctatatcgtgttattctgtttatgattttttgctgagtagatccccttgtgctcgatgtatgataagttatctatatcgtaatagattcgtatgtcaaaacttagtcgaaattttcgatctcatctcttctgttagccacaggtggctgattgaaatattcttcaattgagtctgaatttttatgttatatgcaaataattgtcccgctccagttcatatgtctgatgaaacatgaatgtaaaggaattaagactttggttatatgattcgagtctgaattttcttatgcttatgcaaataatagtccaaaagaattggtgatttttttgtgtagttcatatggttgataaatatgaatgtgtctcaaaagcaacgaagattttgatgacaagacaatctgctatttgagtctgaaatttcttatgcttttgcaaataatagtcatagtcagaacgaattactgaaatttccctccagttcatacggttgatgaaacatgaatgtatctctttagtaattgaaactttgacgatcagacaatctgttgcattgcctagtcttgcagattctcatcgatccttttaattcttctctgcagtcaacaaattgatgcactaa

SEQ ID NO: 2123 - DNA, 1501 bp, Oryza sativa
attaggagattatgctctgataccaattgaaagggtcaattaggtctagagggggggtgaataggataatttaaaactttatgcggaaactaaaactgagttagggtcggaaagtctgatcaacagtcagactatccgaaaatatcagatagtctgatgttggatcagactgtctgatccactaaaagaacactacaagaagatctagtgcacaaacaagagtatggcgcaaacagcgactagatctatagcggcacaaaagcaaagctaaataatgggagaagagatatcaccaacaatgaaattcaccgagttgttcccggagttcaaatccttgaggggattctactctccgttgaggagctcactaagagccgggtctttgctaaccctttcctcaagaggttgcactaagcactcctccttccactaaggggtatctctttccttgtggaggcgagatccggccttcacaaacttctcccggccaaccacacgtagatcggtggctcgggagtgacacctagccgtctaggagtcctcaacatccaagagtaacaaacaccacacaactcttggtcaaccctagtgctcaagatcgagtgaaacacacactaggccctcaaaccccaaatccacaaccaccaagatccaccacacaaagaacaatgagggatttgagagagggagaaagagctcaaagatccaaagcaccttagcaccaagctcaacccaaagtgaatgagaatgaaatgagttgggtaaccctagaaaagggttaggtggggggtatttatagaagccctcaaaatgtggccgttgggagagaatcttttcatcccaccttggaaagtccgaagtgacatcggatagtccgatgtttttgaccccccaagcaggccagagacagagaacgaaattctggagaattttggacaatccgatcgatcggatagtccgatgtcatatcggatattccgttatttttgaaccaagaatttcatcctctcacagagactcaagttccattgaatttcggagtctctggatcatcggatactccgatcacatcggatagtctgatttaaaactcactcaaaaggaataaaaagcaattcaaaacagagagtgaagttctgagaaatttcagatagtccgacgtattggatagtccgaccttatatcggatagtccgatattttttagccaacacttagacccaagacagtgagcaaagttctgtgaaatttcggatagtctgagcatcggatagtctgatcaacatcggatagtccgacagacataaaacaggaatacttcaaataaatgattttgagcactagtgttctaccaattatatgcatgtggcatccctcttaatagtacgacatcctaatactcaagaacacaagatatacatggattagaagacaattaccacaaaagatgccgcaatacttattgtgttgacatccactcctttttcatccttgcatacatc

SEQ ID NO: 2124 - DNA, 1501 bp, Oryza sativa
ctccttgggttctaatcaaacatttaatttatctcttcatttatgtattgaatgcatgaagactacaaataggaacaacttatttggaaaaactcaaatgtgaaatatgtctaacttttgtggatggagggagtactgcacaatggctaagctaaataaaacatttatttatcttgaccagcttgaggtccacatggttatgctgaatgcaaattaagaaaagcaacttactttagaatgtgaaccattagaagtcaggaaaaagtactttagttggcattccattagaattttaccaaactaattaaatcaggtgaaacaaaaatcctacattgagtattaaatttcctgaagctaccaatgaaggtcaaattcaatcattttatcatccatcatgataagccaagctttcacataggtagtgcagaacttttgcatcacccaaataaagcacagaatgggatttctttgttaattgacataatagcatatagaaaaagctgatcaactaaacataaaaccacccacaagattcctgcatctaaagccagttcgcattaattcgatggatacataagcttaaatgagatatggtacaaacaaggtagatactactcgtaaacaattcgtgcagaaaatgctagtatgaagcgatcaaataccacaccatgacctaaaagagttactaatacacaaaacttgtgtatcctacggatgagcaatttgtggttctgaaccaagcactgctatctagcttttatctgatacgctacaaaattacaaatctgataggccctcttcaaaactaactgcttatcgatcggataacaaagtaacagcatgatttacagaagctacagcaaaaaaatcaccccccgatgggggatggggaagcaagcccctctcacctcagtcgctgtctgcgcggcctcgtcagcctcggtggctcctacccgcggccgccgcgcagcagcgggcccgcgacgaagccagggactcgccgagccgcgggcggcaggagcggctgcgcccggagcggccgcgccgccgcgcgcctggcgaaggcgagcgacgaggcggcggaggacggccggcgcggatcccgggcgggagacggcggcggcgcgagcgcggcggccgtgcggaggagagcagccatgggtgaggggggattggagggaggggggcggagtttggctttggccgctgcacgctgtcgctcgctggctatcgtcgagtcgagcagcgcgcacggcacggggataactcgcgcggcgccggctcggacggacgaacggacggacgggatggatgggtcgagaatagagatgggcgcttctggaaggaggcaggggttggccggttcggttgttagcctgcttgatgggtccggtctatggagaagtggatgggccctgttctggaggcttagccggtgaggagaaaaaggacaatatgccacttcatacggtggatttcgataaaatgccacctaatatat

SEQ ID NO: 2125 - DNA, 1501 bp, Oryza sativa
ttcaccgaagataccgaacatctcgtgcgcatgagagcaggtacaatagcaggctataagccaactgcaaacatattttaaggagataaaaaaaggagagagaagagcagcgggctacagatttatagccagctgtagcacggactccaagacgtagtgtgtgtatgacatgtgggaccaggtattaatagtgtagtatataactgttgtatgaatgagctattagattggctatagatgaattggagctagtagttagctatactattgaacttgctctgagagaggcaagctgcgggtgcctcgtctcccgcgatctgggcctatatgtgtggttcttgctcttgctctatgggcccactagcttttgttggttctgcgtgatgcctgcatgtagggttgtaaaaaaaaaagctcgagactcgtgagcgtctcaagcgctcagctcgagctcttaacgagtcaaacccgagtctagctacaagctcgcgagctttgtcgagccaagctcgagcttctcacgagcctaattgtgtgtaactttagaataaattagtatctattcaaatgaataattagtgtattttggcatcatatattaatcttgagttctcataatatttttcttcaatattgttaattaaaattattgtttttactaaattttatcatcaaaatatacattattgtatactcggtcgagctcgtgggcctagccgagctcgagcttgtgtcgagctcgagccaaggcaggcaagctcgttcgagctcagctcgatgatagccctacatgcggctccacgtctgggtaagtggatgaatgcatagataagagcaattggatgatgggcagctggaaaacttcttcgatataaagccgaagtccacaaaactgaacggtttactctctaccgttgggaatctctctaccgtttactctctatattaaaaaaaacaaaaacaaaatctaatacgagatacgacatattttaatattattaatctatacaatttactgtacaggtttgtattatcatgatatattaacctcgtcataaatttatttatttaaagataaaaaagagtaaaccctacttttagatgtgcacgcactgcttaacaaattctaatcaatttcgtatttactccgtctactactacaaaaaaaatctgtcccgggtgtatattcacagtgaaattccccgcactcccggagaccccgacccaataccgtcatttccagcaccgaaacggcattttcgtcctcgatgttcgtcctcccgacacgtcgccctccgagaaggcgagcagcgcagtgacacaacctacagaaaaagaccgttctacccctccaccaacatagcaaaacagaccacacgacgccgcaccgccgcaacgcaaaagccctaaaacgcctctgcctctgggggatacaaccctaccccgcccccaatccgcgcctccgtctctccgcctctcttcttcgataggcggatcatga

SEQ ID NO: 2126 - DNA, 1501 bp, Oryza sativa
tttccatccaccgacccggaccgctcgacgctctcccccctcccccctcccccgcgactcgtgaaatcccccagccgacacgccgccgccgccgccggctactccgacgaactcgacgccgctcagagctgcctccggcgagcctccgccccgtacctagctcttctcgcccccccaccccccaaagctcgcctcctccgtctccggagcggtcctctcttaccgcttttgactccacctcctctgacctgcgcgccgactcctcctgagtccggtgtgccgtcgggaaggtccctacctgtgcgccgccttctccaagtccgtcgcaagtgacccgcccgcgctctcgatggtaagccacccgttctccccccccaatcttcacccttcctcccacagggttctagggtttgggcattcgtgtgttttttttggcttaatggcaggtgcatgttgtactgatcgagatgtttgtgcatatgatatgttaaagctttgtattgttcagaagttaccggtggtgtagcaatagtctatatagaaaaccataatatgtagtgccgtatggaccattgctatctttttgatagaagcaaagatatgtggtttgcttaaatacagtggcccgggggcctatggactactgcgagcacaaaacaagaataaaagaaaaaaaaaatctcaacgcatgatattgtacgacacaacattatctcaacaagtctacattaagcatggcaacaagcactaatcacaagttcataattcatcatccatttgcaaacaagtgtaaatagaagagtatgtactaaaacatatctcaactccttaagattcaggctttgtacttgggtttctactactagagccccggttgaagtaactcttcaaatctgcaaaacaaattacacaaatgcaatttcagaaacaaatttgtacactttgaatttgcaaattgtaatattcttaaattgtcaacaatatgtacctctttgtgatgccaatgccttccctttcctctttctatccattttctgctgatgacttggcttgcttgctatgcttggtgttggtgctgcactgctgctggctggctagttggcagaggttagtggctggctggctgctgtgcgcctgtgctggcgatggcgccctctgccctgcctgcgatacatggctgcacccctggctggctggtcacttcctgatagctcgcagtcgccgcctgccgcagtgccatgctgtgctggcgcctggtgcggatgccgccgctctgcgcccgccgctcgggagcctggcggcctcgcccctcctcgcctccaccttccctctcgtgcgccgactccgctccagcaggcagcagccgcaccgccgatggggattagggtcgggatgaggattgccggattggagaatcgatggaggtgaaggagatgggggaatttgggtctagggtttaatagtcaaaagaaacatttacatgaaacaagcccagcttggc

SEQ ID NO: 2127 - DNA, 1501 bp, Oryza sativa
tcggactatccgatcgatcggattgtccaaaattctccagaatttcgttctctgtctctggcctgcttggggggtcaaaaacatcggactatccgatgtcacttcggactttccaaggtgggatgaaaagattctctcccaacggccacattttgagggcttctataaataccccccacctaacccttttctagggttacccaactcatttcattctcattcactttgggttgagcttggtgctaaggtgctttggatctttgagctctttctccctctctcaaatccctcattgttctttgtgtggtggatcttggtggttgtggatttggggtttgagggcctagtgtgtgtttcactcgatcttgagcactagggttgaccaagagttgtgtggtgtttgttactcttggatgttgaggactcctagacggctaggtgtcactcccgagccaccgatctacgtgtggttggccgggagaagtttgtgaaggccggatctcgcctccacaaggaaagagataccccttagtggaaggaggagtgcttagtgcaacctcttgaggaaagggttagcaaagacccggctcttagtgagctcctcaacggagagtagaatcccctcaaggatttgaactccgggaacaactcggtgaatttcattgttggtgatatctcttctcccattatttagctttgcttttgtgccgctatagatctagtcgctgtttgcgccatactcttgtttgtgcactagatcttcttgtagtgttcttttagtggatcagacagtctgatccaacatcagactatctgatattttcggatagtctgactgttgatcagactttccgaccctaactcagttttagtttccgcataaagttttaaattatcctattcaccccccctctagacctaattgaccctttcaattggtatcagagcataatctcctaattaggcttaaccgcttggaagcataagatgaagatgcatttgaagtctattaacccatctatttggagaatagtcgaaaaaggttatgttttgcagaatcccgaagatcccaccaaggaggacgacgagaatgagcacaagaacgctcaagccgccaatgcaatacttagtgccttgagtggaagtgagttcaaccgtgtggatggcattgagagtgccaaagtgatttgggacacgcttcagaacttgcatgaaagcacggatagtgttcgtgagtccaaggtttagatcctcaaggggcaatttgagagatttgtgatgttggatggtgagagcccaagtgacatgtatgaccggttgagcaagattgtcaatgagatcaagggacttggctccaaggacatgaccgatgaggttgtggtcaagaagatggtttgagcaatcactccaaggaactctaccttggttaccatcatttgtgagcgtccggactacaagactctcacacctcatgatttgcttggacacattcttgcccatg

SEQ ID NO: 2128 - DNA, 1501 bp, Oryza sativa
tgatggttattctacattaagcatgctcatgttgattacattcaccactatcaccaaatcaaatcccattgtaaatatcatgtttattatcttgttattttggattaaaatatgccgaattatgaccaaattttcaacatcaactgagctcacatatctatgatccccacgattgttgcagtctcaaaacacaaagattacatgtgcccatgaaacaccaaccgaggtctacctctattttagcaaactgattgatcacatgtacaagaagttggcaaaagggaatccaaagcatttcacagctgctggacgcttggcactcatttcttcaatttaataatttccatgcagaacctggggggcaaagcaaaaggtaaaaaacctgaacatttctccatgattatacgtgggattcttctcagcatcccaaaatcgaaaccaattttgtggtgcttggtacacacggtttgggacttctttgagccacaaggttgaggcttaattcagagctgcccacagtttctccgtttcggtttattcagcggccatcccaaaaaggaacggtttcagttcatcacacactactcgacagccgacagtcactctcggagaagaaaggccgtgaacatgttggatagtactacttcgactaattgaccatttgctgctgccatgagaggaggacaaatcaaacggacagagtgtgacaagtcactctaaagataacagaattctaagtactagctttgctactgtatttgggcaacatggaaagggatattccacatcgttttcggcctcgagagggaaatgcggccgtttccggtagaaaatccggataagattacaccgcagcttgcagatcgcaacgggagagagaggagaggagaagaggagagaacccctgcacgcaagtgcggaggaggacgaggagaatggcgtctctatcggatcgccgacgccgacgcgtcgacgttggacagccaagtgagaaagtttaagatcttaaaaagcagttggttggtttacgagaatttaaaaaaactggaagaattaacttctggattttaacttattttgtgtattttgtaattacaacttttcaaaaaattagatgaagaactagactgtttgagagagtttgattctcaaagaagctacggctacgactgcctgtaactcccaaaacaagtcctcatctcgacctgaagccatggaccgcgaggctgagcctagtatggagattgggtccggcccaacttagaaaggttagcccaatcggtgattgggcctcgtataatgtagcggaggatagtgtttgggcctttgggcggggcccagcagatgctcctcgaaaggttcggccactctccgtccgtcttcctcgtcggcacgctgcacagtacgcgcgctgctcctaaacccaaaccctaaagccgccgattcctctcctctcctctccacaccagctcgatcgcgatcggggtcatggccgccgcca

SEQ ID NO: 2129 - DNA, 1501 bp, Oryza sativa
cggtggaaccactcctacaaaatggtttacacccaaattcagatattgcagattggtggataggttaccaatcgagcttggtatatctccttttatttgattacgagctaggttgagtgcttgaagaagggtacaatttgcaaatgcgtgtaaccatttttcattgtcacttgcttcgagatggttacccgctagatacaaatcggacagatttgcaagctcactgagataactaggaacctggccatagaaattgttgtttgtcaagtctatcaaccatagccccgaagcgttgataagggaagttggtatatgaccttcaaacatattcctcgctaaggaaaggaattggagattagggagcacatcgccaatgttgggtggcagtgcttctttccctagcatgttatcactcaaccataaagtctgtagagaagacagattgaacagttcatgtggaagtcggcctgatatgttgttcataaaaatgttcaatgacaacaaatctgacaatttcccaagctcacggggaatgcttccctcgagatggtttatttgaagagagagatagtttaggccggtaatgttgccaagggtgggagggatggttcctgtgaatgaattattggaaagacataagctcgagaggttcgttagaaggcccaatttggtgggaatttcaccaacaagagaattcgaggagagatccaacacccttagtctcgaacagtttgcaagcccctctggaatagtatcacgcagtgagttatgcctaagatccaggactttcagtctgtggagatggttcagcggaggcaatttgccggagaaatggtttgaagagaagttgagtgccttgagaaacgtgaggttcccaagggaggagctgattgtgccggacagggagagtttgaagagattcagcgccgtgacgcgcccagggtgcctccggctgcagctaacgccggtccactggcagaaggggacgcttgcgttccacgagctcatcgcttgcgttggatcttccgttatatgcttcttgaaatccatcagggagagcagatcagctgtgttgttcagagttgcttcacaacggatgctgccagctccgtaagacagcagcaacagcagcaaaaacgccagaaatgcagccatattcagaggatgattttggtttcaaaagatccagaggatggttggcctcagcgccttccttatctgccaaacgtaaagcgtgaacatttcagcacaaaagtacaatacgatagcagtaatttaacactagagatgtatttccagcaggagcagacgatcgatgagacgactttgcgatgaatggttaacatgcgcgataaattgcataaataaatatcgagagatcagaatgcacctcgcccggcgtgtttgcttccgccttgttcagtgcagaggttggaaactcgcttgctcgtaggctcgtagctaacgcggcgaaaggtacgcatgcacctggcacacccta

SEQ ID NO: 2130 - DNA, 293 bp, Oryza sativa
tctttccgactgtgaaggtctcaggggctactgtggagattatgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggtatga

SEQ ID NO: 2131 - DNA, 1501 bp, Oryza sativa
ggcgcctgcggtgacttcgtcaatcttcaggatttgctgcctcagtcttcgaatatactcataggggtaaggtttgcgtgcgtgcgttcataggggtgagtgtgcgtgtgttatgagcgcctgcgttgtactgtgtaattctaaaaaaactagtagcatgtttaaatggatgataagtagaattacttattcttcgtcattgtgccaagatgaaatatggctatcaaaagtagatgaaaggagtataatataaggcataaccacccataatccaaaaccaagaaataattaatatcacatcattgtcatgaaccaccctaactagtacaatacatgcaaccaatagaattaaaaatcttgtgagtgtacaatttaaaataataataatttagaggagagaacatgctaattaattatatgcatgcatgcacgtcttatattacgaaacaactttaaaaagtagtatttgtaccttatattttggaattgagggagtataaacattttggatgagtttactcttatatagttaatgaaaagttgttgtttctccaacgacatctctcctatgcttaaaatgtactccctccgtattttaatgtatgacgtcgttaatttttttaccaacatttgaccattcttcttatttaaaaattttatgcaaatataaaaatatttatgtcatgcttaaataacatttaataataaatcaagtcacaataaaataaataataattacataaattttttgaaacaaatgaatggttaaatattggtaaaaagtcaacagcatcgtacattaaaatacggagagactactacttaggccattcacaactcaatgactaggatagtgttcatagcattaaatagactgccacttaggatgaaaaataatgtggcaagtgaataaataaggaaagagaaggaaaccatgtcttgcatgagatatagtttctacacaacatccaaaatatcatgtgagataagtagcattaaatttaagtatggatagtggtgttcacattagaaaagtagtgtctagtactagtttcttgatgatgtggagtttatgaaaactatgtctagtgtttgggttgggaatggccttagtaaatggccttagtaaatagacaccttaaataatcactagtgagtaaataaggtaatgtttaaaacgacaggaaattaatacatatggaactggagcgaattactgtccttcacattcgtgctacttgtggagattatgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcctgccccccatcctatataaggtgggcaggaggccctctagggggtatga

SEQ ID NO: 2132 - DNA, 1501 bp, Oryza sativa
acgtgatgcagcaatagcgtcatgtcctttttgtttttttggccataagattggaggggaaaaagaacagggaatataatccttcctcgtgagcgtttcttggccacgaaacactagtgtttgttttgtatgtagtaatttttatacaacatataacttgtttggtatgatctgtgaaatgatcttggtgtttggtgaacaaagttcatctcacaacacaaatagctacacggatacaattcattgctaatcacatgcattgatatgtgcatgttataattaattatttaattataagatacagacagctaatagacaatctattgtaccagtagttagctttagccatgttctattagggcacccacagtggttatctataagctctctacaagagatccatgtcagcatattttcctacttagaagagattaaatgaagagagagagcaaagctatctactaacatggagatagtctatagagaaaaacgaggcaatggattagagagctatagatacccatgtagacataccattgaagtggtttactattaatctagtctattgttgaggtgtacatgttttatagatagcaccttactttaccattgcgggtgctcttagccaccagcggactatactattcacattgctctaaagcacgcacgcattcaccggttttgtctttcctcctcggattcgacggcacgcgcaccggtgaatcggtgatgcagtgtctggctggctcggcctcgtgaggcgtgggagttgcttccttcacgtagaagccagcaccattaatggccggtcggggcctggacgcgtgaactgcgtgtagtgagtagcatcgtgtgagatgagatcatcttcacccatccacccaggtcccaggggcctgtctggctctctcggtgtctcctcatccgcatcttgttttagctgggagttttgatctcttttttttttctccactctacaaggtatttaactatttatcacttttaaaatataataattaaaaatttataactcataattcgtgacgcgtgagttctcacgtgtttatgttatatgagttctcatatatctataatatattagtttaatggtaaaaattttaattgaatatgtaagagtgataaatatttctttggtgagccatcaccaccacccaatcagccacccacggtccagccatggcgtgccgtgccgtgccgtgcattgagccctgctgtaagccctatgtgaccttgttattcatgcgtattagagcatctacaatgtaagatatccattgagtgttctcactaactgaaaacacttatatagacaatcgtctcacaatggaggccatagctagatgggttcctcaaaatctataggtacccctaccaaaaggtcatcgcgttaaatttcctcatctaccctcggcaactcctccctctctctcatcgctcccctctctctccctctctcacgcgccacggctctctccctcat

SEQ ID NO: 2133 - DNA, 1501 bp, Oryza sativa
atacagtataactcaatcagtgtactgcaaactataaatcccaagggccaaggcatcctcaagaacctggatagccataatttctatattaagagaaaatgttaggcacttaaaaggcactgcatttcctgaagaaataactactgttgagcagtgactctatcattcctgctttgttaattatccaagtgatagctttgcatagaggaaaatcattttccaatttgaatgtatcttatttcagttttccatgtcatttaattttgaaaagcaattcaacgatggccctagttgttcctctttagagaacaagccaccttactaattactcactgacaacttgcacttttctgtatccagtaattccgtaacatgctttcttttgcaggatgcttcggcttataacaaagagaacacaaagcttaggatgcagattcggtggatgcaaccagaacttgatgcacaccgtggaaggcttaaagaagcaataaatgagatgaagctgatggacacaaagtatctggaagcatccaccaagctgaagaaggacctttctttctactgtcgtgaggttctgaggttgaaagaacagcttaaagaatcacaagttaaagcatcttgaccctgaaatctttctgctgagtaattcttgtgtggagaaactcgtggtagtactaaccatatgacaaacaattggtattgcctcaatgccacttcatacaacttttgtatactgctagtgtatttgtttcaggtaggtgtatagtgctacaattccctgtagatcattacttcctaatgcacctgactcaaattataaagcagtggaccgtctagaacttttaacagcctttctcgcactgcgagtctgtgatatagggtgagttattcatattgtgacatatagatactggtttttcgtttggttctggtctgtagcaagtatatacctactacagtacttacgagtatagtggtgaagtgtggacgcatgattgattgcgcatgatgccggtgatgcagagcagtgtaagctgcttgtgccgctcgccgtctccatctgaaacgtggtctcgtcgctctcgcgggtgcaggcgtgcagccggtgccggagatgacgcgacaccaatgaaaatcacgtgagaagagaagctcatcggatcggaacatctagtgacgacgccaagcgatggcccagaaacacacggcctgccgacgccggtgcaatcgggacgggccgtggcttttgtgctcggacgttgggcctcccctgaggggacattggccatgttgggccgaattgacactagattttcagcctaggcggcgggaggagtcgcagcgcagggctgagttcgaagtagattgacgctgaacctctgattcttcttttgcacattttttttttctcgggaaaaagtaattcgaagctgatagctcgcggcggcggcggcggcggcttcgcgggcgatggcctgggaaggaggcagcggcggctcgg

SEQ ID NO: 2134 - DNA, 1501 bp, Oryza sativa; identical to SEQ ID NO: 2131

SEQ ID NO: 2135 - DNA, 1501 bp, Oryza sativa
tacgagacctaaaagtggatggatgcggagacaaaggatttagacaggttcaggccctctcaatgagaggtaataccctactcctgtttggggatttgaatccgccgagtgtgtattgatctgacgatcaggttgtctcatcataccccctagagggcctcctgcccaccttatataggatggggggcaggattacaagatagaaaccttaaccaatacggtatcggtttcctaaatctactttacaatattatcaaaccaggactttaggccgttccgtaatatacaaggaaacgtaatacccgagtcatgatctattacatattccatagatataagttatcccctatgactagtcggataaccatgccgtatgggtatggggtacccataatctccacaagtagcacgaatgtgaaggacagtaattcgctccagttccatatgtattaatttcctgtcgttttaaacattaccttatttactcactagtgattatttaaggtgtctatttactaaggccatttactaaggccattcccaacccaaacactagacatagttttcataaactccacatcatcaagaaactagtactagacactacttttctaatgtgaacaccactatccatacttaaatttaatgctacttatctcacatgatattttggatgttgtgtagaaactatatctcatgcaagacatggtttccttctctttccttatttattcacttgccacattatttttcatcctaagtggcagtctatttaatgctatgaacactatcctagtcattgagttgtgaatggcctaagtagtagtctctccgtattttaatgtacgatgctgttgactttttaccaatatttaaccattcatttgtttcaaaaaatttatgtaattattatttattttattgtgacttgatttattattaaatgttatttaagcatgacataaatatttttatatttgcataaaatttttaaataagaagaatggtcaaatgttggtaaaaaaattaacgacgtcatacattaaaatacggagggagtacattttaagcataggagagatgtcgttggagaaacaacaacttttcattaactatataagagtaaactcatccaaaatgtttatactccctcaattccaaaatataaggtacaaatactactttttaaagttgtttcgtaatataagacgtgcatgcatgcatataattaattagcatgttctctcctctaaattattattattttaaattgtacactcacaagatttttaattctattggttgcatgtattgtactagttagggtggttcatgacaatgatgtgatattaattatttcttggttttggattatgggtggttatgccttatattatactcctttcatctacttttgatagccatatttcatcttggcacaatgacgaagaataagtaattctacttatcatccatttaaacatgctactagtttttttag

SEQ ID NO: 2136 - DNA, 1501 bp, Oryza sativa
tagctagaagaattcacccagcaagagcaaatcaaccacatatagcatagatggaggcatattccctggctcttaggattcacaacaggggatttgtacggctcgatcgccataaattggtttaactagcacataatttaaaaatgcactgtttactaccccaagcaccgaaatcacctataataacagctcaaagtacggagaaaaagtaatttcgcagttaaataaaattaactctccctagatacagacaacgaacaaggcaacaagccaatagaaaccatgccaagccagattcctcagaactcacgccgcaacaccctagttccccacggaatccgccgcgagaaacccaaaccacgcaccaggatcatccgagaacagcgacgaagccaatccggactcgccgatgctccatccccgtcaaaacccacgcggcggaggcgcggagcaccatccaaacatcgtcctagcctacgagctccaaaccccctcttccttccccccctagctcaatcggattcaatcaaaaacacaccgcagcttctctccacgccaaccaaaccgtaactactgcaccaagtaaacgtggaacctcacctcagcgatcgcggcgagacccccaaactgctctcctcctcctcgccgcaacgccgccgggtcgtgggatcccgtggacaagcagccggggaaccctcgcggagtcgcagcgactagtccactacttaccgatttctcggcgggaggggagaggagaggggagggcagcggcgtggaaggggagatggaggagaaggacggttgccgcgggggcgagggcgcaattaaggaagaccaaacggtttccctaattgcgcgcttctcttgttgttaagccatggaggactactactaaaccccaccaccacccggggggcgggggatccggtacgtgtaccccgggcgtgtaccccggcccccaccagtgcgctgtgcagtagggcgatgaggggattggaggagctgggcctggctaggtgggggctgtggtcctgggcttttccctcgtgcacacgcaacttcgtacccagagagaattaacactcctgtctctctgcggttaactacaggtttagactgagttcggaggcacccttgctgtctgacacgaaaaacaaaacaaaggattagcgcgagattaattcaatattagtttaaaaacttgaaaaatatattatgtttataatcatataaacactataaatactttgagggttatgtttatgatccatcgtatataaattgtccaatctatactccatccatcccaaaatataaacattttcaacatagtgtcaaagtcaaatgtttttaactttaactattaatagaaaaaatataaaaaagatcaatcatataaaattgatattactagatttatcattaaacaaactaccataatatgtaacttattttatttaaaatatcttacttttatagatattgttggtaaaagtagcat

SEQ ID NO: 2137 - DNA, 1501 bp, Oryza sativa
gtatctaataaagaacaccctccatcttctatcaagttcttttcattggttgcttagttttttttttccgctgggccagccaaaatttattaagaaggggagggttttaaaattacaaatttacagcaaactgcccaaacctggcttagtttcatactgtattatcttaccaggttgaggacaggacatatttggtatcagaactttcagttatagcaagacaagaaaaggccatgcttgatgaatgcagagaattattagctatggcagcaaaactacaggtacttccaatgtaatcccatgtaatctttcctaaatctgagcacagagcccccttgaatatcaaataatgtaatttctctgtaattgatggcaaactgcccatgatggcaacagttcatacacaaagccttacctagagctgttgtatttttaatcaggtacaggagtccagcttgcggacgcatctcacacaactgaggcctggaattgctcatatgatttgacaatctaagggaagatctgcaagtcccagaccagccttctgaacaggtacaccagtgcaagttgagcctctggcgatatgaacatattgtgcaaacatacaaggagtttgtagagatgaaataatagaccaaaagaacgttgaacatcccctggtgatcatggagtgatgctgtgcagctaacaactcatggtgcggtacagatgatagatttacttaaaaggtctcctcatgtgtaaataaattcattcaggttccccacacccacctacctctctttagtttctctaaaattatttgttagtatttctacaatgatagagctatgttctttccgattgtattttttggcatctggaaagaaaatacacagatgaaatggaagggcaaaagtaatgaaaaaagtgtatttccctttttcttctcctccaactgttgttgccagatatataggtctgtagctctactcttttcgtcagcttgaccaacttaagcgttgggtgaatgctgacatctcactcgtaccaatatatattttctttggattgcagtttactctaaacaacactgttgctgggcacatttcagtttgttgaaatgtcagaagtaccttatgcagtagttgaaatttaaaacataagagttgaattctcatgggatggccaatttgccgtatgcgttcttaggatgttctctcagatttggtatccttttggtttcacttaggctttacacctaggctaagccttgcctaacactttcttacctagatgcaagactcaaaattctagtatttgttttgtttgagtcagtttaaagcaaagctgcctgtgctgcaatctgaatatattccttgtaggaatattacttcagcccttgaccaaatcgattcatatacttttaagctacattaatgcccatggtttggtccaaattacccatatatccctagtaggagcaatgagaacacagctgcaaaaaatctaacaaacatgg

SEQ ID NO: 2138 - DNA, 1501 bp, Oryza sativa
tttattaaatcatatcaagattacattcttgagcaagaagctcagaaacattccctggagcctgcaggcgccaaacgggtatcgttccatcgatcggtggttacctctgttgcgccaccgccaccaccagccaacccatcagtcgagttctcggcttcacccttccaattcccgagttggcttaacgagtcagctagctcaattcaactcatcgagtcgagccgacctgatagtactatataaaactgattgattcatattactacgacgttttagagcatcaccaagaagttttctaaactgaaaataggaaataaataagttgatctccctaagagaaagcctaaattttatcaaaaaaaaatatttttctggaaatattttttttgataaaatttaggctttctcttaaagtgatcagtttagaaaactgaaacaaattttcggagagattatacgtctgttgatgcttaaggctgtgttcggtagaacaagttcgcatccggaacagaatagtgatcacagaaaacagagcggtctattagcgcgttattaattatgtatttgctatttttttttcaaaaatggattaatttgattttttaagcaaatttcgtatagaaaattttaaaaaaacacacaccgtttagcagtttgaaaagcgtgcacgtaaaaaacgagggagaggggttgggaaaaggggcatcctagctgcagccgaaaaacctacatccagtttgtggaaaacaaaaagaaaaaagaaaaaacccaaaacctaactactgtagcctgtacgcacatctatcccccatccgccgccccctccctttcgtctttcgtcgctcgctactaccgtgccgcgtgccgcctccctcgatctcacgattcgcctccgccgccccgtcctgttccccaacgctagctcccattccccacgcctccctctattctattcccgctttccctatcttccaaagccgccgagccgcgcggccgagtgcaaaaaggaaaaatatcggtccccgcgagctagggtttaccacccccccctcgtccacctctctctctctccgggtgcccacgccggcggcgagctctcctcaactgcgccgccgagagcccccccgccccccctgttcgtgggggaagtacaggttcgcagtgccaccctctgtgtctactagtgaagtttcagttttggactatgattttgttattatgctccattatgttgggagattgggattggggaattgaaacagtcacgtgaatccaattaggcaactaaaaaaacaaaaacaaagagagtacaaaatagggaaaggcgaaaaattgagaggcaccgcactggggatgtttgattgcttataattcaatggctgatctgtaaatgttagccatttcggcttggaaatgagtggaaaaagctaattaatcggaattttttcgcaggctgatcttagttgggggggtatactctgcggtctacttgctactccag

SEQ ID NO: 2139 - DNA, 1501 bp, Oryza sativa
aatttttctagtcttttataaaatacaagattatttagagaccatgtttttacattagttgagacgaaaatgatcttactcaaaaatattcttcttattactattctttccattttttcaccctcatgcaaccatgtttccatattatataggctaagagtcgttgttgagctgttgttacccatagcaccgatgttttgtctctcatctttcgctctttcatgtcaacgaatattcctaattaacaacgccaagagtccgctattaacaaccattgtacatgccgttgcgctgatctcgctttcttgtgattctctgttatctttctgttttaagatcgtgattttctagggtaacaaactctcttttctccttaaaattcaaaggtgtctttccctttagctaaaaggaggtttgcatttctaactgaacattggtgcattttgtgaagcttgttatttatatatttgtaacagcttatgctctttgagacatgtcattgtggatgcctctgttatgatgcgtttgttgttcggcatcgaactaaataagctgttgagtgttgttcattcgtttggtgtggtattatccgtatgtggaagttgttatgatgcgtattgcttctgtataacgagcagcactcttttcatgtcatgatgactgacattacacacccttcatataaagccatatatatcttttattctccaggtgtgttgtattccttcaatacggtaaaacagatgcaaaataatccaaggtttgaaaattgtaccactgttgtgtagccacaaaatgacatgtgcctaactgctgaatttgagtggattaattgatttggaaatcctctagttatctggattagttttggcctttcaaatggcgcactatcgatataggaacctaagtttgcttgtctttttaccggtaatcctgaacttgagtgccttgtgttcctgctcggacgaccactaccatgttcatcattaacctctccatttcaacctgttcacgatcctgcttaaccaatccaaaccatccacacaaattgaaactcctacaacaaagttctcctgatgatttcggcactgaagaataattagcttttgtggccggcagtgctgcctaggaattcagggaaatgtctctctcctccacgctgcattgtcgtgtggatcttggatcgttgggagagattagccggccatacactagtacagtagtacaatgttaattacattggctaatcaaaattacagggagagattagcagtgtaccagtactgcacaacgttaattgcattggctaagtataaaaattagtagggaatcagcggaatggtggtgtgaaaaggtgcatgatgcgagagcaaatcaaggtttagttttcttccctttgaggctttcactcctctcgttataaaagcagttctctgtcgcagcggcgcgggaggaggtggcagagaaggaaggaagccaaacggcatgggctctcgtggcg

SEQ ID NO: 2140 - DNA, 1501 bp, Oryza sativa
ttggttgctctccaagctgagggactggtttggactttccagaagatgctttcttcagcgttcgctcatagtccgatagcttgatggcctccttgacaggtgcagacatacccctgaagaagttcctgacactcgggtctataggaatcttcttttctggacttcgaggcttgaattgtctcttgacttctgatgccacgtaaacgtcaagctcctcttgcgtgcaatcgtaccccgggtccttgttcttggcggcgtcaactttcgccttctttgttgcccttgtgtgggcaggcggtggagctggagggggcccttgactttgaaggtgccggaagaggagcttgcggaggagtaggtgtaggagcccgaggaggagtcggtgcaggagcctgaggagcagtcggtgctggagcctgaagtggagacggtgctggcggagcatgaggaggagacggtgcaggatcctgaggaggagatggcggagccggaggagatggtccatgagacgccgcttgtcgcccagggaggatgatgtaccgcctgtgccatagaataatggcatggcttgtgtctcgtagatgcgtctcaccgtctcctccagggtaatctagctcgaggtcctcgtacgctccttcgaccaactcaacttcgaccttcgagtatcctgctggaatcggcctgcagtggtaagtacctgaagggtccgttgggatggccatgcccgacgccaccttcatgtcgtgagagattatttattagtaatcaacatatataagcagcaactagcggaatggccaaatctaaaatatataaactacgagcttacctttattgataagttcttgaaaggaatatacagctcacatggtgtccgctgagtgatgtcatcaacaggacaggtcgattcatcctgggtttgcatggcgtccatgctctgtgatcctacttgccccgttgaggcgtagctgctatggtttcctgacgggctcaacattgcaggaggaatggtcggctggggatcatgggaccgatgtgcggccatgcgttcatcaaccttccttgccacctcctcttgcatgttgagctcatagctcgatacccaggactctaaatctgcaatcttcgcctcggtatctctcttgctcctcatccgactcctgtacgtctggatgtcctccttgaaaccaatcttccaaggaatcacccctttccctcgtgttcgtcctagatgctctggagtctgtagggcgagtgtcagctcgtccctatctctgtccggttggaatgtgccctgtgaggaggcttccactacatctgttagtcgtcgcgcagcctctcgtatctgatcgccgaagaccagtgagccatcagctgggttgagcgttccaccgtgagcatagtaccagaacttcgatcgtttcggccaattagcagttgccggttcgatacccctctcaagcaagctagcctccatctcctcccacttcggcatcgcgac

SEQ ID NO: 2141 - DNA, 1501 bp, Oryza sativa
atatatatatatatataaaccatgcatatatatgtttcaatacatatatatgcatatatatatatatatatatatatatatattattatatgtatatatgtttcagtacatatgtacatgcataatatatatgtatttatacatatatatatgttatgcaaatgcatatgtatatatatatatatatatatatactatatatatttacattatagaaaatgtttacacatatatatagaaacatatgtagtcatgtattaattacaatccattatatgtcctagctagctacgatttcgacgtagtagtagtcactagctcagaagctaaggacctatgaattgtgtttccgtcgtagtaaaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgttacgtaatgaaattttgaatttatttgtacgtacatcgagctctcttgtggtgatgatttggtctacaaggcagtggcaatactcgcacacgtagtagccgcacaagttagttccctgcttttgctttgcgcactacaaataaatgacaaattaacggcgtgagatctaattaatatacacttgtatgtattaatttgaatcggagaaatataaatgtagagcatgtttacccacaggaaatttgaacttccgcttaagtctttctctccagttgccgcggaccaaatgacggaactgataccaagccctacatggagtttaaagatatgattcatagtagcaattaacataacaagaatttcttaattaacagaggaacttataacagtacctgtctataagttcgaaaaccttgtcaaacgtagactcttttttatccattgagtcatatacgttgacggtgcaggccgacaggtcgaagagtaaaagcacccagtggaatctgcaatgtgcgtgggatgcattacatatgaaacacttagcaagttcgtacaggaatgaaatttggtatataggaagatagtaaaattaaactaactctgtgttgtacggcaacagtatgaacgtcttgtaatgctgcgcctgaaggagatggacgagattgtcctctatgtcttgcggatattggtcgagcattgcgacgtttactttccgagggtcgatgaatccagtatcgaaaaccctccgccgtcaggccctttgaatctccattctacaacgataaaagggagtattttattttatatagtctacttatatacaaggacctaattaattaaaggagacgtagtaattaagaaatctaactgaacgatatacttacaaaatccagcaactcataatagagacgtcgagggcgtccagctggtatagttcgtagattcccttgaaattgatccagagaatgtcatctccttgcaagaa

SEQ ID NO: 2142 - DNA, 1501 bp, Oryza sativa
acatgaagagaatagtgggaagtaaactgaatgtaaagaaagtgaatccgagttgcttgttcatgggagctattcccagttatgaaccaagtgatatgttcgaagatagtttacagaggtcagattaaaatcacatgtaacagcgaagcttcagatttggcagggtaacgatcaaaccataacaagtccagcagtaaagtcatctggaaaggcgtcaaagcatgtcaagtgggataagttgactctgttgagaaacataattgaaaggcgaaaattatcgaccctcgcatcgaatagcagaagtagctagcacccggagaccaggaaagctaatatgaggcagtttgtggcaacttagaagtaaatgacaagcatgatattctcataatgacaagcatggtatcctagtaatgacgagctgatctcgacgcataacgtgaaatgggtaacttctatgaggttgacgccaaaaatatgaactatacgaagttctggaactgaagccccatcttcaagtgccgcaacccagacgaagtcagctaaaggttcaaccagggacaagtcaggtgaagagaagattccatctgcaacaggagatcgagacaagcagtacagagtggagaagttttgctaggcaagtttgttatagaagacgcgacggaagaagtcagataagaagagaagaccgcccaacctatcttcttgctagcctcctcgaatctcggggacgagattcttgtaaggggggtggatttgtcacgtcctgataaattcatcccgaaataaaaatcattttctaaaaggaataatagaattaattaaaattcggaaagaaattggcaaacactaaaatacgtacaagaaaaattcgaatgtggcccggagaatttttgttaaattctccttggtcaaaaaggagccctcaaattttacttgaattttcagagcaccggaaataattattaagcaacaaaaacaattatcaaagtttattaaaaagaaaaacctaaaaataaatcctcttcctcctttgggccaagcccagcccaaagtctccctctcctccctctctttctctccctctccttctctccctcctcctcttgggcctcctcccctcccggcccactccctcctccctctctctcccgggctccctcgccctcctctcctcctgggccgcctctcggcccaagccgttccgccccctcccacctgggccgcctccgggcccaacccgagcggcgccccccctgcctgagccagccgcgtgcgcacgcgcgccgcacgcgcgctgacgccgcgcgcccgcgtggggcccacgcgccaggccggccgtcgtcttcttcctcctcccgctcagcctcctctccctctccgggaaaacctagagccgttcctcctccaaatccgcgcaaatcaaaccatggattccaaaattaattggggggttttaaatcccattgattcctcttcaattccccccaatttcccccttgga

SEQ ID NO: 2143 - DNA, 1501 bp, Oryza sativa
aatttaggtcccccttatgttgtaatcattagcaaatgtacgtgcatgaatttaggtcccccttatgttgtaatcattagcatgtaacatttgattacgagttttgagcaattttcatgagttttcttagtgccaaaaacatttggaatgtataattgtggcgaaatattgggaaaaaaatatatatggacagtttacttatagagaaaaaaaaatatgagtttttttggtaaaaagatctttctatgcggctggcttaacagcccgcatggaaagatctttttcgcatgcggccggcttaacagcccgcatggaaagatctttttcgcatgcggccggcttaacagcccgcatggaaagatctttttcgcatgcggccggcttatgtcgaccgcatggaaagatatttttccatgcggtccctaaagccgcccgcatgcgatgatctgtgcctatatatagggagcgcggggagccaaaattttctaagtcccggctcccgcgaaaccctagccgccaggctgccaaaatttcccaagtcgccatcgccgtcgtccccgccaccgccggctcctccccaaagtcgccccgccccacgccgccgccgccgccgccgtcaggacctctcccccctcgccgttgccgtcgccgccgccaggacctctcccccctcgccgttgccgtcgctgccgccaggacctctcccccctcgccgtcgccgtcgccgccggcaggtcgccgtcgccaccgcacggaactctcccccctcgccgttgccatcgccgccgccaggtcgtccccgccgccaagtcgtccccgctaccgccggctcctccccgaagtcgccccgcccctcgccgtcgccgacgccactgccaggacctctcccccctcgccgtcgccgtcgccgccgccaggtcgccgtcgccgccgcacggacctctcccccctcgccgttgccatcgccgccgccaggtcgtcgccgccgccaggtcgtccccgccgtcgctcggtaacatttacttttaaaaaaagaaatgtgaaatgtgcaattgtggattgtggattgtttaattgtgcatcgtggattgtgatatgtgcaattgtggattgtataattttgagaatgtttaattgtggattgttaaatggagatttatgtttaaattgggacttatgtttaaattgggacttatgttaaattgggatttatgtataattgggactttgttaaattgagatttatgtataattgggacttttgttaaattggcagctatgttaaaatgtgacttatgtttaagttgagacttatgttatattgggatttatgtataattgtgatttttgttaaactgagatttatgtataattgtgacttatgttaaattggcacctatgtcaaatggagatttctgtttaattgtgacttatgctaaaatgggacctatgttaatttgagatttatgtataattgggacttatgttaaattgagattta

SEQ ID NO: 2144 - DNA, 449 bp, Oryza sativa
gccgccccctcccccggatatgcaaggggaaggaggggagggggcaggcgccgccagatccgccacccccaagcccccccccttcgccggatctgcacgggaacggaggggagggggcgcgcgccgccgccgctgtcacccgtggccgccgcgtgctctcctcccgccatgtgccgcccgatccaccgccccctcccccggatctgcaaggggaaggaggggagggggcgagcgccgccggatccactgcccccaacccccctccgctggatctgcacgtatgggcgacagcctggagcctgtcccctatttttccttgcggtttcacttacgatccgtatgggaaaaggggggggggcgtccaggaaaatctattctgtagtagtgacaacccaatggttgggtcgggcctgcacaggactgacccagttaagccgtgttgtactagg

SEQ ID NO: 2145 - DNA, 1501 bp, Oryza sativa
cctattagaaaatgtgttgggtgttgtatttactaatataagctaaatgttgccattcatatggtttaaaaatctatgtgatttttctaaatatgtatcgagtgaccaataggtagtctctagcattatatgacccaaagaaatacatttattttacttttaaaatgtagttaatttaggtattgaattctaaattttattgtaaataatctcatcctgtgcacggataaaaaatagctatttatatgatatagttgtttaaaataatttattacaaagtacgttttctaatattaattaagaaaatgtttgaaaataggagggcatgttgccctcatgtattagggtgagggcagggattatgaaacgtaactacgtatatatacctaatgtaacataatggatggcagcggtggggtgtgggcctttctttttttttctttaagtaaaatccgaggatagaaaatatgggtgcaccgtatattagtgaaaatcgacggctagatattttggtttttttttataatttgctagagtgacacatggtgagatgcgagtgtttgtagaaagctgtacaacggtttgagagcgttttaaggatgtttaatggcgttttagtatataatagattataaaaaaaacaaactattatatatcagccccatgtgtcgtgatatatttaggaccaccatataatttttataatttaattaaaggaaaataacggaatcacaaattagatatataatttaaaaataatttagaagatggttcaaggaacattgattggatattttatattattattatagatcttagtttaactatatatattcatatttgtgatgtaatatattttagaaaaccatattttatataaagatcatggatttttatgatgtattttttgtcgtcttttttatgcatatgcgtatggttttttcttttctttccagcgaacagtacgtaaactattgttttgtttttgtacgtacgtacgtacgggagaagacatcgtataaaccaatagtagaagcgcttaaatcatataaagagaaagttaatttttttcaataatagatctaatccaatggtataaaatgatgggtccaccaatttaaatgaaaatcgatggtgagatttgataatgccacgtggcagcctaggagtgtttgtacgacgccacgtggcggtttaggagcgtttgtaggaagtttaacggagttttagtagatagtaatagatttagatgttaaaaaataaagttgttttgggggcgaagagagtacgtatttgggggggggggggtggttaggaattaagttagcaatggattctcatcgctatggggacagtaatacacaaacaattttcgtgtataagcatgttgcagacgaatcataagtatctgcgtcaggaaaaattcgttgtcctattttcgatatgactccttaagagacccacacgtgaaaatatattttcgcagactgccctcttaggg

SEQ ID NO: 2146 - DNA, 1501 bp, Oryza sativa
aaatttgattacagttacatatacttgataaaaatgtcaactacaacatcttggtattgcaaaaattgtgttaactattcgcatgattatagttgcacaaaattataattaaagttgtacaaatttaaaaccaaagttgcacaacatttaaaaatggcaactatagaaacatacggatgcaattgctataggacgatgaaaaaacttgttttagttagtaaataatagtactatgtataccatatttcaaagtgatacgactctattatatatttgtacaaactcagcttatctgcatataagtaaatgtcaaaaacaaacatctttgtgttgcgaaaaaaaatgtattaactattagcatgattatagttgcacaaaaatcataattaaagttgcacgaatcactaaccaaaaagttgtacaacattaaaaaatgacgactgtaggaacaggaaggtgcaatttttgcatataaaaaaagtaacaaaactggatggatatgacattattcaaccacccacatgtccaagctcagcagcaaatcaaaatcttagcagaaggaaatgtactttttttaccctgcagcaagctccacccccccccccccggggtagaatccaacgctccctgaaaacaaaaatcgtagtgagctactacatctgagcatacaatcagtctgaagttgtgcttgtttataaccaaaattaggaaaaaaatcgtatagtagtcagctaaaaaagaattagttgcacaatttaataattgaaattgcatatatttataacataacttgcacgaaatgtatagtattagttgattttgctatttggacaatgctactggtatgtagatggttcaagcgggaaaaacacagtacatgaaaaaaagagaggcacgcttgctgtcgtgtgttgatgagaaaaaaaaaagattcaacataaaaagtagtatgggttgcaaaaagcaaaaacaaatgaaaagttcgacataattactaagaaaacaagttgtctaccaaaaaaagtccccagttgtatgcatgttttcctaaaacacaaacgctatttatcaaagtaaacggaaaaattggctcaaaaaacattaaatgcacaaacttattacacgacttgcacgaaaaatcaaaatggctactacaatagtcagggagtgcaactagcatagataatctcaaaaaaacataatttcaaaaagattactctcctctctcaatgctctgctggtaatctcaaaaagattaaacataattgataggagcagagcctagagttcattttcagggaggcttatctcagattgatcactgatggaatggaagcaaaagtggcttagtatgtcacagttgagcagaactactgttaaaaaaaatacacagcacacaaaaacaaaagatagctttttctgtatacaagcacaaaaaaatctccctgtatagagtgaccactaaaatggactgattaactcaaaccctctatgcacaaaa

SEQ ID NO: 2147 - DNA, 1501 bp, Oryza sativa
ccttttccacacgcacccgccagatttcctcttcagcttcgtttcacttcacgtatgcaggtgggattacatgggcgcggacgggcggtactacgaggacatggaccggatggtggcgttccagcgcgggatggcaacctgggccaactgggtggacgccaacgtcgatccagccaagacccgtgtcttctaccagtccatgtcccccacacactacaggtaaatctcacaagagccaatctcatattctcatctcaacctcatgattccatcaccccatctctctctacagtgtacacagtacactagacaccttaccatgtgcgtgcacgtgtacagtagtacactcgtactatgtggcaatggtgtattgtatttcactctcttttctgacaacgcgatctaattttgttctgatctgtgccgtgggccgctggatcgatcgaccagctcgaaggagtgggccaacccggtgtcgaagaactgctacggcgagacggccccggcggcggcggcggcggcggggctgaacgcgacgacggcgcaggcgacgtcggggcaggaccaggtgatacaggccacgctgcggtcgatgaagagccccgttcgcctcctcgacatctcggcgctgtcggcgctgcgcaaggacgcgcacccgtcggtgtacagcggcgacctctcgccggcgcagcgcgccaaccccggcggcggctcggcggactgcagccactggtgcctccccggcctgccggacacgtggaaccagctcttctatgcgcttctcttctaccaatagctgtagcctgtaggcagttaatttcgtttttttttatatcgctcggtgtaacaatcttcagagtgaaggtgaggaggcgtggtgacagtaggcacacatggatgagactctgagaagaatcaagaatgtacattgattgatcatgcgctgccaaattgcagttgcagtgtacacggttgtactatgatctgtctgtgatctgtcgctaaatactctgataattgtgactctggtacccacatctaaacatctttgataaccttgcacaacagaggatatttgacttgatcgctaataaccacacgcgaggttctttcaactacgaactccctttgtttttttttttcggacatgattattctcagatcaattcacgattacaaacgaaaaaaataatgtgcattgtaaatacaaacgaggatcaactaccggtctaccgcacggtacaacgtttacgaattttttttatttataattttttttattaaaagttttacaaaaataattttccattttgaaaattgacggaaggagtcgcctaccgccctctgggagggcgatttttaaaaatcgccctctcagagggcggcgaaaatgacgtggcagacggccgttcgctctcgggcgacggccgtcaacgaaatttgcaggcggcccccttgccgccctccgctagggcgattttatactgtgcggggggccgcc

SEQ ID NO: 2148 - DNA, 1501 bp, Oryza sativa
attttttttccaaaagcttgcataaaaaatagaatatttttatattttggtattttgatagtaagggctttgatggcggtggaagctcttatatagattctcataatttatgaccacaaaaatacaaaatttgtagcacaatctatattgctattgggtcaaagccaacatgataagctattttaatcatcaactaaatgccttgttactcatgtggcatccttggaaacagtgatgtaacattctaatgtgacattactcaggtggcatttaattgaacattcttaggccattttataagaatgttcatattttgggcatgtttatatttcgggaccagagaatttctaattatgccgcaatttataatctgaactgtgatgtaactaatccacatgtgcaagagaaggtttggatgaattagttgcagcagacaggtttattgcgttgtctatcacggtatacatatgcaacaatcaattttttagtgcacttaggataatgatctagtacatacattctacaccaacacgcaaaaatgcataagcgttcctattacaatctcaatgatcatgacacagacattaattatatatgtacgctgactccttttcgattgaaacgaaacgtggaatgtgttccattagtctaacccgtccaagcactgaacttatgctgcatacatgagcgagagagcgtttgtttttcctttttttgaaaaagttttgtgccaaagttgacaccacataccatagacttggttgactcactgctgcaatccacctttgaccacccatgcataccaaacgtactactgtattgccacgtatacaataccgtacgtacgtgctaaactaaactatcttaattagcagtgagaaagacgcatcgtgcaacatccgataattccacaaatccacaccaaacctacggctttcacacacatgcattagatcgatcgaaccgctaattcctggaatataatcgccacagcgctaaattaattaaaccagtcagtcaacccacgagttaaaagcggggcggcgtcgcacgccaaattcacacgtgacagctaccgtcttctcgtctgacccgagtccgagtcgaccgcaccgcgtcgtccccttcggttcaccggcgcgcgaacccccccacgcgcttcacggcggcccggtccggtccgtggctggcaatggcagtataaaaatcgtggacttctcttaatcccatcaccaccactacccgcacagcaaggcccatccgcgaacgcagagcagaaaaatcagaaaggaaatccgtgtaagccgtcaggggcagcggctgctaccgtcggtggcggcggaggcgatggcacggctcgtcctctccgagtgctgcggcctcacgccgctccgcctgcgcgggcgcggcgccattgcgctgccggcgccttccagcctcgccggggggccgcgccgccccgtgtccgccgccgccgcggggggagccatccaccgcgagt

SEQ ID NO: 2149 - DNA, 1501 bp, Oryza sativa
aagggagaatcatttctttattccaccattccacaaaaaaatgtacttttccattttctaccacaaataaatacccttgatctaggagtatgactgatgatcttcttgagtccgtatttttggctttgtaatatatatgatgcaggtatgtcacaatttgtccctaccgagctccacatatcagccttagaatagggataaattctggtacattttgccttggtgaggatccaaaaagaaaatatacatccttgagagataagagagaaagtcaatacgaggaaaagagctagtttgcgaaaattcataaaaatcccatgagtctggcacagaagcaagagggaatcgaatcgagatcgttccatttatcaattgctcaagatggtaagatagccattgataaagttcacaggtacatgtatggttgtaaatgattttatatgcctgattcatatcttgaagaaattcattctacactaacctttactcagggatgagcaaagaactaagtgtggggggttttgttggcggctgttaaattttgattctataccgccaacatctgcataaaagtccagataataaaacatccaacatagtgataggtgcttaatctcacatattccacaagtgttggtgtatatttgtatgcaggtgataaaccccgaagttgggaggaaatctagactaaagtgaggagaatcttgtatcaacacaaggatgggttgtgaacttcatcaaaataccagagaatcagcccaaaataccgaggaatggatagaggaggatcaggggaggacatgggccaaaggccaggcctggggggcatggcccaagttcggcagaaccctggtgatcaccgttgatctcaggttttggcatggacattcgagatcactccttgatggcggttgcggggcagttcggacatttccccttcgctaaccgtcatacctacctctatataaagacttcactttactcacttcgacacacacttccaagcttgagctgaattataagaggctctattgtactatattgcatactagaataggaagagagtagagtagaagaagtcggaagaattctggagttgtcgataatcttctctcatttattttattctgtttattactctgaattcaatataatattcttcctgagtaatttagatttatctcgtgagaattatttcttggttagttcctaaatagcatacgggatcattgatcactatagtttatttatttatagtggttgctttagtgtttgatcggcactagagtagttattaattgcgtagacgcggtgtctgggtaattaatctacagtggttgctgcgcatcccacagtacgtttgaggtaggtgtagaggtggtgacagcactcaagagcacttaagtcctccctgtccgggtacgtagtagagcgacatctaggaagagcgggtggccagtgcccgaagtattgcgttaggattaaaattaagctttccgta

SEQ ID NO: 2150 - DNA, 1501 bp, Oryza sativa
acgaagtaaactctacaaaactacctgacaacatcatctcattttcttctttctcaccaatatcctatatatacgagttatgggaatgttttacgtttgatgtgcctagatttttcaaaattttcagccacctttttcttcccttgaatgataattcaatggttctcatcattctcctattactcattatttttttaaaaaaatgcctcttttttagatgaaaggttaaacaataaattattttatcatataatattatacacgaaataaactacttgaacaaaattcaaacttaataaaaaacaaagtaaaacgaaatataacaactaaattaaaattaaattgaactaaagttacatattttcgcagcatctgtaattttcagcttagcaatatacaactttaggtatatggaatttatcaattttcacacgcctgaaatctagaaaatcccacaatttacttaaaattgctaattagatgccacgtgacaccacaaactaccctgatttaggtctaaggatgaaatatagttgatttcaagaactgagagatcaacaatgaagagcttcgtatagtggatagaccatgtgaaagggcatgcagtctaggggttgtactgacagttcaaataaatttagattgggttatttaaaggctaagttcctaatttaaaaatactgcatatatctggttggatatagaggcccgggtataaatgcccttctctaataaaaaaaaagtggatagaccatacgaacaatgccatagttgagttgagggaccaaacctggacttttctcggatggagatcgaagtctcgagtggtacacggcacagcatgaaggcaactacattaccacataatataaccgattaaataaataaatcgggcgctgaacaggcagtataattgaacgatgatatcgtacaattcttccataagtgcaaagcatgatttagtgatctgcagctttcgaaccactcaggtctgaaacttgctgcccctgcccactacagcagaagcagttgggcaaacactcagtggctcagggccaataagcagtttttgatgcaggcgttgagaacacaatttgttggaacagtatcagattagttagcacgtataatgcctagtacttctacttcaaagcagtatccttcagcacctttcgggttgacaacgacagtgaaatacagtaaaagatgctcacgcttcggttggctgtctcaactccaaatattgcctttgcttcactcctactcaagtgaaataggtcgttaaaaagcaagtgcctagtgcaccagctctgtccctgacagtacagtcatataattccctcactttaattacatttcttgctgcagttgcaccggcatgagcaccattaggtaccaataatctgctactaaagcacctgaagctgcaatcacagaaacctcagctcactctggaagaagccaaccatcagtgcctctgcctgcacgtagtgagctcaca

SEQ ID NO: 2151 - DNA, 1501 bp, Oryza sativa
gacgggcggtactacgaggacatggaccggatggtggcgttccagcgcgggatggcaacctgggccaactgggtggacgccaacgtcgatccagccaagacccgtgtcttctaccagtccatgtcccccacacactacaggtaaatctcacaagagccaatctcatattctcatctcaacctcatgattccatcaccccatctctctctacagtgtacacagtacactagacaccttaccatgtgcgtgcacgtgtacagtagtacactcgtactatgtggcaatggtgtattgtatttcactctcttttctgacaacgcgatctaattttgttctgatctgtgccgtgggccgctggatcgatcgaccagctcgaaggagtgggccaacccggtgtcgaagaactgctacggcgagacggccccggcggcggcggcggcggcggggctgaacgcgacgacggcgcaggcgacgtcggggcaggaccaggtgatacaggccacgctgcggtcgatgaagagccccgttcgcctcctcgacatctcggcgctgtcggcgctgcgcaaggacgcgcacccgtcggtgtacagcggcgacctctcgccggcgcagcgcgccaaccccggcggcggctcggcggactgcagccactggtgcctccccggcctgccggacacgtggaaccagctcttctatgcgcttctcttctaccaatagctgtagcctgtaggcagttaatttcgtttttttttatatcgctcggtgtaacaatcttcagagtgaaggtgaggaggcgtggtgacagtaggcacacatggatgagactctgagaagaatcaagaatgtacattgattgatcatgcgctgccaaattgcagttgcagtgtacacggttgtactatgatctgtctgtgatctgtcgctaaatactctgataattgtgactctggtacccacatctaaacatctttgataaccttgcacaacagaggatatttgacttgatcgctaataaccacacgcgaggttctttcaactacgaactccctttgtttttttttttcggacatgattattctcagatcaattcacgattacaaacgaaaaaaataatgtgcattgtaaatacaaacgaggatcaactaccggtctaccgcacggtacaacgtttacgaattttttttatttataattttttttattaaaagttttacaaaaataattttccattttgaaaattgacggaaggagtcgcctaccgccctctgggagggcgatttttaaaaatcgccctctcagagggcggcgaaaatgacgtggcagacggccgttcgctctcgggcgacggccgtcaacgaaatttgcaggcggcccccttgccgccctccgctagggcgattttatactgtgcggggggccgcctgcaaattggcggcgagggggggcatggaattttgcaggcggcccccttgccgccctgggggagggcgatttttgcctc

SEQ ID NO: 2152 - DNA, 1501 bp, Oryza sativa
atataattgttgtcgaatgacaactgcgtcacgtcgaagaacaaggaaattggttggatgttttgaacagtaaaacaatatattgacttgaaaaaaaaatttgggatcccccgttacattgccctagggggctatttatagccttagtacaggcttacaccttctatggtttagattgtacaggggaatttacatggatacccttattatagggatattagtaagggcacacagtgtctattacacttatgggctctaatgtgccaattaggctggcctagtcatggcgaacggggccccatgggcctagcagccatctagtcctcctcctttgcatagattccagcttgggcgaagccgtcgtgcttcgccacataaccttcgccatgtgcctttcgcccatgtgatcctctcgattgcgaagtttggatacggggctttggtcttcgcccacatgcttcaccacatggctttcgccatatgcctttgccttggtcgaacccgacgcccctggcttgtttcctcgtcggttggatggtttcggcaggtccggtcgaaggccctcgtgacatgcctccaacaataatgtatataataactcgacgtcttacatggataaaattagagtgttcaagcaattgaagcactaatcccgacaatgcaagccgccataacaagccttatccctcatcggagatcgaagttgatgcagcccaacttgaaacaagaactcatcgaaaataaaagggtggcgatatgccgaaagtagattgtgttgatctttggagatagattacaatgaccccgggtacacatatttatacccataggccgttaagagtcccgatcggacattaaacacacttttctaatgataaaaggaaaattacaagtgctgatcagacactcgataaatattttctaaacataaaaggaaaattactatatcttgcctaattaatagatggaattaaactatcattccgtggtcttcacgattcctcctcgaacttggtctcttctggataagtgttgacggtcgttatcgatcagtttcgaccatcaatattaccaaaatagaggagaactagtgatgcttgtaatccataaatatgttagaataataatattccactggtattaggtatactaaccttttgcagagaataaccacaaagtggaggagaatcaacatcaactcaaatgataaatcaatcggacgatgtcgagaatcagacttatgtgtgaataggccaagaactcagaattgacatgatgaattgggccaaaatttgcaagtctatgaagtgaagcaacggaggaggccacctgctgattttgtgccaggttgggccggcccctggttcgaccgaaccaggaggttcggccgatcctccctctccaccgttggatgtggggtttggcagggacggtccatatattgtcctgatagctgttgcggtgtacttcagatatttcacaacggttacaaccgtcatac

SEQ ID NO: 2153 - DNA, 1501 bp, Oryza sativa
atcaacacaccgttgacagcccttaaatatcattgggaattttttatgtctactactcggattgcagtggtgcacatggatggcttgcgtggttctagccgtcagaggctgtccttggtctcatcagcctcagccaatcagtcatcaatttgctttatgagcccttaatgctcctgctttactcacctgcatcttttgtatttttgtgtttcaattctggtataactctcatttcctaacaacttcatctcttggaaatctgacctgtgcgcacatttccaatttatttttttacccaacagaattttagttgagttaaaatggtctcttacgtaccataagcattgcccagtgatgatggttaattgccaatgcaatcaagatcattagtgcattgcattcaaattacaaacttgaagtcgttccaaaatccatgtagtcttattgaaacatatgacttacttcagctcctggatcttaaaactgttggaattaatgaatgggtcttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctggcctggcctggcctgggcagggcaggcggcgcgcgtgcacgacgtacgcgtcgaatggtccgaaaaattggctcctcacccttgcgcagatgcagcctctttttgcagttttgtcttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacctttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgtttttctgcgtagtttacatgtgtagatctaatgatgcgttcatgctagttttcatctgtaatgtcatgacttatttatggaataaattaaatcattatatgcccataatctcaacattccaaaaaccttattataggcactgtgattttacta

SEQ ID NO: 2154 - DNA, 1501 bp, Oryza sativa
agatatcacctcctgtgacttcaatttaaaattttatttaagcctaattaatctgtcattagcaaatatttactatagcaccacatggtcaaatcatagagcaattagatttaaaagattcgtgaacaatttacacgcaatatgtgtaattagttttttatcgtttatatttaatacttcatgcatatgtccaaacattcgaagtcacttcaaatatattttaatcatttaaattttaaaatatattagaatattttaaaatacctaattaatcacttcaaagatattcaccttgagtctcttatgaaacctcaattttatatttcttttaatcatcagtaacatatcaaatagatagctacgtgtgtgcaaaattttattggtggatatattagaatcacctactagtaactgactagtcttcaactgaccaccgactagcgtctaggtgaatactggttaggaatatatttacgagtgtatgcatatgatgtgtatactcttgtcttttcccataatcgtgaaataaatatattgggggggggcagcgaagtcacttcagctgtgaccacgtgccgatagagtaccgtcggtagtgaagcattggtgcgttaaccgtgggacgtcaggagtaggcggcagatgtaaaacctagcccagtattgccgggccggcaacaacgacgttttaggaatcgtttttcctcttgggggcgttgtcgagccgcgccctctctcttgggtgggctgtagggtgaaaacctttgtcttggttctccttgagatgtcgacagacggcggcgtcagtgctcatcatcgcttttctctcaagaggaatcgtttttccttttgggggcgttgtcgagccgcgccctctctcttgggtgggctgtcgggtgaaaacctttgtcttggttctccttgatatgtcgacagacggcggcgtcagtgctcatcatcacttttctccctcgagatgttgtctaggaggccccctaaccaaaacctcatgaacaactatgtgtgctcttgctagacggatgtcctcttgtagcggcgccgtaatcaatgcaagctggccatgtcgacgggccttgcgggggagagctgttccatcttctttctcaccctctcccctccaactccaaaggcgtgcatagagttgaacgtgatgctcgctgctagaattcagcgtcgcgtgtggtcatggtgccgctccactcatgtttcatctccctcgcccaaccacctcgcatgtgcgccactgaaccctgcttcctggaggagagacaagcctccgcctccaccactatgcacttctagctgcttctgatttgtcaatcatgtctgtatgttgttatgtcattctccattcctcactaatttgattgctcacaccatatctcaatattataattaggtccttcactgctcgagatattaaacagcaacatcaaccataactatatctaatgactgcggatttccgaatcgttcagagc

SEQ ID NO: 2155 - DNA, 166 bp, Oryza sativa
gttggacttcaccggtggtggcaggagcatctccatgaatgtatagaggaattcagcagtggtggcgttgatttctgggagtgaaggaagagaaacggtgtcgatttgtggttgggggggggggtgggtggtgtccttttttttttcttttttcgtgctaggaaca

SEQ ID NO: 2156 - DNA, 1501 bp, Oryza sativa
gtgatccctcccggctcaacattgcctctatagcttgagccaagagggatagaatatttcatacatgttagctttaactacaaatccaacagatcggacaacgatggatttaggttgagaaagctctctcatacatcactgaccacacgaaaaggccacattgacaacaaaacaacattacttcgattttcaaacacatctattattttaaatttagttcaggtctgcatatgaagtcttatttttttttttgagaaacttaggacaatttgccatttatatgtattaaagatttgcatccaaggctgctattggcgtctttttcgatcccaacacgagactcacctaaaaggttggcggtgttaatggagtcaccaaccacctcgatctagataactctaaatcaatatgggttttgaagattgaaccggctactggagctgatttagagatcaaaactagccacgaggacaatttagatcgatttgaatataaccacccatctcgtggttgaacggaaggtttacagggcaaacctacaaagggatgatcgcactctcacggcaaaggtggacgttttacaacgcaaatcgacaaatatggatgaaactagggtaacgtaaaagacatggctaaaaagtaaagggaaaagaatgattcaattgtgtagggattgagatattgggggctagaatcgaaccagccttagcccttataaaggggttggtattgccttctataagttctcctccatgtctaactctgggtagaaactaattgaaactcaaaaaataccttccgaagcaaggaaacccgagacctgacagaatcggactctgccggtctgaccaaccacatgctggcggtcagactagcgctacatgtcggtcagacccgcccataggcggtagttagaccgaccccatgaaggaaacccgacgcattccaaattttggaaatatttccctatttcgactctaggtgctaaatttgggtgtaaacagctacttcacaaaatggaatgatgcacaaaattttacgtatttgtctagaattttcattgttgtaagaatcccttaaagttcatttaaggaccttgctgaattcaatccttgtgctaggcgtccaatagctaaatgtccatgcttgtctacgccatcctaagatatatattttaatagttacacaaagaagaaagataggttcaatcaattgattttcaaaaatgcggaaggcaatccaaacatttgtttcagtttatagtttattggtgaaatcagtcagcaccatttatgaaagtctgacaacataaatgtgcatcccctgaaactagtgcatttctgtctacaagtgaaaatggaaaatactaaagaagatataaatgctaaataaaggaagacgattcatttgctattatgatgctagcaataaatatgttggtttagatgtatatttatgaaagcaataaatatggtggttaagatttagatttatgtgctta

SEQ ID NO: 2157 - DNA, 1501 bp, Oryza sativa
agttttgtgaaatttacgcacattataattgcgccttgagttaaaataatagacaatatcatcttaaaaaacatcaaacgtgatatatgcaaaaagagaaaaaacgaataattaacatactatgatctcgatgggagccaagaggatgacggtgtagaatcgtttgacgtatgagtcagctaggagggccgccgggatggagaacacctgcaacgcggcgaacaagttggtcaccgtcgtcgtcgcctccgcgacacccatgtgcatggtggcccggaggtagctcaccatgttcaagacgttggcgatgttgggcgcgttggtcaggagcaccatcgctgcatgcattaacatctgatcatatccatgattcgttatcaacttcagcatctgagagcgttctgatacatgagttgtattaagttttaattcggtccagaactgaattttgaattgtagcacagaggtttagatacgtcaaaattcgggattggaataaacttggcttgcttgtaagaaaaaaaagtttggttatcttgcaaattgagcatagcttaaccgattaatttccttatggtggaagcaactcatccgaatctgaattcaagttgcagacttcataatggcgctcgtatttatagttaattatgttttcagtcgtaggtgatgtacccgtcaacaactagttttgtacggaccgggtaatatcaatatataccggtctattttgtgcgcatgttgtgagcgcctaagtttatattgcgtttgttagaaaaagtttgattgtctttatcctatagcgagttaaaatttatactagcactatatttcaaggtagatgtggacccaaggtgaaaaaaacaagcttatctttgttgaccagtaaatgtgtgtattctacttcctttatcttaaaataagttaatccaaattcatattaaaaaataaacttattatagaacgtaatagtaggaaccaaggttaagggattctaaccaaatggtccaaaattcgtccatttcggtaaggatcgagactaaatttcgcccatactttatgtttgctgaattttggtttaaatttggtaataattaatttctcacatttttttaatttcattcattttggtcccaaaatttttatacaatcgaatctgagaacactggtagaagctagccatgaacagaagccatcaagccaacaactcagtgacgagcaaagctgcaaaggagagacatagtactaaaaaaacagtagtacataatcatgcttagctcaccatggatgaaaatggatgctcttacacctccatgcttccgggtgtccaccggcctccccctccaatccactagccctgatgagctgctcatcacctctgtctgtctctcttcctctatctgaaacctggaaatgttctacgtgatctgagctgactgactgtatttgcagttgcagccatatatataaatttctgtctggctagtggcgattgatggacgct

SEQ ID NO: 2158 - DNA, 1501 bp, Oryza sativa
agcacaaggattgaattcagcaaggtccttaaatgaactttaagggattcttacaacaatgaaaattctagacaaatacgtaaaattttgtgcatcattccattttgtgaagtagctgtttacacccaaatttagcacctagagtcgaaatagggaaatatttccaaaatttggaatgcgtcgggtttccttcatggggtcggtctaactaccgcctatgggcgggtctgaccgacatgtagcgctagtctgaccgccagcatgtggttggtcagaccggcagagtccgattctgtcaggtctcgggtttccttgcttcggaaggtattttttgagtttcaattagtttctacccagagttagacatggaggagaacttatagaaggcaataccaacccctttataagggctaaggctggttcgattctagcccccaatatctcaatccctacacaattgaatcattcttttccctttactttttagccatgtcttttacgttaccctagtttcatccatatttgtcgatttgcgttgtaaaacgtccacctttgccgtgagagtgcgatcatccctttgtaggtttgccctgtaaaccttccgttcaaccacgagatgggtggttatattcaaatcgatctaaattgtcctcgtggctagttttgatctctaaatcagctccagtagccggttcaatcttcaaaacccatattgatttagagttatctagatcgaggtggttggtgactccattaacaccgccaaccttttaggtgagtctcgtgttgggatcgaaaaagacgccaatagcagccttggatgcaaatctttaatacatataaatggcaaattgtcctaagtttctcaaaaaaaaaaataagacttcatatgcagacctgaactaaatttaaaataatagatgtgtttgaaaatcgaagtaatgttgttttgttgtcaatgtggccttttcgtgtggtcagtgatgtatgagagagctttctcaacctaaatccatcgttgtccgatctgttggatttgtagttaaagctaacatgtatgaaatattctatccctcttggctcaagctatagaggcaatgttgagccgggagggatcacacttttttttgctagtgtacctttctttaaatgtttaacaaaagggacaagccttgccgctaatcagctgtgaaggcctgccttgctagcccacaacccagtgctggcgaacagcgatcactactacaaaatcggtttttcatggcggaaccatatttttttcgctgacggccctgtgcataatccgcctgcgaaattgaaacgatgagtgaggggataaaaaccgccagcgaaaatagattttctctgacggttgagttatgtagcatgctagtgaagatatatatagctattttcgctggtggctcacttaaccaaccgccagcgaaaatcgattctcgctggcgatagctaaagaggtccgcttgcataatattatcac

SEQ ID NO: 2159 - DNA, 1501 bp, Oryza sativa
cgctgggtcgcagcctcccatggccatccctctaaggctgtcgaactcccacctcttcccccccctcccaccccctttccaccccaaccccaaatcgagacttgaacttgtcgggccgccttcattcgtcggagctcgagaagaaaaaatgtgacatgaatccaaccgtgaagggttcaacagaattctcacctaaaatttttgtcgaatgaaggttagcaattcagtagtgaagtactacctacagaattttagggttggacacatttatttagaaagtaggtagaattaaatgatgaaatgttgtaattagatgagaagtggaggtaggtggagaaattaaatggcggatgattgtaattgttgttagtagtatattttagtataagtcctgaagactaaaaattactatattttggatggagtaatacatactatgtgctatacaggcattgtttaattcccagaaattttttcccaaaaacgtcacatcgaatctctgtacatatgtatggagcattattaaatatagataaaaagaaaaactaattgcacagtttgcatggaaatcgcgagacgtatcttttgagcctaattagtccatgattagctataagtgctacagtaacccacatgtgctaatgatagattaattaggcttaataaattcatctcgtggttttcagacgagttataaaattagttttttcattcgtgtccgaaaacaccttccaacaaccggtgaaacgtccgatgtggcatagaaaattttattttcacgaagccacattgaacctgcctcgcctcacgaaaacggtcggaaacgatcggaaaacagccttaactatttccataatcatattttctcggaaatgaaatcaaaaagggtaaagtcagaaacgaaaacgatatcggaaatatcggaaaaccggaaacggaataatacggatagaaatatgttggtacagatcggaacccggtaacaaatacggaaacattaaactatagaaaacatatatttaactcataagtatgttatatgtataaataaatttaagctatactatataaattataaattaaatccattttagccacgcactcaagttaggatttgattgaagagtcaatcaatctctaaactgtgggtaaagtagagacataccctataaatatcaacatatctagaaatacagtaattattataagaaacagtaatttccataaaaatacggtaaatacggaaacgatcggtataacagcaaaaccatttccgtttccatctccatattttttaccatttccaattttttgggtcaattaccatttctatatagctcgaccggtagaaagtcagaaacgaacgccggttccgttaccgttttcacccttactaataactatgctcctgcatggacctgttggacgaaaatatttcaaaatttgtattgggccgttcgcttgagaagcgcagaacatccagagttccagacgtagtaca

SEQ ID NO: 2160 - DNA, 1501 bp, Oryza sativa
tttccctctctctctctctcgcgttcaaacgggcggatttgcccccgcaaatctcgccggcgccattgatggcggctggacctcccgcgccggtttccttcctccccggccgctctctcccccttccaaccctatttaaaccctccccgcacttccttcgcccgttttcaccctttgccgcgccttctcctcaccggaatcgagctcgcgccgtcgctctctctctccgccgccgctgctgagctccggtccgccgccgtcgtcgccccggaccgcctcccgccttggcaccgcctccttcggcttcgccgcaccgtcgccgtcctcgtccacccccttgtcgagctcgccgaccgccgtagcgccgccgtccccgtcgacccgagccgcgccgccgccttcctccgctccgagcgcctcctccgtcgccgccgtcgcctcggggtgagccgtggaccactgcctcgtttccccctctccctcccctctctcggccgccgctccgccgtgcctatggccgccgccggcgaccataggggcgcgggtgccgcctcccgccagccgcgccggcatggccgccttcgggcgcgccgagtgtctgccgcatggggcccggccgtcagctgcccgcgccctcgggtgcggctgacgcgtggggcccacggcgccggccggtgtgagcccgggtgcgcccggtccaccgtggaccgtgaggctgccgcgtgggccccactcccgtggacccggtccgcgcgcccctccccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaggtcaaaaacccatttttctgccttgttcctgcttgttatatggagtttattagagtaaaagccttttcttttctgttggtcgtgtagacgctgcagcttcggaagatccgctcttcgtggaggttgaagccgacgtttgggaaagcgagcaaggcaagtcacatcatccttgaacatattgaatcccagtttataaaattattttgatttaaaattattgcattaccgctttacttaaattcccgcgttatcactattttgtttagccatgcctatttacctttgttatgaccttattattgttgttattgttattattaccttgttcaccctagaataaacaaaaccccaactagtgggtactctatttatggtaccactagtatgaatttaggtagatgcttcgctggttaattaggcaacattaggtggttttacaactctagactttgggaatattcatatcacctggacactatggaatggttggattattgtggaattggattcacacctccccctctattcaaaaccctcaaaatggttttaggctgggctcggggtgcatggttttgatagtaacac

SEQ ID NO: 2161 - DNA, 1295 bp, Oryza sativa
cttggacacgaagaggcgtagtgcggtgagcagcaacgaaatggccagcttgtccgcgacggaccactcaccttgctcgaaattcttgacgagcacggcctcggcgagcttggccgctagcaacatgactaccctgtcggcggcacctgggtgtacagcggcgaggacccgggcatggcgaatacgacctcgaacgccaccctccatccggcgtcctctgggaggccgttgagccactcggccggggtccccatccggccgtgcaggaggcgcagcgcggcggaggtgatccgcaggtgggggtcgcctggtctgtccgcgaccagccgggcgacatcggcgagcgcttggtcgaatcggccgtcccgagcgtgtacgagtgccaggcccatctcgacccggtagacgaccgtggactccgcggccgctagtttcttggcatactcacggaggtacctgccggtgaaggtcggagcgcggagtgcaccggcggcgagcgcgtgggccgcgtcgaggaacaaggcgtccctgccgctgctgctgccggcgagggccgcgttgaggtcccgcagcccagggtgcgcgcggacgaggcccaggtgtccgcgggtggtggtggcggcgccgtcttgcggcggatgggagacgcggacggaaatccccgacagcttcgccgccacggccgccgtcccggccagtgccgcggcgagggcggcgcggcggagtctggacatgtagccgtttgctctccggcggcgaggagaaagtctcgtggtttgctgaggattcgtcgtgcttgtactggacgttactggacgctaggatgcagagctctaaaagatgaaggaatcctttccctatataggtgtactacgtctggaactctggatgttctgcgcttctcaagcgaacggcccaatacaaattttgaaatattttcgtccaacaggtccatgcaggagcatagttattagtaagggtgaaaacggtaacggaaccggcgttcgtttctgactttctaccggtcgagctatatagaaatggtaattgacccaaaaaattggaaatggtaaaaaatatggagatggaaacggaaatggttttgctgttataccgatcgtttccgtatttaccgtatttttatggaaattactgtttcttataataattactgtatttctagatatgttgatatttatagggtatgtctctactttacccacagtttagagattgattgactcttcaatcaaatcctaacttgagtgcgtggctaaaatggatttaatttataa

SEQ ID NO: 2162 - DNA, 1501 bp, Oryza sativa
ccaggattttctataacaatgaatttcattttcagagcgcagttgcttgctgcaaataatactcttttttatctaattgtatcaccttatctaattttatcacctttggatgtaattatctgagatgatcaacaaagctttaattcctttatctaaattattgtggaggaatcattggtaaaggaatcaagtcattcattgaagacacacatgctggaatcaagatttcaccacaggataacaattttcttggtttgcatgatagactcgttactgtcacaggacccttggaccatcagatgcgtgcaatatatttgatatgaagcataagttatcggaggacgttcactacccacctaatctgagttccccatttccatatgcaggccttagtttccctagttaccctggtgttcctgttgggtattatgatcccacaggtgccgtataataatgctgtgaattatggacctaatgggtatggaggaagggaccaaaacaacaaacccagtacacctatgagatctcacctgctaacaatgacgcccaagattctcactattggtattgctgatgaacattttggtgctgtcgtacgacgtgccggaaggaacattacagagatcattcaggctagtggtgccaggatcaagatatctgatagggataactggaacatcagaagctattcaggcagcagagtctatgataatgcacagggtgtcagccagttccgagaggtgataaaatctcgtgaagagacgaggggcattatcatctgatggaaaagaattctgatgccaagttaggaggaaaaatttgataatttaacgcttttttcattgtccaattactttaattgatatttttgtgaggatgatatgtgagaccatatgagtgtatgaaagtgaaccagaatgtcaaataatcgaaacccattgaaaatagtgttaaattatcaaatctctcagttaggaggaggggatggagattgtcttttctagttttagcactatccgcaaaaaaaaaagaaacggcacgcaatctcgattttacggctaaccactaattatcgtatcatacgtctttatcgtatgcatggcgatccggcttaactactttgtttgtttctctgtgcaatagtatctccaagattaacaaacccatgcccacgtgtactacgtaattatcctctattgtatctatctccaacgtacggcgcatcgtatcgctgcggcctataaattccgtatcacccccacgcccgatctctgcaattcgatcgcttgcatctgcaaagttgcaactcatctcgtctcctcctctcctcccctcctcccctgtagcctagctaattaacttcaaattagcagcagtatgatgggacggcgcggcagcagctggtgccggtggtgggtggcgctgctggtcctcgccgtggcggccgatgccgtgggctgcaccagcgtcagctacgacgaccgcagcctcgtcatcgacg

SEQ ID NO: 2163 - DNA, 1501 bp, Oryza sativa
tttatatcttatgtatctccataaattattacaaatgttcaaacatattaaaaaattaacgacatcatgtattgaaaaacaaaaatagtatacactaggaatatctatacctatacagcgttaacctggtgaatctgccgttgatcaaatagacccacacattattaatttatagttaatatcatggtcccatgggcctcacaaatcccatccaataatctctacatacaattttgttgggaattcagttggatatattgccgatgatctggatttcaagcggaggcatcaacacaaatggaaatagagatgaactttaggacgcgctcagatatctccaagtcgatcgggtattattgtttctcaatctagattggtttctcatctcaaacaattttaacctgggtaaactatatatatgacacggttgaaaaatgagcacctggaagagtacatagtaacgtgctaattactttgctgacagagtttagtctatgattatgttgactacacggacagaattttggacaatgattatgttgctaccaacatatgattaattccgtggctactttttttatttctttttacatgtacagattggatctaatgccaaaatttatttaattaattagttttccacttaacacattactacgcatagttacaatttcaatataattctcaacggtgataacaatatcaatattgtacaccattcataatacatggatcttacaattttaaaaatatacaacgaattctatgattaaaatataattcactcagaaaataaattaaaaatcaccatattgcagttggcattaatttgccatcaatttaaaccattcctatacgattttgtatgactgaaatactatcagagtaaaattttatagggctaaaaaataatatttaaaattatctcgtgcgttgcacgggttgacggctagtataacaagtcggttacctcgggagtgctccggggataatggatggaaccagagaggatgatccggcgctggccgtcgatgacgaggctgcggtcgtcgtagctgacgctggtgcagcccacggcatcggccgccacggcgaggaccagcagcgccacccaccaccggcaccagctgctgccgcgccgtcccatcatactgctgctaatttgaagttaattagctaggctacaggggaggaggggaggagaggaggagacgagatgagttgcaactttgcagatgcaagcgatcgaattgcagagatcgggcgtgggggtgatacggaatttataggccgcagcgatacgatgcgccgtacgttggagatagatacaatagaggataattacgtagtacacgtgggcatgggtttgttaatcttggagatactattgcacagagaaacaaacaaagtagttaagccggatcgccatgcatacgataaagacgtatgatacgataattagtggttagccgtaaaatcgagattgcgtgccgtttctttt

SEQ ID NO: 2164 - DNA, 1501 bp, Oryza sativa
cataacgacacaacaatctcaacgcataccgagtatccaccaaattcatgacagccagaactatttgtcatgactcaatagcattatgtgccatctaattagcggagaaagggttaaaggtaaagccaatgcgggaaggcggggaaaaagcggcaaagtgagttctaaaaacgaatatattcatgtctcaaagatcacctcctcgaccacaagaagcatggatgattctctaaaaaatgggggggggggggggaatcacaagaagcgggagctaaaccgcaacgaagcgggccgaacatatatttcctaaataaaaacagtgggaaacgggaaaacccaaaaccctagggagggggggactgattgggcgagcgtagtgtgagtggagtgagagtgactgaccgtgtcgtcgcgctggatctggaccatgtggaacggcgcggcggaggatgccatggcggcgcgggggggaacgaaggagcgggcggggtggagtggcgggcggcggaatggggaggagaggaaggaggaggagaaggcgcggcgtagcagcagttgcggtgtggccatctctcaacacaactaatcaaatcccaagcagcagtcgcgtcgcgtcgcgtcgcttcggtgacggtggggatggggacggagggcgatggaccgaccgatggatgcagggcagcccacacggcaggcacccgcttttgttgctaatcatcagggccctactggctttggtggcctgcctcggcaacacggcaccccgttgctgtcacgtagccttggcctggctgcttccgtgcgtgcttcaccgctcccacgcccgacgtgtggacaatattctgagaggggaagttcagcgttcgctctacgggcgaagcaggataaatgatcaccgaggctattttcaaccaaaactggtcgaaaactacgctgtttcgatgcaggatgaaagtaggttataagtgaaattttgaatagtttttgataatttgaatttgaagtggtaaaattcaaccgaaattaatcaaaatttatcaaattttggccaaagaaaatcatatcaccgtgttcggaatctaatattaaatcgaagaggtgaacactgatacaaacttggtgtgttcgaacctagctaggtgttcagaccccttccctcccaacacgtaaaatgaagcaagggctagcacatgattaattaagtattagctaaaaaaacttgaaaaatagattaatatgattttttaaagcgtatagaaattatattgttgggaaatttgagaagttgtgggccactagccttatgcatggtctcaaatctcaaagacttaaatgaattaaaacaattctaaattaaaaaaaatgaggtggcctgtctgtggaacatcattgtacatcatggtcatgtatgaaatgttgacagcttcacatgggctgtgtttagttggatccaaagtttggattttgattgaaattggagcagttgtatgtatatgacatg

SEQ ID NO: 2165 - DNA, 1501 bp, Oryza sativa
ttcctcgtcttccaccggcgaaccgaccttcatgaaccgacgtccacctcttttcgccatccgagccttgagctcttcttcttctctctctcctcccatgtccggccgtcgccgccgacggtcgatctcctccctcgtagcttctctatcctttcccttgcgccactatgatggcgaatccattttacccctttaccccttcccttccaccttgagttaagccaccaccgccacctcccaaaccggccggggctaagctcttgccgctgctgttccggccatccctctcttcctctctaccaaccaccgacctccccgagtgcgcgtcgaccgggaacacaatatgccgccgacgtcgccacactttggccactggaagcccggcgccccgctcaccctctcctctctcttctctcggctcactgtgaggcagaggaagaagagaacgaaggaagaagaaagagagaaagaaaaataaaagaaaaggatattccctgacaggtgggcccctatacagtaccctttcatattttctagatttaattcaaatcctattatttagaagcccatatctcctaaatcatagatccgatttcagtgaaacttggacctaaattcatctaaattcaaaatctacattttgataccaaatttgctattttaatattttatttgaatttacttaatttattcaaataccatttgaataaatatttgatttaatcttataattgaatttacaatttaaacttacatttgcttttcaaatattttattttatttccaaaataccctttagccactaaaaagttgccggttggaactttacgccttacatggggacgttcgtgcggtctaccgaccccaacgtcggaccgttggttgtaaagcccagcaaaaccaaacctaaggtcgaagtgctgctcctggcaccccacgcctcgatgcatatagtggtcggagcttcactattccctcgacctccacagcacgccgcacagttagctctcgggctctatgtgatcctagccgctccaccgccactcacggttgttggagtaacacttccgcccccactaatcttacaccaacctcctattcctctagccgatatgttgtctgtcgacaccggctagagaagacaccaaatctagtcgttatgctgccaactctagcaacgactagcaaacaaccaaaccctagccgataccttcttagttaaattccagccatcatccaaattccatatcctctacaatattacctatccaccatattctccgccacctactctccacctaccagaacctatatataaactatagagcctaaccgatgcgctatcctattccacaattggctctaagatataactaaaccccagctattatattacctaaacctaccgccatcaaatactagctagccacatactcgcttaaccaagacaactatccaaactagctacttcccatccttccaaccaatcaaagccttcaca

SEQ ID NO: 2166 - DNA, 1501 bp, Oryza sativa
acggggattaggaaaccggcgagtttccgaacctcggtgaaaaactccttgtctcttgtctcatttatttgttgcatttacatttgtgtaatttacattcatagagacatatttgagcacatatcaccctaggattgcaaaacttaacttaggtgtattttactttcctagagatatacttgagccactatcactctaggattgcaaaacataacttagttgctttgttagacttatccctcaccaagcctagcaacttatgttagttttgattaggtgtcatttagttttaaatcgtctattcaccctcctctagtcaacatctcgatcctacacgtgcgctgagggaggagctcccggccgtccccgcgcgggtgaggagctcgctgtcgtctgcgcgcgggggaggagctcgacgccgtccgcgcgcgtaggaggagctcaacaccatcttgccggtgcccatcggcatctcgagcagcgcgtggccgcgcgtgtcgagggcgcgctttagctcacccatgtatcgcggccgccgctgctcccgctccctaccgccgtccccaccgccactgccaccgctaccgcccccgcccgctgccgccgccgctccccaccgccatccccaccaaagagaaatgccgagggaaagagagagataagggagagagagaaagggaggaggaagaagggaaggagagggaggatgacatgtgggtcccacatgtcagtgggtctcacgatactttatttgtgtgagtgacatatgggtcccacatatttctttttattttttgtttttattctaatgtcacataagcgccacgtaggaaaaaggctcggtcaaaaccgccacataggcggcatgtcatccaaaaccacatcagttttaatagtggttggaggacatgaatcatactcggggatagttgagggagttaagtatactttttccgggtttaacatgatgtttcgccttctcggtccagcggcccagtttagaagaacgcgctccgacgggaaaacgagataccccactggggccgtttcgtcttgttctcgctccctcctcgcgccgctagtccggcaaatcgaccgatgtttgcaggcctgcagccgcctagcgttgccggaagagggcatcgcgatgagccatcctccccacctgacccagccccctctcctcgctaccttccctccctccgctggaagcgcgagatatcaaagtcggatttatcctttggccactagctaggtcctagtcctacgatttgggatctgatgcacgccaagcgttcggagctcagccaacaccgtccaaagctctcacgaggaggccccgggagcggcggattgatgaactctccacttctccaggctccaggtacaaaccaacacttttgtggctttctgcttgtacgcattgcctgatgaattctgtcaacacattccacgcgtacatgtctgaaacggcattcatcagactagaagacaatggaga

SEQ ID NO: 2167 - DNA, 1501 bp, Oryza sativa
tgtctactccagctccagctgtcatatgtcagctaactactgactatgactacacatttcagcggagcaaattttggatgaaatctgaacagctgtgacgagttggtgttttaattctttaatttactgaagtactactacctagcagtagttcatttaccgaaaatgatatgcccgtcctttgtgttattgtgtatctctgagactctgacagcattgggctgcagagaatgtgtttttcaggaaaagaatgtggctggtaccgtaggagtatgtatttgtgccagttggcagcaggatttgttttctatcttcttttggaagaacttgttgtttttgggtctataacttgtgttaaattgtcattgccctttttgatgttacattaccatggctgtgtttagatccaaagtttggatccaaacttcagtcattttccatcacatcaacatgtcatatacatacaactgctccaatttcaatcaaaatccaaactttggatccaactaaacacagcccatgtgaagctgtcaacatttcatacatgaccatgatgtacaatgatgttccacagacaggccacctcattttttttaatttagaattgttttaattcatttaagtctttgagatttgagaccatgcataaggctagtggcccacaacttctcaaatttcccaacaatataatttctatacgctttaaaaaatcatattaatctatttttcaagtttttttagctaatacttaattaatcatgtgctagcccttgcttcattttacgtgttgggagggaaggggtctgaacacctagctaggttcgaacacaccaagtttgtatcagtgttcacctcttcgatttaatattagattccgaacacggtgatatgattttctttggccaaaatttgataaattttgattaatttcggttgaattttaccacttcaaattcaaattatcaaaaactattcaaaatttcacttataacctactttcatcctgcatcgaaacagcgtagttttcgaccagttttggttgaaaatagcctcggtgatcatttatcctgcttcgcccgtagagcgaacgctgaacttcccctctcagaatattgtccacacgtcgggcgtgggagcggtgaagcacgcacggaagcagccaggccaaggctacgtgacagcaacggggtgccgtgttgccgaggcaggccaccaaagccagtagggccctgatgattagcaacaaaagcgggtgcctgccgtgtgggctgccctgcatccatcggtcggtccatcgccctccgtccccatccccaccgtcaccgaagcgacgcgacgcgacgcgactgctgcttgggatttgattagttgtgttgagagatggccacaccgcaactgctgctacgccgcgccttctcctcctccttcctctcctccccattccgccgcccgccactccaccccgcccgctccttcgttcccccccgcgccgccatggcat

SEQ ID NO: 2168 - DNA, 1501 bp, Oryza sativa
aaatctagatgggagaggtcagtgccaaactaaaggctgcgttcatttgtgccagttggagcctatccctctggcacggaaaacggaatagcttattatcgcataattaattaagtattagctaaaactaacttgaaaaatggattaataagattttttaagcaactttcctatagaactttttttttgcaaaaaatacaccgttcagtaatttgaaaagcgtgcacggaaaacgaagaggggagttggaaacataggctgccgaacacagcctaattgacatcaaaacccatcccttggtgtcagctcatctggcgtcgagacatcacaccttggtgccaacgtccctgataccgaggaccgaggatgtgcaataaggtttctaaattgtaagggtcgatttgtaaaatatttttctaaaaaggttaaaatagcaaagaaaaagtccagtcttttttttatttactgctcctaacacctaagtagtattttgtcctacaaattacttccaactattttttatgtaattagtataatttactagttagcatatattgttttgttacataatgtgcaagagctggttaacaagtctaatgaggtggggaagaattagtgttgggatggcggagtcatggtgcatgattttattcatcagggtttaaatcctgtacccacgaatattacgtatttataggcgagtttttaacatgattttagtaagatcaaggatgtgcatttggttttcgtctctttaagcatgcgttagaggcacattcgtaggggatgtgagtgtaatattgcgcatgtagtggtgtgtgtaccgtgtaataaaaaaaaagagaatccatgaaatgccattgacaagtaccctaatcccagaaatgccgtcaacaagcacaacttcctgaaagtgccattatacaagcctatttgtcccagaaatgccatcacagtcaacgcactgtttagtccacactgttagaacaaaaaaagtttacaaaaatgactaaatcgccctcactccaaattatactatctcaatccgttaaaagaaaagaaattggaaaaataagaagacagccctaaacctaacacgatgggtgacaggggcgatgcggtggccccaggcggtggcgcggcggccctcagcggcgatgcggcgctcccaggagtattagatgcttaagcagatggagaaagacggggacgcggtggagtcgctggcggtcgatttggaggcaatggtcgggagcatggagaatgccggtgacggtggcctgcagtggctgaagtctgtcagcctcgacatgcttggcgggatcatggactccggcccgagccccggcgccgggcactagacgccggcggtggcaggggttttgggaattgggatccatcagcgatggagcacgcatgcaggctgaattgagggaaagcctatgggtgtgtttagttcacgtcaaaattggaagtttggttgaaattggaacgatgtgac

SEQ ID NO: 2169 - DNA, 1501 bp, Oryza sativa
ataagttcactccaggtccctcaatttgtcgccgagtcttgaaattcgcccctgaaccgaaatatcaggtgtacctcatcccaactcacaataccatgtcaattttggtcactcggcagtaaagtagttgtttttagctgacgtgatgagtgggacccaagtgggcttgtcagcagccaactcgtctccctgtccctttcccttttccgtctcttcccatttctcagatactcaagcatcgagcagggtagtcggtgaggagggggtcacatacgatctgtagtggtgaaggggagggacttcctcatcatcatgcgcgccccgactgtgcacggggagtccaccctgatcatgctgagctgcacctatcagagcatggtcaccatggagaccgtccacatgggaggcgacacggggatcgtccctctcatggtggaccccgtgaactacgacgtgttaccgaaggtcgagtaggagctgcaccatgtctaggccacggaggacatggtggtcatgcgcaccgccaccgagcagagcaacttcaagctggttgttgccgtcctcgaaaagcgtcatggcgtgctcaagtcacgcgcggaggagctatacgacaaaccgcggtccgtgacgtaggcagccgagctaagggagatgcaggacagggtggtgatgcgtcaggagatagaggactttggtaggggcttaatgtgtgagaaaagggataggaaaaggtggaggaatgggttcaccttgacgaggtggagttggtggcgcgaggtttggccaacggggctccggtgagggagatcgaccggcggcagcgtggtggccagacatggtagagagagaagacaagagctctaagagtttggttgtgggggaaaatggagacatcgttgtctcttataggcagcgaaaggtggttgcaatggaattcgctgatgaggacacggtagtggcggcttgagatggaagaaagcgacgccggcttcgtcttcctattggttgcccatggtggttcggtttggtgacaaacaacggatgacgtcggcagggtgactcacaactgaggttgggcagcggttagggctgtcaacgagccgagctcgagcgagcttccatgtgtaggctcgaactcactatagactcgagtcgagctcgagccgagtctaggtttgccacgagcttgaagttgagctcgagctcggctcgttcgagcttcgagcttttctcaagcctgtttggtgcggtggaatactggaacaattcattccattcaaagaaaaagctgacactgtgatgcatgattagacggctaaggccctgtttctttcagcttgggattattataatctagattattgagtcagattactataagctagattgttataatctatagtagaataagcggttagttgtttctttcctagattattgggtttgcaagtctaaagagagagtggggtggcatggtgggtaatttttcacccaataatct

SEQ ID NO: 2170 - DNA, 1501 bp, Oryza sativa
aaactaaatatagctacttttttgataactttatcaaaatttggtaagatcaaaaatgacatcaaagtgaacagagccttagtttccaacaggagccgaacacagggccgggctcttcgctttctttcgtgtgcgcttttctttatgaggtaaaaaacgaataatgtttatacctggtttcctggcttcaaaatgtctgtgtttcatgtcatgtgtaccaccgtatgtcggcgccgtactgcagagggaatgagaggatggataaaggtacagctacccgctttcgaattatttgtcgtcttatctaaattaaccattttaagttcgatcattaatctttagaaatctatttgtgtagtataacgttatactcccttcatttcataatgtaagactttctagcattactcatcatatttatatagatgttaataaatatagacacatatatatatttaaattcattagcatctctataaatatatggacaatactagaaagactcacgttatgaaacggaggaagatttatgcttttattcactacagaaacaactccatagtcgaactaatggtcaagattaaagcaatgagtataaatggaggggatcaatgagcatcggtaagctttgctttcctatatatgagtactaagttctaatgttttataacctcgtagagtggcagggagtcgttaataatttcttctttcgctttctccaaattgaaacttgaacaggacaggatttgaaaccggctctctccggatctgttcattgggcgatcgttcaattatgcacgcaaaagagagtgctttaatcaaataaaagatacagtttgggcacgtctcaactctaaagctagctatcactagcttcactggcgtgtttagttagcatcaagtggcagctatatatatatactcagaacaatctagcatatatattcaactggattgagatcctctgacataacttctcactaacttggtggctgacatgtgggcccgaaagtggtgaggcccacatgtcagtcacggcgaacattagaggatcatctttcatattctactagtgtggattgcatggatacgggactaccacgggtggaactacgtacacctgggatgggaatagctaattatattgcctcgctagggctcagtttctactgttttttttaggaaaaaattgctataggatactcaaaaatcgtgtaattgtctaagagacactgtaaaaatgtgacactgccgatggacagtacaaaagttgtgtagtttaggacaccaaaggcattattttataatttctgggctgaaagaggggagagaaattttgaaatgatgggaatgcccctgtactccttattcctttctctcaatgcagccgacatgtggacccacgctcagtgtcgtcatcctcctctcgccagcgcccaatgccgaccgacgccactgcatcccttccaaaatccgatcgattcggtgagagagtcagcga

SEQ ID NO: 2171 - DNA, 1501 bp, Oryza sativa
agaggcttgtcctgtgcaaggcttctcgatacaagcgaaagagaagttctgattaagggaaaaagtcaaagagggctggttcgacgaaggttgtgtggtatctatgttgacgatcgttaagtgcatattttaactaccaattcctgcgtaaaagatatcaattatattatcaaaacttagtataggactatactactaaccacttccactagttttggtaaatatagctatgcaggttatttaaggagaaaatacacccgacatgcaatgaaaatgaacccccgaccaatcacgtgcgagtacacggattgaggagcccacaagtcaacttaaaccgactcaaggtgaggccaaccacccgggaaccgactaaggggcccacctgtcatccaccgaccaaagtcggaggagaaagacggttgaggtggttcggccaaacccctgctggcgccgctaactgtcaccttccatgtgtcactccctgattggttcctgatggcggttatgggaggtcgatggccagaaaccgccatactcaaccatcattggacactataaaaggaggactccatcaaacttctcaacacacaactcttgagctcaagtagagtacaattcacttgtagttttatatttagtatgttagtttggtagagagtgacgggaagctccggaaggagtggctcgaaatatcggagttccttcgagaattttagggaggagtgccggagtgtcggcattcttccaacggagtttcggagaaagccgggattgttggccttcttctctcgcttgtacctcgaagaatgctttctttatcaagtaagtgttcgggtttatttatgtcccttaattagtttatttaactgagataagtattcttatcggtgtgggttcgtcgcttagtgtgcaactgagtgctctagcactaggactctggataaagaaggaagttcctacacaaggttagaatagtaattaataacttagacgtggtgtctaggttagaaattaacttcatttgttgcgtgctccatggaaagtaaggtaggtggcaggtggtgacagccatgtccgtccttcgtatctctccacgttcgggtacatcatatagctcaaggccggactcatcctagcagaccaggggagagccggtacccgaagcattcgatagagttttatctttaacttaattaactaattaaaagacataggaatcatttctagccaatttatcttaagttgttgtccttggattgaatcttgatcgtatattatacacacacgttccttgtgttcgatacccttggaatactctaagggggaagtgctacaacggtattccttgcgcttacggatttatctgtgatcataagaaatacgatcaatctacctatcgttgatcgtttcaagaaaatctttgctaatcttaagaaagtagagttatacccaattataagaacgtggatgaattcatcgcagggacccagatcgtgcaccc

SEQ ID NO: 2172 - DNA, 1501 bp, Oryza sativa
tgattcggcgctggatgatgatcccctgtggttcaggggctcgccattgacgcccctggatggcaggaacctgtatggcacggcgaacatcttggacacgaacaccaccaccggcgcgctggtgctcgcgttgcacgtcgccacgcacctcctcaccttctccacctccgcggcgacagcggcggggcacggcgcggccgccgttagctgctccgtcttggcggccggcatgagccttgccaccctggtggcctgcgcggcgatggggttgggagtgcactccacgaccatgtcgaacaccgcctccgcgagccgcagcttccgcttcatcttgtggtactgaccccagagcggctcgaggacgtacttgacgaacatcggcttcgggttcgggttggccgtcgccgccgccatggcctccttccccaccaccgtcctgctcctctcgtcgaagtacttctgcccccataggcctttgagaagctccgcggggtcggctctgagcttgggggctagtagcttggccagcgtgacgaggcggaagccccagccctcgcgcgcgcaggcgaagacgacgttgccgttctgcggctggaacgcgtcctcctcctcgtcggcggcgtcgccgttgtcggggagttcttgcgagagggcgcaggcggcgtcgagggtggagaagtaggagcgcgagcgcagcgcggagtagatggagttgacctcggacacgatgcggcggaggcgcgcgtgcgcctcggcgggggtgaggcggagctcggcgacgaggcggtccaccttgttgaggacgaggcaggggcggaggcgctcgacgaacgcctggcgcagcgcggcgtgggtctggacccggaccccctcggcggcgtcgacgaggacgagcgccgagtcggcgagccgcgcggcggcggagacctcggagcagaagtcgatgtggcccggggagtcgatcaggtggacgcggtggccgccgccgtcctccccgccgcggcggagcgcgatcgaggccgacttcatggtgatggcccgccgctgctcctcctccaggtggtccatcacgcgggcgctcccggccatcctctcgctcacccggcgctcgctgccgtacgccgcgatgaggtggtcggccaggctggtcttgccgtggtcgacgtgcgccaagatgcaggtgttgcgcacgcgccgtggccctctcccctccgccgccgccgccgccgccgccattggattagttttggccggtttcgtctacgtcggcggggctctccggcgtacggatatacggatggatagtagtagtctgggcctcgggggaatccgactcgtacacggtacacggcccatgggccagcccaagttgggaacccgtcgccgtttatatctcaaaagaaaaaaaagaaaaaagaaaaaagaaaaaaaagaaacctagttcgtcaccgtcaccgacgccgggaaggaggaggaagcggggagatggcggcggcggcgg

SEQ ID NO: 2173 - DNA, 1122 bp, Oryza sativa
agccgtgtcttacgcccttcatttcaaagaagaaaaataaaacgaaaccaaaatttctgtgtgcagcacaaacgcacttatttaatactcagtgcggatacagaattaatgtacatgaacacgaagtaaaagcgacgacgtatgacgacgaacaagaagaagcaaattaagccatcaaccacatgcatacatgtaattatggggagaaagtaattaagcatataaaccgttcgttcttgcgttcattcgatcgggatcgatctagtattggtcggcggcgtgcttcttggcgtccttcttctcgtggtgctcgtggaaggcgaaccccgcggcgcccagcgcggccaccgccgccacctcctccttcaccttgtgcccgtgcgcgttctccgtgtccttcttcgcctggtgcttctcgtgctgcaacgacgtaccacaaataaattctccgttaattatctcttaattaatcagctatggctaggtagttatcattagatcatagttcaccactacataatcgatttttccaagcggctaaaacatataggttagttaaagtgggggatgacatatacgtctgcgaaaatcgattttcttgtaatagtggtggtcaaatgtactaattaatgacttacgagagcgtaggcgccggcggcgatggcgccgaggccgccgagctgctcgaggtgcttgtggtgcttcttctccttgtcgtagtccaccacgccggagctctcctcctccccgtccttcttgtggtggaacaggtggtggtgcttcttctcctcagccatggctagctactcactgattaataatcttagcttccttcagacagagttagtcggttgccggtgttgatctgtgcaaaagctaactagcaaagcacatgtatttatagcaaggagcggctagcatcagctacttgctaataacattagtttgggcctcaaatctcagtttagagggggagggcgtacttgggcgtgtggtatgtgttacgcgcagttgttgttgcaggtatgaactatgaaccctcaaaagtctcaaggaatcaagagagagatatactgtttgggataatggatatatccatctaattaggttaattagctaatg

SEQ ID NO: 2174 - DNA, 1501 bp, Oryza sativa
tactagtttgtactacctctatcccaggacatagcaatttaggattgatctacgtatcttatactacaccaacgaatctaaacatatggtatgtagtactccctccgtcccaaaatataacaacctttagcacttaggatttgtcccaaaatatatcaacttatccatcatcccaaccaatcacagccctccaccatccacttttctcacctaccttcactactcatccaaacacaaccctccaccattcatttctgcctacttttttaataatcatgttcaactctaaaacttattatattctgggacggagggagtatacctgacacgctttcgatctgcctggtctgcatgatgatctctggtttcagaattggtacaaagggctcattcagaaaagtcttgaaattcacgttgtcatcaacggaaaataggacggttggccgcttggcccaaatcacaccgtggggccatgagttgttgatctaatgaacttttttgaaaccttgatccaatgaactaggcactcgaatttgctaggggttaaggtataaaagtggttcggtgaaaatattttactcacgataaaggtagaacaacaagtaatttcaaacgaaagaaaaatctgtaggtttgaacccacaggtacaagttaaaaggatgtgcttgaacaactcatgcagttttaccgttcattttctgaatcttaatttttgtatccttagctctgaagaaatcaagaaaccgagttcaacctactttgtcctgtcgggctgtctctatccgggctgataagaaccgagggagtgtgacaaaacccaactggccaatccgcgtgttgattacatttccaaatccttggtcgacgctaacaaccattgtccatgtcgatgcttagctgatgaatcttgactttgtttgcatgtccttccaccaattaaggtgaagatctagcagatgagctgtaatagccatcacactgcttcatttctgaaagacaattcaagcagtaacaaattaatggcaaacttataactcctatgtacaccattgtactgtgtacaaacaactaaacgtattcggtaatttcagtaactaggtttctgaataatcatgccagttaattagtagtagtattgatgatgcatcttaggtcaccagctggcacgtcccattcggataattgcagtggctgactggctctgattaattaattgatgatcgatcgagcgcgccattacgcggtgagtgaccatgaacgagtctttatcaaattaaataggccattagctaattaacctaattagatggatatatccattatcccaaacagtatatctctctcttgattccttgagacttttgagggttcatagttcatacctgcaacaacaactgcgcgtaacacataccacacgcccaagtacgccctccccctctaaactgagatttgaggcccaaactaatgttattagcaagtagctgatgctagccgctcctt

SEQ ID NO: 2175 - DNA, 1501 bp, Oryza sativa
ccggtttattgtaaaacccctaatacaatttacttgaatcgttcttttactatgtttttctattttaccctagtttagtccatctttatcggtttgcgccgtaaaccgtctgccgccgctgcgagagtgcgacacctctttgtaggtttgtcctgaaaaccttccattttgcccacgagacgggtagttatcctcatatcgatctaaatcggcctagaggctgattttgatctctaaatcggctccactagccggtttagctgtttttcctcaaaacccatcttgatttggccgtttagctagattgaggtggttagcgactccataccaccgcaaggcgtttaggtgttgcgatcatgcttgtcgacttgtcaaaaaagttggcaacacgatttttagcgactccgctggggaacgatctaatcggccatatcacggccgaatttcgtttaatctagtcgtctcgtcgaatagtttgtttcggccaaacggccgaaattaatctataccttaattagtcgctgcactgttcttatcgctggattaatctattcggcggcgaagctatttggtcgttcatcaaattcatataagcacttgccatgtcgtgtgtatcgaaaatcattatcaggaagcagcagacggcttggcaacgtttcctttttgtttcacacggcaacagagaaaaagatcaggctcctagagccgatctaccgggtcacaagcagcagaagcaacatcaatctgttagtacatacattagcacatctactgaggagaattaaaaaaaaatcaaagccgattcatattgtttcggctgttattgtgagatcgattttctgaatttttgcttacacacgaggagacagaagcaattctgttttacttgcacacacgcttgttatattcaaaggaaaaatcaagaccggatattaatttattcggtcaaatatttcggctatgagctatatggctggaattaatcaaggaatttcttcatcaaccatgatgagcgggaacgagatcatgccgatctcattggatgatttcgaaggagaagaccgcaagtccatgtaggagtatatcaaggagatcacacaggaggcgttgataagggcgtgcactaggactcgtcaaggtgtgatcattaagcccgggccacttcctaagctcgctcccgatttggtacgcaatggagaggtaacacaatctatccaacaacaagtagcatctacaatagattcatccatgattgtttttaaagatagattagatgcaacttttggaggtaaatttgatgagattttaagatttaaagttggccctctcttggccgattttatttgtaaagataaagcctctaccactgctagccaagctcctatagatcaaacaagcagtggaaccgatggagcggcgcatatagacggtccgaccaggcctgatggccggtcagaccgcgacttcgccgtcggtccaaccggccaaacggccggtctga

SEQ ID NO: 2176 - DNA, 1501 bp, Oryza sativa
gattgtatcagctgaggctgatgggtctatatcggatggaatgcatcggctgcgagatgatagagttagacgacgagggatggatgatggctgaaagctcactctttgtcggacttggttctggaaaagatagtggtgaatgttgaaaggagactgagtttgaagaaagtacggcaatgctatttatcgattaattttaggataagtttattattttccttttatgttttaggaaagtttatctcatgcgcgaggggatagctcccatctcaagtagccgaacacaatgtaagtcaaccatggtcagagaaacaggaaacgggatgagttggacggaaagggttcttacaggaacagagggaagatttggggtgctaataaagtaaattaggaactttcagaattataaaacaaaaaaagagaactttcgatgccatagaaccaattttgtgaatataaaaccccctcaaattgagcttcctaaatatagaacttcgaatagtttccaaccatttttgatttccgctggacaatggtcttaccgtattcgtttccatttccaaaaacaattacaaaattaattttcatatccgctactgttagaaaattatctatccgagactatctatttccgaaaatgtgtccgaatatcggaaaatatatgaatcatttttatctctaataatggctactaaaacaggccaagtctaaagttcgatgcaccaatcatcgccacgcactcgcgcggttgccttgagctacttgttttatataggaccaccgatttattttactaattcaaaaatttaaaatttatagtacgcattcaataaaacaacaatttgtaatataatacatcggtatgaaaactaaagtaaattatccacataagtctaaaaaataagaaaaaagaaaaaataatattaatatgtaccttaaactgaagaaaacaatattaatatgctacatggttggttcttgtttagataagcattatattgtagtgagtacttagagtgctgtagtaatttttagggatcaaatttaaaattttaaaaagtctaaaatgtttgaacatgccatttcaaaaatctccagaacttgaatttttgcacacaaatctccctctcaaaatacttcccgctaacgtgaaaccttagcttccctccaaaaatcccaagcaattagtgtgtcccttcaacttcccatgcaccataaataattgctgcctcttcgtatccttaacccaatcgttctcacatttcctcattccccgtcctcccacctgaacaaactcccccatctccatcaagagcactgcacacagcatggcttctcctgtcctccagaactatgcgtctcctgcacatgccctgtagcttcaccatgaagacatgttgctaggctgcttgtgacttcctgagacaatatgtaagtgtttttttcttctcttgctcggttatttgtaaattattctgaggatttgagggactatagggtt

SEQ ID NO: 2177 - DNA, 710 bp, Oryza sativa
ttaatcggagaaaaagaaaagacagagtccatatagaaatacaatttaaaaatagctgaaattcggaattaaaaaataaggaatattagaagaggagactagagtccatatagaaatacaatttagaaatagttgaaattcagaattaaaaaaaggaatattagaagaggagactagagtccgtctatatagaaatacaattaggaaataactgaaattcggaatgaaaaaaaggaatattagaagaggagactagagtccatatagaaatacaattaggaaataactgaaattcagaattaaaaaaaaagaaatatgagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaaatagaaattcggaattaaaaaaataaggaatattagaggtagagtatagagtccatataggaatttaaaactaactaaaatttggaataaacataataaaattaaaagtagagtttagagtctgtataaaaatacaatttacaaataactaaaattcaaaattaagaaaaacattggaagaagaatttaaggt

SEQ ID NO: 2178 - DNA, 1501 bp, Oryza sativa
cttcatttttctccttcctttttgtttgctgctgctgcttcttcttcttcttgttgttgttcttgttgcaaccggccgggctaccttgcttgcattgcatcttgtttgccatcgatctgcactccagcttattttcgatcgatactatcatctgttacttaaccatctgcaccaccgtaccatccattactttcttgaggctccgatcgagctttaattaatttattaattattagctgcgcaatatataaatatatatatatatatatatatatatatatgtgcaagttttttttctatataaatatacactattaattagccacactatatgctcagtgtattactagtagcacatcgatcgatctgccgatcgaggatttgatcacggcacatagagggttgttatgacacccggcacttaactccgatcctgtaccatcgattccttcaattataatcgggtagtactgtcttaattcataattaaataaataaaataaaattactagtaaatgctaactgagtacgtacgtactcagggtcagagatgcgtactacgcacatatatgtgcagtatatacatgtacgtatatggcgttcgcgaaaaaaacttagtacgtactgtatatatatacatataaagtattcgatgatttcaccaatccaacacaacgtacaatataatagtacctgcagatgttgtactcctacgtaatgagtagtgtttagaacttattaatttactactactacgtcactagctagatcgattgatttggccttatatatgtactcctacgtgtttgaaggttctctagcactacttacatactcgagactgattaatttcaaaactttacatcgtttgtttcactgtttggacggtagagtttgctatatatatacacctagcttttcctcttgcttttttatatgatacacgcaaggcaattaatatcagagtcttatactctctccgtactcgtaaagaaactcgtttaggacaatgtttaagtcaaacctttaaaatataaatcattaataactctcaagttgttgagtttgaaaatgtaaaaattatatgaatagatttgtcttgaaaaatacttccataaaagaatacatatatcactttccaataaatatttttatagaaataagaagttaaagttgtgttttggagaccgtgaagctgttcaaaatgacttctttttttttaagtacggagggagtatatatatagaagaactaggtagatagagtccccaattaattgcattacggtagtaattaactgacaaaaagtgagtgagagagatgaagctgcagctacataaattaatggacatgatgatgaggacggaaacgataataataatacagttaagcaaagtgtgatgctgcgagcagagcagtaatgatcgagagaggatgagtggctggtcggccggccggagatcagagggcgtgcccgtgcagtcgctttcgattgagcaat

SEQ ID NO: 2179 - DNA, 1501 bp, Oryza sativa
aaaaaaaattgtccgataaaagaaaaggaaaaagctgaaaagaatctgactccatcgacgcggtaaaaaaaggcgaaaaaaaactttccgataaagaaaaaggaattatatgtgacgcggtaaaaaaaataaaaaaaccaggcgaaaaaaaagataaaagtccgataaaaaaacggggcgaaaaaaaaacaaatctgtcctatccaaaaaaagccaaaaaggggaaaaatcaaaacgaatccgactccgtcgacgtggtgaaaacagggcgaaaaaattccaaagtaaagggagaaaaaaaatcaaaacgaatctgactccgtcgacgcggtaaaaaaagggcgaaaaaaatccaaagtaaaaggaattatatgtgacgcggtaaaaaaaatcgatcgggcgaaataaaccgggcaaaaaaaaatctgtccgatccaaaaaaagggaaaaaatcaaaacgattccgactccgttgacgcgataaaaaagggcgaaaaaattgtctgtttctaaagaaaaaggaattatacgcgatgcggtaaaaaaaatcgaatcctattatatctagaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgtttttagtccatttatatatcttctttatctctaatctaatctaatctaactataaaaagagaagtttctacagtatattaaaaaaggaaaaaatgcgcgagaaaataaaaacggtttaaaaaaacacgtgagggaaaaatgtcagaaaaaagcacaaaagaaaacgcgctagaaaataaagtttcgtagttctaattttctgattgttatcgacgtggttatgcatgaaaaacgtatattatcattacgttttttcacccgttgcaacgcacgggcatatttgctagtataactccaaagatgactataatacgttaattaaaggggaggcattatacctggtttattacgcttgagggaggtgatccaatcaggagcaagagctaagggggtcaaatagacttattccttattggactaaccttatgcactgacagcccagaaaaattggaatatgtatgggctcctgccttcccttcccaatgggccaatgagccatcttttcatccactaggccatatatattgctttcctccacaagatgaaaggagaaagttcattttgactcccttaactagtgaccgaatctaattcgtacccctcaaccacaataccggatatctcgaacccccaactattaaaatcagtgtaatttgactccctcggtggttttggagggcggtttcgctgacatggcgcctacgtggcggtattgacctgttcttcgttccacatggtgctaacgcggcgcgtaggtggcattagaattaaaatttatgtgtggggcctatttgtcattcacaaaaatatgtg

SEQ ID NO: 2180 - DNA, 1501 bp, Oryza sativa
gaggacagttgaaaacacgttataagaaagtagagaaaagaatgtgtttcacactatctgagctcgacgttcataaaagaaggtgcttgacaaacctcgtcttctgtggcccatgaaacttcgtcaaataacgattcatacatcttgggcacaagttcatatgggaaattcacaaaacggcggcacacaagcagacccacatcaggtgctttgtcccccagcatttgcttgagcttcttcttggtatccttgtcaccacaaacagcaagcaggtaatccttaagatccttcatacagcggtgctcctacaagacaacaccagcaagttgattaatcagaagccaccagtgcagcaagacctatgtatcttgtggatgaagcagtgagtaggttgaacatacactgtatcttccaagattaagcacgctaatgagaccaaacagatcgtcattgccaccagtgctgcttccatcagcaccatttccttcaccatcctcttcatcgtcagcaatcttgacaaccgtacccaccgtggtctgctcaaggatgaggtcgacgaagccagtgagatcccacggcttggagtcgaggtaggtcttgagcagcagcttgacgccatggaagtcgccgggcttggggtcgtagaaggcgaagtccgcttgcaccgtatcgagctaggagcaccaatccgaagagcaactcgcatcaatcgatgagtaggaactccagagaggctagaaccaaggtagaggtaggcactcacctcctccgacgcgtcgtcgctgtcgtcggagtcgctgctgtagctctcgtcgtcactgctgtagcgctcctcgtcgctggaaggctcggcccgcttggcgcgcttgggcggcggcatatcgcgactggagccggcgattcctggagagcggcgaggcgtgagaaggaggtagcgaggccccggcgacggcgttgccaattaagtgtaagcacgcgtacctgaagggatttcgtcggcggcggcggcgggtggatcctcggggggaggtagtggtttagaggaggaggcggagaagaggagggagcgagcgaacggggagaatccggcgaagggagccgggcgctttcggtcgccgaccatgatcgccgagcagtcggcggcggcggcggcggcggctggttcggagagggaggagaggcttgccttctccaatggaagtagaacgaggcccatgcatcaaggccctgtttgttgggccgcaaggtgagtcgagctccgtgcagcccatattgttaatgggctggaaggctaatgcgacaaatgtgagaggctgggcccacgcgacatcgacgaagcgggcccccctctctcgataaataagccgacccaagcctcaaaacaccaaccaaccaaccaaagaaagaaaagctcgactcgagctcgccgcgattgaatcgcgcatgggcacggcggcgggcgacgcggcggagcagccaccggcggcgccggaggcgaaaa

SEQ ID NO: 2181 - DNA, 1501 bp, Oryza sativa
cctgaccatcattttcatgcatctgtatttttttaatgaattattagccatgtccttattcggtatgaatgcctgatgtattgactgaattaaaattgtcaatatgctgttttcttcttggaccatatctgtaattgacaaatattgtttctttcagggtatgattgctgggcatgtgtactacttcctggaagatgtatacccgcggatgactgggaggcgtcccctgaagactccttcgttcatcaaggcgctatttgctgatgacaatgttgttgtggcaaggccacccaatgctgggcttggcgctggagcaaggtttggtgctatgggtgcagacccccaggcccaatgatcaattgccattcgaaggcagttactgattcgagagttcttttttttttttcatctgttcaaattgcgaaattgtacaagcaatgttcccgtgtatttatacaggctatagatcagagaattattgtgcataagaaagcatttagtagtatctggggcagctaaatttcttaactggacacgaagggtgaaggaaatggtttacgagtttcaaccggctggacaatgccgccatccttggttgcagaaactgatcctttttgcgacgattgacatctgaccgggatacttttcaatgtggtagtctattggtaacgataactgtatcaatcgttgtgatgtttgtccttgcgatttatggtatcagaaatgttagaatgttttatatactgtttgggtttgaagaatattggtcgaagatgaccctcgaaatgtacagctatccgtcaaagtatttttttttaaaaaaaaaacatgagtggataaaataagttacgtgcaatgatattcataacaaaatattgcaagtacatgcgagtaatgattcttgcaaattacatagaaagctattaatgtaaaatatcacgtgtacatgataatattgattgctaggagatattagctgttggatatatattacaaaagacaaccactagttaccaaatcgtccccaaatacatttcaccgatttgacttgaatacaacagatcaattttacttgaatgcaacagatcaattcataagcgtgccacagagctgaagtacgataagcagcgcgggttacgcggcgcagtctcgcactgaaagaagtgtttgtgggtatatcatcaactaccccatttgatcaaatcctgtcttaaaacataaatcttgttctaaatataaaatgtttatagccagatggaataataaagagtgaattttacaaaactacatatacatgtacattgatcaaaatatataaaaaaaatacagatttaaaatattatattttaaaattatcacaaaactatatatgtagggcctcatatatttagatgcagtatcaggagatcggtcccttgtgcatcttccccgtcttgacttgctccggttcaattcaaatcacctcgctcgccgtccgtcttcgtggagctttcgaatacga

SEQ ID NO: 2182 - DNA, 1501 bp, Oryza sativa
cccatcagtatctttttctgtaccaaattcctcgatctgcttctacaaacatgtggtgagtgtatgttccagattcgatatactaggccacgaaccattgaagaaaaaccaggaagcgagcccaccaatgtgcataacaatttttccgacaggatgtagtgcgatcattaaagttgtttatctctgttattatttatgcatgtgggaacctccaagtgggaaacaggtgaattggattgctcatgcagctcaactgatgccaaagttgaacctagctagctaacatattagtaactattggttgaattgaaaacatgcttgacacaccgttttggataggaaagactggacctaagaactagttgccttgtgctgatctatttgctaactacggatttatttatgattacaattcttttgctcccggcggtttgcttcttgtgtagaattgtaaagctgttgggtcattctaatgtgttgcagtgtcctattatgactgaaaaaaacttgttcatggcacttggtacaccatagagtgaagtttcccttatttaggctagcttccaggcttaatacagttatggtcagcagtcacattttttttgacatcacaagagcagccacattttcctgataagttgacatgtgtggcatccgtacacaagtgtggatttcgtccaggatactcaatctgttggcactttatctattgaaaagcatatagtattcaaaaggtgaatgatgaagaacacttagataaagtgatgcatgttcatctcctatgtgctcttgcatagtaggttcatgttgtatgtcaatctttttgagcccactttctgattcctctttactcggttaaagctgtaaactctgagtctcagtaattttttttccttagaaaatccgcatggagtgtttcattgccaacctgctgccctgctaggctgatatgtttttgtccttctgaagctgaaacatttcagtacatcagtaaatcatttcatcatcctttgcctaataaacatttgcttgtgaacatacctgtagtttttgtccgaagtgaaattcattaccttttctcccaccctataaagctatgtgttcatataatttaaacagcttctttttcttggaaaagacaggcagtgagatcagcatcaagcactaccagcgggcaccagcagatgcatgtgggccacagcactagccagtaccacggatggttccgtcttcctggccgtgcaagccagtccacttctcatcatcctctgtccgtgcaaggtgccctggctgcaagtataaatacccagtctccttaccttgcaagtctgggctcttaaccaaatgagcaggagccaactgatgcatatgtataagcttggagatctgacgcctgctccatccatgacgattccaatggcacattcctcaaggccaactctgggttttcccctagggacggcgctcctgatctttgttatcttctccctcagtggcatct

SEQ ID NO: 2183 - DNA, 1501 bp, Oryza sativa
tcgaaacgccagtgggctccttcgagagaccatattggcaaaagttgaggttgacgaattagaagcttggacggggcgtgtattgagattaacgtaaccactatatatagcctataggcaaatcatcttgttatcgacgggtatcaaatacatgtacctttaaaagaactactccctccgtttcaaaatgtttgacaccattaactttttatacgtgtttgaccattcgtcttattaaaaaaaattaagtaattgtttattcttttcatatcatttgattcactgttaaatatactttcatatacacatatagttttacatattttattttttttaataagacgaacggtcaaacatgtgctaaaaagtcaacggtgtcaaacattttgaaacggagggagtattaaattttaaaagaattattaaatgtaaatacgagtaatcttcacttttaactctaatgtggtgggtagatttcaatacaagaaccttaccggttgaattagacttcaccaatagattacaatctcggtagatgtcaccacttacattgctccttaataacgaatgtagctacccctttgaatcgtagtaacaaaaaaaaacagaagaatagaaaaaacatataattctaacaggaatgtaagtgtaaaatagcgaattgctaagtacaggaaaaacacaacaatgatcgtttgattggatcacaggaaaaatacaataatcggatgagagagatagactcaaaggattttttttgctaagtttcctccaaaacctatcctatgcaataagccatcccataagaattttgtaggatttgaaaaaacttcaatcctttaaaccaagggctaaatagaaaaatttttgatagatttcaatcctataaaattccttcatagttcctttaattcaaagagatcctatactttcttcattctagaatatgagaatcttctatgaaatctagaagtaatcactttatctcaaaatacaccatataaggtctggtttagttggggaaaatttttggatttgatcgtcacatcagatatatagacacacatttgaagtattaaacgtagactaataataaaacaaattacagatttcgccagaaaattgtgagacgagtttattaagcctaattaatctatcattagcaagtgtttatggtagcaccatattgttaaatcatgacataattagacttaaaaagattcatctcgcaatttacacgttaactgtgtaattgtaaagaaggcctaagatcttattgggagaaaagtgattattactactactccttataatcacgacagataatcttgttcccaagccgacccatttaaagccgtgcacatggcccgaggttctccactcttctcagcccgcacgcacccaccactctctctctttctctagctagctcctcctcctcctcctagtagtcgagcacacactactacactacactagtaggagtagaacctagagaaaa

SEQ ID NO: 2184 - DNA, 1501 bp, Oryza sativa
tttacgacggcctacaaaacatcctcaatccccaatactagaaatttttacccttaaatattcaaaatcgtacaaactagatcacataatagtatagagggttgttttagctgatgtgacatcctagttagtaaaaataaataaatactccttatcttctcctcgttggcaccacatccgtgtggtctctgccgaccatcaatgcaacatcaagatggtagcatcaaccattttcctcttcttcttgtttgaccggcagacactggcgttggctcgacggacatcaccatcgacgcgtcccatagcccctagcacacgttttcacccctcccatgatggagtgctcgttgtcttcgacgccattgctgtgcccccatcatcatcttccccatccatgcggcggccttgaggagatctcggccctgagggacgcgaaggggtagacacgggagatgagtgtgaccgtgtggtcatggagtaggagacagagggacacgaggaggagcgcggggggctacaggatgtggcgcggggagatgaggcaggggagcagggagagtatggcatgtagtaggggcggtgggagttggagcttgtgtgagggtggcacgcccttcgctgtgcacaaatttgccgccaacatggtgcactctccatgcacgacaagaatccctgcactgcgcacactcgcccacgacaacagcaaccagtgaattgggcctgtggaagtgtcgccgtcgatgaggctgaggtcgatggtactggtggttgcaaacttttgtgtgcagccaggtgacaaggttgtcccaaccgttcaccaccactgttggtcgtctcctctctatgtcagccgcaccaaggtgaggcgccgctgccgcccctcccccacgtagggcgctgacatggagagaaataggaaagtggggagaggtgatgagtgattggagtagaggggagatgaggattgtaaaaggaagagaggtatcccatgacatgtgggtctgatcaatggtgactgacccagtgagtgggcccgatcaacttgccacgtaagaaaaaataactctctataatgtcattggacctactttacatggtttaaaatagttataaggggtggagatttctggtattaaaaatcgaggatgttatacaaactcgatgtgaaattgagagacaggagatgaacttactcctttcttcttcttcttcttattttttttctcctctagagtagtacactaatacatgcatggccctgttcttttctccagcaaaagttggataaacttttggatactcatgacacgcttttcaaactgctaaacggtgtgtttcatgcaaaaactttctatatgaaacttgttctaaaatatcatatcaatccattttttgagtttgtaataattaaaactcaattaatcacatgttatttctatctcattttgcatgaaacatttaatctaaatgttacatacgcgttggtggggccggggcggca

SEQ ID NO: 2185 - DNA, 1501 bp, Oryza sativa
tccgccccttggaggctagcgcgcggagtggcggggccgaggcgatgatgacggcggggcggtgtggagcggagcggcgacacgggcgacaggcgcgagcaggcgctgacgacggcggcgaccaggcggtcggccactcggcactcgcgcgcggcttgcaacgggaggcgcggcggatggagtggcgcggctcgggcacgcgcgctggctgcggggccgagcggctgcaggcgtggcagggcagcggggccgggcggcgcagacagcgcagacagcgcaggcatgatgcgagcgacgaccacgcgggcgcgcgcgcgcgaacgacgcgcggggagcggcagcgagggagcgaagaggagggctcggctcggcgcgggcggctcacgcacgcgcgggcagagcggagggagcggaggaggggcgttcggcgcgagcggctcacgcgcacgcgcgcgcggcgcgcgggcggagcggagcggagggggagagagagagagagagagagagatagccggggagggagggggagatggcccgagagagattcggcccatcgaacccagggggaggcaaaatagacttttgcggaggaatttgagatctgagatggcacggacactagacaacaagcaaagaaacaaatttcgcaattagggtttttaagagataattttcccgctaggcgccacgacggaacgggcgctacagctttggaatggcaatggttgggtgggagctggtgctgtgggcgaaatcctagctcgatgttttcgggttgacaacgatgacgcctcggtgttgtacttgctcttgagaatgttgctgagttgtcagctctctccacccgatatgacttttcgggtgaaaacctagtccaaggtggatagcctccatggaggcaccgcctcgaaggtcatgttccctcgcattcattgccttcttcctagtttggccttctgcgttcggttagtttcgtctctaggttggtgtaagaatgagcagatctttccccctctctctctctctcatcctcatcctcaaacctcctgtgagggtggccgggagtctgtcgtcgacattcttggtgaaattggtttgaagcgagagcgtctgcgacctccttgtagggctagcaattatcggtcacgtacaacgggtgtgtgtttggagcctgtagcatgtggtggagtagtcttttttttttccctaattatgaccttcttctgttgtaattctatacataatttttttcatgctatatcaatatgaatcttcttgtgttgtcttgtgcgggtcattcagaaaaaaacactattagtaagtgggaaactagaggccgaccggaggtttctttctatcgttgggagcctctctgccttccgacctccatcgaattgggtgcagaccagcagcagccaataattaaggtcgtcggccgtatatatgatgatggagaatagcagggagcagcagccggagtcgtcgccggcgaacaacaata

SEQ ID NO: 2186 - DNA, 1501 bp, Oryza sativa
ctccctccgctctgcccgcgcgtgcgtgagccgcccgcgccgagccgagccctcctcttcgctccctcgctgccgctccccgcgcgtcgttcgcgcgcgcgcgcccgcgtggtcgtcgctcgcatcatgcctgcgctgtctgcgctgtctgcgccgcccggccccgctgccctgccacgcctgcagccgctcggccccgcagccagcgcgcgtgcccgagccgcgccactccatccgccgcgcctcccgttgcaagccgcgcgcgagtgccgagtggccgaccgcctggtcgccgccgtcgtcagcgcctgctcgcgcctgtcgcccgtgtcgccgctccgctccacaccgccccgccgtcatcatcgcctcggccccgccactccgcgcgctagcctccaaggggcggaggcagagtccctcctccctctgccgcgtcgccccgctcccccctccttttcccgaagaggcaagggacaagccccctttctctccccccttttcttcctttttccctctcgccggcgtcacctcctgtcgccgttttggccgctagccggagcgccagctcgtcggcttgaccgtccaatgtcggttcccctctcccaaactgacattgccgcccctataaacctaagcttccccctttcctttcctctcccgttcgcctccacgccattgccgccgcctcccgtgctctgttcgccgtcgcctttcgtcgttgcgcgtgtcggaggagccggcacgagcaaggacgcggaaggggactccgggcgcgccctctccttcctcttccccggcccgaggccggagagattactcccgcgccgtcggcctctcgtcactgcgccccgcccgcacggtagtgcatccctccgttctccctcctcgctccatctcctccccttagactcgggtagtagcacgagtagcctccccgtagctagccggcgccgccccgaccgttgccgccgctcgccatgtgctcgccgctgtcgctgcccgagctcggaagcgcctctcgtcgccggcctccctcgatgcgtttcctcctaatccaacgctagcatcggattcccgtagccgcgtagatgctctcgccgccaggaatcggccccttgtgacctcgtcgccgttttcccctcctcccgccgccggttgccgccgccgcgattcgccgccgtcaagctccctccggcgaatccgagccgttggctcgtctcccctcgtctcgtgcaaccacccggtgtgctcgctttcgcctatatcgccgtggttcgctccgccgctcgccgctgtcgtccgccgttcgttccggccggcgtcgtcgtctacctcccgccggcccgcgtggcagccacgtaggcgccacgtcggcgcaagctcggccaaggccgggtcgaattgaccccggtcagcccctccccgtgcgcgcgttccaccgcgagccgtgaggctgcgcgtgggcccgccgcatccgttccaccgcgaaccgcgcgcg

SEQ ID NO: 2187 - DNA, 1501 bp, Oryza sativa
attgcacatggaagaagctagacttagtcaaggattgtgcttgattgaaatcttgaagaccgaaatactaagaatctgtgaatattacaaagaacatactacatgttgatatctgctatagcaggccatgcccattcatataaagcacgctgtatacagtatgttgattggaagactactcagaaaaagcatggaaccagggacttccatcaatacttggcattttctcatcacaagtcagttatattagccggccaaaacaaacattttgcgaggcaaagaattcaggaataaaacaacgaaccacttatcctaactgtagacaaccagctgaaattagcagttagcttatgagattcacagagatacaggaaattaaattcaaatgccaatctactgcagctagtagccaaaaatctgaaatcattcctatatcaagtacaatgttcataatccaaaaggcacccagaaacaatactaagtagtacattacggcaaaaggatacagaaccatcattgcccacaacctgcaaacaaaaggataactaaattaaaggcaaaacgatataaggcagtggcatgatgcactaaacctaaagtacgcttgatatggcacgctaagaaaatgaagtttgacaataagtcagcaataatatagcaagcttgaatcagtaagcaaactcaatgaagattttgtagcaatcagcgtccttaaagcagggacaagagagtacagacagtcaacttgcgtggcacaacacaagagcaatgattctaacacaatttgtcaataagtataggtagaacaaaacaaatgcaaagcaatagccatagcagcatgggaagggagtagatcttatacctgaagaatgacagaggtggtggtgtttggatgaacagtgagcaggcaaatgctctgcaatgtcctcttgagcgtcatctcatactccttctcttgcttccctgcaaataaaaaataaaaaataaaaatagcacaccatttgagcgattcaattgggcgagcagcgatagcaagcgtggagaggagagtagttaccaatctggccggtcatgggcttccagacgacctcaatggatgccttctcgggattctcccccttcctggttcccggctttggcccgtacacggcggcgagcacgatggtgtccccctgagcccaccgcgcggagccatgggcgcggtcgagagggttgcgtgtgcaggagaaggggcggagctggttcgggttccgcccgtccgcgcggctctcctccatcctctctccttcggcgatgggaaccagcgtgacggcggcggcggtcgtcgaactccagaaaccctagaaaaccccctcctcctcctgtcctccccttgttctaccatgccaccgcggctcgtgccaaggatacagacaaatcctagccgttcgatctgaatccaacggtcgagatcgccccagcctgtcccctattctggggcgagttccaactaggcgaaacc

SEQ ID NO: 2188 - DNA, 1501 bp, Oryza sativa
actacgagcgcctccccatctccgtcctcctcgccgagggcgcccaggtcgacgccgtcgcctactacgcgcaccgcggctacgccgacgacctgtgggcgcgcagcggcaagaaggggtacccggagtactcgccggccgtcgccgacggctacatccgccgcaaggatcggccgcagcagctcaccttcctggagcagattcgggtgttcgtctcatcgcagtcatcgtagaacccatcaattaatctcttttcttttcttaatctatttttcttctctttgcaatcactcctcctatttgtgcgatagcgtgcatgggccatgtgacaatctcttgtgatgaatggatgatcacgcgtgctacctaacctaccagatcgccatatcaggctatcgctgatcgcgtgatctgtagtatcacatccgtttgtgtgggggtaaaatcagccatcttcctgtaataaaatagaatgattttccattagactcactgatcattggctgtgaaatttgccggccgcctgttcatcagttatctcgatcaaggcttcaacttttactgtggtatgccggctcctagctggaaaatgttgaggacaaaaactcttcttcaacccaaagataacacaaccatcctgaatttggttgtaggggacgcaaattcaaaaccataattttctggtcacaataattgatgtgttcaagataacctgctctgctctgaattttctgtcatcttaattaattacagctgccttgaatcgttcagacaatacacgatatcttagttgactcggaaataaaatgaacgaatgaatctaaagacgagccttgcgtggattgcaaattggcaaaggcagcacagatgctcccgtcactcgcttagaataacaagccacaaacacaacacaagaacaaagagaatttgctttgtgcaagattcttctaatgcgattacatcaagaatctgttactgtcagtgtcactgtcaaccatttgcacaacgggcgggccttgacgttccagcatttttgacgacgaaaaagtggagaaaagagaggagacaaaataacagtcttgcgtggcaccgcctggagtccacgtcactttgaacggctctgctacaacgatacacccggcaagacagcaacttgcattgtgtttatcattggtggctcaaaatcacagcaaaacaagccattgcaatatataatatgatgtcgacagacggctgttcgcaaagtaccatttttcccacgataagctgaatctatcatactcgactgccagtatttggtcagtttccatacacggttagctgaatcttgccttcacaaattaacagtttttttccaccctgcaagattgcattataataaacctgtaacatttaagctatcgacagagacgtcagtaaaaggaacaaccagccagtttgcaatagcttatctgcttataataggaagatgaactctaactggcagtggcacagatcactg

SEQ ID NO: 2189 - DNA, 1501 bp, Oryza sativa
gaggacagttgaaaacacgttataagaaagtagagaaaagaatgtgtttcacactatctgagctcgacgttcataaaagaaggtgcttgacaaacctcgtcttctgtggcccatgaaacttcgtcaaataacgattcatacatcttgggcacaagttcatatgggaaattcacaaaacggcggcacacaagcagacccacatcaggtgctttgtcccccagcatttgcttgagcttcttcttggtatccttgtcaccacaaacagcaagcaggtaatccttaagatccttcatacagcggtgctcctacaagacaacaccagcaagttgattaatcagaagccaccagtgcagcaagacctatgtatcttgtggatgaagcagtgagtaggttgaacatacactgtatcttccaagattaagcacgctaatgagaccaaacagatcgtcattgccaccagtgctgcttccatcagcaccatttccttcaccatcctcttcatcgtcagcaatcttgacaaccgtacccaccgtggtctgctcaaggatgaggtcgacgaagccagtgagatcccacggcttggagtcgaggtaggtcttgagcagcagcttgacgccatggaagtcgccgggcttggggtcgtagaaggcgaagtccgcttgcaccgtatcgagctaggagcaccaatccgaagagcaactcgcatcaatcgatgagtaggaactccagagaggctagaaccaaggtagaggtaggcactcacctcctccgacgcgtcgtcgctgtcgtcggagtcgctgctgtagctctcgtcgtcactgctgtagcgctcctcgtcgctggaaggctcggcccgcttggcgcgcttgggcggcggcatatcgcgactggagccggcgattcctggagagcggcgaggcgtgagaaggaggtagcgaggccccggcgacggcgttgccaattaagtgtaagcacgcgtacctgaagggatttcgtcggcggcggcggcgggtggatcctcggggggaggtagtggtttagaggaggaggcggagaagaggagggagcgagcgaacggggagaatccggcgaagggagccgggcgctttcggtcgccgaccatgatcgccgagcagtcggcggcggcggcggcggcggctggttcggagagggaggagaggcttgccttctccaatggaagtagaacgaggcccatgcatcaaggccctgtttgttgggccgcaaggtgagtcgagctccgtgcagcccatattgttaatgggctggaaggctaatgcgacaaatgtgagaggctgggcccacgcgacatcgacgaagcgggcccacctctctcgataaataagccgacccaagcctcaaaacaccaaccaaccaaccaaagaaagaaaagctcgactcgagctcgccgcgattgaatcgcgcatgggcacggcggcgggcgacgcggcggagcagccaccggcggcgccggaggcgaaga

SEQ ID NO: 2190 - DNA, 1501 bp, Oryza sativa
atgttctctcctctattggaaaatttatttataggaaagcgatacaagctgagtagctgatacatttatttttatcttcactaaaaagttcatgtgtgtgatacatttatttttatcttcactaaaaagttcatgtgtgtgatacatttctttttatcttcactaaaaagttcacgtgtgtgatacatttctttttatcttcactaaaaagttcatgtgtgtgatacatttatttttatcttcactacaatgttcatgtgtgtgatacatttctttttatcttcactaaaaagttcatgtgtgtgatacatttatttttatcttcactaaaatgttcgtgtgcgcaatacatttctttttatcttcactaacaaggtcatgtgtgtttataatgcttcctatttgtttagttttgccttttgcttttttcacctttctttctagaagctaaatataatataaacaacttttcttgttttcttcaagcaggtttctttgtctgatggcattattcaggaaggtcctcagagaatttcagaggcagctatacagatctctaggtgtcgtgtagcggattttctgaatggacaaactgggtatgatttactcccagattctggcaaggtatggaaaatgagctcgtcttgtatgaattttagtgctctaatggttattcttattacattatatttacaattcaggtcattgctctagacgttaatttgcctgtgaagcaatcttttcatattcttcatgaacaggtgactatgccttcttctgctagtttccctccaatctttcattcttcttctgctctgtagcctgtttccctccaatctttcattagttgttctgacattgaactagtgatattttgctttgatctgtaaatatagtggaataggtacatacctttttagtaaatatgttggcctgttgttgcgtacaatgtttggtttcattggcagcttcaattcatctgagattgcatgaaaatggaaacactgcagcctcatgccttaaaagttgcagctacttcacctacttcacacttcttgtacaacccaatgttgcatccttcctcttgtacacatcacctagaatgcatgtggtcaacctttaaaagcttgaaagagcactatatatgtaaaaacattcactttaatttattaatcgatacatcatcaatggggtctaatttttgttaagatttgattagagcaagtaattgtcaagggtgatgattgatgtgtcagacatccaatacaacaattagaagaggttggaggaagtaggttctattctgtttgcactccacaatttccatataggttataagaaagttcagctctgtgctttcttagctgccatcttgattctgatttaattatttttggcatcttgatataactggaaatttcatagtttctttaaccatatatattgaagtacaagaaatattggctggttttgggaacatacattaaataaatagtgtacc

SEQ ID NO: 2191 - DNA, 1501 bp, Oryza sativa
tcttccaccgtacacattttctgtctgatactaatttcatagacctctcgatacatcgtgcttgttttgatcactaaatttgcttgttcccatcagtatctttttctgtaccaaattcctcgatctgcttctacaaacatgtggtgagtgtatgttccagattcgatatactaggccacgaaccattgaagaaaaaccaggaagcgagcccaccaatgtgcataacaatttttccgacaggatgtagtgcgatcattaaagttgtttatctctgttattatttatgcatgtgggaacctccaagtgggaaacaggtgaattggattgctcatgcagctcaactgatgccaaagttgaacctagctagctaacatattagtaactattggttgaattgaaaacatgcttgacacaccgttttggataggaaagactggacctaagaactagttgccttgtgctgatctatttgctaactacggatttatttatgattacaattcttttgctcccggcggtttgcttcttgtgtagaattgtaaagctgttgggtcattctaatgtgttgcagtgtcctattatgactgaaaaaaacttgttcatggcacttggtacaccatagagtgaagtttcccttatttaggctagcttccaggcttaatacagttatggtcagcagtcacattttttttgacatcacaagagcagccacattttcctgataagttgacatgtgtggcatccgtacacaagtgtggatttcgtccaggatactcaatctgttggcactttatctattgaaaagcatatagtattcaaaaggtgaatgatgaagaacacttagataaagtgatgcatgttcatctcctatgtgctcttgcatagtaggttcatgttgtatgtcaatctttttgagcccactttctgattcctctttactcggttaaagctgtaaactctgagtctcagtaattttttttccttagaaaatccgcatggagtgtttcattgccaacctgctgccctgctaggctgatatgtttttgtccttctgaagctgaacatttcagtacatcagtaaatcatttcatcatcctttgcctaataaacatttgcttgtgaacatacctgtagtttttgtccgaagtgaaattcattaccttttctcccaccctataaagctatgtgttcatataatttaaacagcttctttttcttggaaaagacaggcagtgagatcagcatcaagcactaccagcgggcaccagcagatgcatgtgggccacagcactagccagtaccacggatggttccgtcttcctggccgtgcaagccagtccacttctcatcatcctctgtccgtgcaaggtgccctggctgcaagtataaatacccagtctccttaccttgcaagtctgggctcttaaccaaatgagcaggagccaactgatgcatatgtataagcttggagatctgacgcctgctccatccatgacgattc

SEQ ID NO: 2192 - DNA, 1501 bp, Oryza sativa
ctgaccatcattttcatgcatctgtatttttttaatgaattattagccatgtccttattcggtatgaatgcctgatgtattgactgaattaaaattgtcaatatgctgttttcttcttggaccatatctgtaattgacaaatattgtttctttcagggtatgattgctgggcatgtgtactacttcctggaagatgtatacccgcggatgactgggaggcgtcccctgaagactccttcgttcatcaaggcgctatttgctgatgacaatgttgttgtggcaaggccacccaatgctgggcttggcgctggagcaaggtttggtgctatgggtgcagacccccaggcccaatgatcaattgccattcgaaggcagttactgattcgagagttcttttttttttttcatctgttcaaattgcgaaattgtacaagcaatgttcccgtgtatttatacaggctatagatcagagaattattgtgcataagaaagcatttagtagtatctggggcagctaaatttcttaactggacacgaagggtgaaggaaatggtttacgagtttcaaccggctggacaatgccgccatccttggttgcagaaactgatcctttttgcgacgattgacatctgaccgggatacttttcaatgtggtagtctattggtaacgataactgtatcaatcgttgtgatgtttgtccttgcgatttatggtatcagaaatgttagaatgttttatatactgtttgggtttgaagaatattggtcgaagatgaccctcgaaatgtacagctatccgtcaaagtatttttttttaaaaaaaaaacatgagtggataaaataagttacgtgcaatgatattcataacaaaatattgcaagtacatgcgagtaatgattcttgcaaattacatagaaagctattaatgtaaaatatcacgtgtacatgataatattgattgctaggagatattagctgttggatatatattacaaaagacaaccactagttaccaaatcgtccccaaatacatttcaccgatttgacttgaatacaacagatcaattttacttgaatgcaacagatcaattcataagcgtgccacagagctgaagtacgataagcagcgcgggttacgcggcgcagtctcgcactgaaagaagtgtttgtgggtatatcatcaactaccccatttgatcaaatcctgtcttaaaacataaatcttgttctaaatataaaatgtttatagccagatggaataataaagagtgaattttacaaaactacatatacatgtacattgatcaaaatatataaaaaaaatacggatttaaaatattatattttaaaattatcacaaaactatatatgtagggcctcatatatttagatgcagtatcaggagatcggtcccctgttgcatcttccccgtcttgacttgctccggttcaattcaaatcacctcgctcgcggtcagtcttcgtggagctttggaatacca

SEQ ID NO: 2193 - DNA, 873 bp, Oryza sativa
  unsure (1)..(873): unsure at all n locations
tcacccgagcacccccgcctccagttcgaggtcatccgctgctggccccaactcccacgcaatcggccagacatctgtagctgttgctaattgcttatgttnattnnanatagtnattcatnnnntntnnncnnannagcctntnngtttagttnnnnnnnnnnncnccactgaagccattactctgctgatgctgaaaatatagtagtagttcatcgagcaaataaggtttgttttttcatgtagcttttctcgccaaaacccctcatcattctccaacttccatagccattttcctaggagagacatattcattgtctctggatcaagaatcccaagcccaccctggtcttttggtctacaagtcactggccattgcaccgaataatactttctaatcccctgatctgccacataaatcttgttctataaaaatccatcatcctttttcactcctatagcatgatgagcagtagtatgtcatggtgctctttcattcatgttgaatagagttttttttatgagcgagtcccaacttaagattaagaaaaggccatatacactgtagtatgtgttatactccctctgtttctaaatacttgatactgttaattttttttaaatatgtttgatcgttcgtcttattctaaaaatttaagtaattattaattcttttcctatcatttgattcatcgttaaatatacgtatatgtatacatatagttttacatatttcacaaaagtttttgaataagacaacggtcaaatatgtgctaaaaagtcaacggtatcaaatattttaaaagggagggattatataaataaacatgaggctatgggtcctatcttattgcttagcgaccttaaacattg

SEQ ID NO: 2194 - DNA, 1501 bp, Oryza sativa
ctgccatttcatttactagtgtacgtgtcggaacacattgacatgcctcctcggcgaccatggtgcatgattactaccaattttatcgtttgctccacgacttaaattgaactaaagcaactaaatttttttagaggtaaaatttgcatataggagtatgtgttttaagtcattttaaaaaataagtaaattatattcacgggagattgaattgacatgtgggtgcaatatagtcctaaaacttaaaacttaataggtgagcttaccgatacaacttaataagttaacctcaaaatcatcttcaaatttaatttttaaaatttaaattttggctacggctcgtaagccattgagggagagtctatatcttcttcttcttaataataaaaaaggaaactttgaaatagactatccacggcatgatgtgaaggtggtccttgtaaaagaatcgatgcactccccccggggggggggggggggggggcattgacgcgtctggtcaatatttgtgtttgtgttgtacccgtctatgtttacatttcaaggatctatatactctgttcgttccaaaatataataatttttaatctctagaattcgttctagaatatgataacttctccatcaatattctcttcccaactaatcaaaattctccaccatttaatttccccacatacctccacttgtcactcaatcacgattttctctcgtttagttatacctagctatttttaaataaccatgtacaatcctaaaaatctatatattttgggaggcgaggtaataggtgtttaataaattctaaggttaggctaaaagattccatatttgtcattcagttgttaatttttatatgtttgaatttctttgtaacaatcgatctgattgactctaagaccattgcaattattggagtaatatgaatcattacagaaatgcttatattatgcataaaattagtgacaccatgatgtgaaaaaggattgattccatttgaacgcgcctgcgggaatgcgctttattggcagccgtggagccatctatttattcctcttcttcgtttgtttttttttatagaaaaaacaaagactttgatacgaagaccttgaattaggtagtaccatatataatactatatgcgtagtttagtaacgccatgatgggtagcttaaagctgtgttcggtagttggaggtgagaaataatctctcgcgcatgtaatattttttaaagtaactttttcatagaatttctttttaaaaagcatacagtttaatagtttaggaaacgtacgcgtaaaaactgagtgagcggagttgaaaaggttgagtgaagatcacagtttagtgagaaccacgatgtgaacagggcaaccaacaaaggcacgtgactacataggaacattatattagtgtcgacgtttgatgtcgcgattccggtatttgcatagtatggggatcgttggtactaggatatacgcgagatttaggtaaaagaga

SEQ ID NO: 2195 - DNA, 1501 bp, Oryza sativa
tggcgtggacgatggaggatgcggccgctagcgacgagctccggcgtggagcgtggatgacggatgacgcgggcgccagcgatgagctccgacgtggcgtggacggtggaggatgcggccgccggcgacgagcttcggcgtggggcttggatgatggaggacgctgacaccggcgacgagctccgacgtggcgtggatggtggaggatgtggccgctggcgacgagctccgacgtggacggtgggatcaccggcgacgatgctttggtgcccggctcctgattcctcgcaagtatcacctaatacgtggtaggaatagaaatatcacctaatacgtagtaggaatcgcacaggtatcacctgatacttgacaggtatcatatgatacttcgcgagtatcacctgatacgtaataggaatcgtctgataccttataggtatcacatgatacctcacaagtatcacatgataccggttagatatcaagacatgatacctcagaggtatcagaacctcatacctaaccggtatcatctcgtcacaacgggattccgttgtatagcagccctcttttcttttgggtgagtgatgaatgggacccacatatatgtttttaattctaataccacctaagcgccatatcaacaacatagaccaatgtaacactaccatgtagatgccacatcagcgaaaccaggaaaacctctaattattaaaggagttaaattgcatcggtttttatagttgggatcgagatatcgggttgaaggatacaaattagattggtcgatagttaagcgaacttattccccagctggagggctgtttggattgaccaggcctcacgtacactgcaagcccttccgggcccaacttaattcagcctgcttcaacttaattcagattttaaacttctctcctttctcttgaaacttaattagcaacaaataagagtagcatctcaaggtcctaggttcaaatttccatagaagcgtgaatttcggactgagctgtttgatggactaagttcccaatttagaaaaaaaatgtatatatccggttggatatagaggctggataaaaaaatcattttctatttttttttaaaaaaataacaataaatataatatgaaaactcttatgagctgtttgtatcccatctagtaactcctccaacctttttagataatgaatattaaatctggcttttgctttgagagaagctacagtctcctattataaagttcttggctcgaagcccaaacatgacaaaaataaacaaaggaacaatcatttattataaggttgttggctcaaagcctaaacatgataaaaataaacaaagtaagataacaacttattcatggagaacccctccatattttaaacctgaacagcatgaaagaatggccgcgatcaagcagaaaatgggaaagaaggcagccgagctccaggccttcctggtgtggtcgaggaagcctgccttgcatgaatcgcactgg

SEQ ID NO: 2196 - DNA, 1491 bp, Oryza sativa
  unsure (1)..(1491): unsure at all n locations
tcacccgagcacccccgcctccagttcgaggtcatccgctgctggccccaactcccacgcaatcggccagacatctgtagctgttgctaattgcttatgttnattnnanatagtnattcatnnnntntnnncnnannagcctntnngtttagttnnnnnnnnnnncnccactgaagccattactctgctgatgctgaaaatatagtagtagttcatcgagcaaataaggtttgttttttcatgtagcttttctcgccaaaacccctcatcattctccaacttccatagccattttcctaggagagacatattcattgtctctggatcaagaatcccaagcccaccctggtcttttggtctacaagtcactggccattgcaccgaataatactttctaatcccctgatctgccacataaatcttgttctataaaaatccatcatcctttttcactcctatagcatgatgagcagtagtatgtcatggtgctctttcattcatgttgaatagagttttttttatgagcgagtcccaacttaagattaagaaaaggccatatacactgtagtatgtgttatactccctctgtttctaaatacttgatactgttaattttttttaaatatgtttgatcgttcgtcttattctaaaaatttaagtaattattaattcttttcctatcatttgattcatcgttaaatatacgtatatgtatacatatagttttacatatttcacaaaagtttttgaataagacaacggtcaaatatgtgctaaaaagtcaacggtatcaaatattttaaaagggagggattatataaataaacatgaggctatgggtcctatcttattgcttagcgaccttaaacattgatggcctgtttagttcgcgaaaagaaaatttttgggtgtcacattggacgtttgaccggatgtcggaaggagttttttttacatgaatgaaaaaactaatttcatgacttgcatggaaaccgtgagacgaatcttttgagcctaattaatccgttattagcacatatgtgttactgtagcactttatggctaatcatggactaattaggctcaaagattcgtctcgcaatttcttctctaactgtgcaattagttttttaatttatctatatttttaatgcttcatacatgtgttcaaagattcgatgtttttttgaaaaagtttttggaactgcctgaagatgcccgagtaccaaacagaaaatttgctgcgtgcatatgacgtgatcgtgcgcaaatactccagttcctaaggacctgtacgccaaagggacgtcccctccgctcccctccccagatcctctctctcgaatcgtctttgggcggccaacgcatcttcctcttcctcttcctccatctcatctcaccatcccatccacgcttctcgactcccagacgacgctgctgctgcctttcgtcaaccccccacttctccttccccgccgccgctcgccgcca

SEQ ID NO: 2197 - DNA, 1501 bp, Oryza sativa
cttgggcaccttggggttgatccgccgcacgtccaccgcccgcttccgcgagaagtgcctcttcagcacctcccacgccatccctccagctccgccgccaccgctaccgccgccgcctcctcggaggaactgcatgtcgccgccgccgccgccgccgccttggttcgctggctggggttcagttcagcttccgcagctaagcccccgtctctcccttttcacccgtaggccgtaggaaggagaagaattttggcccattagatgagatatcatatgggcccggaacaaaaaggagaagaaggcgaaggcccacgattgcagattatatgggcccagcccaagaagagaagaaggcgaaggcggcggctgggtcgggcgctccccaccatccaaccaaccaaacctctcatctctccgccgcgatggcaactgcggccgccggtggtgaccagtgaggtcgccgccggctgaagtgtggttccattcgaggtcagcaccccctttcctcttatctatctgcttctattctatatgccctcctagatgggagcgagtgaggctgggggtacttggaaacatgagcagatgagctcaattgatccgatttgattttgattgggtttattttgggttgttcgctgatggaaagaccggaattttgctcggaaccttgtgtttgcagggcagtggcctgtagcgccggccgcatatgtcagctctccgcttatgccatggagccatcaagtcgccgtgcgctcggaagcttgctgctgctgctgcgccctgcgctcggaggggaatcccggcaccccaccaaaagaagcaagcgaccttctgcttgatgcgagcttctccttccttccgcacaaattctaggtagtgttctgttcagcgtttgcaccgaaatggctagattcctgatgtgtaatgtgtcaattttgccgctgtgtgtttattaggcagtacttaagtcaatttcgtgccacaccaagtgtttggacattatacagacaattttgtgctaaaatggggatctaaagctactctttccaaattcaccgtagcagtgacctcagttagtataaagacatgcctttctctcctttttgcacctaatgtaaaaaacattgcgttttctgaacagttggctgtgttaattctatcatggaagactcaaatttaacactctctttatatgtcgtcaatcttcagatatagagttggcaccgaaccggagtcaagagtgtgaactgcggtatttcattcaggcagtttgtgttttctattgttggcatttttgtccatctttacgcttgagttaacactctttaaagtgttgccaattttttgttgatgacatgaaatgttcgaacgtataccacactgtaacaggagattacctatagcgtttgctctacttgccagttttgcttgtttgtataatgcagaaacctctttttatgcaggcagatgcaatggtccattgaggctatgaccgatg

SEQ ID NO: 2198 - DNA, 1501 bp, Oryza sativa
ccaaacacaggctaagggcacccacaatggttatctataagctctctacaagagatccatgtcagcatatctattatataattaaaggaatagaaaaaggagccttcacgttcgctctcatggcctagaaattctcacattaatcggagaaaaagaaaaaacagagtccatatagaaatacaatttacaaatagctgaaattcggaattaaaaataaggaatattagaagaggggactagagtccatatagaaatacaatttacaaatagctgaaattcggaattaaaaaataaggaatattagaagaggagactagagtccatatagaaatacaattagaaaatacctgaaattcggaattaaaaataagaaatattagaagtagagtatagactccatatagaaatacaattaggaaataactgaaattcggaattaaaaataaggaatattagaagtagactatatagtccatatagaaatacaattaggaaaaaatagaaattcagaattaaatatataatttaaggaatagaaaaaggagcctccacgttcgctctcatggcctagaaattctcacattaatcggagaaaaagaaaatacagagtccatatagaaatacaatttaaaaatagctgaaattcggaattaaaaataagaaatattagaagaggagactagagtccatatagaaatacaatttacaaagaaatttggaattaaatatataattaaaggaatagaaaaaggaacctccaagttcgctctcatggcctagaaattctcacattaatcggagaaaaagaaaagacagagtccatatagaaatacaatttaaaaatagctgaaattcggaattaaaaaataaggaatattagaagaggagactagagtccatatagaaatacaatttagaaatagttgaaattcagaattaaaaaaaggaatattagaagaggagactagagtccgtctatatagaaatacaattaggaaataactgaaattcggaatgaaaaaaaggaatattagaagaggagactagagtccatatagaaatacaattaggaaataactgaaattcagaattaaaaaaaaagaaatatgagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaaatagaaattcggaattaaaaaaataaggaatattagaagtagagtatagagtccatataggaatttaaaactaactaaaatttggaataaacataataaaattaaaagtagagtttagagtctgtataaaaatacaatttacaaataactaaaattcaaaattaagaaaaacattggaagaagaatttaaggt

SEQ ID NO: 2199 - DNA, 1501 bp, Oryza sativa
gcttcttcttcttcttgttgttgttcttgttgcaaccggccgggctaccttgcttgcattgcatcttgtttgccatcgatctgcactccagcttattttcgatcgatactatcatctgttacttaaccatctgcaccaccgtaccatccattactttcttgaggctaccgatcgagctttaattaatttattaattattagctgcgcaatatataaataatacatatatatatatatatatatatatatatatatatatatatatatatatatatatatatgtgcaagttttttttctatataaatatacactattaattagccacactatatgctcagtgtattactagtagcacatcgatcgatctgccgatcgaggatttgatcacggcacatagagggttgttatgacacccggcacttaactccgatcctgtaccatcgattccttcaattataatcgggtagtactgtcttaattcataattaaataaataaaataaaattactagtaaatgctaactgagtacgtacgtactcagggtcagagatgcgtactacgcacatatatgtgcagtatatacatgtacgtatatggcgttcgcgaaaaaaacttagtacgtactgtatatatatacatataaagtattcgatgatttcaccaatccaacacaacgtacaatataatagtacctgcagatgttgtactcctacgtaatgagtagtgtttagaacttattaatttactactactacgtcactagctagatcgattgatttggccttatatatgtactcctacgtgtttgaaggttctctagcactacttacatactcgagactgattaatttcaaaactttacatcgtttgtttcactgtttggacggtagagtttgctatatatatacacctagcttttcctcttgcttttttatatgatacacgcaaggcaattaatatcagagtcttatactctctccgtactcgtaaagaaactcgtttaggacaatgtttaagtcaaacctttaaaatataaatcattaataactctcaagttgttgagtttgaaaatgtaaaaattatatgaatagatttgtcttgaaaaatacttccataaaagaatacatatatcactttccaataaatatttttatagaaataagaagttaaagttgtgttttggagaccgtgaagctgttcaaaatgacttctttttttttaagtacggagggagtatatatatagaagaactaggtagatagagtccccaattaattgcattacggtagtaattaactgacaaaaagtgagtgagagagatgaagctgcagctacataaattaatggacatgatgatgaggacggaaacgataataataatacagttaagcaaagtgtgatgctgcgagcagagcagtaatgatcgagagaggatgagtggctggtcggccggccggagatcagagggcgtgcccgtgcagtcgctttcgattgagcaat

SEQ ID NO: 2200 - DNA, 1501 bp, Oryza sativa
tttgaaggttctctagcactacttacatactcgagactgattaatttcaaaactttacatcgtttgtttcactgtttggacggtagagtttgctatatatatacacctagcttttcctcttgcttttttatatgatacacgcaaggcaattaatatcagagtcttatactctctccgtactcgtaaagaaactcgtttaggacaatgtttaagtcaaacctttaaaatataaatcattaataactctcaagttgttgagtttgaaaatgtaaaaattatatgaatagatttgtcttgaaaaatacttccataaaagaatacatatatcactttccaataaatatttttatagaaataagaagttaaagttgtgttttggagaccgtgaagctgttcaaaatgacttctttttttttaagtacggagggagtatatatatagaagaactaggtagatagagtccccaattaattgcattacggtagtaattaactgacaaaaagtgagtgagagagatgaagctgcagctacataaattaatggacatgatgatgaggacggaaacgataataataatacagttaagcaaagtgtgatgctgcgagcagagcagtaatgatcgagagaggatgagtggctggtcggccggccggagatcagagggcgtgcccgtgcagtcgctttcgattgagcaatatatatatatatatatatatatatatatatatatatatatatatatatatatatatatatatatatatatatatatatatatatgcgcgttgccatcctctctcttaagtttactatatgccctaattaattactagcttaataatgtttttatacaaccggaatatatacccctctattctaaaaatacttatatttttgaatggatgaagtagtgcatagtaggttaataataatgccagtgtaagaagcaaccagaggtattaccaaacaagagagaagactgacagtacagcaagactacaagagagacgactgaccattgtctcgcttggcacgtcttccgaggcgtacgtaggggcccaccaaccctacccagggcatggatgatggatgcgagcgggcgtgtacggtggatgcgtggcccacgtgtcggaatcatggcagctcaagctgatgctgctgctgataataacagcatacgctgctgcttttcgcagcttcattgctttggctgctgcatgcatgagactgtacatgatacagatgatgcagtactagcaaaacacaaaagccaggcgccaatcccgatccatcatccgatctccatcgatccatcgatcaatcgacctaccttactagtattgcattgcagctagctactaatttactgtaggatcgatcgagtaacaactgtgatccatggccggccgtgggctccattgctcccagcagctgcctccttctgctacctcagctcatcgatcgaccaacagcatgcagacatcgatcgatcagatgtctg

SEQ ID NO: 2201 - DNA, 1501 bp, Oryza sativa
gagctatgagtttccagagaaatgttaatacaattcaagtaccgcgacagttagttctacaaatttaagctgctgtccatatcagacgcattaatatatatttttttatttattttagataatattataatttattatttattcgtagtaaagcacgtgcattcagcttgcataatagtaatggctacagtagatataactaaattcttttgtacccccaaatgcaattcaaaaatttgaagtgtttaggtcacaccactgcacaagtgagttatcgatgtgcattgtactctgtacatataatcgtattaatggttgactagagattctatacaccacactgcaaacttttagcaataaatcgcggtacatgcttaagccgagagttgccttttagggcacccaccaaattaaattgagctcctggctatctattatattatcaaaacagctatgaaaggaggcaccacgtttgctgtggatgctcgaaattcccatattaatcggagaaaaagaaaagaagagtcaatctaaaaataactgaaattcggaattaaaaatatgcaatattgatagatgagtccatataggaacccaatacgtgattaattaaaatttggaataataataaaataaattccaaaattagaaaaacaaaaaaagaagagttcgagtacgtaggtgacggagcgtggggctcctcaccgggagaccgcgcaggcccccctttgccggttcggccggggactcagggtgaaattctaagctctctgtatgtggaaggttcgcgaccgtcgaaagagcataagacacgggcgatgtatacaggttcgggccgctgagaagcgtaataccctactcctgtgttttgggggatctgtgtatgaaggagctacaaagtatgagccagcccctcccttgttctgggttccgaatctggaaaagtccagtcctcctctaagtgggcaaggtcctccttttatatcttaaggggataccacatgcaccatctccctctcttctgtggggacttactctaccttttcataaatggacggagatttgtatagttgccgtccgaatgaccttctgataggacggcccatacctacctccacttccgccggaagcaggtgcgacgtgggattatggctgtctgctgacgacatgaccagtgtcagactggtcacaaatcgctcattcttgtccaccacgtgtcagtttagcaatctacatgttggcccttcttcacacaacatcttgcctgtaatggttaggatgaagcctggcatatatctaaccaggactaacgtgccatctctgggaggtaacacgctagctccagctggggacaagcgcctagaagccctcgtcctgacgggatggggcgaggcgtgcgtcagatcgcctgtcgccacctaacccgcgatctgaccggtctgtgactggtcacaaaccggataaacgagtgcactgcactgcgttacatgcggcgtgacac

SEQ ID NO: 2202 - DNA, 1501 bp, Oryza sativa
tctatgatgcttgtcacatttcagccaatagagcaatattactcaaccaagtaatactaaacatttcttgagttggacaagggtaaaactctagtctgggctgctcctcatcatgaatcaaacttgggctagccttgtaggttggcccttaatcaaaatttgtcttggcaggagctatattgggggctcaggttgctatgaatttagcggggcttaaactgaattgaacataggcccaatttggtccctaaaaagatcaagtctgaatgattgcactataatatttacaatcagattagttatcctttgtttaggcgctctacctcaagataggtaatgtatccagtcagacagtttataattgtctcaaaagttgcatttctgctcattgcaacgcaaatcagtatcatataagagatgtattatcccatatgggccccaaaaagaaaacgctattgtcctacaaagcaaaagagtgtcccagttaactgaacttcacataacatcattgcacaaaaactcgcactcgatcgcacgaaacacatatatggtatgatgggtttcctaacacaagcagtcaagcacaatgccatcaacacaacagaaccatcagaagctttataaagctaaaagatcaatgatttacagaataacaagggcaaaaacaagtattgctcaatccaacaactgaaacctccccgaaacaaagcatacagatatgcaggaagtacaaggaactgtattacaaaatcacataaaagatttataaatatctaaccacagcaacagcttatgaactgactaagaaaaagtctggcaattaacagcataataaaaaatgtaacgctaaaattaggtttccacaagtccacccacaaattcgaacaagcattctaaagctacaaactaacggaacaactgcaaactgaaagaccgtcatatcaaatgtccccctccccacaaatcccctaccataaattccccaaactaaagctcacccagctgaaatgagcaacgagaaagcccctaaatttccgcgaaatcagcaaccgaacacagattagtcggggaagaagaagaagaagacgggagggagcccgcaggtgcgcacctcgactgtccagatgaagaaatccccttcctctgcacacgcatacgattccctcaaaacaagaaccaacaacgaaagctaccgtttcttggatccaaccagcgaccccgacctccccgagcagggaaggtaaggaggagcgccaccgtggggagcttgggagggtgactgaggcgagcggcggcgggcacggctgggtggcacccctgcgtgcggcaacaaacggcccataatttcaagcccacgaagagaaccgggtcggcccataaaactagcaggccaaagcccgaatagaaagcggcgcgcgcgagcccacctcggcgtcggtttcttcactctccacccatccccagtagaggaggaagcgccagatctccacacccacccgcg

SEQ ID NO: 2203 - DNA, 1501 bp, Oryza sativa
aatgaaaaaaaggaatattagaagaggagactagagtccatatagaaatacaattaggaaataactgaaattcagaattaaaaaaaaaagaaatattagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaaatagaaattcggaattaaaaaaataaggaatattagaagtagagtatagagtccatataggaatttaaaactaactaaaatttggaataaacataataaaattaaaagtagagtttagagtctgtataaaaatacaatttacaaataactaaaattcaaaattaagaaaaacattggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaaatgaattaaaaaaagaaatattaaaagacgagtctagagtccatataggaatatatataatttacaaataactaaaatttgatattaaaaataattaataactaacacgtatataaaatataatataaatattacacattagtagttttgtaaagttattgcaaaatttaaaattatgttgtcattttaatatatttgaataatataatgagaaaacatatatgctaaattaataataaagtgaggagtatattgtagcaatcgatgcaaccaatcaaacccatccacttagatccagaaagtcaaatagtacttacattcagtctccattttgcacaaaagcatttgctcatactccttgccttctccacccccacccagcaactttgcttccccctgtgttcttccttagctcgttccttccgatggcggagctaatggccaccatggtggtcgggccactggtgtccatggtgaaggagaaggcctccagctatctcatggagcagtacaaggtcatggagggtatggaggagcagcacaagatcctcaaacgcaagctgccggccatcctcgacgtcatcgccgacgccgaggagcaggcggcaaaacacagagaaggggcgaaagcatggctggaggagctccggaaggtggcctaccaggccaatgatgtcttcgacgaattcaagtacgaggccctccgccgcaaagccaaggccaattggcagtataagatgctcggcatggatgtaataaagctctttcctactcacaaccgtattgtgttccgttacaggatgggcaacaagctcaggatgatcctgaatgcaattgaggtcctaattacagagatgaatgcctttaggtttaaat

SEQ ID NO: 2204 - DNA, 1501 bp, Oryza sativa
gcacgcatgcaattttttttcttcaactaatatatgcatgaaacaatgctagctagctgttaagtacgtttctcctaattatatattcttggacagtaggaaaaaaatgttatacgcatggacacatgccattttagccggctgtagaaatcactacgagagaaaaggttttcgtatgcgaacaaaacaggttttcgcacacggtcggccatacattgtttgcgaattaagacatacaaaaatcgggtatttctagaggatggtttcggttgcctgtagaaatcaatttccccacttggctcatgggggggggggggcatacaattgccctttgtctgcccattgccacatcaattttcatagaacaatccacaaatcaaagagaaaatgggaagaacgtttcatcagatttgcaaatcaagctactccaaaatattttgtatttacaaatccaacaaaaattcacaagaaaaagaagaagcaacaactacaatcaagcgaccgcgatggactagatccaggagccttgccgtcgccgttgcgcactatcgaggccatcgtcgttgtcgtcgtctaggtcatcattctccactgcgctgccgccatttgctcctcttcccttgtcactgccggccgcagctacaatcgtcctcctcccctctagctagatctggtagagggagagctagtctgggaaagggaggggagtggagtggaatgaaggagccctttgaagcccctgttgccgccgccatcacccctttgctaccgccgacctcctccctttcgaccagatttgggagagtgaggggagtggataggcccgaccgaagccccagcagttgccgctgacctcatcccatccggccagatctaggagagggaagggagataggggagtggaggaggccggccgaaaccgtagctgccacaccttccgctgccagccgccgtctccgccaccctttccaccgtcgggctccttccctctagccatatgtgacagaggagatgggaggggagtagacaagcacaaacgatatatatgatatttatatgatatttttaaataacttttatatagaaagattttattctatttaataatttgaatgtgctaacgaaaaccaggataaaatcataataacatgcctatatatatccgaccgattgaagcaagtgtgtgaagacgcgcctactgattcattcttcaattagtggaagtagcatccgtgtttcgaattattgcatatatatatacccacccagtacgttcctaccaaagtctaacttacttttcaaagcaataacctagctaattgatgcatgcccatcatgtatgcatcttaattctgtttgagctcagcggtcaaactcaaacaagtacaacctacacgctagtttatcaactcatagaacctttgtaattaacacaacacatgcatataaacactaagatatatccaaaaaatggcaaatcatcaatttatcttgtccctat

SEQ ID NO: 2205 - DNA, 1501 bp, Oryza sativa
acgcacgcatgcaattttttttcttcaactaatatatgcatgaaacaatgctagctagctgttaagtacgtttctcctaattatatattcttggacagtaggaaaaaaatgttatacgcatggacacatgccattttagccggctgtagaaatcactatgagagaaaaggttttcgtatgcgaacaaaacaggttttcgcacacggtcggccatacattgtttgcgaattaagacatacaaaaatcgggtatttctagaggatggtttcggttgcctgtagaaatcaatttccccacttggctcatgggggggggggcatacaattgccctttgtctgcccattgccacatcaattttcatagaacaatccacaaatcaaagagaaaatgggaagaacgtttcatcagatttgcaaatcaagctactccaaaatattttgtatttacaaatccaacaaaaattcacaagaaaaagaagaagcaacaactacaatcaagcgaccgcgatggactagatccaggagccttgccgtcgccgttgcgcactatcgaggccatcgtcgttgtcgtcgtctaggtcatcattctccactgcgctgccgccatttgctcctcttcccttgtcactgccggccgcagctacaatcgtcctcctcccctctagctagatctggtagagggagagctagtctgggaaagggaggggagtggagtggaatgaaggagccctttgaagcccctgttgccgccgccatcacccctttgctaccgccgacctcctccctttcgaccagatttgggagagtgaggggagtggataggcccgaccgaagccccagcagttgccgctgacctcatcccatccggccagatctaggagagggaagggagataggggagtggaggaggccggccgaaaccgtagctgccacaccttccgctgccagccgccgtctccgccaccctttccaccgtcgggctccttccctctagccatatgtgacagaggagatgggaggggagtagacaagcacaaacgatatatatgatatttatatgatatttttaaataacttttatatagaaagattttattctatttaataatttgaatgtgctaacgaaaaccaggataaaatcataataacatgcctatatatatccgaccgattgaagcaagtgtgtgaagacgcgcctactgattcattcttcaattagtggaagtagcatccgtgtttcgaattattgcatatatatatacccacccagtacgttcctaccaaagtctaacttacttttcaaagcaataacctagctaattgatgcatgcccatcatgtatgcatcttaattctgtttgagctcagcggtcaaactcaaacaagtacaacctacacgctagtttatcaactcatagaacctttgtaattaacacaacacatgcatataaacactaagatatatccaaaaaatggcaaatcatcaatttatcttgtccctat

SEQ ID NO: 2206 - DNA, 1501 bp, Oryza sativa
gttggatttgtaaatacaaaatattttggagtagcttgatttgcaaatctgatgaaacgttcttcccattttctctttgatttgtggattgttctatgaaaattgatgtggcaatgggcagacaaagggcaattgtatgcccccccccccccatgagccaagtggggaaattgatttctacaggcaaccgaaaccatcctctagaaatacccgatttttgtatgtcttaattcgcaaacaatgtatggccgaccgtgtgcgaaaacctgttttgttcgcatacgaaaaccttttctctcgtagtgatttctacagccggctaaaatggcatgtgtccatgcgtataacatttttttcctactgtccaagaatatataattaggagaaacgtacttaacagctagctagcattgtttcatgcatatattagttgaagaaaaaaaattgcatgcgtgcgtgcatatagggatcgaaattagccagtgtcaaattaacatacatgaccgatcgatcgattcccgaccacgatcgagctagcacatatatgtccatggtgtatgtatctatcatgtttaacgacctcagctagctgctggctaacgtaccaacaaccagctgctgtccaagtcaattacatgaagctgatgttgatcccgatcgatctcgcatgcatgtactcatctttaatttattccgatccctacccggccgctgctgtccattaattatattctttggttagttagatgatgattatccaaattatttcagtctcttctctagctagtatatattacgtgtgccaaattaatttaatcatgtctgagtagtaaaaaaaactgatatacagtacataattgtacttgagcaaaagaaaactaattagtaattcattcagtctatatttttactacggtcgacatgcatgtatatatgctttcaattttaatttgttatattagttatatataacaattatatagcaaattataaagaaattaaatttagtgcatcctagttcgttttccgcccggccctccaatatacgtagtatatatagtatatgcttggcattgagagttatatatagttggggtgcaatgcaaggaggccgtgcacgcgtgcttgcaagcgacggatgcatgatcgagatggatggatagatagatagatagatagatagataggagtatgtgccaagaattcaacttagtagctagccaagactacctccggctcaaaatatttatatttctaaaaaagagacatattagctgtacaaacaaattaccataataatcctaaaaatatagaataaagtaaatattgagacaaatggagatggaaatataggagggggtagaaggtaggatatttctaattgggtactacctccgtccttcccagaatataacaatttttggctaaatgcttatattttgggacggagggagtaggttttatcttattacaaatacaattattttaggagaaaatttaa

SEQ ID NO: 2207 - DNA, 1501 bp, Oryza sativa
agacagtcccagtaagtaaatattaggctctaatagtaccccttctcttcctactttaaaatatgtattcccttctccgtcattctcactctccacgagtcggaaatcattctcgccgactctagcacaagagaaatggcgaacaggatggtggcaccaaatcgtgtgatcttctagcttaggtacggatggagggagtccgacttctattgctatagctaggactcacgttttatagtatggacctaaaaactaggtcctgatctttcaatagatattgataactctcaatttgatagaaacttgacacatacgatcccgttttcgatcaacacgatccgaaccttgcaatcacagcaccacgtctcctctggttatcaaccatgcgctgttcggttgacctcgctgagaaggctaatccctacgggtgtttcacctaggcctctgaactctcaaaatgtatttttgggtccctcaacttgtctcgagtgtcatatatatccaaacaggcttcaacccgctccatgtgctgacgtggtatgccatggtggcgcgtacgtcagtagaacccatatatcagtcacatatagaaaaaatcaagaacatatttttctcctctatttttttatttttttaaaaaaaataaaaaaaatccctttctcttctctttataaattttatttttttttctatatggctggcatatggatcccactaacacgagcgtcactgtgacatgccacgtcatctcacaaagcgggttggagcccgtttggacatatatgacacttatgacaagtttgagaacccaaaaatatatttcgagagtttattagggatctagatgacacatccgtatacaagtttaagaaccgtacgtgtacttcactactcttaatgtttatgatatagctactactgtctgcttccaccaatcaccgcgtctatttttttaccaatcttacttctaatcacccctccttgctcccactgatccccaaccatttctcatgcattcaaggaacaatgatgcatatgtgtagagatgcatctattctcgaaataatttagagctatatatgtcgatagggacaagataaattgatgatttgccattttttggatatatcttagtgtttatatgcatgtgttgtgttaattacaaaggttctatgagttgataaactagcgtgtaggttgtacttgtttgagtttgaccgctgagctcaaacagaattaagatgcatacatgatgggcatgcatcaattagctaggttattgctttgaaaagtaagttagactttggtaggaacgtactgggtgggtatatatatatgcaataattcgaaacacggatgctacttccactaattgaagaatgaatcagtaggcgcgtcttcacacacttgcttcaatcggtcggatatatataggcatgttattatgattttatcctggttttcgttagcacattcaaattattaaatagaataaaatctt

SEQ ID NO: 2208 - DNA, 1501 bp, Oryza sativa
atctctatataaaccgagccgccgccttcacgcaaaacacacgaaatcaatctagggtttgcctcctcctctgtgctgcgccgtcactcgtagactactccatcccgctcgccgtcgtgcacctgcgatcgggagagcaggtctctggaacctctgccttcgacgtcttgcaccgggagaaggcggcaataaggtttttgggaagcacttcgcgcgactgctccctgttcgtccgcgacggctcgccttcctctccgcttgcgtgctacgcgccttcgtcgacgctcgcaaccgcgagtagttcctgccgagcaatcggtctttccgccacctcggtacgtgttcgacatgttgcgcatatttgatctgttcatgttttactgcttagtttacatgtgtagatctaatgatgcgttaatgctagtatacatctgtaatgtcatgatttatttatagaatatattaaatcattatatgtctatattctcaacaatccaaaaaccttattatacgcactgtgattttactatggctggttttgccgatgcactgaggccagataaatttaccggtgtgcactttaagagatggcagatcagggtcactctgtggctgacagctatgaaatgcttctgggtgagtactggcaagcctatgggcgttcttaatgctgatcagcagaaagaattcgatgaggccactactctctttgtgggatgcattcttagcgtgcttggcgattgtctggtcgaggtgtatatgtatatgaccgacgctaaggagttgtgggatgcactgaatactaaattcggtgctactgatgctagcaatgatctgtatatcatggagcagtttcatgactacaagatgtctgacaaccattctgtagtcgaacaggctcatgagatacaaaccatggctaaggaaatcgaactccttaagtgtgtcttacccgacaaatttgtggccgggtgtattattgcgaaactacctccatcttggagagatttcggtactgcactcaaacacaagagacaggaatactcctttgaggggttgatagcatctcttgatgttgaggagaaagctcaggaaaaagatgccgcgtctaagggcgatggtgggcagtccactgccaaagttgtgcacaaggcctaggacaagagcaaggggaaatacaaagcttagaagaccaccaacttcaagaagaagaacaacaacaacaatcctaatcaggatgagaggagttgctttgtgtgtggtcaacctggccatctggccagaaagtgtccacaacgcaaggggatgaagacacctgcagggcagacctctaagtttgctaatgtgaccattggcaacactggagatggaagcgggtatggtaatttacctactgttttttcagttaatcagtctactaattggtgggttgatacaggggccaatgtacatgtttgtgctgacatctcattgttttcttcttatcaggtcgcacggggtt

SEQ ID NO: 2209 - DNA, 1501 bp, Oryza sativa
aaattcgatccatagcaactaaacaacctggtaaaaaatatactcgcattaagtttcctgcttcaactagaagcatagaccaccggtttttcttcgatacgtagcactttcatcacattttaagctaacggtgttagattagagtaaagaaatttatcctcgaattattttacccttcgttttcctcttacatgaccaggtcatcgaccaagctgctatgccttgcatccctcgctctgtgcaccgtcgagcaagtagcagccgtcgtcaccccattgagtctctcagcccttgtgttgataggttgcacacgtcaagccagtcttttccgctaacgaccattctgctctacctttgcagccctcgctctatgcaccgtcgaccaagcagtcgctgttgtcacccgctgagcctctcagccctcgtgcatgttgataggttgcacacggtcaagctagtcattgccgctaatgaccaagccgtagcgccttgcagccctcgcgcaataagcaacccatgagcagtagtcgctgtgctttgctgtcacgctcggtcaagctacttgcaagctggcgctgcagttgtagccccaccgcgcctcacaagcagtagtcatcgttgtcaaccaagccgttagagattgatgccccgggagcggtgccaacggtttcgagcacgaaagcaccacccagaggcgagagggaggagctgaggtccatggggctgcaggtggagaccgatgataggggcgagagcatcggtgttggtgacgagggtcgtagatccagccgtctgtgtagacataaatgatagagaggaggtgtcgagattggcaggcggagacgtagctggcgagggcaaagaggacttggtggctaacatggaacttttggcgacggaggacgaggacgatatgtaacaccctcgtcacatttaccatttatacatgtaagttgggatgaaaagcaaaaaagactatttgctcttgcttctctctatatagcatcgtaacgagggtgttacatatcgaagaaaaactagtgacacttgctgccttctagcgaagaggggaggaatttttatgctatttttttttcttttttaccgactgttttgagagtgctaggggtgtgaaaaagaaaaggaggcgataaggttgggaaaggaggaggaaacggacgccacgtcacaagatgagagagagagagagagggtcgcatcacatcacatcacatgatgctgctggggctgcaactgaagtccacggcccccttgtgcaagaaagaggaaagaaaattccaaaattgcttcacgcacccccccacccacacaccacgcgtcctccaccgtccgatctccaccgcccacagcccacaccacggtgggaacgggaacgcggcctcccctattcggcgcagttgctatacgtaccccagcctcgtacacaacgccttccccctcccctcctctcctttcctctcgcccaccggaatcctcctcc

SEQ ID NO: 2210 - DNA, 1501 bp, Oryza sativa
cagatatgtttcgtagccgtgacatagaaactactagttcaaactgcagatatatatggataacaactctgaaatcgtaatcaatcgccttgcatggctgctatggcagtgggtcaatgcaagcaagaaagaaagattaattaacttgtatgtgtagtattcgcacagccgttccaaacaccacctaattagttgttaataattaataatgtactgaactatcaagcaaattaagctagttccatgagtgagtaggagtacgtcagtacgtggcccgtgacggtaggtaaggttccctttctttccttgtcaatcgatcaatctgctttcccttcctttcatccagggaattcaaggatccaagaatatgtacactttgctagcacttgcctttaatccatcagtccaactaattcatcacacagttcagttattagggaattatataagccaccaccacaaattaattggttcacaatatgtgtccagctaattaagatcaggtaccgctaattaagatcaggtacccaagtatagcatatgtttagtccaaattaaattaactagttcatgaggactacagcaagtaggtagcttaccaactctatgggtgaaattaaacatatgatctttttgtgtgttttgagtgttagttttcgactatcatgtctgcttgcatatatagatttttatcgatcaaattttgtgatgagcagagcagtcactgccgtgctagctaataactaacctgtgcgtagtgtgtatacgtattttctcataaatgatttgagatgaaaagaaaaagcagaggagaggagctagctaattaagcttgaattatatagataagtgcagtacacgtaagtacgtgacagggagcgatggagagacgaaagacggcgactgcacaacagatgaattgatggagtatgtatttaaaagcctcgctggcgatcgatcgattatattgactgaagagtaatctctgatggatcgatttttgaatcccaaaattaaacgatatgatatgatagagacatagcctgtatccaagttattcagttatacaactactaactcctgctgaacaaacctcatgaaaacttttaagccaaacaagtaattaatcatgcatctcatgagctcacaaatattatatgacgcaaccaaagctagcgtagctagctactcttgaagtggaggaaggaagaatatacatgtgcatatgtatgtatggtatgataaacttgactaattataccattggatcattgttaaccagaaatggtataaagaagacgcatatttttctttctcttgcgacggtgggcatgacagagacgcagcatatatagatggatggcatccgaccaactccaattggcgacgtcgtcttccttctctttccgcccgccacttcataccgccctctactcttgttgcttagctacctagctagctagctttcctctccactccatccacccacgcacctcaatcg

SEQ ID NO: 2211 - DNA, 1501 bp, Oryza sativa
aatgatttaatatattctataaataaatcatgacattacagatgtatactagcattaacgcatcattagatctacacatgtaaactaagcagtaaaacatgaacagatcaaatatgcgcaacatgtcgaacacgtaccgaggtggcggaaagaccgattgctcggcaggaactactcgcggttgcgagcgtcgacgaaggcgcgtagcacgcaagcggagaggaaggcgagccgtcgcggacgaacagggagcagtcgcgcgaagtgcttcccaaaaaccttattgccgccttctcccggtgcaagacgtcgaaggcagaggttccagagacctgctctcccgatcgcaggtgcacgacggcgagcgggatggagtagtctacgagtgacggcgcagcacagaggaggaggcaaaccctagattgatttcgtgtgttttgcgtgaaggcggcggctcggtttatatagagataggtcgcttgatcagggcgcccgcacgatctccactccgcacaaacgaaccggataagtcacgcgtaacttatccggactccacgccattttcacgcaccggatttttcggagtgtttccaaaacaaaacaaatccgaattttcctgcagcaaaacaaaactgcaaaaggaggctgcatctgcgcaagggtgaggagccaattttgcggaccattcgacgcgtacgtcgtgcacgcgcgccacctgccctgccaggctaggcgaggcgagcgagcgcgtgttccccctcttctctccaccacacatgcttcaagtggctaggagggcatcctcccttttaaggaggtccccctctcctagaataagcaaggtggtactaaactccacatgcatgccatcccatgaggtgggcttttgtgattttctaaagaattaatcttcgaatgggccttagcccatatattaattccaacagtgtgtgtgtgggcgcgcgctaggccccctttgattcaaaggaaattcatagaaattttagaggatttcattcctatagaaatttttcctatatagccctctgaatcaaaggaatagatcttatagaatcctatgaaattcctatggagtgcctaatgccatgcaagttttggaggaattttaacatgaggtagaaccttatggaaactttccttcgagtctttatctctcctctaattcctatgtttttcctgcggtccaatcaaacaataatttctatgtttttcctgtgttttgctatctctattttacacttacgttcctatcaaaatccaacgtttttcctattcctatgttttcttattcatgcgattcaagggggccctaccgaaaccctcctgccactaagagagtgtttgtgagtaggggaaaagaaaagattgagaagataagctagcgcataattaattgagtattaattcttttaaattttaaaaattaattgatatgagtttttaaagcaacttctctaaagtaatttttgcaaattaagca

SEQ ID NO: 2212 - DNA, 1501 bp, Oryza sativa
tttgtatgtcattccatgaagttaattttccaatctttgacgtcctgaagtattctgtagttttataccaacttttgtgtatcatcattttaaacaatcgtgtatgaaaattgaaatgcagtttgttgacttgtactgcttatagctgattcctttctcatcttcctctaggtcagcaccctgaaagttgcacaataaccctgagcagtcttcaccaaggaaacgggctgtctgcttgtctgatgtgctattcttgttctggtatataaatcggctgctatttaggacacttcttgattgaaaatgccaacaagaaaaaaaggccttgcaagaaatgccaccactgagcatatcaatcccccaaatagccgaaaatcaagcagatcaactcaggctgcagctgctgaacataaagtcaatgatctgatcacttcttcctccaaaaagcagatcggtaaagtttcccctactattatgtacagtacaaagctatagcctatttataggaatgtatgaaactatgagtatgggagagtaaactgaaaacttccagagcttttcatcctacttgttgtgttctgcagtgctcattatatccaagcttattcctgatgtttaagtgccttttttttgtccactactacaattatgcttggtattatttgggaaattattcttcaattttcctttatctttagttttcttgaaattggttgtggctccacatagatttttcttgattttgttccaaatatgaattgctacctctgcaggtggaggccttctgaagaaaaatcgagctcttaggggtgggaaaaaattgaattctatttatgattctgctggtactggaaatgatgtcgcgggcgtgccaagtagcagtttcttcaatcacaaggtaaagttctttctgctcaaagtgaattttttagctggtcaggtgttgtctatttgtgtaatcatacattttaacatacggtgtgtttcgataaaagcgaaaaaagaaaaaagaggaaagcaatattgtttctgaaataacctcaaattgactgttgctttatcctttacttatttgtctggttgatctttttctattgctagcaatctcatgaaaatgatgaagatcgttcatgtgattccatattttctcccagttttcacaatcagaaggaagatgttactgactgcttgagcgaaggtaccttttgaatataactccaccttagcatttattttctgcactccaagtgtcagatctgtgtttgaatttttcacatgcatttatctagagaataagaaaaacaacattttttagatgacttcatgatagtgtacattgcatatttagatgcactctgtgcatactgatacctgctgcattgcttctccagtttgtattttccaatacgccattgtcattatgcaggcttagtacatgaagaagtcatacatgagcctgttcagaatgctgaatatgttaccaatagcatatcatgcaata

SEQ ID NO: 2213 - DNA, 1501 bp, Oryza sativa
aacattgccaccatgaatatgattggttaaccattttttatttttctctctagaaactaaactaaagttgattttgatctaagcttattagtagtactacattttctttggcatgattcatggctacatctttttttaagcattggcatggcttcagtaaatacttgctcgatctcaggagtatgttttctagttaatttagggcatgtttaattggggaaaagaaaaaattttggggtgtcgtatcggatgtttaaccggatgtcggaagaggtttttggacatgaatgaaaaaactaatttcataactcgtctggaaaccgtgagactaatattttgagcctaattaatccatcattaacacatgcaggttactatagtacttatggctaatcatagactaattagactcaaaagattcgtctcgctatttcttccctaactgtctaattagtttttatttttatctatatttgatgctccatgtatgtgtccaaagatttgatgtgatgtttttgagaaaaaaatttgtgaactaaactgggccttatgctatggtgatcttgttactagtgccaatgtttttcttcatgtttagagttgtgtggattgctgaattgcagggtagatcaggctgatcagtcacccaacaatgtaactgttatttgttataatcagcaggaaagctgacaagcacatatcacttgcagacaataaactgtttccatctttttatgaagaaatgatacccatatatactatcgacgaatgcaccaaacgaaaatctaaaaacctgccactttcagtcttttttttttggttttatgtgatactgattgaattggaagaagacaacaaaacaacaatagatacactgtggatataatgaaataaaaatcttcttcttcttcttcttcttcttcttcttttgaaaaattctggccatacgattgtcaaattcttcttacctgattttcactgacaaattgcatccttcatgcatcggcttaagcaaacaaaataaagagaaataaaaaatcgcaacggtgcaaacatgcaatattgatgcatgaggtgctcataggaggacaaaatgctcagtggaaatcaagtcagctggttaaaaaaagaatccaacaaagatccgtctttagcaactgcccctcacccaaaaatggatttatagataaacttttcaaaaggcacactttataaccgtcttgccattttctttttctctgaacattcatctcaagcttcagagtttcatagcattggaaaaaatatatacagcgtaggagttttattagctgaagggcctgttcactttgatgttattttcaaccttaccaaattttggtaaagttgccaaaaaagtggctatatttagtttcctgccaaattttggtaactatataagaaatcctgccaaaattttggcaaattgccaaaatttaccaaaatttgataaggttttttttggcatcaatgtgaacaagcc

SEQ ID NO: 2214 - DNA, 1501 bp, Oryza sativa
aggatcgataacattgtgcagaaattgcagcacggatgatggaagaattgaattgaagatagataatgcgctggcaatggaccacggggtgtaagtaaaaataaacatgatgattactgagactgaatcagatcaaagagaggcgacacagatctcgccgtctgccaaggccatcccatccagatgcacgtctactagatagatccacccctactcataaagccaggaccatcgatcatactggtaggctactagaggttcaataggacatgaatttgcagaaataaattggtatgaatcaaataaaaccccgaaatttatataacactatcgcattgtctaattgtctagttttgtaaattataacatgagctggagagtctccaaccaccgcatggggttggaggacgaagttgggctcctggaaaattttccttgaatattttgatatatatgtttattagttttgttttttgtttttttttttggggggggggggggttgcttatgtgtatactgatctaatattgtattcttcgctctatttgtcaacaaattcattactctactgacattattttgtttttttatgttttatttaactattgagtgattactcaatcaacagaagtgtggcatatcatatcatatcatatcaaacaggaggagtgaatacgctcttaaaatcagttgccaaaaatatcttatttcattatatgtgacgtaacatgttagctgtttttatgtcttaagaatagctcggattttatcccaccactcttgttaattatttcaataaaaactataatcgactgtgtgtcttaaagcagagaactggatgtaatacattttcgttatcttttaagagaaatcatattggcatgccgctttggatggcgtcgtggcaggaggtgagccacacaggaggcgcgtacgggcgtgtacgaggcatgggcccaatgggccatgggcgcgtgtgtgcgagccactactttcccggggcagcgtcggtaaggcacaaagctcggcagctgctagcattcatggccaaatcaatgaaagatacaattcaattcaattcgggggtacgtggtggttagcatttggctactctgcatcaaaatggcacgaggaaaattccttcttgcgtcccatgcatctcgccatttcctttttttttctttacatacacatagccccatcgtccctaataaagttaaagttttaatttttaggcttaaaatttaacttgattaaagatatttttacatagtttttctgcattgaacacatatataaaaattttatctataaattatttttattttctaataaatagtttattagagaatacgagcaaccaataagacagacaggacaaagcaaagcagacgtttagaatgctccacatgcatccatatgaacacacatcttactgatataagcatctacagaagactatgggcttgtttggtttgataccaacttattgccctaccaa

SEQ ID NO: 2215 - DNA, 1501 bp, Oryza sativa
acaagtaggatgaaaagctctggaagttttcagtttactctcccatactcatagtttcatacattcctataaataggctatagctttgtactgtacataatagtaggggaaactttaccgatctgctttttggaggaagaagtgatcagatcattgactttatgttcagcagctgcagcctgagttgatctgcttgattttcggctatttgggggattgatatgctcagtggtggcatttcttgcaaggcctttttttcttgttggcattttcaatcaagaagtgtcctaaatagcagccgatttatataccagaacaagaatagcacatcagacaagcagacagcccgtttccttggtgaagactgctcagggttattgtgcaactttcagggtgctgacctagaggaagatgagaaaggaatcagctataagcagtacaagtcaacaaactgcatttcaattttcatacacgattgtttaaaatgatgatacacaaaagttggtataaaactacagaatacttcaggacgtcaaagattggaaaattaacttcatggaatgacatacaaactcactacatacactgaacttagctcttaggtacttcaatcaatatatgtcaaactctccccacagtcatcaaaaaacaggacgctactacggcatacacacttcagtcactcggtaggccactccgtacggcactcaccgtatcggcgttcgctactactacaggagtgacccctcagctcgcggcagcgacgaaatcgcgcatacggaagtcggaggaggcggtcgctggtcatcagcgccggcggaacccagcagcattaccggaaaatccaagcatgaaggtgtcgggagtcaaagaggcataccggaacaaggagagcagaggcggcggcgggcgggacgggaccagccggaggaggcggcggaaaccaaaccctagcggcggcggccggagaggaagcggacaggagaagagggatttttgaatcgtcgaagaggggagggagctccaaaagggcgagaaagtaagcgtgtcaggtgggccccacgtcagaatccagtaggtgtaggcgggccgcctggagcttggcccattaaggcccaatcaaataatacaggcccagtaagctgaaagaaccatgggctataaatagctagctggttttcggggaataaaactccgaaccccctcgacaggttcgggaagaacacgcgttcgtatctgcaacgcgaaataactcaacggctgcatatgcagagttgaatttgaacttatatatattacatgttaatacaacttcttatattttttaaaaaaaatcatatctatatttaagtaacatacggacacaagtaaatattccctccaggactcaaaatccacttcctatatataccaccagaagctagcaggaacgggaaggcaggtcggtcatacacgtaagataggacgagtatgagagagcgagagcaatagcaaagcccag

SEQ ID NO: 2216 - DNA, 1501 bp, Oryza sativa
atttctgaaacaaacaacgggtgtgtgcaagagaatatctgaagatcactcgccttcctgtggccactagtaattcggtgctacagtttctcttcccatcgatcatatgcacagtgcatggaaatgacctcaatgcatgaatgatgccattggcacagaacactgtcgaaccaaaaacagtcgatccatccactgattgatctgggccaatgtacctttcaaccaaatctatcactctctaattgcctgtccttttctctcaaggctaaataaattataccgttgttttctcttttactagttggcatcagcatgaatcagtttatacattatattatatagaatacatgagtatctttcggcaccaggaatcgcagatgagcttcttacataaagcataagaccagtattgggtctttttgcccgtcagacaagtccactcttgcttcttgtatgcatgaagaatggaaaatactgcagctcagctggcatgttccaagcaggtcaggcctaacagtttgcacacgaattttgaccagaaataatccacaagtccagctccaaccagcatccagattcagatgacgcagttgcagaaaaaagatcgaattcaatatggaaggattcttttcagagtccacaatatgtacaagtgttctgtgttcacttgttcagtctcaaccattcataaagagatactaacagagttcaagttcttgttgcatacatcttccaagtgccaatagtttatttattcacgattcacggttgtctgttcactgttttgtcccttgattcttcttttatttgacgagtgcgccatggtgtaagcatgaatgcgttgcgtattcagagaaagtgaatctgaattttctgttgatcaagtaacaaagaggaagacaccatcacaccacgctctacttgctgggttcagagaaccatgaaactttcagagtgggagtagactcagaaatcaattcctttatatatttcgggcttgttcacattgatgccaaaaaaaaccttatcaaattttggtaaattttggcaatttgccaaaattttggcaggatttcttatatagttaccaaaatttggcaggaaactaaatatagccacttttttggcaactttaccaaaatttggtaaggttgaaaataacatcaaagtgaacaggcccttcagctaataaaactcctacgctgtatatattttttccaatgctatgaaactctgaagcttgagatgaatgttcagagaaaaagaaaatggcaagacggttataaagtgtgccttttgaaaagtttatctataaatccatttttgggtgaggggcagttgctaaagacggatctttgttggattctttttttaaccagctgacttgatttccactgagcattttgtcctcctatgagcacctcatgcatcaatattgcatgtttgcaccgttgcgattttttatttctctttattttgtttgcttaagccgatgcatgaa

SEQ ID NO: 2217 - DNA, 1501 bp, Oryza sativa
attaacctggtatataggtattggatccggtactcataggtatcaaacccgacctaggtatcgaatccggtacttataggtatcaaacccaatacttaggtattagacttggtattcataggtatcatactcggtacctaggtatccgacctagtacgtacaggtatcagaattgatactcataggtatcagatcagatacccgatacccaggtatccgatccgatactcataggtatcatacgagataccggatctggtactcataggtatcaaacctgacctaggtatcgaatccggtactcataggtatcaaacccgatacttaggtatcagacttggtattcataagtatcatactcggtacctgggtattcgacccgttacgcataggtattagaacaaatactcataggtatcagatcagatacccgattcccgagtatccgatctggtactcataggtatcagacgcgatacctagttatcggatccggtacttataggtatcagacccgataactcggcatcagatcttgtatttataggtttcatacttggtacctaggtattcgacccagtacttggatatcagatatgataatctagcatctatatatcacatactagagtttctaagatgtggtataaccaagagcccaacatgacatatctaattagaatacattgtatccatatataatttaggtaattatttgtctggtctaatccatgcatggtataggacacatgcaaatagatgcaacccatcttaaacacatagctaggctactaggctctgccataataagtaccctacatggctagggtacgggactactagtagctattacagggatttgacatgcacagcaagctagtagtactttcggttttatttaatagctaggctagtatcaaaggcaggacaggcatgctgggtattagctagctgtcaggaacaagactatacactgatacacatagcaaacatgcgtgatgataatcctagcagcacgcgacatactcgggagaagccggcacgcggggccgcgtcatgggggataagcggtataccattcaacggtataccgttgtgtagtctttctcttttagtaattagggagtcgagatatcccggtattgtggtttagggatacgaattagattaagcctctagttaagggagtcaaagtgaacttactttacggcagaacactttccggccgagatagcccagtaaggcccatgggccttgtcgtgccggcccagcccggtctatcggttgcaacatgcaaacgttgcgcagcttagccttagcccaacgatgacgacgagatatcagacgtgtacgtgtgtacaaaagcacagcaacaatggcggcgaggtgacgtcactgctcattaaaccaaccaagaccaagtgtatataatgtaagtatgccactgtctcgcgtcgtcactgagctgtggcgttgcgagtgatggcgcggcgaggaggcg

SEQ ID NO: 2218 - DNA, 1501 bp, Oryza sativa
tccgtttatctcaatatatagtgtattttgaattctcgaggactgaaggacaggagacatcaaatctactttaatatgtccatgtccgcaccgtgtcctctacggagtttttataaatgtttgtaagtgtcaagtgattcaaattatatgtttaaacgtgatatgtataaatgaccgtaaaaaaatacatggcagtggtgacaattaagtcccacactaaaatgtacgactctgacatttccgtcaattgtaacccattgttgtttttttttcttttttttatgcaagtagtttattcccgacatgtatctctatggtactatcttaaaatgggaataatacgttatattatgggataaaaagagtacgtgtttgaaagacgatgaagactaataacaaccaaactaatacctccacgtacataaccgtggccattataattcatatcaaaatgcacgttactaccgtctaccgttgagtctgacgcaattcaatcaatcaagaataaaaatataaatcaatttgtactggaccaaacgcaaacccaagttccagcaccatcgtttcgaaacggtatatttgcaaattaaagtgatctccgaataaaatttttatatacatgtttttagatatctaaaagtaaagtttgaaaaataaatttcgatgaaaaatcttaaaatcagttttaaatttaaggataaaaatttaaattttagctgataacacgagcatgggagaaaagatgaggagatgaggtccttcgactttgtacaccacacgagctcagccagtacacgcgacggatgagccgaaccgtttcatcccggccgtccgcgtctaatccgacggcggccgcggcggcgccagacttggccaacggtcgaccacgccgccgacgcgcgtaacctacttgcgccgacgccgccgcgttatcctactcggttgcggcgcggggacgggatggcgtccacgctttcctctccttgccaccaccacctctcctactattatagccaccaactccgacgactgcggctacgcctccgcccctccaccggcgtctacggtcggccgtcaggttcttcgatcgcccgcctttccatacccattccttctgtatttcattcttgattttggggggaagatgggataaacaattggttatccagtagataacttcgttgatcgattgacgtcgatttttatttttattgctaatggagaagaagctaggtgatattaacttgtttgtttctagcaacatgagggtacaagatctctttcagttttgacacaaccaaatgagcatccaaagtaacactactgtacttagtatcgcgatgttcttcaaaatgctgtgttaatgaaaatgaaatagtgtgctgacagttgattcatgcagaacttgacagtggtagagaactttattcccatccaacgttcgggggaagccgtagccgtgtgtcgcgttcatctttcatggaaaaatcccaaagaaagc

SEQ ID NO: 2219 - DNA, 235 bp, Oryza sativa
gatccccccgagccactgcacctgtacccgacgcgcgacgcggcacaatgcccgcctcacctgcacgtacgccatgcctcccacccctccgccgctccgcgcgcccatgtgtccaagattccggaaccgacgacgtacgtcgacgtacgtgagccccccccccccccgccatggattcgctgcctatatatacgcacgcgatcgagctgatcgatcagtgtagcgatctacgaga

SEQ ID NO: 2220 - DNA, 1501 bp, Oryza sativa
tgaggcaggaggtgtcgccggggtcgaggtcggcggcggcggcatagtgggcggcggccctcttgtacagctcctcgccgtacgcctcgtcgccggcctccttctcgcgctgcgccgcctccttccgctccttcgcccccatcgcgcgcccgccgccgccgccgccgcgggagacgacgggagccatggatggatggatggaggccaaagggcagcgtacaaactctttggctcttcagggatgattagcagataagctcgaccgacgtagcttcacctctaattaatcaggccattaggggcataatgacctcattttctttcttgaccgacttaagtctccaaccgaccaaccctccactacagcatgcagctgggcttacaaaaaaatgtctattaatattaaggagtttcaaaacgcgttcagcatgtagtcaaaagaattcctgcaagttaatatgtgtgctttctccataaccatgtactagttgctatttccactacatgaaaaaatgttacaaattcatggcgagatttcaaaaaggaacctagtatttctttttataaaaaaaatccattccaaattcatggcgagatttcaaaaggaaagttatttgtgcatttcggcacacccaaatatgtttgtaataactgaaaaatattgtgaaaataatactcggtgttatcattaaccaagtacagtatgaccaattttcaggaaatttaacggcggttttatttccatacggccttaagcgatgagtggcagcgtacggtatgaattgagaaaaatggccgggccagcaatactttcccatccaggcgtctggaaaagcccaagctcccggggcttcacatggatgggcctgataattagttaaattttccggcccatacataggataggcccatgcgaggaagatgagatgatgcatcatgatctgaggagagatgggcctatgggttgagggcctgggccttcttgcgaagcaggccagtcttcagatgcttaggttttgcatacagccctacagagtttcaactttggcgctgtttcaaatgcagaaattttaaacgaaatttaaaatgcaatttttttaataggattggattttttttgccgcgcggaaccagcgccgtacgattgcgttcgaatcgacggtgcagatttgatctcgggggcagaacgcggatcgcgatccgtgggagcatgagctctgcactgtgattggttggagcagctgcgcgcggatcgcattcgcatcccgcgcggggccgcgcctccccaaaattccaaacccaaaatttcgcccaaatttcgaacatttccactgcgcgcgaatgcgaatgagcgaatccctcccaaatttcacgcctatttaaacaccgcgaattccccccctctcaatccaccaccgccaagtctcaaatccaaagaaatcactcgccgccgccgcctcgccttctccgccgcgccaagctctcctctcctcctcctcga

SEQ ID NO: 2221 - DNA, 1501 bp, Oryza sativa
atctcacggagcgcgacggtgccgggcctgaagcggtggggcttcttcacgccgccggtggccggggccgacttgcgcgccgccttggtcgccagctgcttcctcggcgccttcccgccggtggacttgcgcgccgtctgcttcgtgcgggccatcgaggaggaggagaggagagcttggcgcggcggagaaggcgaggcggcggcggcgagtgatttctttggatttgagacttggcggtggtggattgagagggggggaattcgcggtgtttaaataggcgtgaaatttgggagggattcgctcattcgcattcgcgcgcagtggaaatgttcgaaatttgggcgaaattttgggtttggaattttggggaggcgcggccccgcgcgggatgcgaatgcgatccgcgcgcagctgctccaaccaatcacagtgcagagctcatgctcccacggatcgcgatccgcgttctgcccccgagatcaaatctgcaccgtcgattcgaacgcaatcgtacggcgctggttccgcgcggcaaaaaaaatccaatcctattaaaaaaattgcattttaaatttcgtttaaaatttctgcatttgaaacagcgccaaagttgaaactctgtagggctgtatgcaaaacctaagcatctgaagactggcctgcttcgcaagaaggcccaggccctcaacccataggcccatctctcctcagatcatgatgcatcatctcatcttcctcgcatgggcctatcctatgtatgggccggaaaatttaactaattatcaggcccatccatgtgaagccccgggagcttgggcttttccagacgcctggatgggaaagtattgctggcccggccatttttctcaattcataccgtacgctgccactcatcgcttaaggccgtatggaaataaaaccgccgttaaatttcctgaaaattggtcatactgtacttggttaatgataacaccgagtattattttcacaatatttttcagttattacaaacatatttgggtgtgccgaaatgcacaaataactttccttttgaaatctcgccatgaatttggaatggattttttttataaaaagaaatactaggttcctttttgaaatctcgccatgaatttgtaacattttttcatgtagtggaaatagcaactagtacatggttatggagaaagcacacatattaacttgcaggaattcttttgactacatgctgaacgcgttttgaaactccttaatattaatagacatttttttgtaagcccagctgcatgctgtagtggagggttggtcggttggagacttaagtcggtcaagaaagaaaatgaggtcattatgcccctaatggcctgattaattagaggtgaagctacgtcggtcgagcttatctgctaatcatccctgaagagccaaagagtttgtacgctgccctttggcctccatccatccatccatggctcccgtcgtctcccgcggcggcggcggc

SEQ ID NO: 2222 - DNA, 1501 bp, Oryza sativa
tactacggtaccgagacttgaattgcagattttgagcattatgaaacagactacagaagtatagagtacttgcctttatgtatgaatataacagagacttgaactgcaattcttttcaatgcttttccttttgagaaaaacactactacttccaatcttggggacaaatgctgcaaatccataccagcaatcggaaaacttcagaaccattttgatttctgaatatcaaacagaacaggacaagtactaggataaccgaaatattcagttcagatcatcagaataacttcagaaacattctgaacatcacatcatccagtcaaaggcaatctgttcacaggatcaagatggacacagaaatttggggataaaacagattacttcgattgcaatttcagaataaccagcagttacattgcaaccatggaaactaagaatctaagactacgacatgacaaagcgacgatctaataataacaccaactggtagaacatgacaagtccctatgaatcaagcaagaaccaaaggtgggctgatggcctaagcgcgctcgccgcggatccggcgcgcgagctggatgtccttgggcatgatggtgacgcgcttggcgtggatggcgcacaggttggtgtcctcgaacagcccgacgaggtacgcctccgcggcctcctgcagggcggcgacggcggagctctggaagcggaggtcggtcttgaagtcctgggcgatctcgcggacgaggcgctggaaggggagcttgcggatgagcagctccgtgctcttctggtacttgcggatctcacggagcgcgacggtgcccggcctgaagcggtgcggcttcttcacgccgccggtggccggcgccgacttgcgcgccgccttggtcgccagctgtttcctcggcgccttcccgccggtggacttgcgcgccgtctgcttcgtgcgggccatcgagaaggaggagaggagagcttggcgcggcggaggcggcggcgagtgagttctttggatttgaaacttggcggtggtggattgaggcggtgggattcggcggtgtttaaataggcgtgaaatttgggagggattcgcattcgcatagtacgcgcgcagtgaaaatgttcgaaatttgggcgaaattttgggggtttggaatttggggaaggcgcggccccgcgcgggatgcgaacgcgatccgcgcgcagctgctccaaccaatcacagcgcagaactcgaccccccacggatcgcgatccgtgtgatgccccctggatccaatctgcaccgtccattcgcacgcaatccaacggcgctgattccccgcggccaaaatccaaacccaaaaaattttcgcgctctcaaattccaaaccccagcctccccctatataaacgcgtcgcctccctcgctgtctcaacccactccgccgccgccgacttcgccgcgaaatttctcaaatccaaagctccgccgcgtcaagctctcctctcctctcctcctcga

SEQ ID NO: 2223 - DNA, 1501 bp, Oryza sativa
gagccgcgcgcggggcgaaacgagccggtagcccggccggtacggtggccggacgacccatgccgatcccctgcgctgcagccaacgcaacggacaaaaacgccagccatagaaatgggaatcgaaggccatcgatcgagcgccgttgccactccacctgatacataattgcattatttgtaagcatctgtataagttgagtatagtagagagagaaattaactagactggccagactcggtcgccatcgccatcgccagttgcacgctaatttaacggaagagtgcatgcatgcatccattgataggatagacatgattaattcgccacttggtctgttcgattatgtttccactcttactattattttagaaacacactatacgaatacaaatacggacgttcataacgcgcgtatactgtaagtaccttataaaaacttgaccgatatattttgaagatgatgaaatcactacgaacgtctttgctgccgacatgtatatcacctatcaataaaaaaataattaaccgtaaatgcaagcacccatttgctcacatatcatgacattggagcaattgaataagtgctattttttttaagtaaaatacatgactgtctttaaacttgaaagtagctgtcacttaggtccgtaaacttaaaaattacacatatagatctgtcatcttggtttaatgattcgtagccagtccaaacctcacttgactggagctaaccgctgacgtggcattccacgtaggcaacatatttacagacaaccccctccacgacgacaagtggcaaaagaattaaaatttgccccttcgtgctacaacagcaccctaaaacccataaaaatctctaatggcggtccagcgcagagcagaagggggaagagggggcggcgccgatccgacgaagggaaaaggaaaggaagagaagaaatataagggttactgatggttgggtcccataggatgactcaaaaggttagaccaaatcaaagtgccacattagcgaccctcctaaaccttgaaggagtcaaattacaccaattctaatagtttgttgattcaagatatccagtagcggtttagatatatgaattagattggagatatatctgagggagttaaactgaacttattcctaccgtggtcgtcaacttcggatcacgcggcccaccctccctacatggcccaccctcgacgcacaggcaggccgagacccacccaccgcaaagcccggtcgatgcgggccgaagcggcgtccacgcgagcacaaccccagcccagcccgcctcgtgatccggcccatcacgttgccttcttccttccccgaccatggcgactccgtccacctctccgctccaattctcccccacccgcaaccgcgtcctcctccatccttcccggcgaagcgatccaccggcggcgaggcgcgtcagctctcacccgaggagctcagccccaccggcgcgggcgcgcgcgcgcgcggcgagga

SEQ ID NO: 2224 - DNA, 1501 bp, Oryza sativa
ctcgacgctgggcatgacacatctccagttaccaacttgcctcttgaacacatggaactcattcccaatcgcgcactccgttctgctattgtgtggtggcacgaacagcagaacgcggcacgcgaacaccgcgacatggcgtgaactacaactcggcgtttcatattgtaaaattcttaattgttgtctgtacttttgaacaattttttgctgtctgtagttacttgttagccatgtttataacacacaggttgaaattgtaggctgttagtatgccttgtacacacaggtcgatataattcatgccagaatgcaacataaacacagcattcagtaaaacagctcttaatcatatgactgtgaaacagtaccaaatatttcacaaaagcaggtgaaacaaatagcaagatttgaacatcagaaagatttcccatttataatcagagcaacaattgacagcaacagcaacaagccattacatcactactactaagcaattctggtactagagctatcacagatgaagcgactaataaattaatcaggcgcgctcaccgcggatgcggcgggcgagctggatgtccttgggcatgatggtgacgcgcttggcgtggatggcgcacaggttagtgtcctcgaagagcccgacgaggtacgcctccgcggcctcctgcagcgcggcgacggcggagctctggaagcggaggtcggtcttgaagtcctgggcgatctcgcggacgaggcgctggaaggggagcttgcggatgagcagctccgtgctcttctggtacttgcggatctcacggagcgcgacggtgcccggcctgaagcggtgcggcttcttcacgccgccggtggccggcgccgacttgcgcgccgccttggtcgccagctgcttcctcggcgccttcccgccggtggacttgcgcgccgtctgcttcgtgcgggccatcgaggaggagaggagaggagagcttgacgcggcggagctttggatttgagaaatttcgcggcgaagtcggcggcggcggagtgggttgagacagcgagggaggcgacgcgtttatatagggggaggctggggtttggaatttgagagcgcgaaaattttttgggtttggattttggccgcggggaatcagcgccgttggattgcgtgcgaatggacggtgcagattggatccagggggcatcacacggatcgcgatccgtggggggtcgagttctgcgctgtgattggttggagcagctgcgcgcggatcgcgttcgcatcccgcgcggggccgcgccttccccaaattccaaacccccaaaatttcgcccaaatttcgaacattttcactgcgcgcgtactatgcgaatgcgaatccctcccaaatttcacgcctatttaaacaccgccgaatcccaccgcctcaatccaccaccgccaagtttcaaatccaaagaactcactcgccgccgcctccgccgcgccaagctctcctctcctccttctcga

SEQ ID NO: 2225 - DNA, 1472 bp, Oryza sativa
ctatgttgacttgattgcatgtcaaacaacttactgttagtgataagaaagattatatatgtatatttagtgatttaaaataaatattaaaaataaaattacgttaaaaatactctaaacttatatccaaaactagtaagttttaaaaattaaattatgataatagttgaattatatttgattcattggacaaactataaggctgacataaacgtatccttgatttgtactttattcttttaaaaaaacatgataaacttgaacttaatatgacatagataaatagagatgattttaccggatcccataaatatattgaagccgtggcaagtggcaaatcagcgatacttttacaagctatgtagcgacgtggtttgaaatacaatacaaatgcatccgtttaaataaaaacatgtgctcttacctctataaatacatacctctacgatccctccgagtacaggactgacatgctttattaaaaaatgacacttacacgcactcatgtaagcatgcacacactcatcatatcttaaaattgacgaaatcatctatacatgctcgtataaacacacactcacacccttacgaacgtacgcttgcactttacctctatgagcattagactagtatatcatgagactcatgaaaaacacctatagatgctcttataaacacacactttatttctatgagcatagaccggtatatattgagactcacgaagttaccacgtgctcctcggtgttgacgggtcgccgtctatcattagaagaataatataaatgtgcacacatatattaagtcaatgacttaaatttgggtgggcaagttctaccaccaggaattaaaaataaccaacaaaaatcatatttatattgtttgttgtgttccagaaaaaaataaaaaaaaatgaagaaagcacttatctagtactccctcgttttaatattataagccgtttgaatttttttattaatcaaaattctataaactcggtcaaacaaactcagaaaaaattatatctacactataattcaccaactatctcttattacatactccctccttttctaaatgtttgacaccattgacttttttaaacatgtttgaccgttcgtcttattaaaaacttttgtgatatgtgtaaaactatatgtatacataaaagtatatttaacaataaatcaaatgatagaaaaagaaataataattacttaaatttttaaataagacgaacggtcaaacatttttaaaaaagtcaacggcgttaaatattttgggacggaggaggtagtactttatacttgattcgtagaaaatcgtccaatccgacgctcaagatcgtcgcggaccctctcctcttcccccgcacgcgctccgcacccacacctcgatgggccgcgcgtctcgccccgatcgcctcccctctctctctctctctctctctctcgcacaatcatcgccgccac

SEQ ID NO: 2226 - DNA, 1501 bp, Oryza sativa
  unsure (1)..(1501): unsure at all n locations
acatttgcattgattatcaggtacaaagtactacctccgtttcatattacaaatccgtttcatattataaagaaaaatttagcaacacctaaactgtcaaactagttttattaagtatatcattgaatatattttaataatatatttattttgtgttaaaattattattatatttttctataaacttggtcaaacttaaaaatatttaactaagaaaaaagtcaaacgacttataatatgaaaagaagaatgacttttttaagtcaaactttgtcaagtttgacaacatctaaaatataaaattatttttattaatctaatattgaatatagtttgataatatgtttgttttatgttgaaaatattactatatttttttataaatttagttaaacttaaagaagtttgagcagtaattgctcaaagatgccaattgtagctatactacctccattgtcaaaaagatgaggcgtagaacacgtgtagtcaaataaaaaaaatctgaaaatattaagtaattaatatataaatgcaaaagtatcaggatttatttaaaatgtgaaaattatgagtagacactttcttatgaaaaactctttcttgcatatagactatagatctatagtattttaaatatttttgtaaaatatattgttttgaaatataatgataaaacatgtgtgtattgacgactactatcgatgtatacaatgtcagaataaaaaataacagagacaattatatccctgcaacagcattggctgaatgcctgaatcttcgacgattgggagagaaaaggagctagtatagctgcatcgatcacccactaccaatcgtgacgatctcgatcgatgcttttgaacatataactcaccaatggatgctcgatcgatcataggagagtggattttaaagttacagatctagatatatatgcttctttcacatacgaccaatcgtacgcgttttctgacgatgaattcttctacgcatgcatatgatcaatatcgatccgtatcagcttttccaaaacatgggttctgattgatactccctagctgtagtccctttcaccatcatatcatatcatcagcacgtagtacctgtccttaaactgggcatattcagtggggggcgagatagacagtgagatggaagcctgaaagagacactatatatgcccagctgatagattcacatgtgatacacatttgatattaagcacatctctacttatatttcatagcaatttcttgctacatccaacatgtgcagatcgatgtgctagtataagtactgctacacatatatgtttacattctgctgtatagcttgatctaggagtagctagcagccgctgcatataaatacaaaaatgcatgcatatacagtgtgtgtccttgngtgcgagagcgcgcgtgcgtctcacatatacataaagcatggtttagtgagtgagctcgttagatccagtgttatatacatacagattaatgcacac

SEQ ID NO: 2227 - DNA, 1501 bp, Oryza sativa
tgtattaacctggtatataggtattggatccggtactcataggtatcaaacccgacctaggtatcgaatccggtacttataggtatcaaacccaatacttaggtattagacttggtattcataggtatcatactcggtacctaggtatccgacctagtacgtacaggtatcagaattgatactcataggtatcagatcagatacccgatacccaggtatccgatccgatactcataggtatcatacgagataccggatctggtactcataggtatcaaacctgacctaggtatcgaatccggtactcataggtatcaaacccgatacttaggtatcagacttggtattcataagtatcatactcggtacctgggtattcgacccgttacgcataggtattagaacaaatactcataggtatcagatcagatacccgattcccgagtatccgatctggtactcataggtatcagacgcgatacctagttatcggatccggtacttataggtatcagacccgataactcggcatcagatcttgtatttataggtttcatacttggtacctaggtattcgacccagtacttggatatcagatatgataatctagcatctatatatcacatactagagtttctaagatgtggtataaccaagagcccaacatgacatatctaattagaatacattgtatccatatataatttaggtaattatttgtctggtctaatccatgcatggtataggacacatgcaaatagatgcaacccatcttaaacacatagctaggctactaggctctgccataataagtaccctacatggctagggtacgggactactagtagctattacagggatttgacatgcacagcaagctagtagtactttcggttttatttaatagctaggctagtatcaaaggcaggacaggcatgctgggtattagctagctgtcaggaacaagactatacactgatacacatagcaaacatgcgtgatgataatcctagcagcacgcgacatactcgggagaagccggcacgcggggccgcgtcatgggggataagcggtataccattcaacggtataccgttgtgtagtctttctcttttagtaattagggagtcgagatatcccggtattgtggtttagggatacgaattagattaagcctctagttaagggagtcaaagtgaacttactttacggcagaacactttccggccgagatagcccagtaaggcccatgggccttgtcgtgccggcccagcccggtctatcggttgcaacatgcaaacgttgcgcagcttagccttagcccaacgatgacgacgagatatcagacgtgtacgtgtgtacaaaagcacagcaacaatggcggcgaggtgacgtcactgctcattaaaccaaccaagaccaagtgtatataatgtaagtatgccactgtctcgcgtcgtcactgagctgtggcgttgcgagtgatggcgcggcgaggag

SEQ ID NO: 2228 - DNA, 1501 bp, Oryza sativa
cgtcatgtccgccgccgtctcgcgcggcgagcctgatcatgatcatgtgcagctccagctggccgtgatcaccgggcggagaatgctcgtcgtcgccgggagcaacactgccactacgatcagctcgcagacggcggtggcggcggcgatgccgtactccgagtcgaagaggtcgagccccggggggcccgatcctcagcaccattgattgatcctgtgggaattttgcatgaggctgtccaactccctacgtggaatcaatcaattagtaactactaattaattcactgtgttgttgtgcgcagctaattaaggtggtgtttgggaggggagggacttattttagtccctctcacaaaaacataagtctctcctctagagacttatgcttttgtttagcccctcccacccaaacaccatctaagctaatcgatcgagctgtatggtgtggtgagctattgtataagttgtaattgagccaagttcagttctcatcgagctgcgagcctacgatgtggactatcggtatggttgtggtagtaataaagtttgcaaagatgaccgtggttatattataaccgaattatccttaaatacctttttttaacgaaccagcacaggagtaaatgttacatttacaagaaataaagaactgtaaaaaatggcaaagcctaaggaattaaaagcgcaaggtgttttgctcctgctgagacccaagttttggctttctccttgatttggggccttccactcatgccatagccatcttaccctcagcgctcgtgcaaacttttctaggttgaacacccctagcccttcataagctgttggcatacaagttcttgcccagttggccctgcatttttcgcctgtgatgttatcggcccctgcacaaaggaaccgtttcctctgtttgtcaagcacctcaagggattccttcgtaacttttagagttgtccagagtagacaggttgctgacgtgaggattgacttgactagtgttattcccctccccccctatccctatgtttcttcctcgctagcctactaggtgtcttgcggatttgtcaaaaagtggctggaggtctgccttgtgtagccttgtcatggctagggagagccctaggtatttcattgggaagcttgctctggtcgtcggcgtgctttccaacaagtcgtcgaggtctatgctggcacacctaattggcttcacctgagatttttgtatgttggtgcatagccctgttgcttgtccgaagcattcacagaggccagcgaatgcatctacatcgtccttctttgggttgatgaagaccgttgcgtcgttggtgtacattgagattcagaggcatggtgaccgaccctagccctaagcttgctgagcaaattgaggtatgtggcttcgggcagaaggcatgtagtgggctgattgctagaataaagaaaagcggggataatgggtctccttgccgtagtccacacccatgacatgttttacttc

SEQ ID NO: 2229 - DNA, 1501 bp, Oryza sativa
ctgatgggtgcaatcaaaccctgaagaatcgaaccggacattcacgaagaagaaaaatcaatgcgagatcgcccgagaccgatcattctggtgaaagtacattgcatttacatcacatggatggatggatggatatccatcctgcagagagcctgaaacctgtagctgaaggaggtcgatctacagactacagctgaggctgcaggaccatggttagctgggtgtccggcacacagtggtttcatcacttagaaagttcacagggatgcctgaattgctgactcgataggcatcataacagctgagattaattgtagccatcatcatcatcatcatgccaggacaacccaactaactgttttacatatgtgttcttttaactctttttctttcagcatgttcagatcagtacttcagaccattgtcaacgggagaaacagggaactaatctacatcaacattgtttacacatgtgattgaatgctttgcagagagcagatgctagttgctatctcatttttagaatgtaagctggttcggttttgttataagtcaaactttttaatttaaatttaattaagtctatagaacagacgtaataatattttaacactatatttaataggaaaaattgtaaccataccattataattttgtaaaatttgagatatgacatcctgacccacatgtcattgactcatgtgggttctacatgccattgagataccgatgccatatcttaaactttgaaaaattataatggtatggttccaaattacctatttaataagtgtctgaaggaaacgatggacttaataaaactatttaagtcatgtagatgtcattacatttttcgataaattcagtatgaaaaaaacagaatatcatcttaccttctaaaccggagagaacagtagcagcaaaaacaagatgggccaagctaatgaagtaaagttatacaacgaccaaaggaaaaggattaaaaaaaagacaataattgcttactcctacatggatcatggatgcatgtaggtgactgcatttctgttggaggtttgctgctgctgattgatgacgaagtttgattcaacttcttctccttcttcattcggcagtcaacatatatatcagtcatcagtgcagacggtcggtggatgcaggtagctgtgctgacagtgtgtatagtatgtaggtgagttggatgttttcagggtcactgcaggtggtgctcgttaaggcttaaatcaataattatcgatcgcgtacacgtaaccatcagcttttgcatggcttaacatgcatgatgcattattacgggtataaatgtgtaatcagtacatgtaattagtcaacacggctagtatttagatctttgtttagatcatggaccatctatgattcagctagctaacctttggtgctctggagcagtgtgcgttgctttcagtaaaggtaggcaggatgttgattagtgaaatgtatgtatctgtctatatatact

SEQ ID NO: 2230 - DNA, 1501 bp, Oryza sativa
tgtccaaaaatatatgagattttggtcggatgtgtcccaatctaagctagactcttctgttcagactcgtagtataggatgtgtcacatccgactaattttttttattccccttaaaaaaatcttttgtattctaggatgggtggaattttgctcactttatctactcccaataaatcattccctactttcataaattcctatgcaatagttactccgaaaatacactagtgtataactttgagataagcgaaggaagctactccaagtcataagtacaaatgaacttagtatagaacgaatgatacatactgaaataaagaaccgcaccaagcgatgaatttttttaatttttaattttatttattaaaatatttacagaaataatttttgatttgaaaattttacaaaactagtcgtccatcgccctctgggagagcgattttactaacgtggcagaaagccgatggccctcctgtaacggttggccaccgagggatgggaaatttataggcggcccccttatagccctctgggagggcgactttttactgtgcagggtctgcctgcatagtagaaaatcgtccacccagagagctaaagggggccacctgcaaaatgtcacctcctcccgtacagtacaaaatagccctcctagagggcagtaagggagctgcctgcaaaaatgccaggcagccctcttagctcttttgcaagcggccctctagagcaaaaatcgccctctgggagggcgacaagggggcggcttgcaaaatttcagcgcccttggtggctgaccgttatgacaagccaacagccggctaccacgtcggaaaaacgctctctgggagtgcaatttttcccagaaagcgatgggcgactagttttgtaaaattctcaaaccgaaaattatttctgtaaatattttaataaataaaattaaaaataaaaaaaattcccaagcgatgcatagcatgacccatcagatccattttgttaggcccagatcagaccactccactcgtctacgtaggcctccttggtcacagcggccgcccacttctgcccaaatcgcatgtcccgtccaggttcaccgccacaaaccggccgggtggacgcatccgcactccactccactccactccactccactgcacgccaacgcccaagcccaccaacccaagttgagtcgtggcccccccttcgccctctcctcgggccggtccacttttgcggccgcgcccgcgcaacgcggcctctctcgtgacgcgagcccgattcccccgagccactgcacctgtacccgacgcgcgacgcggcacaatgcccgcctcacctgcacgtacgccatgcctcccacccctccgccgctccgcgcgcccatgtgtccaagattccggaaccgacgacgtacgtcgacgtacgtgagccgccgccatggattcgctgcctatatatacgcacgcgatcgagctgatcgatcagtgtagcgatctacgaga

SEQ ID NO: 2231 - DNA, 1501 bp, Oryza sativa
gaaagagagtggggaagaactaatgaaacgagaaacatggatctggacaatggacacatgattatgtggagaaaaaggtgttgtggcaccgacggtagctccatcgtctacagctcggcggccactccggaagctatcgctggatttgcagcacttggacatgttaatacgcacatttagctcttaaagtatgaaatagaaaactatagttaaatttaaaaagaacccaccctaggccgatctgaccacagctatcgggctgatctgatcggcggcatgtggtcagtcagactagcagagtccgattccaagttcgatttattggttcttggggcttcttgctaagacatgagattttagatttctaattggatatgaaatatatacgggaaagcaagtccaccactcctataaatataagggagcaaagaccgattgaaacaacaaccaatcaatcatcaaaatcaatttaatatcccaaccctctatatcctatatctctctccttttgtttacctatgccaagtctattctcctcaaaccatccaattgtttgtcgtctttcatctctatggtgttagacgacgtcctagccggcatgccgagtctaggacaaaccggtgtgtgttcactttgaagggatccctcccaagtgtttgttcagcagtatctacccgctccctatagcagtgcgcctctaggcgccacgccgcaggttgcacataacatgtgtagcaacacgattctacgtcaattaaatactcgttggtagctggtgtatggagctcgagcttggctaatgcttggtagttacgagagggcaagcactggccacccatggaagaagaaggggaggacgtagacaaaatgggtccaaaaactactgagcagtgaatttatatttgcaaggcaaggaattcttggcagggagagaaaaaaaaaaaaggaaagctaatctggccacgctgatgctgatgtggcactcctttgtatcctcctcgtcagaagttccctaggaacatggacaaactcctgtaccaagttctggtaaaaactataattggattaattgcgtagccatggatatttgatgatgatgggggctgtgggtcctcccgaaccaagttctgttataaaaatgatatgataaggacattcttcatacatggtgctaatgacattcaagaaaaatcaaatagaagtggaaatgtttcttagaattaatattatttcaattaataataatttgcattctatgtgaaatacaacataaacttttatgttggtggtattgcagtatatgcacaagatgacaacactcaaccgaatgtcttgaaatggagatgggtggtttagttactgcctggaagctattatagtaaagagggaagcacaacaccatggccaaggatgatggttcaaatctatgggatttcagaaaaaaaaaaagcaaaggcatattgactatccatggtacatccggaaaataaaaaactttgcc

SEQ ID NO: 2232 - DNA, 1501 bp, Oryza sativa
cgtggaactcttgttttgaggacggttgaaataagtaaagtgattcactaattaatccccaatggtttggaaaatcaagttctccagcaagcaaagaatcgtataaatgtataaaaggggggaaatatatgtggtaaacaccgtcgagtaagtaaaaatttgtgaaaatcatatttaaaaggtttatatataaattaatgaaaaaatacactagagtttggtatagccacaggggcggagctatagtaatagggccggtgtcaggtgacaccgacgactttcgacaaaacgtatagcaaaactgcttatccataagttataacaccatgatctaaccataattagtatactatgacaccgatagacacgttatgacaccaacgaatcaattttctagatccgccactgtatagccatgaaatatatttccatccaatcttaagcctaaaatcaaattcaattttagaaggaactaaagtgacagcctgtacttttcacctaaaatctacgcttttttcagaatttgtaattttttaattcatgttttcatgggttttcatttcattgaaggttataaatgtcatgttcagattgtagccaaaataaccttatcaaagtttggacgagattgacaagattttttatgtttttaccagagttttggtaaaaaaaactaaatagatgtatgtatttagcaattttactaaaaaaaatagtatagtttgaaatgaaatcaatctaacaatcctaaaagcccttcctcacatgattaggcagtcaccagctagctaccgctgcttgcagtaggtcgtcttgcgttgctactgtactgattacatcatttgactaggtcgttgcacgcgtcagccggtagtccggacagaatttcagtagcatcattggtgcatatgccaaccgtcgagaatgtcagggatgatcagccaacgtggcaaatatgctaatttgtgttagtaaactaataaaaagtacatggacaactaaccggacttcatactactagcaagtagtgtatatatcagtcttttgctaatacaatattctcggtcaacatgctgcatatcgacatcgtacagtctttacatacataatatccatggcaccagtttggcactctagaagaggccatattaaagcatatgcatccatgtacagctagaaaacaacatagattcacatggcaccattccaattccttgctaatagatacactgacaaagtggctttatccaaagcaaaaatccgttcaaaaccatggattatcctgatacaaccattaattcatgccttaatatataaggttttgtacatgtttcatttgagtaggacaacaatttggaaatgtttataccggaaaagaaccattcaaatgtgaattatttcacatgctactcatgctgagggtggtatatatatgtattggcagtgtgcactgaaatactcatccatgcatgcaaagaaagcctgaaactcccaagaaata

SEQ ID NO: 2233 - DNA, 1501 bp, Oryza sativa
gctatacgtacactcacaaaatttgagacgtatttcctctctcctaaaaatactcaattgaggtggtgtttaaaattcatatagataaagataaaaattaagtgttttacgtaaaatgaggtgatattaatgtataattaattgagttttaataattacaaacttgaaaattatatttatttgatatttgatagtttgaaaagcatactatgaatatctaaattttcattcaactttttgttggagaaaagaatctgaacggtcatatttccttttacgttgagttttttctggacggaggaagtaactaaatggtgacattaatcatgagcaccacaaaatgttccttttttttttatgattgaaacacaggaaactctctaagaataatttcgtttctacaggaaactaaagctatctagatgacacgtcttaacatatataaaatctagaaaaatattaccgtcgcttctttaggtgagctgtgaattttttcttcattagtatgtcacgcatacacagtcggaaacaaccgtgacacggtgatggatagggtgttaataaatacttcgtcctaatatataacaacctagtataggatagttgctatatattgggaccgagggagtatgacgttaaccgcttgattattgttattataatcgagcccgtacaaattaagaaaccactcgataaaccggctatatagaaaaatcaaactgaaatttattttttttcataaaattgtccaaatttaattgtttgttgggcaactgagcggtaatcataattatcgacaaaaccgctagagagcagagtgactcggactgaacaatttttctcgagcgcgcaaaaggattgcacgtcaatatattaggagaatagaatatttgttaaatgacgcaatcagtcagactcggactgaacaattgtaaactagacaccattaacagggaaatttaccttttctattttaaaaaaactgtccaaatttaattggttttaaccgaacaaaaatcatgattatggacaaaaccactcgggagcaaggtgacttcctctttaacgattttgtaaaccttgtacactattgacagtttgacactgatgtgacgctccgtaaaaatggtttactacttttaaaacgatttttacatggctattttcaaagtaggactaaatgttttttttttaaaaaaaatggagaaaacacaatgagatgactgaattcacactgctaccgatcactgtcatcgtcgccgtggacatccctgtcagtttgtcactgcactcatcatacttaatcgccattacccccaagcaattccaacctaatcacaaagcaaccaaaccaatcatctcatctcatgatctcatatgcactataaataatcgctcaattcaacggagccaaacccacacaagaaatctcacccaaaaaaaaaaaaccaaccaatcaaaaaccaaaccatggcgcgccaccgccaccgcctcgccgccg

SEQ ID NO: 2234 - DNA, 1501 bp, Oryza sativa
tgtcaaaatgaattccagtgttaatttgtttctgataatcacaagtcatgcgaaatatgtatgcaagcggtatataggattgggaccctaatattgttactccatgcgtggtcttcttggcatcttatctatgaaatacttcattactttggcacgcatgctattcttttgacttcatctctacatacatatttggtgctctaaatgacatcaaataaaaacgtcattaactacaaatttcatatttagcgctctaaatcagtgcctcctctcttgctttttgtactttgcattgatgctgtcatattgagtaacttggtgatctatttgtacatgcttatatcttgttgatcaccttctagctctagtatataagtagtgtgcaaagtactctatctataggttttattttttctatgcagggtcggattgtcctatcattgttagagtgtcaaacacttagtgttgtcggactgtccagcaccgaggtggacagtacgagcctatatttccactaggcgagttcatgtttttctctgtgttgatcggattgtccagtagctgccgggttgtccgcttctgtgtgttgttggactgtctgcagtggtaccggattgtccggttgttctaatttccattgcatgtttatgtaattgcaggaaacgcctgttcatcatcctatgggccatatccatggtcctcagtgcactttcatttcatttaagagcttttcaagaactccaatagatctttcacgacctgcgaaatcgtttttatagaagtgttgcgtgggagatttggctccccaaatggattccgaggtgttgcttcccagtgtaaagtaatgtggtacaagggtttgattttgttaccttaccgtttaatcccaattagcactaaataacttatatttttatttttaaatagttattgacccgtgtattgcaacagtatttttatagacgggaaggatttatttttttctttttttttaattctgtagtttcgtggatgcgaaagatttgggcgaagtaggttatttggtttactctatacagtcgtagattttttttttgggaaattgtttttttagttggacggtttttataagttgggagaggttttcacgtatggaaaatgagagggggagtggccagacaaaagaccccatttatgtagtagagagctataactgaacttgagatatgtcgaaactactcccgagtatagcaaactgctataaatacaaatctttgtagtagaattacccctacattttggtttctctgagtcgatcagcatatggagataaaatatgacctcaactatcgttgattacgctatatgtaatttcaagaatttcgggaatttgaggcactaggaactgcaatgagtttagtttcaaaatgttgttataggtttagccaaaccgcaacacctcggggctgaaattaagacaggaggatagccatgccatttcgggtctttgggatgagagagt

SEQ ID NO: 2235 - DNA, 1501 bp, Oryza sativa
atagaatctacatgattttaaaaaacatgattttagtagatcatattatcggcagaagttgggggttgtcccatctcgccttttttaacctcttttctattcacttctggactttttggatgtgtgcctacgggcagaggctggagatgtaacccatttccattatctaaaaaaattaacatcatgcaattcttcgactttgataatccaagtatatgagaaagtcactgatcattggaaaaacccaaatgagaagcaatgtccttagattacagaatgctctgttctgtaataatttctcttcgatttgctgagaaatagcctcatttcaaatgtaaattttctcatgcacggacacgatgggtaggttctgatcaacttccagagttccatgtaggaggaggggctaacttttctttttaatgctgtttctctctccatttgtttcggaaataataaaataatggtatcgttgtcctctagcaaattatcaagtttttagaatatccacgagccgtatcatattttttggatgtctagcagtaaagacaacaaacattaaacattaagtatcctatgataaattttgcctatctattaaccctcaaatcccccaaactccctcgtctctcgtctctatgatattttaggacatcccctatatcgatcctaggataaaccggtttcacactaatggggtttctcccaagtgatcgttcaacggcgtctgcccctatatggcgatgaatctccgggtgccaccacaggttgaaagaatgaaaggtgctccaatgtgtattggcatggaaccaattttcggtgtcaatagtatgtatatagaattttgcacatgcacaatttaacgtgttccattgaaatttacttagaaattgcttctaggtaggtgcatgcatatttgtttaatccctatcaagaggagatgttgcacgacatttcattgctccaacatttggtttggctggtcttgaaatgcaacaaaaatgttggacaagacaatgtactgtccacaactggcaggaccggccggctggccctatgtcctatggatccatgttactactactcccatcagcatgaagccatgaacagctagatcgatcaaggagggctgtagcatcatttgcactacgacgaattgagctctacattttcgaatggttctcgatggctcatcaaattcatttctttccatgctctgccttcccaagatgccaaagtgacttggagatcctcctaattaagactattgcatgcgtggtctgctactgtggttgcacgcaaaatggatagaattcgacctcacgttgctgttcagttcctagagcctccaattcccaagactcatcatcatgtatggaggcttttaggatatgaattttcactgagcttgtgatagttgaggtccttcatagtttcactctttctctccatatatgctgctacacagttcggccaaaaaaaattaataataggtaccagt

SEQ ID NO: 2236 - DNA, 1501 bp, Oryza sativa
gctgaacttccacaagccgcgcaaggagaaccggtgtcgtccttccttaaattggtgttatgcatcgccctaacactaacctctccctctatagataccgccggtcgtcgccccttttcctccccttttttcctgctatttccactgtcgccgtgccaccgacttcgcctctgcctcctcctaccgacaccgcagctagccagtgcctcggtgcgccgtcgccacagaacgatgttgtcaatgccgttgtgccggagcgtgcccatggagccatggctgctcttcctcctccgttgtgtagctgatctgtgggtcccgcgacaaaaaatccccaaataatcacagccatccaaacccttgattcaatctcaaccattggatctatttaaccctagatccatccctgtcagcgccacatcattgccctgtatcacctcatgtccatacgcatcagctgagtccacatacaccgagtccaccatactccataacactgtcagtgggccccacacatattttcttgtcagaaaaaattcaatccccgaaattaagtatccaaagaatattcccggaatattacttttttcttttaccctcagattttctctgaattcaaacttctgaaggctataaattttccattcgaactctgattcaatccattcttccaccttaagtcctctaaaatcgagctctacgtcctggtttaatttgttgtttcattttatgttctttagttagatttttcttttgtttatttgtttttcgtttgcgatcgtatagacattggagcagaagagcagtttgtttcagaagatgtcgtgcaagactgggatcaacgcaagtgcactctttgaacatattgatcccatttttatcaattgttttgttttgaatacatgcattattttatttacgaactaatgatgggtagcgtaacctaattttcattatatcctaccttgataacttttgattacccatgataccttgtcaccctagtctttgtgagttgaacattaggctcaacaggatgcaatgtcgtacaccccgtaaaatagtgaatgctgtacaattggaaactttttttttcttgttgtgcattagcttaaattgattaacgtaaattattattactccgttatgctctatagatagtagcaatatgaaataactgcatacatatatttgtattaactactcaattatagttgtctcatttatttctttcagaggataccatgaaatgcaaccctacaaaagcatagtgctaccaatgatatatatgtttgggcttcaaggatagaaactatatcaaggcggcaatatattactatttattcgctcttacagttttataacatcggattgggaaaaccatttcatgaaaaaaagtttcctgcacatggagaccaaggtgttgccctcaagtatattaggaacccaaccgccgctttattggatttaggagttggttccattgtgcaacatgtgtgctagt

SEQ ID NO: 2237 - DNA, 1501 bp, Oryza sativa; identical to SEQ ID NO: 2234

SEQ ID NO: 2238 - DNA, 1501 bp, Oryza sativa
atgaaacatgtacaaaaccttatatattaaggcatgaattaatggttgtatcaggataatccatggttttgaacggatttttgctttggataaagccactttgtcagtgtatctattagcaaggaattggaatggtgccatgtgaatctatgttgttttctagctgtacatggatgcatatgctttaatatggcctcttctagagtgccaaactggtgccatggatattatgtatgtaaagactgtacgatgtcgatatgcagcatgttgaccgagaatattgtattagcaaaagactgatatatacactacttgctagtagtatgaagtccggttagttgtccatgtactttttattagtttactaacacaaattagcatatttgccacgttggctgatcatccctgacattctcgacggttggcatatgcaccaatgatgctactgaaattctgtccggactaccggctgacgcgtgcaacgacctagtcaaatgatgtaatcagtacagtagcaacgcaagacgacctactgcaagcagcggtagctagctggtgactgcctaatcatgtgaggaagggcttttaggattgttagattgatttcatttcaaactatactattttttttagtaaaattgctaaatacatacatctatttagttttttttaccaaaactctggtaaaaacataaaaaatcttgtcaatctcgtccaaactttgataaggttattttggctacaatctgaacatgacatttataaccttcaatgaaatgaaaacccatgaaaacatgaattaaaaaattacaaattctgaaaaaagcgtagattttaggtgaaaagtacaggctgtcactttagttccttctaaaattgaatttgattttaggcttaagattggatggaaatatatttcatggctatacagtggcggatctagaaaattgattcgttggtgtcataacgtgtctatcggtgtcatagtatactaattatggttagatcatggtgttataacttatggataagcagttttgctatacgttttgtcgaaagtcgtcggtgtcacctgacaccggccctattactatagctccgcccctgtggctataccaaactctagtgtattttttcattaatttatatataaaccttttaaatatgattttcacaaatttttacttactcgacggtgtttaccacatatatttccccccttttatacatttatacgattctttgcttgctggagaacttgattttccaaaccattggggattaattagtgaatcactttacttatttcaaccgtcctcaaaacaagagttccacgggttcagaaacctctggttgtccgaaattccccactgctgccacccgtatcatttaaggtgtcattttatcaaaggtagtcaccctagcaacagataatgccaatactttatcatcatgaacacataagaaagttcaggcaaccgttcgtatccacgtgcttagt

SEQ ID NO: 2239 - DNA, 1501 bp, Oryza sativa
tacctttgataaaatgacaccttaaatgatacgggtggcagcagtggggaatttcggacaaccagaggtttctgaacccgtggaactcttgttttgaggacggttgaaataagtaaagtgattcactaattaatccccaatggtttggaaaatcaagttctccagcaagcaaagaatcgtataaatgtataaaaggggggaaatatatgtggtaaacaccgtcgagtaagtaaaaatttgtgaaaatcatatttaaaaggtttatatataaattaatgaaaaaatacactagagtttggtatagccacaggggcggagctatagtaatagggccggtgtcaggtgacaccgacgactttcgacaaaacgtatagcaaaactgcttatccataagttataacaccatgatctaaccataattagtatactatgacaccgatagacacgttatgacaccaacgaatcaattttctagatccgccactgtatagccatgaaatatatttccatccaatcttaagcctaaaatcaaattcaattttagaaggaactaaagtgacagcctgtacttttcacctaaaatctacgcttttttcagaatttgtaattttttaattcatgttttcatgggttttcatttcattgaaggttataaatgtcatgttcagattgtagccaaaataaccttatcaaagtttggacgagattgacaagattttttatgtttttaccagagttttggtaaaaaaaactaaatagatgtatgtatttagcaattttactaaaaaaaatagtatagtttgaaatgaaatcaatctaacaatcctaaaagcccttcctcacatgattaggcagtcaccagctagctaccgctgcttgcagtaggtcgtcttgcgttgctactgtactgattacatcatttgactaggtcgttgcacgcgtcagccggtagtccggacagaatttcagtagcatcattggtgcatatgccaaccgtcgagaatgtcagggatgatcagccaacgtggcaaatatgctaatttgtgttagtaaactaataaaaagtacatggacaactaaccggacttcatactactagcaagtagtgtatatatcagtcttttgctaatacaatattctcggtcaacatgctgcatatcgacatcgtacagtctttacatacataatatccatggcaccagtttggcactctagaagaggccatattaaagcatatgcatccatgtacagctagaaaacaacatagattcacatggcaccattccaattccttgctaatagatacactgacaaagtggctttatccaaagcaaaaatccgttcaaaaccatggattatcctgatacaaccattaattcatgccttaatatataaggttttgtacatgtttcatttgagtaggacaacaatttggaaatgtttataccggaaaagaaccattcaaatgtgaattatttcacatgctactcatgctgagggt

SEQ ID NO: 2240 - DNA, 1501 bp, Oryza sativa; identical to SEQ ID NO: 2231

SEQ ID NO: 2241 - DNA, 1501 bp, Oryza sativa
tataacatgaacataatgtaaagaaggtattcatatactcggaaagtatttcaataccataaatgtatatagaaaagtattctaaataaagtacaaagcttaccaaagaggaaaggaaagccactagagccatacctaatttctactatattcctattccactagcttaagaatactaaactaacttgagagaatatgagagagctcttgcttgaggtgtgtgttgaagtgaagagagtgaactccttggggatggtcggtggcagttggaatggtcagaattgctctccaaccgtcattggggagtgatccacgccatccagaagaaaccctgcatccaacggtgctagggggttcggccgaattcggtaggtggcctcctccattacttcacttcttagacttgtgaattttggcccaattcattatgtcaattctgagttcttggcccattcatgcataagtttgattctcgacatcgtccgattgatttatcgtatgtgctgatgtcgattctcctccactttatggttattctctgcaaaaggttagtacacccaatactagtggaatattattattctaacttgtatatgtattgcaagcataactagttctcctctattttggtaatattgacggtcgcaactgatcgataatgaccgtcaacacttgcccttgtagaaagcatgcttaagtggaccttctagtttgtttcttactatatcacttaagtttctatccttgtgttaaccagattgtcctggagcaattggacaatcgggtcacttatcatttttcctatcgttgcactaatcggattgtcctacagcagtcgaactatccaactcatctatagttggactaccggaagttgtgtcggtttgtctagttagttctaatctcgctgcaagttttgaaatatcacaaagcacccgttcacccctcctctaggcaaaattaacgattctcaagaccctttcaatatggccatctatttatataaaataccctaaatctaagagataaactaacccattccaatggaaaaatcctcttaagatagagacatgccaaccataacataactcttgttcactttaggacagagcggctcatcaccaactttgtcaaataggaaacccggaaactctaggagaagaggggaaagaagaagggcatacccaagatctaaggagagagggatagagcggtaggggtagaccgaataaggaggaccggtgagagcatctcgctggaggaggctcggtggcatcgtctgctcgcaatcgcgagatggagaagcggtggcgcaatgtatcgagctagaggaaattttcttgacctcacgattctgtgcggattgggccataaaattcccaccttgtaggcttccaaatggacaagaagatttggcccgttgaattttctcccgctggccttcctcccggggattgggctacaaaaggagccataagcgatctcgctagcccaaaatatg

SEQ ID NO: 2242 - DNA, 1501 bp, Oryza sativa
tcagagatcgtggccgtccatcagaatcggacggctacactgacgggccatgattggttaatgggctatgcttgcctcaagggccgcccaatcacaggctagctctggcctctgggtcgtgactggtcttcgggccaaattacttttcccttattatcgggccgaattagtgatttttcctttacataaatgcattttaatccgtttaagccattatttgatgccataaagttgcattataaactttcttatgcaatgaagatcatgtgtagctaaatggaactaacaagaaattcagctagaaatttaatttattgatactaatgttaattttgctttattttggttcaacagtattatgaggtagaattttatgattatatgatttcgatgacattttgatacttagctttatttcttgccccatggtgtgataaaattataacgttatgaaattatgcgcgttaactgttagttcatgttttgatattttatttcgtattgtcttatcgtactatgggaatagaattttatttacgtgcacaattatgtattttatttctcaaaaaaaattatgtatattattttaatcatgtcatatcacaatattttggccaagtggaggaaggtaggaggcagtggactgggctagggctaaaaagtaaaaagaatgagctttcggcccaaaaccaaggatgaattttgattaactttttcaattataatgtatgtagggatcccaatattacaggaagaaaaccctttacctatcgattttgctatatatttgtcgacaaatttttccccaaaaatttgacagatgtaattacagtataatcgtagtgtaattacactgtaacttgcatgtaattatactgtaactatagtataacttgtatgtaactttcaaaaatctctccgtaacatgttatttcggtaaaatggaggtcgtgggaacaaattatttcacatatgtgtgtgctatgatttattttcttcctcaccaaaacaaatcttgtaatagatctaacgattcaaaattatgtgtagttacatgcaagttacagtgtaattacatataagttacagtgtaattacactataattgtactataattatatctgttaaatttttggggaaaaatttgtcgacaaatgtatatgtagtctcatgcgagtacttttctaagattaaactggtaatagctaaaaagttaagattaatttcatttattcaacacaagaaaggaaaaaaaacgtgtagaagccatcgtctctctcttccctagcaacaacaactcattcctcgcttgctggctgctgctccgtcgcctttcccatctccaaccaccactccactccacctcctcctcctccgccgctgccgccgcgcagatccgcgggcaaggggctacggtgcggcggcgccgccctgcacccccacgccgccctccgcaccgcgcgcgcatccagcagtcggaagagttggaggaggagggga

SEQ ID NO: 2243 - DNA, 1501 bp, Oryza sativa
atgaatacggtatatcctcaagtatatgggaatgttacgttagttttaaggaattcggccaatgcgtaaggaaactaacccccaaataaagggtgttagagtcctattcagagaggatgcaaattatgtgatctcgcgggtagaagattctccccgagttctacttggaagccaaggcaattcggcatataaatacatggtgtccatgggatatgggatcatcgaatcatagaatagccaccaaccatagcagaggcaatccggaggactcgaagccaattcgccggttcgatcttgttgagacgttctcgacaggggtcaggtcggtaactcttcagtttatattgttctctattgtaatctctgtggtttccgtataattcatataaactggattagcactgttaccttgcgaggggcctgaactagtataatccttatctttgtgtgcttgatgtcgtttcgtgttgactcttgttacaatgtaccccaataccctcaaaacatggtctatgattataacccatcgacagtggcacgctaggtagggggacttggtgctcaaggtctcgctgagatggcttcaagctcaagaccttctaacaatgatagctaaaattgtcttggcctgggagatcctacccagccggcgtttgcatggactcaagtcgaatccttctgctttcccatcttcgccgcaactccaatcttgccttccctaataccagtcgggatcgagatcgccgccacgaggatgacggaaaataaccctcaaccgtctcctcctcctgtccaattagaaaagaaggcgctgatgacttcagcttctcggggaactcctaaggtggccaaacccccgaacatctgttaaggatcacgtgccaacaaggaaatcttcgcccaatcaccacacctggtgcttgatccgcaaggcgtctcaacactctctggtcgagtgtggggtgatacttaatgtgaaggctgaacttgatgcttgtaaagatcgagctatccagcacacatctccatacaaggcatggtgcccgatccacaaatcgaaaagttacccccttaccggtagggatggcagtcgggcacgacgggcacgagtagtgactacccatacccgtgcccgcgaggtaattcatgcccgcgggcatacccattattacatgacgggcaaggaacactacccatgcccgttgcccgcgggcgccatgtgcctgcgggcatgcccgtttactcgtcacaaactcacagttgaacatttcaaccacaaatctccacaagcagagagacattatcacaatttaaagaaatggtacagttgtaccaagttcaacaatacaagcattacatgttcatcaatactagatggtggtatttatactaatttgactgagggaccacatgtcagttggtttttgcgggtaaacgaacgaagcgggcatgggtagtgactacccatgtctgtgcctatatgcccgttgggtataggttt

SEQ ID NO: 2244 - DNA, 1501 bp, Oryza sativa
ggtggtaaaaaaagatggcgagtattcgtcggctagtgatttcgatgaagatacacttgctttgcttgcagctgaccacttatacttggcattatatttgcttacaggagatcaccatataaatggaggagaaatggtggaaaacacccgttcaatcagccagaggttaacaagtggcgaataaatgtacggaagggcacacaaacccaatgaaactcggccgaccgaggcccagcccagttggcccagaaattctccaggttggtaattaccgacctccaatgatggttgttaccatttcctgcgctccaaccatcattaggaggacatttgacaagaggggaagaaatatgccctttggattccatggagcatctctatccttccaagcaacctcgccctataaatactcctcttctccttcattcacaacacaccaagaaggaataaaaagaagaagatctccttagtggtttatattttgttcaagtgctagtggagttagaaatagaatagctcttgagttcttcaagtcttccggagaattcagatatggttctagtagcttctatccctcttgtaagactttattctataatgaaatattcttctttatatagttttggtcctttactttatttgcaccattattcgagtaccacctttggtttatacttgcttagtattagttatatggctagcttactggagatatgtagtggtattggcttagtgttcattcgtatgattgctttatgtcatctgcagagatatagagtaatatttagtaatgtaagcgcggtgcttagattattgaatatcatgaagtggtactatatgccacgaaactgtaaagataggccgctggtggtgacagcccagtatgggtattcctccacgtgcgtatatagggctaagtaaggttcctggtgcaggtactccttatctataactggttggatggtcatgccggattgtcgtaaagaactcgacaatcaagggtggtttctcgatatactaagagggcatagttagggagttatagccatatagttgtacactagcaagtgtatactaaaatgattatatactagaagtatggaaatgaggcttttctttactcctctccatgtagcctagatttattatttagtgagagtattcttatattgttccttctgtgtgtcaacctaccatttaccttatagactttgatctacataagtgtgatgcgtattaataacaaagtattctcttaccatatcttcccttgggattaaagaaatacgataccttggaatactcccaggtgaaatgctacaacgtatatctgtgcgcttgcggatttacatctgtaaccataagaaataccgaataatgtttcaggcgccattgctaggaattatattactagttatgtcgttaagaaatatcaacatagaccttggcaatctgtcggtctatgttgatgttgctaaagctgccaaatccaaaagtgaga

SEQ ID NO: 2245 - DNA, 1501 bp, Oryza sativa
ttcaaattatttctcgagctccgaaaattcgcgggaaatttcagagagtattttaaggcacaaagaatattacaaaatattctcggccaataatttttaaaggaaatttttaattccctcaataattcacttgattaaattgctttaaattttatttaatttctagaaaatacattatttaatgatttttaatcccgaacaaaaatcggggcgttacataggtgctaaatttgggtgtaaacagctgtcacattgaatgtttgaacacatgcatggagtattaaatgtaggaaaaaaaacctaattacacagaattgcatataaattgcgagacgaatcttttaaatctaattgcggcatgatttgacaatgtggtgctacagtaacatttgctaatgacggattaattaggcttaataaattcgtctcgcagtttcctgatgaaatctttaatttgttttattattagattacgtttaatactttaaatgtgtgtctgtatatcttatgtgacaaccaaacccaaaaattttccccaactaagggcctgttcactttgatgtcatttttaaccttaccaagttttagtaaagttaccaaaaaaaaagtggttacatttagtttgctgccaaattttgataactatataagaaatcctgctaaaattttggcaagttaccaaaatttaatatttttttggcatcaaagtgaacatgcctaaaccgatgttcaacttttgcaaaaaaaaaaaaaaacccttcatcatcagagaagtttattcaaaacacccctatactttccgaaaatataaggacaaatcaagtttcgcaagactatgatctaaaaacgtgagagaacgaggtcgttctcgcgaaaaaggcaaacactccaccacgtctccagtctccaccactcccagtttaccggctctcctctcctctcacgcccctcctcctttcattccccatcctcctctgtctctctctctctcgctccctccctcccgcgcgtgccgccgccgccgccgccgccaccgcccgcccccctcgtccgccgcgcgcgcgtgccgacgaggagttctcctcactccctttcagcccctcccaatccgagaagcagggtatgtatgcacatgtgctctcctcttcctccctatgtttttttctcgatctatttctgtcggggggtttgatttagttagggatggcgctccatcgtacctgcttgctagttgctatcgtgttgggaggtgaggtgatgttatcgtgttggtcatcgtcagcgctgcgcctccccaagtttttaatttaggttcccttttgaagaggtgttgaggatcattacatctaaacataccattagtataattacatcgcaacccagtagtattagaaagggtatgtataacccacataatttttgcaactacaagatgtttcttaagagtgatcaatgagcaacattagttttttacaacatacacctttgtcatctcgcagat

SEQ ID NO: 2246 - DNA, 1501 bp, Oryza sativa
acggagtcagaatcttctatttttttcctttttttcgcccctactttttctggatcggacatattttttttcttttttttggccggttttttcccttctttcgcctttttggatcggacaggtttggttttttttttcgctcgcagatttttttcgtttgtttcgtctgtttttttatcggacagagtctttttttttctttttttgcccggtttttttcacacggttttttttcccacggtttttttgacggacgatagaagcacctcttattttttaagtagtagagatttaatgttctataatataacgcgtttattatgtatatatagaattaactagtagcaccttcatgtttaattcattttttaattctctaccctaaaaatatttaatcttattgagtgcatgcattttactctatcatttattatgtaagtcatcttgactttttaaaatcaaacttctttagatttaactaagtttatagaaaaagatagtaatatctacaacatcaaattagtttcattaaatataacattgaatatattttgatactatgtttgttttatgttgaaaatgttcctatattttttataaacttttccaaacataaaacaaaattggctaagaaagaagtcaaagcgacttatggataatttattagagccaaaaaatgagaaggttataatattttttttcattgcgttactagttgttgtgccttatatttttggttgaagagaatattattgtatttttcttctaaaaatatattgctttactactaatctacaagctacatataatatccatccaatacaaaaggttaaaaaaaatccaccttggccatctccctgaaataagcacgatctgttgagcatatgtttgaaaacaatttttgcttgtttaacttattcaatctaaaatgtgacattccattgtaatatatgatttgtgaaacaaaagctcgacaaattgtgcatgcctatcttagaatcgtttactgatcatctttccttgtccctactttatatgagtaagaagcaagattcttttgttttccctaaaaaaaagaaatacatttgttattgtcatgtattatttgaatacaagcatcatgtgaatatttccttttaggaaaaaaatggttatacaacattaagagctcccatttctaattttgtagcaccaaaagttatctccactctttaatttagcattccatccaaacctctatttgttttcttttctttttattatcttcctgacaaaatatgatataaacactaccgctaccttcttttttcttcctttagtcctttatctctaagggcaagagcaatgcttaccccctccgtccaaaaaaaaaaatcaaacccagggacatactagtatgtctttggtggaaataaggtgggtcccaccacaccctctgactatggtcacaatgcttaagacataaagtgatggtaagttggtcccacaactatgtaaaaaa

SEQ ID NO: 2247 - DNA, 1501 bp, Oryza sativa
taggcttaaaagattcgtctcacaaatttatcgcaatatgtgcaattagttatctttttagcctatatttaatacttcatgcagatatttaaatgttcgagttcgacttgacagggtgtaaaattttggggtgggatctaaacagggccttagttttatgccagtaaaatttgtaacaaaaaattcacacatttgaaatgatcccttcaatacttccctcatcacttacaattttaataatttttttaaagttatgctgaatacctaaaatagatattattgtatattggcttacaaatttatatctaaaggaaaaaatgtagcaagtgaagaaattcaaccacctttttcagtcctttgtcagttcaaaattaccttcagaacccaaccaggacgtacctatgtatttgactccaacctgtctgataactaaaaaaaaaatgtcctagactccatgatgtaaaatttgctaggttaaattagaccagattttattttaagaattgcatgtaacattttctttttttaaattattcttaccttaatttttcctatctaatatttaatctgcattaattttgcttgtaaaattttcttgatggctaacattagttttttgttcttttgcctgtcattctcctcttacatgcagcgcaggacttgcccgtccagtagggcacccaagacccagcacgcgcgcccaacgtcattcgtccggtcgtcgcacgtcctttgcagccgctaattttcctccctcctattgggctgtgacatatatatatatctaaaagtctattttacctccctcttcttgggctgtggtatataaatagctaaaataagtctatttaaggtccctattctttggacaattacatttatatgtctattttagtccctatactttatgtgccgggcctagcctgccggcccatcgtgccgggccggccggtcgggccagcgtgccggtggggaggcccagacacggcccggcagtcgggccatgccgtgccgtgcttgggccgggccaaaaagccgtgccatgggccgggccttcgggcctcgggccttatggccatctataattgagagcgattttttttttctgtggaaatctaccaatccagaagcttatccacaaatcatcaatttaacatgcatcatatatggttcggcaccattcagattcgccagtggaaactgattctatgtacgcctactaacttcaaaatcttcttattttcataggcaacctgtccagctgttttcgataacagaggtacatggcgatgtggttatgtttgtagctttcttgggagttctgaacaaaccatttgtaacacattagcaggtgattacatggcttgttttcccacagaaattacagttttgttgttaaggggcaatacccgaattcttggaggatcattgtttccatttcatttcgttcaaaagaaatttgtttccatttcatcatctggtagactggtatgttcatagt

SEQ ID NO: 2248 - DNA, 1501 bp, Oryza sativa
tcaaactttcctacacacgtaagtttctaacttttttctttaaacttctaattttggcgtgaaactaaacacagcccaacttgaatcgtaggcaattccaaaacgcacaaatctttcgagttgttatgaagcctcaaagaaaaatattaactgcaagatttgggagtgacaaagttaatttcaagcagttgaacgtcgtgttagaaatcgtccaaaattctgatggtgtttaggtaattcaatgggattcctattagttcatttctttgttcgaaatgaccacatgagaaaatttcccatatactaattcgtatcctatgaaattctttaaaaatcctaaattccaaataaacctctgaattcttctcactaccctcagttactgtgattttcctgtcatttactcatttacattaacattggttgtctctctcaatttacagaaccaattttgctttgccccattttctcatctctcccttgccacatcatcaatatcaccaactcttgttgtctgatgaaagctacttcttctgcataacacccatgaactaaatcctgcatacctctgctcattaaaaccgctgccattgttgctacacacatgaatgtacaaacaacaacatccccaaattcaattttggcatcgcaaatctgtcttggtcccatctgatctgacacacccagcccaagaaccatccacacaaacccaagagactactcctaccaaagatcaccagggaagaatcccagaaggccatatgagaattagaattaagacacaagggcatatgttggcagtacggccatgaaatgtcattgtcctgtatatatatgagagagagagagaaatggggggccctcagtaattaaggtagcaaaggctacacattttgtgccgcacaagatgccgcaggaggtcactggctgctacagtggatcaggtagatccgtggattatacaacggtgacgccgcatctgctgcctgattatcagtgagtggccgggacgcctgtgtctccggccaaaagcgtccccccccccccccccccggattctctctgtccctatgcttacctcgcacgcatccaagcgcagtccatgaccgcgaaaaaaaagaaaagaatcatccaaatagtcgtgaaaaattctgaaaatgatctcgattgcgtgtttgttctccgtggagtaaggaatttcactcgtaagacgagtgttgttttcggtaatattcaaatagttatgaaaaaaaaaatcagagaggataacatattaccatataagcttagtttttgtgtagtaagaaattttgctcctaagtaagtcgagttgcgcaattcggattcgggtactaaactggggaggagggggggggggtggagctcaggtgttgagctgtacatcgacggatgttagcgtgtcactgttgctccaacttgctgtcctccagggtggtgtgccagaattttgacaaatcacaagtggagatcccacttgggt

SEQ ID NO: 2249 - DNA, 1501 bp, Oryza sativa
aatctgcattaacaagtcatttaaccactctccataagttgtagcaaggcaacagatacacgaggggaggccatttcaatatacaggtttaatgggcttggaccttactgttttatttcctgaaggaaataatttcactttaggtccctcatcttgacgtcgagtttaaaattcacctctgaactgcaataccaggcataccccaacttacaaaaccggtatcccctgaaaaacaagacgcgggacttaaaatgaacttattcctttcctgaaatgatgatcaagtccattgaacttatggccttttggcccattaccaagagaggtaatcccaaaacccaaacggtttagcccacggtggtgagtgagaagagattttctttgataatggaatagaatattccggcctttgctcaacgaactacaaccaattattatagagtagcacacaaaataaaaagcttctcacacaaaaaagaagacacctaccaacgcaagataaggagtacacaattattaaattctgtttgtgaatctccatcaaaaattggtaaacagttgcataaccgttgcctcaagattacgacatgcaacttttaaacgctcgccctcttcatcacacttttgtagcagtgcccaagacctgagccaatgtattgccctgaaaattactttgccctatggtgacgaaattaaacaaaattgtactatgcatacaaaacagtgaggaagaaaattgctggatgaagtgtcctattttttttccaagcgaagtgttataaccttgtcctatttttttccaagcgaagtgttataaccttgtatgaaaaagtgaacccaaatctttcagttagcaaatgggcttgtttggcagtgctgctttgcagctagctgcaacagtagctgggttgtacctacagtaaaactggagaaaattttccatgtttgctgcagctgcaaagcagccacaacaatctctgctgaaaaccccaatgatacgactcagagaagcaggtcgataagtagaatttacttgacgaagaattcctctgagctgggtatcttttatctcttgaatttgtaattgggtggctcatgaaatggtagtattagggaacaaatatgcaattgatggcgattttgtaatgcatggtgagcctgcttgtcttcatgaattggtagccaacgatttatcaaataaaaagggaaaaagataagtctgaattaccttctgaaatatcgaggttatctgaggaatccataaattacagcaccagatatttcactgtccatagcttttcataccagaatatcttaaatgtattatactacattcgtcccaaaataagtttatttttcaccaatcacacattctaatacaaaagcaaaaggacaaactaaaatactcatactttatgaaaccctaatgaaactattcattagagcaggtacaatagcaggctattagctagccataaacatattttaatgatataaacga

SEQ ID NO: 2250 - DNA, 1501 bp, Oryza sativa
gcgacggcaacggcgaaggaaagctcgggaagaacaaatccgagacgaactcgaatccaactctttccaaaacgatttagccaaagattccaaaggagaaaaggtagaggagatcccaaggatcatttcccctctttcaattcggccggagaaggaaaggaacggccggatttggaaaggaaacggcggcggcgcgaaactagggtttcggcggcggcggccggagaaggatgaaggacctgacaggcgggacccacctgtcagcgacagcgagggcgcgcgcgcgcggcggactgggccggctgggccgaggagagagagaagagatttgggccgactttcggcccaaagccaaaagagactttttaaaacctttttcaatttaaattatttcttaaatgcaattccatttattaaaaatacttccttagctcaaataaatcccagaaaaatctaggaattatagaattaagcaaagtatttaatgaaattttatctggccccattttatattggaatttattaattaaaacaagatcttctcttcaagactttaaattatttctagaaattccatttaaacaacaatttataaattttaaaattttcagggcgtgacaatcctcctcgcagcagcagcagcagcaacctcgctccgcgccccgaccccaattcgtggtgcgcgtcccacagccgcagcaacagcagggtcagcaagggacccgtgcaccccgtcctcctgcgccagctgtgcagcctggtcaaggccgcagagacgctcaaggacagcagcgtctgtgctgcaactgcttcgagcccggacactttgcggacaaatgcccgaagccgcggtgccagcaaggccaagcgcctccccgccccaacaacggtggtaaggacgtcgctcggggtcgtgtgaaccacgtgactgccgaggatgtgctgacaactccggacgtcatcgttggtacgttcctcattcattccattcctgctaccattttgttcgactctggagcttcccactcgtttatatctgtgcctttcgtgggaagaaatcaactgggggtagaacggcttaggaaccctctgctcatcaccacccctggaggggatatgacagcaaagtattacagcccggccgttcctatagaaatccagggaatccctttcccctcggatttgattcttctggacaccaagaacttggatgtgatccttgggatgaattggttggctcaattccaaggggtagtggattgcgcaaggcgcactgtcactctgtaccgagggccggaacaaccagttgtgttctttgcacccccaacctctgttggcagttcagaacttcatcagataggattgtcagaaatccccatcgtcagtgagttcggtgacgtgtttccggaagaactacccggtatgccgcccaagcgggagatcgagttccggatagatcttgctccaagaacaactcctctgtacaaacggccctaccgta

SEQ ID NO: 2251 - DNA, 164 bp, Oryza sativa
gccgccgccgccatttggtactcggtagtggtggggggtttgggtggttgacgagtgggagtcgagtcgacccgtgtggtggagtgggtttaggtaactgagactgacaagtatggcccaccaaccaatcgcaaattcaccatcccatccaatcttgacgacga

SEQ ID NO: 2252 - DNA, 1334 bp, Oryza sativa
aaaccctgggagacttaccgtgcttaccacaagcgggagtgggtaactgcttgatctgaagtatagctcgaccctttcctaggcaccggtggcgtgggtgggcgtgatggagttgggtcggccggggtgtccggttgtccagctgccggattcaccgcggcgcacgaggggactgcccactgcccgttaggggtgggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaaaagcccgcggttatgggcgatcaaccagattcaccgtgattagtctcacccctaggttagcttaatgaactagtgtagttcaggtggctggttgggcctgttgcaacgtggtgtagcgttgaacactgattggttaatattgattaattactacaattgtctttactgttttcaactactgcttttaaatgcctgctttattgcaaatgaacccctagcttcctttggttatatcctgcatcatactcctcttccggtatgacttgctgagtacagtgggtagtactcagtcttgctctcttttcccccacaccagagctgaagatcttcctagttggagctgtcttgttgaggttggtttcgtcgctgccgtcaaggattgcctgtggagtggagtcgccccgctgctgaagtcaagcttccaagtctagctcgttttattttttccgctgcatttgtaatcttttatatttttgtaagacgtggatctgtatgtcaacaattgtcgattgtgtaccctgtctggtcctggacaggggtttaatgcacattcagcttagaaattctggttcatgaatttctaggcgagacatcctagcttcctccacgcccggaatccccgcctcatcccctctcgcaggcgatcgatcctccaccctcccgtacgcggtaggcctcccgcctccgccaatcaacgccgtcgtcctctcccgtctcgccgatgggatattgacccggcaccaacgtctttctcgctttcgtctccccgcgccgacgagagtggcgtcccgaccgtattcccactttctcagttccccacgagaaaatggacatttcgccatgttcaaaacgcggtttcgctagaatgccatcccgaagacgtgattcgataaactgccaatatgaagcgtgcgtctaccgccactttgccattttcgctattttattcattttcgaaaagattttct

SEQ ID NO: 2253 - DNA, 1501 bp, Oryza sativa
ctcggcggttttaagggcggttttggctaatgtggcgcatacgtggctaatttgactcagtcttcgttcgacatggcattgacgcggcgcttacgtggcaattcgaccctgaaaaataataaaacccgtgggacccacatgtcagtctcacatagaaaataataaaaaaatcgtgggccccacatgtcagtcaaactcacccttcctcttcttcctcctctctccccatctccctctcttcatctctctcccctctctgctcctcttccggcgagagcggcgagctggagggggcagcgagaccggcgcccaccggcgagagcagcgagctggaggaggaagccggggcgataaaaggggatcaacgacggcggtgggcggaacagatcgacccggggcagcggcagctccccccggagcagcgccggcaatcgagatccggcagtggcggccgggagaagggcggtggccgatggggagaaggggcgacgtgcagcgatggccgccggaggaggaggagatgcagacatgcggggaggcatggcggtggcagccagaggaggaggacgtccgccgtgcgctgctcccctcggtagcggcggcggcacgggggtcctgggagtcgccgaggtcgacgtcgacgtcgtccgcggccacggccatggcgttcctgtccgcatccggcgtgcaccacagaagcggcggcatggggagtggcgcctcagctgctgcaacggtggcgtcaatggggggaagggaagcgaaagctcctcgctccggtgggctgccgctgacgagctcggtggtggtgaaacgcgacggatcgagcgccatcttggcggctgggggccctcctctgacctctgctctagaccgctgccttcgtcctcttcacccgtcgccggctgtcgtcctcctcgctccggtgggcggtcgctgacgagctcggtggtggaggcgggttgcggcggagggcggtcgccgctccctctcccgctggccaccgccggctgcgcacctctccctccgtccgtcgccatcaagcccccgcccacggcgctcggccatcgccggcctccctgcgtcctccctccctgcccgcctcgccggtctttgcgcgttgctccctcctctcctgctgccggccgcctgccgccgcgcgccgttgtcttccgtggcggctggagagagcagagatagggagatgaagagagggagatggggagagaggaggaagaagaggggtgagttggattgacatgtgggacccacgtgggtcccatgatttttttattattttctatgtgagactgacatgtgggtcccacaggttgaattgccacgtaagcgtcacgtcaatgccacgtcggacgaagaccgagtcaaattagccacgtaggcgccacgtcagccaaaaccgctctcaaaaccgccgagggacctaatctgcactggttttaatagttaagggatccgttgtgtctggttttccgatcgaggg

SEQ ID NO: 2254 - DNA, 1501 bp, Oryza sativa
atcttggcggctgggggccctcctctgacctctgctctagaccgctgccttcgtcctcttcacccgtcgccggctgtcgtcctcctcgctccggtgggcggtcgctgacgagctcggtggtggaggcgggttgcggcggagggcggtcgccgctccctctcccgctggccaccgccggctgcgcacctctccctccgtccgtcgccatcaagcccccgcccacggcgctcggccatcgccggcctccctgcgtcctccctccctgcccgcctcgccggtctttgcgcgttgctccctcctctcctgctgccggccgcctgccgccgcgcgccgttgtcttccgtggcggctggagagagcagagatagggagatgaagagagggagatggggagagaggaggaagaagaggggtgagttggattgacatgtgggacccacgtgggtcccatgatttttttattattttctatgtgagactgacatgtgggtcccacaggttgaattgccacgtaagcgtcacgtcaatgccacgtcggacgaagaccgagtcaaattagccacgtaggcgccacgtcagccaaaaccgctctcaaaaccgccgagggacctaatctgcactggttttaatagttaagggatccgttgtgtctggttttccgatcgagggacgaaaatcggattcggtgtaaagttaagggacctcagatgaacttattcctatttctggcgttggaccgtaatagtcagatgttatatgggccgattaggcccatagcttgtttcctttatcaattaattccaagagtgcaaataagcaagcaaaatattccatcaaaatattccttggcgggtgttgcagatctgctgcttggagttaacctttctagtttctaatcaagctagatgtgccacatctgatacagagagagcttcttggcagtgtgaagctctggaggtgctttaaaaattcttttttgaaattcatcagggacaatcacgtttcttgcacaatatcaattattcttagactaatagctcttgaaactctactgtttctgttgcatcagttatctggtagcattttctaccagctgaacacacgattctacgtacattttaattccaattttcatgacaagagaataattccttttgatgtaacctacccgatctcctctctgaaagcatattatctgtttaaattgtaatcccgaacgatcacaattaacaaatcacatctcatttttttcaaccggcaaacattgcccctatcaataaattgcatgatccacactttttatcagtaaaatcaagtacagaaatcacaaatgccagcaacacttctacaggaagacaagagcatgttcaaccagtgccattggcaatgaaaaggaagcttcttgcattgctccttccagtttacattcacatcaaggaaccaaatagctggtagatcagagtagtaaaacaccagtactggctcatgggttatctgcatg

SEQ ID NO: 2255 - DNA, 1049 bp, Oryza sativa
aaagggtcaatttgtcaaaaaaacggaagtgttcatgaccgggtggggtactgatgctgtgggaaccagatcctaaagcactaggacgtccaacggctctcgtccgtccattcggcatcggacggagtagagtgagcacagcggatagactcggcccatatggtagaaaaatcagcccacgcgatcctcaaccatcgacgccacagccgcggccggctaggaagcaaatgggggaggggagacctctgcaccgtcggcgtcgtcgccaccgccacagcctgcgtctcccgcgcgagggccccttcgttgccaccatcctcttctcggccagcaaaatcgggatggctcctgatttcccgtggtcttcggccggccgctcactgccgctcgtcgtctcctccggcgcatccgcgggtggagtggatcctggaagaagcccctcccctcgtcgctgccctcctccccatctctcgcccctgcgttctctctcccttagcatgttgctggctcgctgccggcagtgtactccttcaaatcatccctgcataaaagttcaaggggactcctgttaattcgttagtagcagcagcagcaggttatatacacttagcagttgttcgaggttgccgactgattcctagtttcaattttcttgaggatgaaagtaatatcatcaccagaacctactacaagggcttgcaatggcagcatcttgaaaatcctagatcgagatctaaaattgatatgaatggatattgtaaattgatgtgaattgggattgcaagtttgtaactcaacactgaatgtgatgactgaatgcctttgccaattgagattgattgttgtgtctatttgagaatgtgaagattgtagttgcatcaatttttcgttttcaattcagtacgtttaaaggaattgaagtgaaacttcagtctagcaaaagaatgtcacttgtgttgatgctgcttcgacagtaaacattgaacattacaatgtgctgttcttgctgcattgagcatttgacgaaaccctaatgtttgcttgcaaaa

SEQ ID NO: 2256 - DNA, 1501 bp, Oryza sativa
acttataagtcgaaaagtctaagcctaaacaaacaagcagtttttccgtttggcttttttgaagccataagccactctaacactattaagccaaaagctaggttggagaagcttttttggcttgtgtgaggtagatgtatgactcaactactaaacttaggacattaaatccaccggcttataaatcatataagccaataagctgacttaaaagtctagaccaataaacctaagcctaaataaagagggccataatactaaagagctttgaaacacaactgctaattggcagccaatccatgctatgccctcacatgtgaatcaagcagcagaacatccattttatcgacgcttgagatatggcagatgatttgccctcgaacattatctgaccatggcccatcaatgacttggacactgacaatagtggccatgcaagcgaaccgacctgcaaacttacttacgtgtcaaataagtggttacccatggatttccacatcgtaacctagattgccgcatctagaaatgcaagtggatcgatccataaactcatttataatctatgggttacccattaattttgcctataaatagatttgtggattagactgcttacatccctagtggcctcgaatatagctcgcatcttagctcaagcttgcaacgcttgctggagcaacgtttgtgcatccttgcagggcgtgtcgcgtgatcgtagatcatgttgtgtgttatgacactcatgatgaaggtttcgtcctcagactctgttttctccctttatgaaatccattagcacgactgcacaagacaggcgcgttaacgatttggatctctgcaagcatcacaagcaattgatcaataaattaattacctatattaacatcacaactcaagtaattgatcaataacataaattgaccaatccatgttaaatgtataattactctacacttagcgcactaaggtcaggaacatataatgtttttcacaggcttatatttgtacagattatagaagtgccaaattgttcatttagtttgtatcaatgagttctttacaaagaagagcatcataggaaatacacaattatgtatactaagaatgttaaaaatgaaaactgcaaatatagaaaggacctcgatgaaaagtttttttttctagggaagggtatttttttacccgaactctacatccaacaattatgttaaaaactgcaaatataggacctaggacctcgatgaatagtttttttttttttgagaagggtattttttacgtgaactcttcatccaactagacatatgcaatattttagttctcaaataacccaatctaaaatcgctcctatgaagatttgaacttagaaccttttagctctcaaataacccaatctaaaattcgctcctatggagatttgaacttagaaccttgggtgctactcaggtcactgcaaccactaggcaaatataggacattgatgaatagtttaggcacataa

SEQ ID NO: 2257 - DNA, 1501 bp, Oryza sativa
atttatggattattgaaacagaatatttattccgagaatgattagagccaggcgtccggcgcggggggagcccgatcgggcgctccccctgtgcgcccctccccccacgtgcacacttattgggcccactcacttctctctcccctttttccacaaaaagatgtttcacctaatgtaattacaatgtttcactatttatagatataatgttgcagtgaataaaaatactcttttgcaacaaaaaatccacatattttggaaactctctattaagggaatttggtttattttttgttccaccaaaaatgtttcacctcgtgtactcacaatatttcactatgtatagatctaatgttgcagtgaacgaaacatcccattgcaacaaaaaaacccatatattttggaaaccccctattaagggaatttggtttattttttgttccaccgaaaaatgtttcacctagtgtactaataatgtttcattgtgtacagatctaatgttgcagtgaactgaaacattctttcgctatttgctgaaacattgtttttatataaggtgaaacaacacctgatttaaacgagtgaaacattttcaatcaacttagtgaaacaattccgatatacttggtggaacatcgtgcaacatttaaaaataattcaataataagctatttttttcgtcgaaatatatccatgtgtagtcttgttttgaagatttaattgcaacgaatttaatggtgcaatcggatcatgatttggataagtaatttaggagaaaaaaatcagtttaaaatagttttgtacgtaaatcggacgctgacgtcatgttgacatcagcgccggattttgctcccagccgatcgggcgcccaagccgtaggttctctctatttattccacacttcaaacgatatattttcttcaaacaatatattttctgctgcattgctaatatcatttgttttaagttatttgttaagcttgtttcccctatttctttcagtctgagattattataatccagattattgggaataaactgaaagaaacagacaacttattaaagtagcttcttataatctggagcccagcttattataatatgataagctcatttaggtgagctttttctagattattgggtgaaaaattacccaccatgccaccccactccctttttagacttgcaaacccaataatctagactctaataatctagaaaagaaacaactaaccgcttattctactacagattataacaatctaacttatagtaatctaactcaataatctatattataataatcccaagctgaaagaaacagggacttatatttgatttgtcaatgaagcggataattcactcgttccgtttttctccgattgatgtttgcatatggagacggtgcaaactgagccgccgtacgtcgtctccctgcccctccggcgacacctccaccagttcggcttaggcttcgagaaatctgcgatttcaacaatgc

SEQ ID NO: 2258 - DNA, 1501 bp, Oryza sativa
ggtgtcgccggaggggcagggagacgacgtacggcggctcagtttgcaccgtctccatatgcaaacatcaatcggagaaaaacggaacgagtgaattatccgcttcattgacaaatcaaatataagtccctgtttctttcagcttgggattattataatatagattattgagttagattactataagttagattgttataatctgtagtagaataagcggttagttgtttcttttctagattattagagtctagattattgggtttgcaagtctaaaaagggagtggggtggcatggtgggtaatttttcacccaataatctagaaaaagctcacctaaatgagcttatcatattataataagctgggctccagattataagaagctactttaataagttgtctgtttctttcagtttattcccaataatctggattataataatctcagactgaaagaaataggggaaacaagcttaacaaataacttaaaacaaatgatattagcaatgcagcagaaaatatattgtttgaagaaaatatatcgtttgaagtgtggaataaatagagagaacctacggcttgggcgcccgatcggctgggagcaaaatccggcgctgatgtcaacatgacgtcagcgtccgatttacgtacaaaactattttaaactgatttttttctcctaaattacttatccaaatcatgatccgattgcaccattaaattcgttgcaattaaatcttcaaaacaagactacacatggatatatttcgacgaaaaaaatagcttattattgaattatttttaaatgttgcacgatgttccaccaagtatatcggaattgtttcactaagttgattgaaaatgtttcactcgtttaaatcaggtgttgtttcaccttatataaaaacaatgtttcagcaaatagcgaaagaatgtttcagttcactgcaacattagatctgtacacaatgaaacattattagtacactaggtgaaacatttttcggtggaacaaaaaataaaccaaattcccttaatagggggtttccaaaatatatgggtttttttgttgcaatgggatgtttcgttcactgcaacattagatctatacatagtgaaatattgtgagtacacgaggtgaaacatttttggtggaacaaaaaataaaccaaattcccttaatagagagtttccaaaatatgtggattttttgttgcaaaagagtatttttattcactgcaacattatatctataaatagtgaaacattgtaattacattaggtgaaacatctttttgtggaaaaaggggagagagaagtgagtgggcccaataagtgtgcacgtggggggaggggcgcacagggggagcgcccgatcgggctccccccgcgccggacgcctggctctaatcattctcggaataaatattctgtttcaataatccataaataattaaaaaataaattgagcaaaacatgactagaaatatagatggtca

SEQ ID NO: 2259 - DNA, 1501 bp, Oryza sativa
ctgctcgctgtgtgctcgccgccgtcgccgaccgtgctccgtagcgcccgctcgtcgccggcctcgctcggcgtagctccgcccaatccgacgctagcaacggattctcggagtcgcgtagatgctttagctcgcccgaatcggtctcccgtcgcgccatcgccgtttccccttctctcgccgccggttgcctccgccgcaatccgccgtcgtcgagcatcccccggcgaatccgagccgttggctcgtctcccctcgtcccgtgcaacctcccggtgtgctcgctttcgcctgtatcgccgtggttcgccgccgccgtccgcgtccgttccggccgacgtcgtcgtctacctcccgccggcccgcgtggcagccacgtaggcgccacgtcggcgccacctcggccgcgaccgggtcaagctgaccccggtacgccgctccctccggccctgcccgcgcgcgcggtccaccgcgagccgtgaggctgtgcgtgggcccgccgcaccgcgtcctccgcgaaccgcgcgcatgcaccgcgcctcccctccccaaaccctagcacgccccgcgtgcacctcgctcacggtgagccaagccgccgacaagcgggtcccacccgggaccacgcgggatggacccggcccaccggcttcctcactcctccccacccgcgcgcatgccttgggccgccttctcaggccgaccggcccgttaagttcggccgagccgccccctttctctcgggccgcgccctagccgcccgagggaagtctaattcccctccctccttcttttctcttcttttcttttcaaaaaggatttaaataaatcctttttcctttagaccaaaaatccaataatcttagaaattcaatatcttcctaaccgtaagtccgtttgactccgttcaacttccaaaattcctcaaatcttgagatctacctaatgacacgcttagaggtcaataatagggccttattttcgccgtttgctgagttgtcccgtttcgcgtgtagtttcggagcccgaagatccgcagtgcgaggatttcgaggatcaagctcaagatctcgagcaaggcaagccacctttgaacatattgagcctatatttgaacttaattatattgcttgcaaaatattatgcattgataggattgcacttaatctgtttgccccgtctgcaaggcagacaggtgggcctacctaacttgttgcatctgatccttccattgttaattgttatatcatgttcccttgtaaccacctagttgcgcctcggtattcgtgcactctgcacgagtatcgacggttgccttcaaacttaaaatctgagaaacatcttgggtaaaactcgggttttacaaaagacttggaaaacccgacacctgggtcggtgcttgcgaactaaatgaatttccaaaatcgcggaccggggaacgtaccgggtgtacagtctcccgctcttgcacttaaggaccgtttccttggaatttcatccg

SEQ ID NO: 2260 - DNA, 1501 bp, Oryza sativa
cttcattctccacaggtctgcataatatgagaagcctaaacttagacatcaattacatccactgtgtttaaaggattcgcagatatatgattccttcagttgcagatttttaaaacataaaaagacggtaacacttaaacaaaagtgcaaacatactcatcagtgtgtcttgtgatcctcctatgaagtgctactgtcaaatcagttccctggtacagctcttcaagggtgcacataagttctccaactgttgcttgtggattatccaattgatcatgataaatcattgcacagctttgttcagcatcttgaatctaataaaataaatcacagttaatcaaaagttcaaattactaataaacaacacataaaactgcaggaaggaaagaatgatagttacatcacttacatttccatagaagaataacgtgtggggttttaggcacctcagctggttgtatctttgcaattcctgttgcaacaacggtaagaatagtggatacttcacaatgaagatcaattcaaactgttcagcggaataaccaccaacttcctctatcatgaagcatctgtctaaccggtggcaatttgaatgtcgatagtatttaaaaaatgtttctgggtcatgagccttttccggattgtcatcaacaccatagtttttgtgcttcagcgaagcttccagtaaataattcccttcggtgatttgaaaccatctgttttggtatggaagcttcttaagtatatcacgataagcagcatcattggtgtaggctaagacaaacctcatatgctcataagctttgaaatagaaaagtatcctgttttcgattggtatcagtggtgcataattgcagataagataaccatgctcatgtggattgtgcagcattagagacattaaagatctccagtcctctggtatttggtccatactgtaattcctgaatacagtttgacggatcacattacgaagatcaagataattttgacaaaccaattaatccgtcctttttgtcctggtgacaagccggaatcttatgtgtccagtaggggcaacccagatattagattcaccaaatcttgacaagcaatacccctcttcatgttgattgaataactccacagccattgatctgacacaacacttaatcctctccttaacaatccaaacattgagtttcttgtattctcccaacaaactacaccgagtgctgtctatatattccatcgctgatgtcgtgaattctctgacagagataaaatacttgtgatctggtaaatcaccataggaagtgcctatgtcatccttcattatgtcgtaaccctgagatagcatgctagtgaatgttaagacattgtataatttattcaaatcctaatttcattgaggaattctcccataacataaagggcattcacattaaaatctgaataaagggcctaagggacatttaatacactgctgtacacctagtttcagaacatgaacatctatcta

SEQ ID NO: 2261 - DNA, 1501 bp, Oryza sativa
ctttaacttgtaaaattatttcttcattctccacaggtctgcataatatgagaagcctaaacttagacatcaattacatccactgtgtttaaaggattcgcagatatatgattccttcagttgcagatttttaaaacataaaaagacggtaacacttaaacaaaagtgcaaacatactcatcagtgtgtcttgtgatcctcctatgaagtgctactgtcaaatcagttccctggtacagctcttcaagggtgcacataagttctccaactgttgcttgtggattatccaattgatcatgataaatcattgcacagctttgttcagcatcttgaatctaataaaataaatcacagttaatcaaaagttcaaattactaataaacaacacataaaactgcaggaaggaaagaatgatagttacatcacttacatttccatagaagaataacgtgtggggttttaggcacctcagctggttgtatctttgcaattcctgttgcaacaacggtaagaatagtggatacttcacaatgaagatcaattcaaactgttcagcggaataaccaccaacttcctctatcatgaagcatctgtctaaccggtggcaatttgaatgtcgatagtatttaaaaaatgtttctgggtcatgagccttttccggattgtcatcaacaccatagtttttgtgcttcagcgaagcttccagtaaataattcccttcggtgatttgaaaccatctgttttggtatggaagcttcttaagtatatcacgataagcagcatcattggtgtaggctaagacaaacctcatatgctcataagctttgaaatagaaaagtatcctgttttcgattggtatcagtggtgcataattgcagataagataaccatgctcatgtggattgtgcagcattagagacattaaagatctccagtcctctggtatttggtccatactgtaattcctgaatacagtttgacggatcacattacgaagatcaagataattttgacaaaccaattaatccgtcctttttgtcctggtgacaagccggaatcttatgtgtccagtaggggcaacccagatattagattcaccaaatcttgacaagcaatacccctcttcatgttgattgaataactccacagccattgatctgacacaacacttaatcctctccttaacaatccaaacattgagtttcttgtattctcccaacaaactacaccgagtgctgtctatatattccatcgctgatgtcgtgaattctctgacagagataaaatacttgtgatctggtaaatcaccataggaagtgcctatgtcatccttcattatgtcgtaaccctgagatagcatgctagtgaatgttaagacattgtataatttattcaaatcctaatttcattgaggaattctcccataacataaagggcattcacattaaaatctgaataaagggcctaagggacatttaatacactgctgtacacctagttt

SEQ ID NO: 2262 - DNA, 1501 bp, Oryza sativa
tccttgatccaggcagcactttaacttgtaaaattatttcttcattctccacaggtctgcataatatgagaagcctaaacttagacatcaattacatccactgtgtttaaaggattcgcagatatatgattccttcagttgcagatttttaaaacataaaaagacggtaacacttaaacaaaagtgcaaacatactcatcagtgtgtcttgtgatcctcctatgaagtgctactgtcaaatcagttccctggtacagctcttcaagggtgcacataagttctccaactgttgcttgtggattatccaattgatcatgataaatcattgcacagctttgttcagcatcttgaatctaataaaataaatcacagttaatcaaaagttcaaattactaataaacaacacataaaactgcaggaaggaaagaatgatagttacatcacttacatttccatagaagaataacgtgtggggttttaggcacctcagctggttgtatctttgcaattcctgttgcaacaacggtaagaatagtggatacttcacaatgaagatcaattcaaactgttcagcggaataaccaccaacttcctctatcatgaagcatctgtctaaccggtggcaatttgaatgtcgatagtatttaaaaaatgtttctgggtcatgagccttttccggattgtcatcaacaccatagtttttgtgcttcagcgaagcttccagtaaataattcccttcggtgatttgaaaccatctgttttggtatggaagcttcttaagtatatcacgataagcagcatcattggtgtaggctaagacaaacctcatatgctcataagctttgaaatagaaaagtatcctgttttcgattggtatcagtggtgcataattgcagataagataaccatgctcatgtggattgtgcagcattagagacattaaagatctccagtcctctggtatttggtccatactgtaattcctgaatacagtttgacggatcacattacgaagatcaagataattttgacaaaccaattaatccgtcctttttgtcctggtgacaagccggaatcttatgtgtccagtaggggcaacccagatattagattcaccaaatcttgacaagcaatacccctcttcatgttgattgaataactccacagccattgatctgacacaacacttaatcctctccttaacaatccaaacattgagtttcttgtattctcccaacaaactacaccgagtgctgtctatatattccatcgctgatgtcgtgaattctctgacagagataaaatacttgtgatctggtaaatcaccataggaagtgcctatgtcatccttcattatgtcgtaaccctgagatagcatgctagtgaatgttaagacattgtataatttattcaaatcctaatttcattgaggaattctcccataacataaagggcattcacattaaaatctgaataaagggcctaagggacatttaataca

SEQ ID NO: 2263 - DNA, 1501 bp, Oryza sativa
ttaatatttgtctcaaacaataccaacaagagagagaggcaaagatagtattgcattgatcatgagataatagacgaaacagatcgctcgtgtatatataaaaaaatcttgatctttcattcataatcaatgataaatacacttcacagattacacgttctcttgcgaagatttccagtaaaccatcctatcacaaatacgagatcactgtgccttccatgacaccaaataaacagaggaagacatgtctgaatcctacaagcttctgcacctactgaataacactgatcacaatgccaagaacgcctcggagttggcccgcagctgctccttctccagcatctgcatcttcagccgcggcagcgacttgccggccgtggtcggccgcggggccgccatgtttgccggggtcggggccgggcgtggcccctgcagcttgacgtccttgacggcgacgcgcacggcacggaaggggtcgtcgcgcgggaagttgccgttgtagatgacctcgaggtgtccgttgtcgtcggcggcgtcggcgtcggagacgacgaccgcgccgagccacatgacgaggcgcagcgtcgttgtgcctagcctccccaacggcgtgcggacgcgcacctcgtcgcccttcttgaaggacatctcgttgaccggcgatcgtcctgacggcttcttccccttggcgtcgacggcgcggtggatgatcgggcgcgaggagcggggactcgagcggcggggaagcgccatggacgacggctacgagcgctgctagctgcgactgcgactctgcgaggatggggtggaaggaattgtggtggatgcagcgctaggatttatcggcagccgagtccgactccgagtcgaaaccaatgaagctagctacgtagcacgtcggagacggagttggagttgaactcggtgattagcttgctgtgattaatggctaatccttgtgaattctgctctatatatacacgcggcattgttgaaatcgcagatttctcgaagcctaagccgaactggtggaggtgtcgccggaggggcagggagacgacgtacggcggctcagtttgcaccgtctccatatgcaaacatcaatcggagaaaaacggaacgagtgaattatccgcttcattgacaaatcaaatattttaagaaacaaggttaacaaatagcttaaaacaaatgatattagcaatgcagtagaaaaaaaggttttttttaaagaaagtatattgtttgaagtgtggaagaaatattccgtttcaataatccataaataattaaaaaatgaattgagtaaaccatgagtagaaagttaagaagtgggggacgctagtccaccaacaaataggaatgcaagtggggttggcttgtgggctttgaggcccccattgtagttatattttgaaaaaaagtacgaattaccccctcaatagttatggtcgtctgatttttaaccctgaactctaataccggttatttttaaccttga

SEQ ID NO: 2264 - DNA, 1501 bp, Oryza sativa
ggcgtcggagacgacgaccgcgccgagccacatgacgaggcgcagcgtcgtggtccctagcctccccaacgacgtgcggacgcgcacctcgtcgcccttcttgaaggacatcttgttgacaggcggcgatcctcctgacggcttcttccccttggcgtcgacggcgcggtggatgatcgggcgcgaggagcggggactcgagcggcggggaagcgccatggacgaacgagctctgctgcgaggatgggtggaaggaattgtggtgaatgcggagacggcgaggggcggcgcgcttggatttatcggcagccgagtccgagttcgaattgaaatcgttgaaggaagcaaagcgtgtggatgccaagcagaatacttctgatgaataatccgattatacgcatctatgctctgcgagacattcctagcttcaatccgaactcgactcgaaatcggagatctccgtttacgcgaagggcaaggagatgacggcggaccggcggctcagtttccaccatctccatttgcagaactagtcgcaaaaatggaacgagctagcgacggaatgcgtgttctcgcatctgtcgtggagagaagctcgccgaggaagccggggatgacatcgaacacctggcggctgtcacagaaaacagaggtgttccggcaccctttgccaaagatctcgtttcaaaaggattgttcatatagtatctcggagaaaacaggcaaatatatgtccggagaaattcgatgcaatatttccttttaaaaaaaaaattcgatgcaataggctcactgcatccacaaatcgtcgtgatcaacgttgtcttaaattgtgaaaaaaaaaaggcaccacagaactacccctgcatcccacaaagtcttcatttctaggtttatatatccaacatttgaccgttcgtcttattttaaaaatatatatatattttttaaaaaagttagtcaaacataaagtattatttattttttatcatctaataacaataaaattactaatcatagaaaactttgaaataagagagtgtatccaaaactgaaaatggagtttttgtcggatggagggagtactgcaagaagcttatcgctgtttaaagaaataaagcacctcccccagtcccaaacgcccatttttcacacgcatacttactaaaccattaaatgcacccttttaaaaaaagaaagatgtttttaaacaattgtattaatctatttatttaattttttaatctaatacataattaatcatatgctaatctaccactatattttacgtgtcagagaaaaagagttcctaacaataaacaaacacagccaaacgaggtaagcttattctagcaataaaaatcaaagagcaattagcacatgattgattaactattaactagtatacatttcaaaaataatttatttaatattttaacaaaataatttttttttacgaaacataccatctatcagtttgatatttttatcatacacggga

SEQ ID NO: 2265 - DNA, 1501 bp, Oryza sativa
ggaagtctaacgttatctctgaactcaccgaaaatggtcacgtgagctcgataacagttcctccgaagtctgcagttgagaatatgaactcgttcatttgcatcgaagtcgggggttactgtcatagttatggataccacatacttaatagtagttgactaaatctcggcaggacctaccacataccatatcctatacagaaacaactttcggatataggaggagttccgataaggaaagacaaccagagttctacatggaaacgacaagtactactcggattgtaggcatattggtttccctagttctacttggacaaggggacacctatgggtataaatacaagcccccctaggaggacagggggacacccaccatgagacaatcaacacccaacacaatcgacatagaagccacaacatagaagcctacatacgccaagacacgccgccggatatcgactttagggataaacacggctagtatcctacggtgtctccggatactgtcaggaaagacgaaagcgctatctctgatctcgccgggcacggattcgaggtggaaggctaccctgttgtcgactacgagtcagatcgtcagactgacatgtcgacaacagttagataggctaccccaaacattgtactggtgtggttatcataaataagagcaataccgacttcggccaacaggatgtagggttattacctgacaactcaggggcccgaacttgtataaaaatcctcgtctccatctcttttacctcagtctcgcatatatcctagcaccgacgatccccatactgtccaaataccgtagtagagacatcaaacgtcgacacatatatgttattatatgacagaaaatataatgatgctaaccgcgcaatctgcgcgggccaccatgctagtttacactgatgttagcatcttaacaattgaaactggtgtgttgtgtcttcagcaagacgacgtgcgctgacatgtggccccttgagagaacacgaagagatgtggattgacatgtggatcctcacgtggggatttacgtgaagttgataaaataacacaagtgattggttgatcaaatagtcacgctcatcaagtttgaccgtaatctgaagaggcccaatataatgggaaagtgatttcatccatcacggggatattccctcgtttcgtgcatgccacctaaatagtcaccaaaaaatttgaaaaaaaaattggtaacatagaataatatgagatatatcactctacaaatatgcatgtttaaattaacttctataagttataataaaaataaaaaatatagctgcaaatgtatgataactatttttagtttaatttattacttttgttgcaacttgtagaagttgaatttggtcttgtatatttgtggagtaatatatttcatattaatctatgttgtcaattgtttttaaatttttaatgactacttagatgacatgcaaacaaggacatatccctcgagagatcac

SEQ ID NO: 2266 - DNA, 1501 bp, Oryza sativa
ccgcggctgcgttgttgttatataggagtaataatcgggttgcaatggtgtccctaacaagttctctaattacatgtaaacccttcaaaatttcagttgcaattttatccctaacacaaatattcgtcacgccaaacagctcgctgagtttccctttttttagtttctcgctcagttccacttccacttttttttttgggggggggggggggttggctaagggataaaaatattatccatgtctcactgtctcacgccgcccctatgtgccctcaccttacgggataaataagttatatatatacttcccgtgtatgataaaaatatcaaactgatagatggtatgtttcgtaaaaaaaaattattttgttaaaatattaaataaattatttttgaaatgtatactagttaatagttaatcaatcatgtgctaattgctctttgatttttattgctagaataagcttacctcgtttggctgtgtttgtttattgttaggaactctttttctctgacacgtaaaatatagtggtagattagcatatgattaattatgtattagattaaaaaattaaataaatagattaatacaattgtttaaaaacatctttctttttttaaaagggtgcatttaatggtttagtaagtatgcgtgtgaaaaatgggcgtttgggactgggggaggtgctttatttctttaaacagcgataagcttcttgcagtactccctccatccgacaaaaactccattttcagttttggatacactctcttatttcaaagttttctatgattagtaattttattgttattagatgataaaaaataaataatactttatgtttgactaacttttttaaaaaatatatatatatttttaaaataagacgaacggtcaaatgttggatatataaacctagaaatgaagactttgtgggatgcaggggtagttctgtggtgccttttttttttcacaatttaagacaacgttgatcacgacgatttgtggatgcagtgagcctattgcatcgaattttttttttaaaaggaaatattgcatcgaatttctccggacatatatttgcctgttttctccgagatactatatgaacaatccttttgaaacgagatctttggcaaagggtgccggaacacctctgttttctgtgacagccgccaggtgttcgatgtcatccccggcttcctcggcgagcttctctccacgacagatgcgagaacacgcattccgtcgctagctcgttccatttttgcgactagttctgcaaatggagatggtggaaactgagccgccggtccgccgtcatctccttgcccttcgcgtaaacggagatctccgatttcgagtcgagttcggattgaagctaggaatgtctcgcagagcatagatgcgtataatcggattattcatcagaagtattctgcttggcatccacacgctttgcttccttcaacgatttcaattcgaactcggactcggctg

SEQ ID NO: 2267 - DNA, 1501 bp, Oryza sativa
tctctctctctctctctctctcgcactctcccatctccccctcccctcccccggcgcgctctccctccgctccgccgcgcccgcgcgccgcgcacgctgcgtgcgcgagcgcgcaagccgcgccgagcgcctccttccccctccgctccgcccgcgcgccccgtgcacgagcgcgagagccgcccgcgccgagtcgagccgcgcctctccatccgccgcgccctcccgttgcaagccgcgcgcgcgtgccgagtggccgaccgtctggttgccgccgccgtcaccctctgccgcgccagcccgcgcctgtcgcctgtgtcgtcgcgccgctccaaaccgccccgccgtcatcgccgtcgtcatcgcctcggccccgccactcccgcgctagcctccaagggacggaggcagagcctccctcctccctcagccgcgcgcccccgctccctgctccttttcccgaagaggcaaggggacaagccccctttctctccctccttttccccttttcctcctcgccggcgtcatccgcctctgtcgccgttttggccgcaagcaccgagcgccagctagcgccttgaccgcccgaagtcggtttccaaaccgacgttgccgcccttaaagccccgggcgccctccctctcttctcctctcgttgcccctctcgccgccgcgccattgccgtcgctcccgtgctctgtctcgcctccgccgtccatcgccgagcaccgggagagccggtgcgttcgtggacgcggaaggggacttcggccgcgccctcttcttcctcttcctcggcccgaggccggagagattactcccgcgccgccggcctctcgtcacagcgcccctcctcttctcggtgatgtctctctccgttcttcctcctcgctccatctcctccccctagctttcggtagtagcttgagtagactccccgtagttagccggcgccgccccgaccgttgccgtcgctcgccgtgtgctcgccgccgtcgccgcccgagctccgtagcacccgctcgtcgccggccttgctcggcgtagttccacccaatccgacgctagcgtcgagttcccgaagccgcgtagatgctctcaccgccgggaatcggtctctcgtgacctcgtcgccgtttccctcttctcccgccaccggttgccgccgccgcaatccgccgccatcgagcaacctccggcgaatccgagccgttggctcgtctccccttgtcacgtgcaaccgcccggtgtgcacgcttttgcccgtatcaccgtggttcgctccgccgctcgccgccgccgcccgccgtccattcgcggccgggtcgtcgtctacctcccgccagcccacgtggccgccacgtaggcgccacgtcggcgccagctcagcctagaccgggtcgggccgaccccggtcggtccctccgcgtgcgcgcgatccaccgcgagccgtgaggctgcgcgtgggcccgccgcacctgcgtccaccgcggaccccgcg

SEQ ID NO: 2268 - DNA, 1501 bp, Oryza sativa
cgaaaaaagttgtaacatgttggaatggaatcaagtagtacgggttaagctgtactactagtatttgtgctactcagttgctatgggctgagttttatttgtgctcctcagctacaatatcgacctctaaaatcgatatttatcaactccctcgatagtaacttttataatgtcacaatcttattactatatgtatatgaagttattgtaaaaaatcattatggataaagttacaactcaaagatcgtaaaaagaaaaatcaaatgccatatatttgtaaccggcggaggtcgtactttgctgctgatgcggtacgaaagtagtggtcgctggtcgccgactcgctacatcagcgctagctgaagatatcacataaaaatcaatacagaagaagtgctgaacaatctgaggcatgtagagaggtatactttggcaccaactggctgcactttattgatacaagacaattgtctacaattgcacagcctgatctgcattatccctagcagtaactagcctaacgccagtggggatttattccctgatcatagtgtctgaaattatctgaaacaacatcacaatctcacggtgcacagtacacgtaaggcagttccggacattcgatgtaggagaacggttttaacacgtccctgtgcccagtgtatttaatctttacccccgggaagtggatgcccagaacccatacgctcctctttgctaggatcgatcaccggaactgcatcacataagcatgtagtggtgaactactgactagcagaaatcaataacaaaaatagaccaagagcagcaatacacatgtactccatatatttgcagaaaatgtagaaacagttttgtatggggtgttgttagataccagctggagaggcttcttgagacttggcggccggagcagctggaagatcactgcctggaacgggcaccggcgtcgcagacggaggatcaccggatgaataggccaccggaatgggggaggcggcggagctgtcagccattctcccgatctaggtaggccggtggaaactggagagcatacgctgttcagcgatgagtgcatccagaatatatagcccaagggtgcgtgagtgtgtctttgcatggttcgatatagagaggatactccctcattttttttttaaatagatggtaccgttgactttcagcacgatgtttgattaaaacaagttataacaaaaataaacgatacttgtattagttcttttaataagacaaatagataaataataaaaatataagaagttttggttagatgtgacacatactatgatgggatgtagaagggagtatctatttatgcttcaagccttcaagcacccgtccaatggatgtcgaagaatcacgtgcgctgatatttttcttcaggaaataaggtgtgcgtttacacctgtacacggaataatagtcgtggttgaattttcttggcaagatggttgtggcgaacctgaagagtcaaaaaaaa

SEQ ID NO: 2269 - DNA, 1259 bp, Oryza sativa
ttcttttgatttaatgtaacacggtaaatataacatgccgatccactcttttgaaaaaaataataattaccctcttgtggtttcacttgtcattaattaacttaagtaattaataaccaatatcatgtacaggcaagtctggaaactaaagaggacagaaccgtcttttctcctgctagttaacactgttaagtgcaaaaactaacggaagtgctacataggctacacagggaaggaaaattttagaaatgtcttgggaacttttgaagtttaggtgttatagagggaagagcaacttttttttttttgctagatagggaattttctcttgattttttgtgagataaaatttaaacttcagaaattaagttttttgggatcgagggagtacgtacgtgtagctttacatcaggcaacatcaggttcattatgaatgttttcaggtggatctgaagcgtatccgacattgtctatcattccattgaaattgttgtcttcagccgtaccatctaatacggatgtgtttaattctttgggtgtaaagttttggaagtatacggatatatatttgaattactaaactgtagactaataacaaaataaattataaattccgcctgtaaactgcgatacgaatttattaagtctaattaatccgtcattagcaattgtttactgtagcatcacattgtcaaatcatagcataattaggctcaaaagattcgtctcgcaatttatatataaactgtgtaattgatttttttccccacatttaataccctatacatgtgtctaaatatttgatgtgatgttcttggcaaaatatttaaatctaaacatacatcaatattctcctcttcttcatgctcagtccaactaacgaattctcgttaggcataaaaccccttaaaattaacggactgtagatcaatcttttgttatggaactgtaccgattctgattcctacggtccaatgagagacgatcttctttcatgcttggaattaatttggaacgttgatcatctaacgctccatgataaaagatccatggaaggacaacaaatgcattccacgctctcttgttcgaaccacgtatattcagctccgattcatttgatctgctgcctgcatacaaagcgttaaaaagaccatccaaaatcaaatggatttgaaaccggcggctcacacagaaatgaaccgacggtaatctgacggttccgataggaagttttgtggtagttagtaaaaatataaagt

SEQ ID NO: 2270 - DNA, 1501 bp, Oryza sativa
ctagtgtgcatggcgtgcagtggaggactcctgatttggtgggactacattcgtcagcagagcatacttgttactgccgagtcttgcacggcgtcgccgcccgccggccggccgctcccatccaaacatgtatgggacgagtctaccacggtggcacgctattgtcaatttgtcatgctgtcactacgaattagctagtcgactcacagatcaccggaaggccataatcctttctctatcagggttaaacccatcggtttagccgattggatcggtgctcaccgattcggaaatttcggtccgaaatttctgaaattttaaacaacatttagttgaatttgaacaaatattaccaaaattcatgaaaaaattaaaaaaaataaaaaattcggtcgaaataatatcgtatccaaaatgaccgaaatttctaaaatttcgttccagaatttctaaccctgttctctatcccgttttaatttcacttagatgatccacccgaactgtagatttctggcaaccaagcaaagcatggagagtaattgaagtcagagtcaagtttgaagtctttgaatatgtgaacagatttcagttttttcgatgagacatctgtgaacagatttaaaggaactattctatgtactacgcatatacattgccgtattagttcgggtcatttgactgctgactgaagaagatgatatttttcagtgcaattcgactgaaaaattgacgagctgagtttacaattagactttcagagtcagacagtgaacggtgaacactactgtcactgtgcttgtttcattaagggaaacgctgacgactacttcgtccgaatatcagtttggattagcaatagaatagacactctaactagcttgctagcctggttgtgtttgggaaaaaactgacattattgctaactccctgcaaccaaacctttagaatatagagtaaaaacatcttacacttgtaaaagttgctttctcatgcaagatcaggacaattctaatgctctagttaggcagttatcttagttactttgtccaattaatttgcttgtctcgacgagagaacagtgaaaccccagagtatacgctaagttagcaatgtagactgcagtaacagacagatacatggatcgatgcacttgataacatcactacaacatgacatatgagttgcatattttaagtggcaactgttaatctcagctcccaattgagctacaaagtgccgaagcaaagttcaagcacaaatcttaagctgggccaaagccatgagcgtctaagtctaggtcctgccgtatatgccggagtacggccaatctccaccacttggccattacaattgccttgcttatggtgttgctgctggtctataaattcatgtacattagcacaacaaccactacaccagacagcttcagtttgcaacgtacccaagtaagaaacacctgttgctcacattgtaattctcattagcaaaactgatggcgcct

SEQ ID NO: 2271 - DNA, 1501 bp, Oryza sativa
gatcccgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcgaagatgttgtccttcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttaagtgaaacttgcttgcacaagacttgcaattcaaggcgtagtccattgttcaagttgtgagtaagtgtagcttggagttctaggtggatgttcaaccttaattggtctccatcgaaccgctggtatataaacagtatattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacacgagcgctcgctcgcctcgcctggccgggctgggccgggcagggcaggcggcgcgcgtgcacgacgtacgcgtcgaatggtccgaaaaattggctcctcacccttgcgcagatgcagcctccttttgcagttttgttttgctgcaaattcggatttgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacgattgcgaaatcaatctagggtttgcctcctactctgtactgcgccgtcgctcgtagactactccatcccgctcgccggcgtgcaccggcgatcgggagagcaggtctccggaacctctgccttcgacgtcctgcaccgggagaaggcggcaataaggttttttgggaagcgcttcgcgcgactactccctgtttgttcgcgacggctcgccttcctcttcgctcgcgtgtttcatgtcttcgtagacacctgcgaaaagtttcgaccaagcaaccggtctttccgtcacctcggtacgtgttcaatatgttgcgcatatttgatctgttcatgttatactgtgtagtttacatgtatagatctaatgatgcgttcatgctagttttcatctgtaatgtcatgatttatttatggaatagattaaatcattatatatctataatctcaacatttggtttgt

SEQ ID NO: 2272 - DNA, 1501 bp, Oryza sativa
aagcacatgaggttataccattggatgtcatccaaatatcagacaagtaattacctggttcgtcgctccagtacgcgggggacgagcttgctgctgggcagcgccggtcggctgggacccgcgccccagtgcgacgccggcgggtgagcagccgcgccccacggcggctccggcggcagggctgccgtgccccaggatggctccgacagcgggaggcgggcagccgcgccccagggctgctccggcagcaggaggcgggtgcagggcggctccggcagcgggaggcgggcagccgcgcccctggccgcgccactggccggcagcaggaggcgggcagccgcgcccctggccggttgcgggaggagggaagccgcgcccgtggccatgctccagtccggcgcccatggtcatctcggcggccgggacttcctcctctaggccggatccatcttggacagaggcggatccagccatctcggtggcggcggctctagggttggcggcggcggcgatctgcctgcagactcggcggcgctctggtggaatcatttttttcacgaatgaggaacgggaacggggcggtactgtggaatagaagcgaatcgttttttttaaccaatggcaatggtgggtaattttttaccatctccatgaggacatatgactccaggttttggtggagtaccccttgaggagctccagaatattcctagagatggagctgcgatttaagagccagagctactccactactcgtgtttggcaaaaaaaacttggagatggagctattttcttggagaggagtcctgccaaacagcccctaactctccagtcctggcctctcattctccgtctctccctgtctcctagtccactcccgacggcaccactgcgctagcacggcagtcggcagcaacgccatcgctccggcgctcccgtgtggtcacgtcccgcgaggctacgacggtgcagtggcactccgcctctcaccggcgcgccctggcctgggcctgctcgccttccatcgtgactcgcgccgtggcgccgcgtctagccggcgacctcccacccgatgtgcgcgccccgccatggcgccgctggcttcgcgcgctcgcgccctctccgcccctcgccggcgcgccctagccttggcggctgggcctgcccaccttagcgccttcccgtcgcgactcgcgccgccgcgctgtgtcccgcatgaccgtgtccaactggcggccttccgcccgacgcgcgtgcccgccgtggcgccgccagcgcccggcgtcactccctcttcgatgagcagtgagcacttcctcagcccctccccccattctagagttctagtagtagtagacgaccagtactatccccttcaataatcaagttttagatttctagtcgtatgccatatcaatagattaccacaaaattgtgtgcaacaataaaaatcatatgacatttttacatggtttgatggttgtcaggagattgaggcata

SEQ ID NO: 2273 - DNA, 1501 bp, Oryza sativa
gccaatcacatttaacctgattgatttttctcccgaaaagaagactttgactgaccgtactaatgttgttctcacgatctaaacgcgtggtttctagtactccaaccaattcgttacttctcatttaatgtcgtaagtaaacttttttttatctttatccattaatttcattcgaaaagacctacacttaaatatttttaattttttatcactatttgcataggttttaagatttatttaaatatcaaggttttaaatttcaagcaaaaaatcatgaattttttttaaatattttaaaagtttgataatggtatcatgtatggcttttaaaaaaagctcaacttaaaatacgactcatgtaaagagaaataaagaagagtgatgtgtggtggggattttttttttttttttggggagggtggtgttgttaaaatgagaacatagtagtttagagcgcttaattaagtgataaaatgaaacagttcagaaggagtaaaatagatttagtatttctcatggtgaatctaaagaaacacatgataaactatataagttattgaagcatatgataaatgataaagatataaatgttttgactaagacaaataaggttgtgttcggtagctacgattggatacctttcccctgctgatgaaaaattcgcatccggctgatggtgccaaatctgcgtttacgtgaactatgtggaaacacatgaaggcctgagagatttgcttagctctagtgcaggtcctaaattttgatgagatgcgggcatgccagttagtttgatcctgtaactgacaagatatataaattgatgatcaaatagccgaccagctaacaaactgatgtaatgatgctagcagatatcgataggggtctgagatattgattctgacacttggataaatgacgatataaatataatggaaaaacttgagcaatcaaccaatcaaccaatgataatataagagtaaattttggaaaactacaactctagtgacaaaactatcagtttgctgcaacattagcgacatgtttcagtttgctgtaataatagcgtgggaaattattacaaaactgcaacagttatatgctgctacagttgtcacctagtatatatattgatatgtggagatagattacagggaccccgaatctacatatttatacccatcggtagatattagtccttattggacaagacacaaacattcctatagataaaataaaagatacaagtcatgatcgggctctaaataatctttcctgaaaataaaaggaaataagtaactctacctaattaatagataaactgtcatgtcgcatcgtccttgaactcagtctcttttagataagtttcttttaattgattaattttctgaaccgaatccatcgagaatctaactgttggtgactgatgtttccatcgacctattccagaactctgaagcgaatattgactctaggctgatgataattttcggggcataccaac

SEQ ID NO: 2274 - DNA, 1501 bp, Oryza sativa
ctgatctgccatctcttaaaatgcacaccggtgaatttatccggtctcagtgcatcggcaaaaccagccatagtaaaatcacagtgcctataataaggtttttggattgttgagattatagacatataatgatttaatctattccataaataaatcatgatattacagatgaaaactagaatgaacgcatcattagatctatacatgtaaactacacagtataacatgaacagatcaaatatgcgcaacatattgaacacataccgaggtgacggaaagaccggttgcttggtcgaaacttttcgcaggtgtctacgaagacatgaaacacgcgagcgaagaggaaggcgagccgtcgcgaacaaacagggagcagtcgcgcgaagcgcttcctaaaaaaccttattgccgccttctcccggtgcaggacgtcaaaggcagaggttccggagacctgctctcccgatcgccggtgcacgccggcgagcgggatggagtagtctacgagcgacggcgcagtacagagtaggaggcaaaccctagattgatttcgcaatcgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacaaatccgaatttgcagcaaaacaaaactgcaaaaggaggctgcatctgcgcaagggtgaggagtcaatttttcggaccattcgacgcgtacgtcgtgcacgcgcgccgcctgccctacccgggcgaggcgagcgagcgcgcgcgtgtgtttcccctcttctctccaccacacatgcttcaagtggttaggaggacatcctcccttttaaggaggtccccctctcctagaataagtaaggtggtactaaactccacatgcatgccatcccatgaggtgggcttttgtgattttccaaagaattaatcttcgagtgggctaaggcccattcattaattccaacaccaaattgttactgatgtccatatgttactacggtgcataatggcataggctttcatatcctttagcttcacaggaatttgttttccttcgagaactatttgcatgtagtgaaatctgtttagctatcaatttgggtttatcgtgtaatagaagtggtaagcaattaagcatatcctggaataaaaatcaccattagaaattctctatccggctaagcttagttgtctatatgttctaattgatgcgtgtttgatacagatttttttgtctctttttcacatggcttcaaacacaagatgccagttttattttgtttgctggttagagaaaatcccaaatagcaagctgtaatcgaactgagccaaaatctagagcaaacttaacatgtgtagaaacagggcaggggaaaaattgcaacatgagagatgattca

SEQ ID NO: 2275 - DNA, 1501 bp, Oryza sativa
gcgttgcgggcggcgcggtactggcttcaaatggggatttagggcatccctcgatgatatatatggtcagtgaatcatctctcatgttgcaatttttcccctgccctgtttctacacatgttaagtttgctctagattttggctcagttcgattacagcttgctatttgggattttctctaaccagcaaacaaaataaaactggcatcttgtgtttgaagccatgtgaaaaagagacaaaaaaatctgtatcaaacacgcatcaattagaacatatagacaactaagcttagccggatagagaatttctaatggtgatttttattccaggatatgcttaattgcttaccacttctattacacgataaacccaaattgatagctaaacagatttcactacatgcaaatagttctcgaaggaaaacaaattcctgtgaagctaaaggatatgaaagcctatgccattatgcaccgtagtaacatatggacatcagtaacaatttggtgttggaattaatgaatgggccttagcccactcgaagattaattctttggaaaatcacaaaagcccacctcatgggatggcatgcatgtggagtttagtaccaccttacttattctaggagagggggacctccttaaaagggaggatgtcctcctaaccacttgaagcatgtgtggtggagagaagaggggaaacacacgcgcgcgctcgctcgcctcgcccgggtagggcaggcggcgcgcgtgcacgacgtacgcgtcgaatggtccgaaaaattgactcctcacccttgcgcagatgcagcctccttttgcagttttgttttgctgcaaattcggatttgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacgattgcgaaatcaatctagggtttgcctcctactctgtactgcgccgtcgctcgtagactactccatcccgctcgccggcgtgcaccggcgatcgggagagcaggtctccggaacctctgcctttgacgtcctgcaccgggagaaggcggcaataaggttttttaggaagcgcttcgcgcgactgctccctgtttgttcgcgacggctcgccttcctcttcgctcgcgtgtttcatgtcttcgtagacacctgcgaaaagtttcgaccaagcaaccggtctttccgtcacctcggtatgtgttcaatatgttgcgcatatttgatctgttcatgttatactgtgtagtttacatgtatagatctaatgatgcgttcattctagttttcatctgtaatatcatgatttatttatggaatagattaaatcattatatgtctataatctcaacaatccaaaaaccttattataggcactgtgattttacta

SEQ ID NO: 2276 - DNA, 522 bp, Oryza sativa
tttttagatgttgttgttgttgtgattctattattccttttgtgattcaatgatgatgattgtggttaattttgggggggtaaagtgtggttgattcgattccaagaaggaattagtatgtgattagtgacttagtgttctttgtgttcttgaatgttctttcattggtcggggtgaagggagcttcttggctcgaatcgagctgatgcatcgagccaactttttttttcgtggaatctcaaaggtacctgttgggaaaaccggtacctttgtgaggttcccaagtttcacctgttgtcttttttgtagtagtgaaagacctcctaggcaacgtcttcggggaggtcatgacaccttaggcaccaccgttgactatccatctggactagattttcacctggagagtcctgccaaggagtgggagggtggtagctcaacaacgccccaaggggcgatcatggcgctcaaagatgtcattgttgccagctcagggaaaccctgagctaagctttttcctgcagc

SEQ ID NO: 2277 - DNA, 1501 bp, Oryza sativa
  unsure (1)..(1501): unsure at all n locations
catccgcttgctcgtcgtcgagccctctcccggcgctcccatcggcgcacgcgtccaccccggccgctctcctctgcatcctctgccggtgtcgcgccgaggaggtgcgcggcgccgtggaggcggcgtggctggcgatagcgagtacgccgttcgcttgctaacccgccgtggctccggatggggagagagcncncgccngntgccgctccctccgtcgcgggcggtcgagccggccgcctcctctccccctttcccgcttcttccccgcgcgccgcagcgcccgctgcgccggcaaccgcgcccgctccgccgtcggccgccatcttcccgcctgcacgtgagagctgagaagttgagaagagaagagaaaaagaaaaaaaaaaaagagagttgttgggcccacatcattttctctcactgacatgtgggccccacatatttatttaaatatttttgctgactaggatgccacatcatcaaaactagccatgtgtactgccttgggaccaaattagacggttttgtaaagttgaggggcgaagatttctggttttgcggttaagggaacttagaaaatctcgcatctccgtgaacttatttcctgatttactcctgtggtccgcccatccacccacccgcgcaccccgccggcgacaacggcaatcgccatggctcgtcggcgaatcgccgcccatggtgaaagcgcggcgaccggttaccggcgcagtgccagccgagtgctggggttgccgaggtccaagcggcggcagaaggcgggcggcgcttgggattgggaaggaagcgggccgtcgcggcaactagggcttccgcggctaggaggtacgtgctcattcacccgtctctctgattggtttattgtgggattttgggctggattaggctgcgggagatcaatctgtgtgcatcccctctccaccctgctcttgattgggcgaattttgccctggattggattcacgcctgatttggtactaactgacaccaaatccacttggtttggtctgatgctagttctgcaaatcgactgagctctggtggcttgaactgtgctggtagaaatattcaatttgaagaattaagaggaatgtggcgaatgctaacaccactaactacattgattggattagaaaacaacacaaaagctacaaatatgttacattatattattcttccatacatgaaattgccaaatcttaatttgcctcatttgaacactaactacattggattagaaaacaaaacaaaagctacaaatatgttacattacattattcttccatacatgaaattgccaaatcttaatttgcctcatttgacgctcatgtttgaggctgcatgcttgattcgaagaatcatgttagaaacttgccccatttctggccgctctctaggcaatgccattgaacatgagaggcctattttaaccaatggaatgacacacctctccattacatcggctacactgacatcatcttgt

SEQ ID NO: 2278 - DNA, 1501 bp, Oryza sativa
tttacatgggtatctataactctctcatgcattgcctcgtttttctctatagactatccctaagttagtgatagctttgctctctctcttcatttaatatcttccatgtaggaaaatatactgacatggatctcttatagagagcctatagataaccattgtgggtgcccttatgagatggaggtctcattgtcttgaaagcgagtcatcctccttccattctcttccgtccgtactatccacatgagtaactaccggatcaaatgttttatctccgaaacgtatcctatgcataccagcattctcatgtacacaccgtgcacgctaacttaaaaatatcatatttttttaagaaaagattgtatatattttttgtaatattatatttatgcgtaaagtctcatctccaatcaccttgtagcacattcttaaatttgtggatctggttagttacagtatggacatgctacttaatctaagcacactcttttgaggtcagatgtagcacttgctaaaccggatcaatcaggttaattaagcagcaacatgacacattccgtttggctgtaaagagtgaaagacaagtgaattgaaagttgagtggatttggtgagatgccatcccaagcatgtgtcggttacgcatcgatcgggggatatatggaggaaaatcattagagaaacggacggattaggcttgatccgtttggctgtatctcttgtggaatgctagctagtggtatatactgccaagtgaccaatggtattaatttgtgtacataatttggtgtgaatattacggcctctggtttgaactattacgcaaccctctcgctacacgaaatagtccaaaaaaatcccgtaattttacaaaagtggagacacaagatatgagggtgtggcatcatttctcattcatccattgcattctctagtgtacaatcctcctccctactcctctatttatagacattccctcttccaccttccatgtttaatgttgggcccaattagtgggtaaccgggctgggccttcgtgggccggcggtttcctaacatgaactattcatatgcatcacccactgatttttttttccttggaaatgaagatgcacagttttattttaccaggacaaagttgtacaattccagccttgcttgttaaccaatttgtattgaatttgttctgcattaaattagcgggcaagcgtaaaaatgctctttctgaagtgtacttcacaatttcattgttggagcttcttttaagggaatggaatcaaattcattatggtactttgtgactacagttgaaattacatgtgaaagtagtcgttaccaaatgtactttgactaattactaaaagaactattgaaattaagattgagcggctgcaaacataccaatgaacatgcccctgcagtttcaggccgtactggttgcaattttaaaatgctcgatcgctgtgcgttgaagaatcaaagagtatcagaaacaaccaatc

SEQ ID NO: 2279 - DNA, 1501 bp, Oryza sativa
ttctgttttggtgtcagctagctcgtgtagctggtaaacccagaattactcttattttcattatttcactatttatccagtaggcatgtatcatctaatgctatatgcatgcttatatatgaaattttaggtgatcaatatttacacaagtttctaagtgaacttgaaaaaaaggcacttcatgaaattttagttcaggttcactaatcaccaataatgtagattagaaaatcaagacgccgtttggcgcgtccactaattagcttgggtgtatggcttttaaaaaccatatagttaatatactaatatttcaatttttcttttatgattttgagcattatggtgtttagatttgacataaaactctaggtataaatccaacaccagaattaatatttgttttattataattgtagcgtaaagatctacatattatttatttatagtataagcagaaaatacatatatttagaaattggttatcaggattatagagtttattgtttatgtcatttagtttttctatttattgcttttagtttctccaaatataggatatgtggtcacgacacgtggaacaactcttctcttgtttttctattcaccgttgtaactgaacgcttgccagttttatagggagggtttattaaccggctctcttttcgacgcttgtatgtcgtcacgtgtcgctcaactaaagaatgttgagggcaacaatcagctggcataaaaccaaccagcatgggattgatagattgcaaaggggaaagatattttgggaagcctttacaatctggatgttatgccttctatttgcttctcggcattccttttattatggatattctctatatttatctttaagagatagataattgagaagtctttaaaaattggatttgtgtcttttattttcttttggctattttctcttatgcatgatttccttagatctatttcaaaatttaacaccgtcatgtgacccaataagatagctcgagacaagccagcttgtggagattatggataccccatatctacatgacggttgtaatttagtcggatatacggtatcaaatatagatggaatatctctatgaagactcgggttaggttctaaacttgtatgtcaaggaaatacccgggatcttagtcggttacgattgtattttatctataatcccatattccgttaggatatggactgtattttgtaaagcggactccttcccctatataaggagggtccgcgtgcctcttgggaggtgattctttttcccagtctatacaattaataacacactcggcggaatcatccccggacaggagtagggtattacttctttaataagaaggcctgaacctgtataaaatttcttgtctccaaacccatccattttcctagcttgacagccacccccttttattattgccgaaatcttgcttcgacagttggcgcgccaggtaggggtagcgtcaagttctcgccgactaagtgcga

SEQ ID NO: 2280 - DNA, 1501 bp, Oryza sativa
aacacatactgccctctttgccccctacgttagaaacatccttccatctactcacgaatgtagatacacgaggaaaatctaagacatgctgacaacctagatctcgtgggaacaactcgaacaagtgaagcctattcattgaaaaacatgtacaaacatacatgaatggggggaggcgctcgcaacttgccttggggaacccaagcaaggagtttgctccctcaccctcctaacaaacttaggaactatggaaggaaaatatccataataacctccgttgaaaatcaaggaaaaagcaataacttagacttttgcaggggtgaagcgtcaagctagcatagattttactctaagcccttccttgtacaacccttgtttttcatacttgtacaatataaatttttacatgtgttatatatcagtaaaagttgtcactaaattttactattagagttatcgcacgaatcatgcaatttttttcttgcagcacaatggctgagttgaatgctgcaagcttgcaacacaacatgtaaaacttggaagtggatttttatccctcgagagaacatcacatatgttttgtgcatgtcgttcaaaaagttatcagaaaatttaaaaaaatttatcaagatagataatatatgatatatcttttcgcaaacatgcgagttaaaattcgacttatacaattcgaaacaaaaataacaaatttgaccgtaaattacgtgttatattcatagtcaaacttgtttttttttctacttgggccgagtttagttccaaaatttttcttcaaacttccaacttttccattacatcaaaactttcctacacacaaactttcaacttttccgtcacatcgttccaatttcaaccaaacttccaattttggcgtgaactaaacacacccttgtataagttgaatttgaatttgtatgtatgtgaagtgatatatcacatatttatctatcctgctaattttttttaatttttaaattttttgatgactttttgagtgcatgtaaaaatgagaggatatccttaagggatgaattaagttttccgtaaaactccaggtatgaacggcttggatgccggccaaaccaaaccgtcgttgttcgtgtgctgttttgcagccgctgtacgagatggccttttcactttccagcataaatagaagccgtcaaatgccggcgtgcgccagtgcgtcgtcggacggcaaccccccgaaagcaacgtcactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtgttggttaaggtttctatcttgtaatcctgccccccatcctatataaggtgggcaggaggccctctagggggca

SEQ ID NO: 2281 - DNA, 1298 bp, Oryza sativa
ctgcagcccctcttgtttttttagttttataaatacaagtagattttgcatacaccatgatgatactaggattaaatggtacaaacatttctcttattctccaattaacgtggtactccctctgttttaaaaacggcgatagtaattttaggcccctcagagtaacagataggtaaattaaaggaagccactcatagttgcatacttgcactagtaatctccataagagcgaattttagattgaattatttgatgagctaagttcttaatttaaaagacagtatatatctacccttctctacaaataaattgcactagtaacaagtaacagcaatacatacttttccaatgattgagaagggcagatccaaattattaagacaatgactacaaaaaattgacattacattttcatgaaaaattttttgacaatgtcaaatctcacgtgccataactatttacttccatttataaaacaccaggcttcatatttttttcaaacaggtaggaaaaacagtattattgcattcatatttaaatataaatatataacagtaattttacttttcaccaccttttattactgacattttgctttggattaccgtttaacaaatattttgaactttggattaggtaatcttaccttcgttacactctgggccatattgactcacttctcaagcatataaacgatttcgaatacgtcggctcttactcgtcaatgaactcctatagccgtatgagagataatttctttactataatacaaactggatatatatatatatatatatatatatatatatataaagagttaagggtgatccaaagtgccacaaaaggtaaaattatccggtttaaagtgaaaacattggtaaatgatggttcaaagtaaaacattgataataaaagtggccccaaagcgaaattcattcaatatatgatgatgttaatgtcatttggtatgtggcaagcaacttatttgaccactccttttcaattagaataaaacgataatgtctaacaaaattataatattgaaaagtacttatagagataaatctaccatattatttatatgtttttaaactaaatattttgagagctgttgattatcaaagttttaaaaatttaaccaaattagtcaatagtgtcacatatttaaatacaggagtagtatttacccggttgatgcgtgtagatcgacatccctaaagagaaagttcattccaatttgtggtaccgtaattaaggcaaataacatcacagaaatgggagaggatgcatgttcaaga

SEQ ID NO: 2282 - DNA, 721 bp, Oryza sativa
tctgttaagcagtgtgcgcatggcgtatgcccaatactttagaaatttctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatacgcttggtttgttcaattaaccacattgtcgggggctacacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtgttggttaaggtttctatcttgtaatcctgccccccatcctatataaggtgggcaggaggccctctagggggca

SEQ ID NO: 2283 - DNA, 430 bp, Oryza sativa
ttttttctgccaggtgtggggcccgggcccaagttgctccacacctggctccgcccctgactacaaggaatttatttggtgatcttttttatggtgaatgtgattaatacttttggaagatttttttttttgcacccgttgcaagtttgtgaaaatcctgtcaaaaatctatcagtgtttcgttaaatttaataaaatatacaaatcttgttagaaaagtatgggcaagtgttaaagcttgtatatgtgtttttataaccgagttgacaccgtcaaagctgtgttcggaagggcaatattccaacaaagtacgtggttatagtgagattaattaattattagcctaaaaatgatagtcagattagttacctattagcctaaaaacttgaaaatagattaatataattttttcaacctgctttcacataga

SEQ ID NO: 2284 - DNA, 1501 bp, Oryza sativa; identical to SEQ ID NO: 2279

SEQ ID NO: 2285 - DNA, 1501 bp, Oryza sativa
catgcaagaaagagcacgcagatcttgcgcagcaacctacgctttatttagatatctaattattagttagtatcaccaattgctggggttcaatatccacttgggacacactcacctgaatcgcctcagctaggcgtacggcgccggaggtgaaatcaccggcgacatgcggacgatcgaatgatgtacgccggcgagcgatgacccgcacccgaaagggaggcgaaaaagaggaaaagtagtcgtcatgttgccggagatgaggttaggcgatggagctctgtcgatggcggccgcgatgcgcatcccgtgagctgctcacaggcgcgcgcgcgcgattaatttgatttcgacaacccgcttgatcaatcgatccccatccaatccgccgcaccatgtgcaagcgtgtgcgtgcagtcgatctctgcagatgaaaccgtaatccgaaaagaatcaagataaatgtgttcagacattaataaatcctttttgccacttacttaattggatgcatggatgaacagatcgaccatttagggtagagacgattatgtgcgtgcacgctgctgtatgtgacagttgctggtatcctgaatcgtactccatgcaacagtagcagtaaaattaatcgacgagaaagttaacctgcttggctgcccatttggccgcttgaaaagatccgctcctgtgctggatcgatccggtgcacttttctgggaaaaaaaccgcaacacagatcaggcgaaatcatgcagcatggagatattttgatcgcttttttccgcgaacttttaacctgacattggccatccatcccccaagttgctctcgagctcgacggcgcgggtgtggttcgtcccctttggcgaagatggattggttttcgtggggagattttatccagtgagagacactgtgcgcgcacactggacctgagccggaccaacccgagacctcgattgcttcgggcggctcgtgcctataaatagggccaggtggtaggcctagcagcttgcgattggtgtgcacacacattagacagcttagctcattgattagcaggtgattaaagtagctttatttaggaaaggaaagttcgagagagagagagagagagagagagagagggcgagatgccttggcgtttggctatggctaggcagcaggctgagccccccacggtaagagaagttcaacagtatagctcactagtaactctaatttatctatagccaatctaatagtcaattcatataatagttgtttactatactattaatacatagtcccacctgtcatacacacaccatgttttgaagtccgtgctgcagctggctacagatttctagcccgctgctcttctctctcctctattatctcataaaatatgtttctagatggcttatagcctgctattgtgcctgctctaatgaccctcttcaaattcgagctatcattgatctgcacgtataatccatcattatactgtgttacttggtgt

SEQ ID NO: 2286 - DNA, 1501 bp, Oryza sativa
aacacatactgccctctttgccccctacgttagaaacatccttccatctactcacgaatgtagatacacgaggaaaatctaagacatgctgacaacctagatctcgtgggaacaactcgaacaagtgaagcctattcattgaaaaacatgtacaaacatacatgagtggtgggaggcgctcgcaacttgccttggggaacccaagcaaggagtttgctccctcaccctcctaacaaacttaggaactatggaaggaaaatatccataataacctccgttgaaaatcaaggaaaaagcaataacttagacttttgcaggggtgaagcgtcaagctagcatagattttactctaagcccttccttgtacaacccttgtttttcatacttgtacaatataaatttttacatgtgttatatatcagtaaaagttgtcactaaattttactattagagttatcgcacgaatcatgcaatttttttcttgcagcacaatggctgagttgaatgctgcaagcttgcaacacaacatgtaaaacttggaagtggatttttatccctcgagagaacatcacatatgttttgtgcatgtcgttcaaaaagttatcagaaaatttaaaaaaatttatcaagatagataatatatgatatatcttttcgcaaacatgcgagttaaaattcgacttatacaattcgaaacaaaaataacaaatttgaccgtaaattacgtgttatattcatagtcaaacttgtttttttttctacttgggccgagtttagttccaaaatttttcttcaaacttccaacttttccattacatcaaaactttcctacacacaaactttcaacttttccgtcacatcgttccaatttcaaccaaacttccaattttggcgtgaactaaacacacccttgtataagttgaatttgaatttgtatgtatgtgaagtgatatatcacatatttatctatcctgctaattttttttaatttttaaattttttgatgactttttgagtgcatgtaaaaatgagaggatatccttaagggatgaattaagttttccgtaaaactccaggtatgaacggcttggatgccggccaaaccaaaccgtcgttgttcgtgtgctgttttgcagccgctgtacgagatggccttttcactttccagcataaatagaagccgtcaaatgccggcgtgcgccagtgcgtcgtcggacggcaaccccccgaaagcaacgtcactgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtgttggttaaggtttctatcttgtaatcctgccccccatcctatataaggtgggcaggaggccctctagggggca

SEQ ID NO: 2287 - DNA, 1501 bp, Oryza sativa
tcagacaacctaagctcagtgttaccagtgcaaaaatgatcatgaaatttttgttctaattgagcccaagtataaatagaatttgccggtaaagaagtaaaccatgtaaaagcagtaccggacaaagataaagaaaacaagcgcaatttaaaagtatcactattagcctcaccacattgcgctaaaaattgacctacatgctcccatatggtccaactatcctcagcactaaatttggtaaattcgggaactctataaccacgaggatatggcacattatcataataattaggatacgacttttggtaaatcttagcatgattcctaatttcaatcccgaatttctccctaataatctcactaattatttcctccatattatcaggcctatattgatttggtggtggatttggtggcctaataggttgtgtttgtggcgcaatatgattatattggtcttgcctagtatcgggaggatatcccctattagtatcattgtagacattagggatatgtggagtagcatgggtaacagtattaacaggtgatgaataataattaaaatcaatactgctagtcgtggtatgaaaacctggagaaattcccagggaaccggtctgaccggctatagatagcctggtctgaccggccaatcacccggtctgaccgacccatggcccggtctgatcggtggtcaatggtgcggtcagaccggctacaggaggcccgatctggccaaaatagggcacggtttgactggctatagtagatacggtctgaccggcataaggtgcggttagaccggtgtcacgaccggtcataccattagctaggttttccatatagccgattcctatttaatcggctgtataatcacccattgacccccatagcattataagcatattgtataggagcaaaactaaaagtagcatatgcatctacacaatgattattaaccttttgaatagcaaagtatgggttgggtgaatcggaggttacctttggtgaagctacaacttgaggtagcgggacgtttcctttcacgacgccttgatcggttctaatgtattgtgtagtaatattattgaacccgttccctctcgttatagttgatgaagaaattccttgattaaatccggccatatagctcatagccaaaaatcgttgacagaatatattaatatacagtcttagttttccttgtaatgctactgtacttagcaaaagattggagaaattgaaccttcacagaaataaccgatacagtaggaatcggctttgttgttgttgtttttttttttgttgtttttatgtgaacagaagtagatcggcttagatagcctgatctttttttagcacgtgcacagtaccagctttgatcaatcaaatctttctgttgccgtgtgaagcaaaaaggaaacaatgttgctaatccggccgctgctccctgtgtgaacacagtttaacgtctagccgtgaccgaacagaacaattaagc

SEQ ID NO: 2288 - DNA, 1501 bp, Oryza sativa
cgtgtgtaagacttgaggcgtgcgagttcacgtcgaagtcgtggagtctgagtctcgcgcggcacgatctgacgtgtgggatggcgcacgtcggtgcggatcgtgtcgtgcgcatgatggtccactactgccgatttactagcgttgtttccaaataaaaggagatgaatataacccagaaaagctgctgaaggtgttgcagcgccaattcatgtgtgttcaagttcagaggcattgttgagtgttttagtttgagagttgcagagagatcgaggacgccgggattccgttcaccggctaacagtgcatgagatagagaaggaaggagagagagagggaggaagaataaagagagaggatgatatgtgggcctcataattttttagatgacaaatgggtctcacatatatgttgttaattctaatgccacctaagtgtcatgttaactctacagactaggtcaacactaacacatagatgccgcgtcagcgaaaccgctctccaaaaccattgagggagttaattgtacaggttttaataaataggggtcgagatatccggtgttatggtttagggatacgaattatatttgtttatatttgttcactggttaagggagttaaagctagcgggtgtgctagcagctgattggttcatttgctgtcccttcgttttactgacacatgtccatgcagcattcggggtagggcgctcctaacgtgactcttctcctatcgcgagcgtctgctgttcctgtatttagatatctcgcgtacatgtatacgggtccaacgggagtagcccctcagctagcaacttgggcctatggtcatgagccatgccaatgcttgcactatgcaggtcgagccagcttccacatacattcatgtcctgaaccgattgactgcgtgcctccgtgcatttgagagtattgttggactacagcgtaaaaagaacagcgacagatttaagcgtattagtctcatacaccatttttagtgtaaaatacacattagttcattattcaattaaatcaaagttcaatatcaatgtgttaacggtaaaatctggcagtggggttcagatagaagggaataaatcggtacagtattttatgaccaagcatgaaggatttgagatcaaattgcgcgtcggatggaaactgtatcggctgaaagcaaaagccaagagtcggattgaccaggacagtcaacggccgattcagccgatacagcacagtttgggtttagcataagcccagtttggaataattgatattgccaaatagagataaggctcattgaagccaattgtatccattaattaggttagttacgacagttttgttagttttgtcaagagacggccgtgaaaggtcttgttcgtatggtttgagtcgtgtccataatgaacttattttgtactcggggtataaatataaactgttagggttacgggtaaggtataccctttacctttcggtatacgtcacatatcgata

SEQ ID NO: 2289 - DNA, 1501 bp, Oryza sativa
tccatggtcccgcgaccggggagagcgcccttgtcgcgtcccaaaacgactctaaaatacatccccgaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattaagaagaaataaacaaagttaaaaaggttttataaaaagaaaaaccctaaaaagtccttttccccccctccccctcttgggccggctcggcccatctctctccctctctctcctctcccccgcggcaaattcggcctcctccccgcgcgcgtgccgctgacgggcgggcccgcccgccaccctcactgacgggtggggcccacccgtcatccccttcctcccgccgctcccgccgcctcgcccgtgccctagcgccgccgccaccgcgaatcccgccgcctcccgccgtccacgcgcgcaataaagtggggggaaatattccccgtgattccctccctctttccccccatttttccctccctctctccctcgcattcgtttggaaacctctcccctaacctcgccggcgccatcaatggcgaccggatcttccgcgcccgtttccccctcgtccggcagctccctccccctcccaatcctatataaaccttccccgtgccaccctccaccgtttccgccactcgccgccctctctccccgtcggaatcgagctcgcgccgtcgctctctctctccgccgtcaccgccgagctccggtccgccgctgtcgtcgccccggaccacctcccgcctcggcgtcgccaccttcggcttcaccgcatccccgacgacctcgtccacccctccgtttcgctcgccgaccgccggagcaccgtcgaccccgtccacccgagccgcgccgccgccttcctccgctccggtcgccgtttccgtcgtcgccgtcgacccggggtgagccgtggaccgccgcttcttttcccccttcccttcccctctctcggccgccgctccgccgtgcctatggccgccgccggcgaccataggggcgcgggcgcgccgcctcccgccgctgcgccggcgtggccgccttcgggcgcaccgtgcggctgccgcgtggggcccggcatcccgtatatatgtatatacatagacacagtttgattattggtcttactatttaaaaagtaaagtgcacgggcggtctctaaacttgtatgggtgtatcaactagatcactaaactaggtcactaaactctcaaaatgaactttttagccctttaacttgtctcgtgtgtcatatagatccaaacgggttccaacccgccccgtgtgctgacgtggcagccatgttggcacctacgtgtcaatagaactcatatatatgtccgccacatattaaaaaaaaaggaaatatttttcccctttctttttt

SEQ ID NO: 2290 - DNA, 1501 bp, Oryza sativa
tcgctagctggtaccagcggcgccccaacctcctccgccaccctggctggccgccatggcacccggaacagcttgactctccgtgcgccggcgtggtcggccatgtgcttcacatccaccatcgtctcttctcctctcttgctctttgcttggcgatgagaatgtaagatgtgtttaagcccgtgattagtgaagactaactaatttgagccaagggcaacctggtctttaatgattgtttctctctcatattcctctaaaaataataaaataatcctgccgggatatcccctagctaattacatgtttttctgacgtcctgtagcaaattttgccaaaacaagaatatgtgatttaaaagatataagttattgaagaggttaaaaaaagacacacactattgtattttttatgttgaatggggatttatactggatggagtgatcacttgacaaaccggtagctctctagtcacgtccataaatttaaatgattgatcagaatccaaacagtcattttaatactcttgggttatatgcatgcatatactcagtggtattcattatgtgcagaatgaattaatttctctttggttttggtgccacaagtaataagtcaaacattttgaatagagggagttacaagtaccagacgaattgaattgaataatcttcatctttgaccaaaaaaaaaaagaaacaaaatgtcttactataactttattaggcaagccgattaattccgtagaaataaattattcctcgttttaattcagattagtatcacttgtacagttctactcgcttgaagtcgacacttctgtttctcttttgtcacacgcacacccacattagagcgtcgcctcgccggctcgcggtgtcatgttcgttcgaattttgcatcgtttttcagctggttggatgcagaggctggagaagctcggggaagggctggtcgcctggccggacgacgtgcacatggccgtggcggcgacaagggacaaagggatgcaccccaaagggtcgtgggaacggtggcgcttcatcggcggcaacggcctgccgaggatcaggagcggagctagaatgatatggagagggtgtcacctgtttaatttactctgttttatatgtgggtatctaaatttatattgaaagggtatatatattatgaaaatagatcaaatatagctataaattttcttgaccgggtttttgaccaccgtcctcaatacttagctccacccctgccggggatcttcccatccactgacggcggcatccatgctcctctgcgactgagacacgctatggcatcatggcacggcatgagaacaacaaaaagtctcgtgctctcgctcccagggtcacaagaccacaggttgattatctaattctaactaattttaatttatgttgtattaattagcatatcggtccataaatagataatcagtaggatgtctattttttaagaaaaatatttttagctaataatcata

SEQ ID NO: 2291 - DNA, 1501 bp, Oryza sativa
agttggttttcggtggagtgtgcaataaaaggttatgtcactaaaggatgtgctccaagtataaacataaaaacatcgagacatgatgccacgagaatcactacacagtaaggaaagcacggggtggtgatagagtcattagtgagtgcatgactttacccattagggttcaaatcttgctacccataaatattacgcgtacgtaagtaaatatcaataggatttagtgtgatcataaatatacagccagtttttatctctctgagcgtgtgtgaagagacgcactcgtggaagtgtgagcgtggtgttgcatgcgcagtggtgtgtatcatgtttcacgtataatggtgtgtccgccgtgtaacggaaataatgtaataagaaaagaaagaatcacagcacaataaaagtctcgagctgtaaccacactatgttgacaagggattggacaaaaactcctgtgaccgaacaccacccgggctggggacgaaaaaataatgtgattagatgggagcgaacaaaatcaacgagccgttggtgcttttgctccgctaataatgcaaaattgcaatttgcaaccccaccatgccatttgcattgcccctcgcctgtcgctgcctgcgccttgtccagccgtggcgccgagttgccgaggaaaccgatcgcctggccgtgccaccgtgccgggtccccatcgccaactcgcgcccaatcccggcttgacacgtcacccctgtaggcgatagtgcccgccacgtcctcttcctctcctcctccccccgggatctcgaaccttctttcccccgcgcgcaccctccaaccccactgaccccccggccccaccctccactgtccccacctcgtcagtcaccgcgaggccacgtgccaccaccgggtgagtgtgacttctgacaggtgaggccacctgccgctgggcccactggtcagtgggtgacggcgccagctactagtggaggagcctctggatccaagcatttttttttatttccggagcccctctttagtctttacttgcgtgaagaaaatttctcctgctcctcctcttcttttttattttttatttttatttttcgtcctcctttcggttcgtgctcgtgttcgtgcgttgatgcgcttgcgcgagagcgtataaatcctcgcggattttcggatttggagggattcttctccgcttcccccgccctcaaatcgcaccccggatttactcccccaattcctcgctctgctctgctgctggattagtgtttcttggcgggatttggtgagcgattgattcgattcgattggattcgattcgatttgatccgccggaggggagggggggagctcgccgcggagttcgtcgccatttcgatccgtacggcggcgtcggggtcggcgtcgtccttggatgattccgatcgatccaggggcaaggccgccaagatttcgtcgggcggaggcggggatcgcggcgggaggggtggatccatggcgacgg

SEQ ID NO: 2292 - DNA, 1501 bp, Oryza sativa
cgccggccggagcggagggtcggcgcaggcgaagggtcagcgcgagcggctcgccgccggccggatcggaggggcggcgcggggggctcgccgccagccggagcggaggggcgcgcgaacggctcgccgacagccggacaaagtggcggcggcagcggaaaggcgacgcggccgaaggtaccttcactcgatctaccttcactgcttcacctcttcctcgatctcgatccggatggggacgggagaacaaatggcagcggtggttgcgggatggcgtgaggagagagaaacaccaaatctagcgtttctctctccgggaatagcgcatgcgccatctatggaggcccatatggcgtatccgttggagccggattttctccccccatacgccatttcctggatggaagatgggatgccggaactgctgggatgctctaaaggccaaagtcaatgtgctaaccatttttttcgtttttgcctccattaattccggtgtcccactgatcggttttcaacacgcttgtctgcaagccccagccacagttctgttccctttcacgcccttttctcagcaaacacatactacaggcgtacagccgcacaccctgagaaatatatgctccaacaagtcctcctcaatatacaaatgaacctgatgacattatttggaggggatcgatcagccaaatggggaataatactctgcaagacgtacaaatacaacatgcgatttcaaggcacaatcaagttacaacaaattcaatgttctctggcaatctgaagcccaaccgaaacatgtcagactcgttgggtggctcctgactcatcaggcgtacaaggtcaatcaattcctatgcttgcttcgtttcagaaattcttgcatcttacatccctcggtcatggtctgtgcttaaaatcagaccgatttgcttttggagaaggaatgtcggatttgatcatactggaaactagactaaaaattctgtctcctaactgaagttttcatttggacctgaaaccatttcttggtcaagaaaaaaaattggaacaaagtaaatccactgcattggtgtgaggaaagaacttccagtgttttgcaatgttttaaaaggagttcacttaaaataatatacctactaacctgcgtgttgatggcagaggcataaaacaaccttttctgtctgaaatagttggcagggatcatttctcagtccaaacgctccagcgttgaggtttgaccaacatgagaagattattattcagatagcttatcatacttctcgaggtttgtttcaggctaaacacgatgtcgtcagttgacatggacttagtgattgagacaaagtgcccacaccaccacgttaacttgccaatctgcgagctgaactaatcgctggtctgatttctaaacaacaacagaaccggcttgcagaatcgtactgtgtgtgagctagcttcaataccattcctccttcagttctccacttctccttcccttgtt

SEQ ID NO: 2293 - DNA, 1501 bp, Oryza sativa
gcccgacaggtacgcgccggcgacgatccacgcggcgcggccgcggcgctccgcgacgtacgccgccacgccgtcggccggcgacggcgacggcgaccgagacgacagcgcgcgggcgagcacgatggcgtcctccagcgcggcgcacccgccctgcgccatgtcgggggtcatcgggtggaacgcgtcgccggccaccgtgacgggcccgcgcgcggcccggcccgtgaggatggcccacggggcccggtagagcagaggggcccacgtgaggttgtccgggtccgagtggcgggccacgtccaggaactcctccggcaggtggcggcccaggttgtcagtcacctcgcgtaggatcttctccggatcgccggcagcttctctctctgcaaaaaaaaaataaattagaaattactaacaaaacagtttcaagttttttctgtagaaaacgttaaatgtaatttaaaatataattatagtatggtaacagtgcatctataatgtaatgacatacatttatatatattataatctttatataacttacgtataaagttgtatatattggttatgttcggacgtgctggttttaaccgtttgtgacaaatgaaattggttacacgtcacaatcagtttgaattgtcatagccgaacacatccaattttttaaatacttatataaaagttatattatatttatagtatagttacaatgaaatgatattgtaagcatagttagatttaaaagttctccacttaaaaaaattgcaacaacttaaattcccaattcataattaagcacatttgcaacaaacttatcatcaaatttgaacaaatttttattcgaggcatttgggctggcttgcctgcggggacggtgttgttgacgacgaaccagtagatgtcggtgtcgctgatgggcaccatgccggccctgaggccatgggagaggaactgcctgagctccttcctcacgccgtggccgccggggtacacggcgaggccgcggacgcaggagcggccggagctcgccggctccgccatgcccagccaccgcgccaccgccgagtgcacgccgtcgcacccgaccagcaccctggaccggatcaccgtgccgtcgtcgagccccacgacagcgagctcctcgccgccgccgccgccgccggcgggctcggtgccgatggaggcgagcctggacgagaaccggatggtgcccggcggcagctcctccgccatcgcctccagcagctccctccggtgcaccggcctcaccctcacctcgccgctccttcaaaaatttcagtcgagtcgagccaaatcgcgaccggttcaaatgatcaaatcacgaattcaaaaaagttttaatttgcatcaattcaaacctgctcttgtgcccaccaaaccgaaacacctgcgtcgctccggactcgaggttggtcaccacggatctgcgcgcgttcatcagcatcagcagcagcagcaattcgattcgattcttttt

SEQ ID NO: 2294 - DNA, 1501 bp, Oryza sativa
agttttgtagctacagtaacatgcattctcccattaaatgttggccggtcaccaaaacggaatcgagcttcatgccataagaaggaagccggccggaagcgtagtaaatgtgtacgtgcatccatggacttcacctgtagtgctagagcgtacggtgagaaaaaccgggtgagatgttttttttttttgcgatgaacagggatatattactcatgctcagcacccaacaggtgagtgataaaattataagccagaaagtggttagagcctcgctacgccctttataagccagggcatggctgacactattttggttacggtgaatcttcatgataacaatatctctattcccagccatgaggtgccaatatccctattcccaaccatgaggtgctttatctccctagctaggaaaactagctctgatcgttcctcctcctttgactggatgagttgaattgcctgtaagcagtcagattctatgatgagatggtaacagcggcgaatctagaaattttaatttgtaagcctgagcaagcctaagaagatataatcatgtatttccccgcaaaaaaaatataatcatgcatataaaatccacacaactacatatagatagggttatatcgattaatatatatagtatgggagacttaggctgtgtttgagaaaggagagatagagaagattgggaagatacgcaaaacgaggtgagctattagtgcatgattaattgagtattaattatttcaaatttcaaaaatggactaatatgatttttttaaagcaactttcctatagaaattttttacaaaaaacacaccgtttaatagtttgggaagcatgcacgcggaaaacgatgtgtaatctatctccagtctcccagaacgaacgctgccttaatatattgttgcgttagcctctaatcactttgctaattgctttattaatcaagcagggtacgtgctagtacagagggcggagcccgggcaagtgcccgtacgtggttccacttccgcccctggatgtacacttgtacgtgcagaaagctggctgcccatgcgtaagattgctcatctccgctagctttggctaatcgcccccacacgcgcgcgcccccgcccgcgccgaagccacaagaaacgtgtttgcatgcaaggccaggccaggccaagcgaggccgcgcgcgcgcatcagctcgcgacgcgagccacctgtgccgctgtgcgcgcgcgccgcctggcgccacgcacgccatgcacgcgcgcgtggggtggaagggtgaactggagaggagagcggcgtcgcactcgtgaaaaccgaaacggagacgagacgggacgtacggcttggctttgcctactactgctgctgctgctctgctctctcctctctctcgtgagcaagcgtagtagcctcgctctctctcgcagccgcgcgcttggtgggagggggggattggggatgatggggagcgagtcggggagggcggtggcggcga

SEQ ID NO: 2295 - DNA, 1501 bp, Oryza sativa
agcatcgacggtgttggtgtcagcaaccgggagctcggcagagtggcttggcgggaacagggagagagcagaggtgaggaagcctcgccgccgcctcctctcctctctccttgcctcccccccggtgtcaccggcaacgaaatgcgcgtcatcgttgtggcagggattgaggtggaggcggagaacaaggtcggtgttgggaaggagagcggaggagaggaggcaacgacagcgatatagggagctggtgaacatgagagggtgctgagccagcatggggagtcgttccctttgccgagatcgacgccgccgtgtttgcacgccatttgcagtggatagctcatccgctgacctagccgtcgaactcggcggcttccaccgttgtcctcgccctctaccatgctctgtctcgccgccgctgccatccactgtcgtctgccggttgatgccattcaccatccaccttagaaagagaaaggttaaagaggagaaaaggtagctgacacatggaccctaaatttatttttattattttattcattgacatgtgggtcccatttaaggtttgttttaattttagtgccatgtaagcatcacgttgatgccacgtggtataaataccaagtcaacccgccgcataagtgtcacgtaggacgaaaccgtctctaaaaccacttggggagttgatttgctatggttttgagttggaggatgagctatggttttgaaagttggaggatgagttatacccggtttttcggttgagggatactattcaaccaggggtatgagatgagggaagcaaaacagacttatttcgatactcttatggcggatcaatactatatcattagggagtttgggactttgggttcgggcgcagcacggcagtaatcatcttcctgatcatacagcccaagggaagaggagcccatgtgtaatcccctagcccaactaaccggccgggcctttgttgggcttggcatagtgtgatgggccagaccagttacgaccaaatccaaccagggccctcacatcctgttttgaacttaggcaggtttagcataattttctcgtaccctcgtagtatggtagtttgttcggataagatcacaagactgcatggttcgtggtgaatttgcatacaaggccaacaaaagaggaaaataaaatcatgcgagtagtctctcatgctaatgagccgtttgtgattaaaaaaaagaaaaaacaaatatcgatccatatggttcacgattacaaatgggaggttaattttctctaaaaaaaacgctatcatatactccctctgtaccaaattataaagcctatattttttatacagtcttcaatgacatattttgaccattaacttatgacatgttatatttttaacaaaaatagaatataaatctagtgatataacatgtataatatttatcatatatatggttagtataattattacacaaaattatcaagtttaatttttcttaaaaagagc

SEQ ID NO: 2296 - DNA, 1501 bp, Oryza sativa
cgggggagcggcgcggcacggggcgcgaggcgacgacggcgacggctcggcagtggcgacgtgacggcgcgcggcgcgatgggacggcgcgacgggatggcggcgagcgacgcgcaacggcacggcggtagcggcggtgcgcggcgcaaggcgatggacggcggcgcggcgacgcgacggaaacgacggcgacggcggcgcggggttaggggcggccaggcgcggtgatggcgacggcgtcggcagaggggaggtggagcggcgtgcggcgcgcggggcgcgagggcaacgcggcaaaggaggggctagggctaggggacctcgtcgaacactttaggtgcaatgaacagtgccgttttctaattaacccgattttggcccatttattatttaaatttgattctttaattcccaaattttgcataaatgaagtatactcaatatttgtgccattccaatccatggattcattctagattaatttattccatgttttatatattattattgtaatttacttgaacttaattagagttaattctcattccattgcttttaaatttgatggatataaatatggtcgtaataatattttactcatttctatcctcaccaaatcttattttaagttgcactttaattacttactttgtccatttactttttagggtttattcctaaccaattatccattattcgcgatttataaactccgaacccaaactccaataaaataatcgaataaaatcggcatgatgcaatttatttaaaaagtttttgaaaatccgcatttttagagtttagatttttgtcgtcgaattttcagggtgttacacctatccccggcgtgacggccggggctcagaggcggcgcgcgtgtcgcggctcggcgcgggtggccgtgggacaccgtggtccagcacggggcggcggccggggattggcgcagcggcgacagccctcatggagggcggggccaactgcatccgggcggcggcctgggcggatggatggcggcggcggcggcggtcctcccggagggcgcggccagatcgtggcccgtggtcggcgcggcgcagcatgggcggtcggacggcggcggtctggccttctggtgcagcggtggtggcgttggggtgggcatggcggctcgtaggccctgaggcagggagtgaagggagtgatggcagtgctaagggagctggcggcagtgggtcgtcttcctcgctgccagcctgcaccctcgcccttcctggagctcctccccttctctgtggggagtttctatgttggattgaggcggcagccggttagcgaggggagctcagaccgccgacacgacgccgtccaattccgggttatccttcggctaaagctggcaaggaggtcgacgggtggcaggacggaggaagtctgggccagttcctagggtggcggcagctctatgcagcaagtgtggtggtcggcaggtggaggggcgccggcgcagtgtggtggaggc

SEQ ID NO: 2297 - DNA, 1501 bp, Oryza sativa
ctagctagcgagtgggctccaacctaatgttttcttttaaggccgcttttgagatggctgatcagccaaatagctgtgtgtctgacaagcttactaattagtccttgattagtaatatatgttactgttaccaacttaaaaaatagacttatttgatttaaaaaaactttagaaagttttttttaaaaaaatgacatcatctaagcagtttaaaacacgtgttcatgataatctagtactatctttgttccaagacataaaaatttataggattcaaattttatactactagtagaatacccatgcgttgcaacaggaattaaatcaaaattgaaatccctggtgcacacctgtcagactagtcagcttccaacttgtttaacttttactaacaagtatcttgtcgttttattttagtgatcatgtaaacattatatatgtgggctaaaaggcactagactatagctctgtgctccatgtgaactatcagggaacacaacatatgaggcatatatgccacaaatgcgagacatatatgccacagatgcgtattacctccatattaatgcacgagtcaccactcaccaatcaccaattcaccatatagcttttcctatctttgccattattgcgaagcagtgcctttgtggcaaaggcagaagccagtggcagcaagtatgccgagcaatgagatttgctctggtgagaaaaaaaaatatcttacgatatcggtacctcactctttaaaattgtttttaactccaacgattgaaaacgattcggtatcttgagatatcggtacctcgaaatactttttgttagaccggagcaaatcttgccaagcaatataagatatgtgcacaacttctgtacatcatccatatatagcactttaggctgtgtttaagttcacgctgaaattggaagttgaaattggaacgatgtgatggaaaagttgaaagtttatgtgtgtaggaaagttttgatgtgatggaaaagttaaaagtttgaagaaaaagtttagcagtacttgaagtgcttgaccttctgttattcactggattttgtgctctgggagttgagcacgtttcgtcagtatgattcctagccccccgcatgaataattcatagcggggaggtgtcaatctcatattgccattattcatcatattattgctgtgaactatttacttgattgtaagaataaattaaatattttttaccataaggtttacgaataaacttaataaaagtgagaaaaacatcgctactaaaattatttttgcatgttcttggctttatttatctcaagcggtcaaaaagaaaaaccattatgaagatggttaaagccgtcttagggtcataagagaaacgcccatggatttttcggctagtttcacaaggtagtgtgcttccttctctaatattcgcgtttctttttttgtcttagggtcataaaccacatgtgaaaaactatttttacatgcagctgtggaatccg

SEQ ID NO: 2298 - DNA, 1501 bp, Oryza sativa
aagaaaaacaacaacaacaaaagttctatttcccgtaagtcctgtattggaaaaaagcaaaaaaagaacatttgaagaaaaaacaagaaaaaaaatgcgtgagaaaataattgtaaaaaaagacaaaagaacacactagaaaaaaaaggcacaaaagagagaaaaatatggttttcattgtaagtaaaaaagcaaaagaaaaatgataaaaaaacttttagaaagaaatgtgccatttctgaatggtttgagaaaatcgcgcaagaaaaaaaacaccatttataaaaaaacaagccgctcattaaaatacaaacattgtcattgacatgattattcatgaaaaacgtatattatcattagaattttttcacccgttgcaacgcacgggcacttttgctagtaaggaaaaaaaaggcattcttctctgtttcttcttctcgtcgtcctctcgtcatgtgattatttgagctgagagagagggggactaggcgaaaaaacaagaggattaaagttaattcatttagaggttatggatgaactgatagggataggatgaagattataagtacacgccacatcggatgaaaactatgtcaatgtatcacataagagcacccgcaatggtaaggtgctatctataaaatatgtacacctcaacaatagactagattaatagtaaaccacttcaatggtatgtctacatgggtatctatagctctctaatccattgcctcgtttttctctatagactatcttcatgttagtagatagctttgctctctctcttcatttaatctcttccaagtaggaaaatatgctgacatggatctcttgtagagagcttatagataaccattgtgggtgccctaagatggaatcgacacccaaatcattgaggggctcgtgttgatttacactggtttttatagcttgggggacaatgtgtatcccggtttcgcggttgagggacgcggatgaaactcggacccatagctaagggacgtaatgtggactttttttgtgggcgaattcgcgcagaaaagctcgctcgcatgggggtgatgggccggcctgtgctggtggcctagaatctctctgactctcctctctctcttcgcctccttgtcggcggccagccgccgccgccgacctcgccggtcgccgccaccggcgccgccggcggagacgccgagaaatgggacggagcctctccgtggcaaggtatgggttttcttcgtcgcccctacatacactggtatctgttcctctacgatttggggatcctttcgcaggtgcccccgcgagcgtcgccaaagcgagacgaattgtttgatcctcgtttcgcttggaatggactagggttccggtagaaattggcgcgcgcttgaggagacaaaggttaatggggatttagagttcatctctcacttagcagtttgtacatttcaattttcaagtctacagttacataacgttgatgcaagtattttttggctgatca

SEQ ID NO: 2299 - DNA, 1501 bp, Oryza sativa
taaactttttcttcaaacttttaacttttccatcacatcaaaactttcctacacacataaactttcaacttttccatcacatcgttccaatttcaacttccaatttcagcgtgaacttaaacacagcctaaagtgctatatatggatgatgtacagaagttgtgcacatatcttatattgcttggcaagatttgctccggtctaacaaaaagtatttcgaggtaccgatatctcaagataccgaatcgttttcaatcgttggagttaaaaacaattttaaagagtgaggtaccgatatcgtaagatatttttttttctcaccagagcaaatctcattgctcggcatacttgctgccactggcttctgcctttgccacaaaggcactgcttcgcaataatggcaaagataggaaaagctatatggtgaattggtgattggtgagtggtgactcgtgcattaatatggaggtaatacgcatctgtggcatatatgtctcgcatttgtggcatatatgcctcatatgttgtgttccctgatagttcacatggagcacagagctatagtctagtgccttttagcccacatatataatgtttacatgatcactaaaataaaacgacaagatacttgttagtaaaagttaaacaagttggaagctgactagtctgacaggtgtgcaccagggatttcaattttgatttaattcctgttgcaacgcatgggtattctactagtagtataaaatttgaatcctataaatttttatgtcttggaacaaagatagtactagattatcatgaacacgtgttttaaactgcttagatgatgtcatttttttaaaaaaaactttctaaagtttttttaaatcaaataagtctattttttaagttggtaacagtaacatatattactaatcaaggactaattagtaagcttgtcagacacacagctatttggctgatcagccatctcaaaagcggccttaaaagaaaacattaggttggagcccactcgctagctagtaaatacatatactccgttttataatgtaattaaggtgttttaattttgttctaaactaaattcctctaacttgggactaaatttatataagaatagttaaaacaaagatcactagtatggccatctctagcattgcaacaccatcaagacctagggtgagaagtataatatatgtacgactgtcatttgtcacacatagtagacatgccgtggatgtttggcaattcatagcaaaagatcttacatcaccgtcgaaacattatgtaattaattgggttaattggatcatgctattataaatttgtgtattaaaaatgacattacaattcatctgttcatagccatgccaggctacaaacagatgaattgtaacaatatttttctgaaaaggcaaatttgcaatgacatgaatccaattaatcttaattaattactatttccttttggctactataaatgaaagaagaactgaatagt

SEQ ID NO: 2300 - DNA, 1501 bp, Oryza sativa
ctgttaacaactactaacaagttggaagcttcaaaactgactagtcgaatgggtactttactttacacgacttaccagaggcagagattcaaacaataggtacgtgtttgctgaatatttacttaagatcggtgtcaaatagccatcacttttggatttgtacatccataagggatgtagagaccggattgatatatattatctttatactacctccatattttaatgtatgacaccgttgattttttgtccaacgtttaaccattcgtcttattcaaaaaatttatgcaattatcatttattttattatgacttgattcatcatcaaatatcctttaagcatgacataaatatctttatattttcacaaaaattttgaataaaacgaatggtcaaacattggtaagaagtcaataacgtcatacattaaaatacgtagggagtataagaaaaagccatcactttcttgtataaagactttggctcaataatcaccgctgcagcccgccatggtttaaggtcattgtccatcaattttagaaattcatgcatgtaaaatttcagtgggtatgagtacatgtgcccgtacaaaatgagtacatttcccgtaatacgggaggtctctactttctcagataatttattggcgttcgtataggtgtgcactcatgggtgtgtgtgtgaatggtctgactgtggtgtatcttccattataggccgtgtttagtttcaaagtttttcttcaaacttctaacttttctatcacatcgaaactttcttacacacataaacttataacttttccatcacatcgttccaattttaaccaaacttttaattttgacgtgaactaaacacagccataatatctttttagaggaaaactgacaggctcatgtaaggtatggttgtcatctattaattcatccattcagccatttagaagaaaagaacaggcggtgcctctctgatgtggccgtctctagatggttgtttgcattgctgcgccatcgaaatctagctgaaaaaagtattgtaggtacgattgtcattcgtcacacatggttgccatgccgtggatgtttcgcaattcataacaaaagatcttgcatcaccaacgagacatgtatcaactgtgccatttttccctccaatattacataagcattccctccgtttcaggttataagacgttttaactttggtcaaaatcaaacaactctaaatttgactaactttgtagacaaaatagtaatattttacaacaccagcaaagtttcattaaatctataattgaacaaattttcataatatattgtcttaggttaaaaatattactattttttctacaaaattagtcaaacttagagtagtttgactttgaccaaagtcaaaatgtcttataacctgaaacggagggattactatatatgtttctacttctctatatatgcctcagttccctactataaatgaaatcagaactgaccagtgatcacat

SEQ ID NO: 2301 - DNA, 1501 bp, Oryza sativa
gcttctcaaaggagagattggatgtcttgtggatgccaatttggaaggtgatgttaacctcatggaggttgaaagagcttgcaaaattgcatgttggtgcattcaagatcacgaatttgatcggccaacaatggccgaggtggtacagtcccttgaaggtctacttgagctcaacatgcctccactgccaagactactaaggcagcgttcgtttggacgacattgagggagaaagcacctcgttttccgcacgcacgctttacaaactattaaacggtgtgtttttttaaaaattttctataggaaagttgctttaaaaaatcatattaatccatttttgaaatttaaaatagttaatactcaattaatcatgagctaatggctcacctcgttttgcgtatcttcccaatctcctcaatccccttctcctcaaacacaccctaaatgctatcacaggaggatcacactcgatgacaacacaatattttgattcactataaatctgtatactgattcccaatttcaagttatgtatcagaacattatatatcatcttgccctttaagaaaagtaggcataagatgtaagatctctaagagatcatgtcttgtatttgaatgaactaagtgtcgtaacatgtaattaagatctctatacccgagaaggaaccagccttactaacaaaatatacttggtttctgttgtctctgtgatatgtaagatctgtaggtatcagtgtgcccccatacaattgtcatatgatgtttttgaaaaacacaggcgcgactgaattgtcagttcagagtggattgttgagcctaacattggcgaatgtgtgacatcctgacagttatgttcaaattatgcacacatcggctatatatcacctatatatacgaggcataattgttcactcaaacaaaagggagaagcctggctgctagcctgaaacttgttttttcaagggtaggcacattaatttggcaactacaacccaagaacctttttgttgagaatatgcaaaagatgtgcacatcattgtattaagatacaagagtttcattacaaaccttgctagatagtggtatagatatgtgtgtgtacatggtatttagctgatatttatgtaaattcgtggaaattggaagccataagaaataagactgttttcacacccagccaatacagtacttgtagcttgcaatagtgccaaagatttgttcaagattctttcagatcagtactaacaatatatgatagcttgtgcaagttgaatcttttgtcttggccaataggacctttgcaccactatccccacggcaggatattttttccattttctagtcaagtcaagccactgtcattcgtcacctaaaatttctatacacgccgtggatgtttcaaaaagatcttacatcaccgtacagaccctttcgactatataccattttgctctccatcattatatacaagttgctagtttttcttttgtcctcatttc

SEQ ID NO: 2302 - DNA, 1501 bp, Oryza sativa
atgtgactcttcaattatattgcttaggccaggtacaatgatctttataagtaaactctctctctattatcatgtaagtaaaatttgattacatggaagaaaaagaggggatgaaaataaaaatatggttgctatctaagccctcttagcaattagtaaaaaaaaaagaattgttgcatggatacgagagaaaggaaagaaatattattttggtacattaatgtttagacaccatgcttacagagataacatttaatgataaaacaagtcacaataaaataaataataattacataatttttttaataagatgaatggtcaaacgtatataaaaagtcaatgacattatacattaaaatacggtaaaatacggactgagaatctgtttagacttttgaaaagtcctacaattccgcgagctaaaaaaactgtgatgcggtgtctgcacccgcgttgcacccgcgttgtttgacctcactaagagcaagtttaatagtatagccaaccgctggctttaaattatctatagtcaacttaatagttaatttatacaatatatatacagtctgcatcaatctcttcaaaagtactacttaataaagagggttgtaaacgaaatcgttagagttgcagcatatttcaacatgacagaattttgcaggatgcgaagaagtaaaactcaaactctcggctgataaaggtcgagctgcataccaaactctcagcagcaacgagctcaataaaactactgaagtagcctggcaaaggctcggtttaaaacagattgttgagtagatggttgccccgcattattacttgattatagtgatagattaaatattttaataaataaacttaaaaaatacagtggaataaagttcttttttttgaaaaaaaagtatttttaaattgtgtagcaaatatcccttttcaacaatctagcactaatttaaacgaactaagcctaaaagatggagttgcctatcgtgagcaggtcaattcaatcagatggtcagtaccagctttgagtactcgtgattaagcactaaacggcatgaccaagtcaaggcatttttcattatttgtctccattatttccaaggccgatcaagcattcttttttttttctttttcaacacacctgtgccaccccagttacgattccattctctttcacatttgagggagctacttcatggctcacacggctgacagggcaagaaaacgatctctgaaaaaaaaaataaagtgcagtggttagttataaattgatcactacgattgtatgaaaatgatgtttttctatctgtcctgcagcatgcattcacagttacgtagtcatacaggtgacaaacgaacagattcattgaccaaacttacccatttgtagcaggtaatggagtctaaaattggcatcccaagcaaactgagcacaaacaaaatataaaggggaggagctgtggctctgcagttctcattcctaaccaacactctgcatcca

SEQ ID NO: 2303 - DNA, 152 bp, Oryza sativa
cccccggccgaactcacaaggggggggggtctcacgaccacctgctagggaggatcactcctcgacaaggtcgcttgctgcctccggttcctctttcgtcaggcatcgcgcatggcgccaccactcccttccctgtcgtcatcctctccagc

SEQ ID NO: 2304 - DNA, 1501 bp, Oryza sativa
acctgcgacacaccaaccagttcaagtgtcctccccaagttttagaaggcagcagacaagtacaaattcacctgcagcctcgaggcggcgtcgatgaagaaaatgcatcatgttgagagaaccattccttcatctacgtgcctcttccctaaattctcctctttctttgttcatctttcccatgctttcgtttgttacctgtaattagtatcatgttgtcatgtattatgaattttgacccattcttttggtgttgtaagataaaaggggtgtacaggggttgctgtacggggctatctacttgtataatttccatgagcctggaattattgtcgccattttttctaaagacaccatctcaacttaactttctggaactgagtgtcagatttgtcggtggctgacgaactcattagtcattaccaccattggacctcactcttccgattttctatgcggacttaaatgtgtcttgtaccaggctgaaacgatagttggagcacgcgatcgatcttatttgattcgtggatctgaatacctttctttagtctaatgtaacatgtttttttcttccttctcgatcgatcattttgctgtttatacgactaaacgtggaagccccccatccccctttgttttgttgattagttctttttgtttgaatcaaattattacattcttgatcgataatgatctcttcctcttatcctgctgtcaaaattcctgaactcctgcacgcaccacgcactacacgattacattatccacaaaaccaccttgcattacacccccagttgttatatgtacccaaagattcggccattgcatccatgttctccatgcatggctgcacctgaacttgtcctgcactcctgctgctccaccatcgctcgcacgtgccccaggatcaatgagcctctcgtggccctttttcttttcttttttaaaattcccctcctccagctgtgtccggtggtgtctcatctctcatgtgccggttgatagatactcgggctttgtttagttctcaaaatttgttttccaaaaacattacatcaaaatctttggacacatgcatagcattaaatataataaaataaaaaattagttgcacagtttctatgaaaatcgcgagacgaatcttctgagcctaattagtccatgattaggcataagtgctacagtaacccacatgtgctaataacggattaattagacttaataaattcgtctcgcagtttccaggaaagtcatgaaattagttttttcattcatgtccgaaaactcctttcgacatctggtcaaacatccgatgtgacatctaaaattttttttcgtgaactaaacaaggccaacaaggcatcagactataaataggtgataccctgtgcttgtactactgtctactgctccctccctccatcccttgctcgctcgcgccacaacgttatcctctcctcgtagatgtggccacagtttttgcagccggaacgagctgtcc

SEQ ID NO: 2305 - DNA, 1501 bp, Oryza sativa
catttcgtcctaagtcaagcttctttaattgtgaccaaacatttaggaaaatgtggcaacatttataacaccaaattaatttcattatatccgccattgaacatatttttataatatatttgtttggtattggaaatgatgatacatttttctatgaacttggttaaacttgaaggagtttgacttgtaacaaaactagttgttacagtattgtggattgttatcctattctgtatagttccagctgttaaattgatgcctgtagggaggttgcaaccatatggttgacatcattacatgtcatggcacctaatccttaagagttgacatttctctgtctgcttgcatatctgctcgttaacaatgccatgatagtatttctgaaaacaacttcaattagtattagttttgtattttactactctcggcagtgaacaactgtttggattatatgctactgctttctatttatgatgttcatatatgagctactagggcactactgcatagtggtactctttgagttacagtttgtgttttttttccaccgtgataagttatcttaaatattgtgttcttgtaatttgattttggtgttagttatgtacattgtttcatatagttcagaaatttgagggttaatcataagcacataatagttcttgaccagagctttttgatatgtcaagtatttatagcctcaatctataacattagcaactgaaagttaaggcacaatctgaagtttaattcttggcgtaattgatacactaaacagtaagccaaccctttaatcaggagtgtcaactccagacaagagaggccccttttgggggctctgaacttcagtaagctagttacttcatcagatgcaaaacaatctttccatgagaattttgacaatgatggttgtactagattttaatagtggcataatcttttgcctctgaattttctcatatcttatgtgatatggcaacttggcaaagcatggacggaggtctgaaagataatttgttgcaaagcatagttataatgttaacatgccactttctaattagttttgctttatgcaaatgtgataacagtgttaacatattcacatcataagattttgcctattcaaattaatttgttttgtgcgcccgaagatccacattaccaagggactggatttaacagaaacttttatgttctgactattgattgcaccacctattgttaaaataaataaataaataaataaaaagacagcataaaagttcaactttaccctgtgagtttgtgacagggattttttttttagaaaaaaaaatatgttgggactaacatatttgctcttatgacgaatatattagtgatcttgagctgtcctactgcacttttctattttatcagcttgctggagactaatctcccccttttgtagttcacaaagtgcgacctaagagcgcattaattttttatctccaagaaaaacctttttgatgatgactggata

SEQ ID NO: 2306 - DNA, 1501 bp, Oryza sativa
tcttgtgtacaagcaggggagcaaagagtcgtgtcctatactggtaaacttattatttgacaggtccaagaagaacaattccttccaagtttcccatgcccatcgaggtattggcccatgcatttggttatttgaaaggtcaattacgtgtagctcatcttgatgctttactgcattgggaaactttgatatgttgcaggatgctaggctcaattctgctactttgggagaacgcactactgagtcattgactaaaccgtccaccacagataatttattatttgaagagcaaggtctgataaatatggtagtctccagaatgaggtaagttccactgtccccacaaagttgttgattggaagatgcaagctatgcagttgtgtcaagttaaatatttgcaatggtatgtttccagtgaagttgctcttgaataaagacattcttctgagattcttgagattgcctatggaagatggtaaagatccagacaaaccacaatgagaaatttggagatctgtcaaagatgttagatttgttatccaagctggcattgatcctactaggccgagccccgaaacctcaaataagttcaaggatttaagcattcctagagaagacggcagttctgtagggaaattatttgcactcagactcagctccttcagatccgtgagattagaaatagagcttggtatgtaacctgagaacttggtgccactgacatgcaatttgatcaaactgctattaggtggaaaattgggcaaatcaccataaacttcatagttgtagctaatatcaatagctgtcagttttctgttctggaagatcctttgtggaaacaaaccctcaaacttatttcttgaaagctgaagaacaccaagggatgacaaatcggcgaagaactcaggtcatacaagtcattttcttgcaagtcaacaacagagatatggcaagctgaagagagactgacagatgggacctgagatcttgcaaaatggtaggctcagaacctgatcttttggagtggaattaaccagagcgttgcaccatccttcccctccattggacatatacacaaagccaagatagagctccctcagattgtcaagatttgcaaccaacctcagaaaatctaccttccagaagccccagttgggaaacgaaggtgccatgattcggcacgatcgtcttcttgattgatcacatagaaaagagttgataaatcgagagaaaccaagttggtgaggcttccaatacctgctggtatctggcctgcgaagctgggtggggagatgttgagatgggtgagctcagtgagcctctcgaatccggtggccgggagctgtgacgcgttgaagtcgttgccgccgaggttgagataccccagcgacgtgaggctgaagacggcggcgtcaaggccgccgctctgcaggcgtcggccgcctagatcgaggaaagtgacgcggccgccgtcgcagcggacgcccgcccagcggcagca

SEQ ID NO: 2307 - DNA, 1501 bp, Oryza sativa
tcggccagacgggcctccaaagcggcgtagcggcgagcaagagagcggtaagcctcaaggagtaggtcgtgctgggtggcctgagcctccgaaagctcaaccatgtgagtcagcactggctgagactcgctgtacgggcaagggtacctggcgtctgagtggccagaaggaaggcgtggaaactgccggaaggcggagcctccgagacggtggctgtagtcgtgggccaggcgacgaagcgcagtccaggagaggtcctggtacgcgatctggagagtaggcctggccacagtgaagtggtgtgggcgaaggccagctccgtgtatacctccacgggggtaaaggtacacagagagctcacagtgagggggaacgcggtccacggagtaccccgtgtactcgggacacgagaagccaaggaaacgggcgaggtcacgaagctgggcgacgtggtgaccctcaccaaaaccgtgggaactgaagctggcgttcactgccatctacaattttgaaagagggagaaagatcagtaaccattttggaaacaaactattgaaaataaagaaaacaaaagaaaccttagcttttcgcaagtagttttgaacttagtatccttagggtcgtcctaagcgtcgggtttcgccctagggcaaagcctgtgctctgataccatctcttgtcacgccccgaactagtcccgactggaactagcccgtgacgttccaaattaacctgttaatcgataccagtcccaggaaacagtgctggtatcacaggaagatagaatatcacagcaacagaggtctctttattatagagtaagagtacagtcatgttgggctgcggacagatcccgagctcacaactgcattacaaaagggaaatggaagccaggacttggaccaaccatcacaggcgcgacttgggaactaggctgaaaccctaaaactcatcgtaaccagcttgctcctggaagaactcctcatcagcaggatttgcttcatcttcttcagcaactgggggggaggatatttatatagagcaagggtgagtacgggagtactcagcaagccaggggaaataagtgtttaatgcaggcttcaaggaaaggctgttgtttttgcaatttattttatttgatctcttttctaaaacaactaggtgagtgcttctcaaacgacacggatgagacagtgcatctcgtccggtcggagtatgtgcaatgtatcagtctttagaattgaaacaaggttggcacccggccaacagcttttcaaacggccacccgggccaacaacttttcaaacggccacccgggcctagctgatcccatcagctgcagattttttttcaaacatcgaaccccttttcacaacagcaatttcacaagcagtagtcaaacaaaactacgctaggaatcacctcacatccgcccatgaccgtgggcacggctgttcgaacagtttaatgacctctgcagagggggtacactttacccaca

SEQ ID NO: 2308 - DNA, 1501 bp, Oryza sativa
aacgtaccgggtgtacggtttcccgctctcgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagcatggtctgggacctaacctgttgttggtctgggacccctctcgtcggcatatggtaaacctgtgtcggcttttgaaatgccttgtcatgaaagcttggaggtctcccgacgtggctgatccccacgggctgggtgacccgggttagtaatgtcatgtgggtaaagtgtaccccctctgcagaggtcattaaactgttcgaacagccgtgcccacggtcatgggcggatgtgaggtgattcctagcgtagttttgtttgactactgcttgtgaaattgctgttgtgaaaaggggttcgatgtttgaaaaaaaatctgcagctgatgggatcagctaggcccgggtggccgtttgaaaagttgttggcccgggtggccgtttgaaaagctgttggccgggtgccaaccttgtttcaattctaaagactgatacattgcacatactccgaccggacgagatgcactgtctcatccgtgtcgtttgagaagcactcacctagttgttttagaaaagagatcaaataaaataaattgcaaaaacaacagcctttccttgaagcctgcattaaacacttatttcccctggcttgctgagtactcccgtactcacccttgctctatataaatatcctcccccccagttgctgaagaagatgaagcaaatcctgctgatgaggagttcttccaggagcaagctggttacgatgagttttagggtttcagcctagttcccaagtcgcgcctgtgatggttggtccaagtcctggcttccatttcccttttgtaatgcagttgtgagctcgggatctgtccgcagcccaacatgactgtactcttactctataataaagagacctctgttgctgtgatattctatcttcctgtgataccagcactgtttcctgggactggtatcgattaacaggttaatttggaacgtcacgggctagttccagtcgggactagttcggggcgtgacaagagatggtatcagagcacaggctttgccctagggcgaaacccgacgcttaggacgaccctaaggatactaagttcaaaactacttgcgaaaagctaaggtttcttttgttttctttattttcaatagtttgtttccaaaatggttactgatctttctccctctttcaaaattgtagatggcagtgaacgccagcttcagttcccacggttttggtgagggtcaccacgtcgcccagcttcgtgacctcgcccgtttccttggcttctcgtgtcccgagtacacggggtactccgtggaccgcgttccccctcactg

SEQ ID NO: 2309 - DNA, 335 bp, Oryza sativa
aaaaaaatctgcagctgatgggatcagctaggcccgggtggccgtttgaaaagttgttggcccgggtggccgtttgaaaagctgttggccgggtgccaaccttgtttcaattctaaagactgatacattgcacatactccgaccggacgagatgcactgtctcatccgtgtcgtttgagaagcactcacctagttgttttagaaaagagatcaaataaaataaattgcaaaaacaacagcctttccttgaagcctgcattaaacacttatttcccctggcttgctgagtactcccgtactcacccttgctctatataaatatcctcccccccagt

SEQ ID NO: 2310 - DNA, 1501 bp, Oryza sativa
gggcggcggtgggtggagaaggccggcgcgaaggcagggcagagcggcgctgcggcggcatcgagagctgccagtcaccgcggtcgctgttgtcgcgtatcctgcagcgaggcgacggcggcggtgggaagttcggatgccgggtgcggctgccgcggcggtacagctccacctccgccgccggcgctggagttgccggagagaaggagatgatgtcgaacgcgttcaggctcgaccgccgccgcgagctcccgccccgcccgaatctcccttccagcaacgacggcgtcgccatcgtcccggtgcactccaccgcggacatcgccgtcgccgacaccctctggaaggccactaccgcggtcggggctcccctcgcgtgagttgctcaggctcgtcaccagcgacgacgacgctgacatggacatgtgctgccgctgctgcgccgccatggcagcatggcgccatccactcaccggagtagtaattagctagctagctagctaggcaacatgacgacgacactagcttaattagcttgtatttagttggttaatttagtgttgttggttgcttggcgacgtcattagctaagctagtgatgtagtagtagcagctagtgggagtattagttatcacacaaggcgaggaaaccgacgcccagaagaggggggggggcgcaggggccgcggccatgccgcccagatccgtcgccaatccacccggccgctgccgccactgatgcgtccgaatggggaagagaaaagggggagagaaaagagaggagggagggaggaggaagaagaagggaaggagaaaggatgtcggtgggccccacatgtcagtgggtcccacatgtcggtgggtcccacgatatattttatatgtgaatgatagatgggtcccacagatattttttaattctaatgccacgtaggcgccacgcggaataagaccggattagtatcgccacgtcagcgccacgtggaatgaagaccgggttggtatcgccacatcagcgccacgtcagcaaaaccgtcctacaaaaccaccgagggagtcaatttgtaccggttttagtaattgggggagtcgttctaaccggttttctggttgaggggtacaaattagattcgttttacatttaagggagtcaaagtggactttttccagatttggatcgctaaccaataagcaggcctcatatgggccggaggcatctcggcccggcagcagcgcgcacccgcagacgggccgcactcccgtgccgaatgctaggacggcccattaggcccaatagacgcaccaaggtccaagtaccaggagaggcgcgcattggcgggaagagggggagaaaacggcgggaagcgccgccgccagtggcgcgaaaaccccacccgctataactcctctccctcctcacctcaccacttctcccgccattgctccgctccccaatctccccaacgagagagagagagagcgaggagagggagagggagga

SEQ ID NO: 2311 - DNA, 1022 bp, Oryza sativa
cctgttaataagatggcagtataaatacatctagtctcttgaataaaaaaaaatcacgggtttagattgatttttactataagtaaagagcaccgaagcatgactttgtggcgaaaatgatttagccagaagttactgtatacgcatagcgacttggtaattatttatttggttttgaattacttatacttttataaaatattattggattcctcgtcagtatatatgccgaggctacatatgaaacaacttctgcttgctgccccctgggcagaggaagatgtatccgttcacgttttgtgcttctaatatattaagttcttagaaaaaaacttcgacggtttatactccctccatactcgtaaaggaagtcgttttggacagcgacacggtctccaaaacagaactttaactttttatttctataaaaatatttattaaaaagtaatatatgtatatttttatgaaagtattttcaagacaaatctattcatataatttttatattttcaaactcaataacttgagagttattcatgatttatattctcaaggtttgatttaaacattgtcataaacgacttcttttacgagtacggagggagtatatatttttaagaattcatggtaaagatatatatgttttactcaatccaataaaaagaaaaatattttgaaacgaatacgacatcctccctgttatactcgttactactccatctgcagagaattagcattgtacccatgcatgccgtgcatagaacgttgcgcatgtctgtatgtagcgatggaccgaatctatctatatctacgacaaacaggcacaataatttcaaccattggattgacaaatctttacagaattaggcgaaagtcccctccgattccccccagtccccacccattaaacaacatcattaatctctcctccaccattaggaccctttgaatcgcaggaatggaaaaacagaggaatagaaaaaaacgcaggattctgacaggaatatatattttaaaacaga

SEQ ID NO: 2312 - DNA, 1501 bp, Oryza sativa
caaatgagcagcaggtgctcttggaagcggcaacatacaggcacacagtggaaaagatggcgctcccagagatgtgaatcacaagggtgtggcattgagaacggcgaggaatcggagaatttgtttgtcctccaagtggagccatcctacacaaataatggttcaaaataagcataacaagcactaaaatgcagctttacattaacttatgtactaaattccaataccttgaaagcaccaacatagaactcgttcccgagcatgtcctgaaccatcccccggaaccgaacaagggtattcggcttgatcaatccaagatttgattcatccaacaccggaacctggaaaggaaaatattcccacattccgtcattccctgaacttcctaagattcatttacacccacaatacaaaatatcctctttctctcttttttttgggacaagctcaacataaacatatgtgacattctaagtatctgaattgaaatgtttgcaagaacagcaaaaagcagttatctttcacccaacttagatctgagagcatagtacttcctaaccacatctactgatgattccaaatttaccctaagaaaacctttaatctccccgtctcatattcattatagacattcaaagatcactaactttgacgatattagggtttcagcgatctaccaaataacatcattttcagaaatcgacagctgcggcaaccatcaacacggggggggatcagacttcttaccttgtcaagcccgccttgctcgaagagaaaggagcggaacacctcggtggcgccccagtctttcccccggaacgccgccaccggctcgtgcccaccggactccgccgccgccctctcgaaggtggagcgcaccgcccccagggggttcccgacgaggtcgtactgcggccccaccatcctccctctccctctcctcgctctctctctctctcgttggggagattggggagcggagcaatggcgggagaagtggtgaggtgaggagggagaggagttatagcgggtggggttttcgcgccactggcggcggcgcttcccgccgttttctccccctcttcccgccaatgcgcgcctctcctggtacttggaccttggtgcgtctattgggcctaatgggccgtcctagcattcggcacgggagtgcggcccgtctgcgggtgcgcgctgctgccgggccgagatgcctccggcccatatgaggcctgcttattggttagcgatccaaatctggaaaaagtccactttgactcccttaaatgtaaaacgaatctaatttgtacccctcaaccagaaaaccggttagaacgactcccccaattactaaaaccggtacaaattgactccctcggtggttttgtaggacggttttgctgacgtggcgctgatgtggcgataccaacccggtcttcattccacgtggcgctgacgtggcgatactaatccggtcttattccgcgtggcgcctacgtggcat

SEQ ID NO: 2313 - DNA, 776 bp, Oryza sativa
ctgtggaactaaacatggcctgtctctggttttcgatcgagggatgattttctaattcggtgataagatgagggatcttcgcagtactttttccacatcaaaattacagattttgtatgggcctcagacatctggcccaacaagggtccgactcattcttcaattttcgaaaatacgtaacctctggtatctgactaagcaaattatgtacgtactcaaaattctaaacttacagtatagttaaatttagcacggttttccaaatagtaagtgatttttaatttgtcctatatatttcgatgtttgtaacaacaaagactaattatagaaaattacattcaaatctcagttcaacggtattaattttatcaaataaaatttaatttatattagatttattggtcgtgagatattaccagggttgaattaatatttatgcataccttgtattttttttggaaaagagggtacaaatggttgactgaaaaccacaacaagttttcttaatcgaaaattacatcaagtttgatttgcagcaaactaataaaatcataaaaaaattacaacacaagcacacaagggcaacaacaattaaaaaatagaaacacaaaagaaccacgtatccaccgtccaattagaactccatgccttccaaattgatgaaactgtaagtgtcgcaaatgcaggcacattcatagtgagcctagtgcttaggagggcagatcgctggccgcaaagcgagtgggccggtggcgtacatgaagttatagtagcca

SEQ ID NO: 2314 - DNA, 1501 bp, Oryza sativa
cggctgtggtcgatctgtcgagctaaattgtaaagctagcgatcgagcaatgcaaacttgtcatgcaacgcaatctagctgaaacacggtggcaacaagcatcaacgcgtgcaatgcgttgaccgcactgatgatctaagccagagagctactactctacctgcacaataatttttgtcacagcttggcttgtcgttgcgttcagctcgactaatcactcgattagttcagcgtatggtagcacgtcgaattaacatactaactaatcatcgtctcaaaaagctaggtagccattatatatacaatccatcagaagtaacaacactatagctttcttagcttgtaggctagcatatggtctgttccatattcaccttaattctactacgaaaaaaaattaagatgttgcacggccaggttcatatgttaattaacttatatagatgaaggcaccaaacaactaatcaatggaggcccttaaacaaatccatgctacctaaactcctatatatccaattgagcattcacactcgtagtataatcggctagctagcttgcagcactcatgcatgcatgcatgcatgcaatggaagcacactcatcagagggtagcatggcatagcatattagcatacaaccaaggtacagcaaggcagcatggctgtgtccatgatgctcgaatcattgcagccagcagaagaaaaaaaaagaaaaaaacacagcacaattaactaattaaggcactagctgctaatcttgaaaaaaggaaaaaaacattagaacatgggttagtacttagtagaacccagcatctctccatgattagacaaacctaattgttgtttaggatctagataaggtcatggcacacatgactgatgagtagtagtgaggtgagatgaggtgatctcaccaaacggtgaagtgatgaaaaccctactgttaatggtgttaagtctctctctctctctctctatctatctctctctcttttgcttcttttaggcgtgtttagttcccaaattttttcccacaaaaacatcacatcgaatctttggacaagtatatagagcattaaatatagataaaataaacaattaattgtacagtttgcatggaaatcgcgagacgaatcttttgagtctaattagtccataattagtcataagttttacagtaacccacatgtgctaatgatggattaattaggcttaataaattcgtttcgcagtttccaagcgagttatgaaattagttttttcattcgtgtccgaaaacatctttcgatatccggttaaatgtccgatgtgacacctaaaaattttcttttcgcgaactaaacaagtccttaatttgtcattttgtcctctcctatatatacaatccatggccaacctcaccgagctcaacacagtgaagagaagagaagagaagctaagctagtaggtaggtggtgggttagctcgatcgccaagtgttcgaccgaggagcgaagaagaaa

SEQ ID NO: 2315 - DNA, 1501 bp, Oryza sativa
cttgatggttgttattgggctgtttttggaattttggttaactgagcctacttaccgaatcgatagactaaatttagttagtcagattcagtgatcatatcttttttatttctatcttggttagttcgattttgcccacccttaaccaaacatcgatagggcggtgtagagtgagacgtattaggaaacgataggcaaacaaacgataaagaacaatagatcaatcacagaagacacgagattttaacgtggaaaacccttccaaagtaggagagaaaaaaccacggacgctagccagcaaaatatcttcactatatctggggagaggttacaacgccgcacggcggcttacatgaggtatatatatggtggaaccctaaaatggatgacgatccgtttcgcgggggctccgcccccgcacctccaggcgtccccaggtgcacggcccaatgggtcagcttcagtctccgccacgctccggcccaagcctcccgacgatgggcctccgcgaaacaactcaacaagacgaagatgatcaaagaggacggtagcaggagtggcttgtatcttcacctccagctactcggatctgttgcgcgcagaggccgaggtcactagatccggtggccttgggctccttgctagtagatgcatcagcctcacggtgacaagggtgatagcgccgtgcatcatgtggtgttggctagatcgatccgctgcatgtaaaaagcagacttgctttggatccagtaatttggctgtaaagctcttgtttctacaaacagtgagaaaaatgcacctgttttctttctgtcagtttcagacccaaagaaaaaagacgccatggtacttgaatactacatgaaacatactatataaatgagtctaactgcaagttagaactacataaacacaaatcttgacgcaaaatcaaatcttgacgcaaaatcttatggacaaagtataaaaagatagaagcccaaaaatctatcgcaagtaaaatagcaaacctgtctttatggagaataatgtagctactaaataatctccatatatatcatctgcttgtgtagacaacctggtattgcagtgccgttaaggacagacacgggcagcacgttctgacaaatctcaatatatatcttcatcctgaatattttcggtagtctacaaattcttaactaatcaccaagcagatcatgagcatgtgatttcttctcttaaaagtgccttacagatcaatcgttacagatcatttatttcgccaggctaatcattatatatattgtcaaaatcgactaacaataaataaagtttgatctgttaatccaaaatcagcacaattaatttccatctacatgtccgcacatttagtccatggtatgcagtatataacccacatgcctctctacgtttcggcacagccaaagcttcaaaacagaatatctcagtcgaccacggagcacagcaagctagctcagaggctcagagcaatggctgc

SEQ ID NO: 2316 - DNA, 1501 bp, Oryza sativa
gtacctgcattcaagtaagatcagaaagcccacaagctaacacaatgctacacaactaggcacttaaggtaagtgtgtgaaaacaaattttagttcgctgtctacttacaccattattttctttccattgttctgcacaaggaaatcaacaagttgcgatgacttatttgatgcttcacatatcatatactgcaaagaacaaagaaattttgtggtttacattaaattgacaagtacataaggcaatcaacaggcatagtcactagtaaaacaaaataagtatatgttacaaccagcccatgtaatcattggcagccacgaataactatccaaatgcttgtacaaaagttcctcaccatacctccaatcgaagacccaacggtgttttggatggaccaagctcttgttgagcaccatctttacctgtgggcttcacctctgtcttaacttcaaccctcacaggattcctcaaccctgctttcgccagctccttaacagcctccgtctgagttgccgaaaaaagccctgttctcctcagctttggcaacttcgaaataatcgacgtaatctgcttctggaatcctaaatccaacagcctatcagcttcatccaggatcaaaatctgcttcgaaaacacatacacaacaacaatttatgtcagatttgcatttcaagcacaaaagaacaacacatgaattttcaattgcttccaaaaccacctcaagattcttgtagttcagagtgtctaagcgctccattacgtcgaacagcttccccggggtgccgaccagtatgtttgcaccctcttcttccagtttctttagctccgccttgatgtcgaacccaccaaccagtagcatggatgagacgcccttcagcgtcgcgaagaagggctgagccacattgtatatctgcgaagacagctctctcgtcggggagatgatgattccaagaaccttgcaaaattccatacatttttctgatcagaagtgaacaagagatgcaatgcaatccagcaactttgcaagcaacgcatgaacagaacaagagaggatggggtggagccgtgagcactgagcagacctcgtggggcttgggaggcgaggggcggcggcggaggatctcgacgacggggacgacgaaggcgagcgtcttgccggagccggtggcggcgtcgacggccacgtccttgtgcgaaagcagcagcgggatggccgccgcctgcaccggcgtgcaccgccggaacccgccgcccttcagggccttcaccacctccggggacagcgcgggcgacagctccgagaacctctgctccgtcagcgcgcgcttccgcgccgccgccgccgccaacgaggaggaggaagacgacatggcgtcgcgccgccgcgtctgctactcgcgtcgcgccgcttgagcaggagagacttcctcttgctgttggtttagggattccggggggttcatcgattgggccgtgatggtgggccgcgtagtcttctcc

SEQ ID NO: 2317 - DNA, 1501 bp, Oryza sativa
gaatttgtgatggggcctatcacctgtcacataggccatactattgacgggctggaataaaccccgatatagaagcaaccatataggcactcatcataggcctcttggccagacccgtcaccagtgacactcatcggtgatgaggataggtggcggcccgataaagattatcattgacaagccgcaacctaaccccgcactggtgacggccccacaaagataatgttatggcccgtcactgaggattatagttattgatggtctccatttattggctgttactatgaatactcccaaccacttcgtggaaaggaatcctgatcaaatgtactatccccatttgtggtgggagagctagaggggtgaatattgtcttttattaaaataacagaaaatttaaggaaaggctatctaggtagtaataaattaaccattcctacaaattttgtaatatattgttggtatttcttaacgacattactagaaatataattctcagcaatggtgcagaaatactcctggtatattatggttacagagttcatccgcaagcgtacgaatataccattgtagcatttcaccggagagtattccaagggtatcgtatttattttatcctgtggaaagatcatgtagagagaactcaactaataatttatatattacttgtgataatcatattctaagtagtggttaagataatccaagggtagagtgacacacaagtattactactcattctcattctcataatatattatctgagctaagtggaaagaaaagagaaagaagatctattcctatacttttaatatacatagtatacatacattctagttaactgatatactagctaataccctctatccgatgccctcctggtactttgagaagccacccctgactgtcgagttccttacgacagcccgtcatgaccatacaaccggggctaaatatggaggaatactctcctcagggaattaacttaggattatatatcggcgtggagaaatacgtactgagctgtcaccatcagcggcccacctctcatccgcaatatataaccccaaataataatatcccgtaatctagacaccacgtctaaactaccagatactactccaatatcatcgtcatgacatagagtaactgcataagcaaacattatacccgcaccaaagcatctcccagataagctagccgtatatttagtataacaagaacataatgtaaagtaggtatttatatacttggaaagtatttcaatccataaatgtatttagaagagtattataataaaagtacaaagcttacaaaagaggaaaggaaagctgctagagccatacccgaactcttccgacggcttccggactcttgatttctactctattcctattccactagctagatactactaaactaaaattgagagaaatgagagagctattgcttgaggtgtgtgtgtgaagtgagaaggtgaagtccttttatagctgaacta

SEQ ID NO: 2318 - DNA, 1501 bp, Oryza sativa
tagctatatataggggtgggaggacaacctaggggtgcctagggtcgtgctccaccagcttggggcgcaccccacatgggccccacctgggccggggtcccaaatgaagttacaagcccataagcccattataggtgacgcagcaccttgttcctgtgattccggccacacgagatggaattcagagaagaggctggatccgttagaaagagggctccgagagctttccatcaactactcacgggccgaaaatggaggtcgtatgcagattcggtggccgtttgaagtcagcagtgtagtaggtagccgaatcggattccagcacttggagtacttgatctcgatatcttcttgttcatccatgatgtgagcaatgattgcatccgtggtagccatgatcacatcatgtttggatcttgtatttattattatgcttaattcttcttcgattgagttcgatctattaagtaatattcataactgcaatatctagcttgtcttatgatcatcaatagagatagtatctgtcgacgggggatacccgtagaccggatatagagggtattggggtacgttggaacgaggatctacataatacgacatcaagcaaacgaaagacaagtaatatactggttcaggacccttgataggtaatagccctaatccagttggtatgggattatatgatgcaaatcacatattacaaagggaataatggaactcgatgataccgacgagaccgtagtcgagttggtttgactagatcacctagcgacttggcttctgtaggcttcggcttcgtaggttgtggtggatgtgttggcggtgagattcgatgccttaggtcccgcccaggggatccttataccgcggatcagttgatctccaagtataactcggagagatcggacccctcacgatatggcaacgacccagttctatccaagtaggattccttctatctgtggactccgtttctatcacttgatagatttccttaacgcatacaggaactatccgtatacgcgcgggtataccatatcagtatacaatatatatccaacgatagagggtataccttatccgtaaccccgacagtagcccccgacttctgcttaaatgaactcatgcaaccgatcgcgacttctgatgtcagaatcgttgtcgttctcatctagtcgatctcggtgtgataaccgtagatacacatagttatcgacaacatcgtacgaagttcaacggtcacgagtgaatttaaattgaagtccgaaaaccgttgcgcgtaacggacctagaattttccggcggcaatctctctcctttgcttggaatacgcaccgtcggtagtgtgcttattgaaaggaattttggggatccattttgaagtccgtttgccacagaacactccggtcttcaaacgcccttcgtcttctccgctcccgcaaaaaaaaaccctagtttgctcatcttgctttgttctccggcgatcctccggcggcga

SEQ ID NO: 2319 - DNA, 1501 bp, Oryza sativa
taaggaccaagccatgaagttaagcatgaaacgacccccgtacaaccgtacttctcgaatgggtgtagacctagcggattagatagctgagcggatgcagtatccctgcatagatggttcacccctgagtgaggcaggtgcgctacggtgggacagccattgaggtagggccgagaggcgtgccctacatcggtgtcaccattggtaggactgccatgagtgtgtgagagagagaacttaacttgaaccataatttaatatgtgtgtgagacttctctttcccgggagcgccagaactcctctcactgctagaaacatggacgcctagagtgcatgaggatttaagttcatggagcgggtactgccaatgcgaggttatcgaaaagctttgccgtgacgcgtctcatgtgttgggacgaggctcatgtgttgggcagtcgcggagtgcgggtaaagtgtacatccactgcagtgtgagtaaaccaaatctattcgaatagccatgctcgcggttattgagcaccgggacatgtattacacttggctagactctaaaattcttaaacttgtgtgggatgggatctgcatgatgatttttatactgatggagccacttcctgagaggcgggaatgtggacgtcctcagaaaaccataacgactcaatggcgggaagctatccttgggatcacaatggatggtggacagaaccgtcattgtttaatatgaatactggtattaaaacttgatcagtctatgctaggtcttaggcttgtgaaaagaattacaaaacttgctttgcgcaaaagaaccatagccatcctctgaattcctctgtcatgtgcatcattgctgtgatggcttgctgagtacggttggtactcacccttgcaaatataaaattaatcagaagcaggagatgaagcctcggaggatccctatgcctactaccaggagggagatgaagacgatggcgttcagtaggtcttagtacggtcgttgcctgtggcaatggcatgccgctgcctgaattccgctgccttatctatttctgcttttggatgtattccagaccgctcggtccgatgatttaagactatgcctgcgggcctatgatgtaataattcgtattagacactcgtgtatgtgcacttggtattccagctatgaattcgtgtgtaccaaactacttgatccagggaaatggtactgtttacacgattgattcctgttataaaaacgggggtctacagagctggtatcagagccatacgactgtaggaaaagaccaaaaggcgccccaccccttttctaagttggccaagggagaaattcccatttagtaatactttcaaaaataaaaacgctatgtttacaaaactcggtacaattttcatcttactcttaactattttctttacaaaaacaagttttaccctcaactgactttgggtttttcttaaaattagatggcagattcggattcacccgctacctgggagt

SEQ ID NO: 2320 - DNA, 1501 bp, Oryza sativa
  unsure (1)..(1501): unsure at all n locations
gtcttcttgttagagtatatggtagttagagtcatattaggataggattgatttgtgtggactccttccatatctgtaatccttccttatctcctccccatgtacttttatatataccggctccttgaggctcaatacaatcgttccacgatacgcagtatacctctcctatactatccaacatagtatcagagcgggcgatctagtcgcctctctctcacgcttccactcgtcgcccccaggagggtttcaatctcctgggggcggccaccgtttttttttccttcgcgttgtcaagtcgatgtcctgagagagatcgatctcttgggcgtttgcatcgtcatcaagcagcagtagctgagtctccggtcatcatcggtttgctcgtcgtcctacctccaccgcccctacctccgatggcaaccgtcagcttatcgacctccgccgggctccgcggctgacggacggccttgtctccgcctaggtcgccgccgctctgggggagatcgtctccgattggctgtctccctcaccgtcattgtcaggtccggtcatcatcggtttgctcgtcgtcctacctccaccgcccctacctccgatggcaaccgtcagcttatcgacctccgccgggctccgcggctgacggacggccttgtctccgcctaggtcgccgccgctctgggggagatcgtctccgattggctgtctccctcaccgtcattgtcaggtccgccaagttgcatgcaccagccagttgcacctaaaagcctaagctgatagggaaaggcgggcaatttactttatacactccaacactccccctcacacgagaccctctcaagtcttaagcgtggaatattggagtgggctgcaattatttatttaattgtnnnnnnnnnnnnnnnnnnnnnnnnnnnnnnnnnnnntgataccatattaagttgcatgcaccagccagttgcacttaaaagcctaagctgatagggaaagacgggcaatttactttatacactccaatagtcccttcgatcctcccatgcatcaaatcttcacagcataaatatgaaacgtgaacagtgcatttgaaattgtctagaaatgtcgatcgtgacggcaggtgccacatcgagtactatatagggtgtgtcacatggggtgtttgggcactaataaaaaaattattacagaatccgtcagtaaaccgcgagacaaatttattaagcctaattaatctgttattagcaaatatttactatagcaccacattgtcaaattatggagcaattagtcttaaaagatttgtcccgtaaattagtcgcaatatgtataatcagttattttttaatctatatttaatatttcataaaggggttcaaacgttcgatttgacagggtgaaaaattttcagttactatctaagcagggcctgaacatccataatgtagctgtctgaaatctgaaaagaacgcctaatcaaagctgacagcaacactatcgtata

SEQ ID NO: 2321 - DNA, 1501 bp, Oryza sativa
tttagaaaatttgctgataaatatataacaaaaccgttttttattttcacatgcatttcctattcatataattacaaaacaagatagaaacataaacgggataaaagcttttgtaggcaaccaaacacgtccaattataccacccaaaacagcacggatctcatggcgttggaattactccatcgttgatcattgtcactgaagggagaccctagcttagctaggtaagggtaaggtagcggtagcgcctctatcaaaaggagcaaaagaaaacgaccgttcctccacgcatgagcatgaactgtgcgagtctgggtgaacagcagcaatgaggagtgaggaagaggattcatgtgtactggcgtggagagcgaccggtgatgggtgatggggtgagggggcggcgtggctggcacgtgcttggttgggttgggggcatccactctttctttctttgtttttcttttcttttctttctttttaaggaaaaggatagatctcttcacactctcatcacctgtactggaccatcttttgttaaaggcgaattcaagagagaagccaagagaaatggttggctataacaaaagtaccgggggctaagcccctggatctagagtgtattttttttcaaaaaaaaaacaaatactccttttatcccaaaatataaaaaataaccaccactaacacaaaaacaaaaagtaaatttaatcacctcatcaattggatcacctcgaaacatgtaaataattatgtgattggaagtttgatggtagatgatttaaaacaaagcaaatttaaatgagctagttagtactatatacatgactgcgtgccatatattataagacatggagaaaaataatagtgtctttatattttatattttagaatggaaagccagagtacttggacaaccaagaaaaataattggtgtcggacaattaaagttgtgttcggaaccccttgtttccatcatgtaaaatgaaatatacattggcgcataattaattaagtattatacattggcgcataattaattaagtattagtttaaaaaacctgaaaatagattactataatttttaaagtaatttttctatatattcttaaaaaaaacacgccctttagtggtttgagaaggatgtgcgtataaaacaagtgagtagaagttagaaagatgggggtaaagaatatggtatagatccttatcaaatccacgacttaagatgactacaactgagcatgtggttttttctttcgaataccagatatataaaggttcagcctattctaaactgatactgtaagtctaacatcggtgtgttaaacagaggagagaaagttcctcgtttttcacgcgcgtgcattttgaactgctaatcagtgttttttgaaaaaaaaaaatatagaatttttttgcaaaaaactatattagtcattttctagtttaaaatagttaatcacacgctaacgatatacctcattttgcgtgcattatc

SEQ ID NO: 2322 - DNA, 1501 bp, Oryza sativa
aagtgatcccaggctagagctcttgggggcttcctagcggttgagcccgtgaagcccggcggccaggatctgcagccagccggcccagccgtcgagatcctagaggcgggggcgggctactgtcgtcggcgtcgggctcttgggggcgttcccagcagttgtgcccatgaagcccggcgtcctggagctgcagcaagctggcatcgagctcctggggacggggtggggcttgggatccagccggcggtgccgggctccagcagccgcgttgggcgaagggcgacagcgtcgagctccaacagccgggcgctacgttggggacagggtggggctacagcctgcgtcgtcgggctccagcaggagcaatgggaaagggcggcggcgtcgggtccatctggcgcgatggggaaagggcggtggcggcggcgtcgggtccagcagccgcgatggggaaagggcagcggcgtcggtccttgccagatgtgcgttgggattcttatgtctcccagcaatagtgtacaagatgaaaagaatcaaagattacatagcatcggaagagtagctcagtggtttgtttcattgtttgtacttgggaagccagaggacgtgggttcgattcctcctcattgcaagaagtgctacaatttttattcttttcaagttaatattacattttttattcttttcaagttaatattctaaggtcccacatgtccacctagacatgctcacgtggctgtgccaaggtgttccttttttttaaaaaaaaaatgatttttaaattatgacaatcatattcattcgcttttgtcatgaactattgtcacaaagaatgggaaaggcacatggtgacatttgtttatgactaaattacaacttagtcacaaacgcttgtcattcaaagaaaaattgtcataaacgcatcactactgtgactaaaatgtgttttgtcatatgaaatttgtcatagaaggccaaatttcttgtagtgcggtggaggtatgtttgaagtgtatagtggcaaagttgacattcggtgttatttagctatccaaattgctagtctattcgttgtgtacatttacacgattaatcaggcaaagaacttacatttctttagaggctacgacctcgaaatgattacacatcggttcacattgatgaagcccataaaatatatttcatagatgcatatatcatataaattttgaacggttggatcataatctaaaggctagattgcatccatgtttcctacattcttttaacgaaccggtatacgctggtggagaaaccctttgtagtcccggttcgtaacccccctttagtcccggtttccaaaccaggagtaccaatccgggactaaagatcgctatctttagtcccgggtgaaataaccgggagtaaagattgatctttagtcccggttggtgttaccaaccgggactaaagatcgagctgaccttttttttttttgcatggccctgttgctgcatggttt

SEQ ID NO: 2323 - DNA, 1501 bp, Oryza sativa
tgacttctttcaatggttttaaaaacggttttttgatgacgtgacagaatgatttggtccaagtatactgacgtggcaacccagccatcaaaggaagtgaaaacagatatggatcccacgtgtaaatgacagagataaaaataaaaaatggtggctcacttgtcagccccacttctccttatcttcttcttcctctcacaggcaaagctggcacgcacggcgacggtgacaagcggcacggaggaaataagttttggaggtaaagaagaacaatagcttggatccaaatgcgaacgtttgctccaagaaggagctacactttgaaaaatgtttgcagcttaattgagacaaaactgaagcttcgattcttgtcaaaccaggttttgtttgaactaattaagaacacaactgaggtcaggcctgctgtatcacgctagctcatggtgatgatcagatcagcaggaggcaaaccgcaacggcggcgcgttacaggagcggttcgaacaggcgctcaactacgtacgtacatgtcgctgttcgaaaaagaagtagcgctgacaagtagaagccccatttttttattacacgatagatccacatgtattttcaatttctttcatgactggattgtcacgtcagtgtatttggattaagtcaacctatcacgttaacaaaaactgctatcagaaccaccaatgagattaatttgcatcaaattttgaagttggaaattgcattatacccgattcaggatgaccaacggcaatagctgaaagaggcaaaataggcttattccgtttttaatgtctgtgtaccgggcttttgaagacaaatgggccatgtgggctatatgacatgtagatgccatgtatattcttttcagtgtcaatataaagttagtatcaataatttgtgttggtagttgtacaaatttgaattgaaaatcttctaaagtctatattgaaaattttttatattgaaagttataaatgttgtgttggccacggtggcgatcgaccagcttagccggagggaaaaagtacacctaaggtacctcaacttgtcatcgagatacaaaattgtcccacaatagcaaaaccacataccgggcgtccctcaactaacaaagccatccgctttaggtccatcggtggttttgaccccggttttgtccgacgtggcggctaagtcagtgtgggaccaacgtgggccccacatgtcagacaatccacgtcagcctcctctctctttcccctattctctccattcctcctctctctcactcactcactcttctcttctcttctggggtggcggctagagcgacaaggcagcaagctggccggcggctgaggcggaggccgccgaggcgaggcgagagaggaggaggcggcgggtgacaaggcggcggcggcggctgcgacgtgggaaaaggcgagggttgcagccggtcacgaatggcgttgacggcgttgggcgcggaggcggaggtggggccgga

SEQ ID NO: 2324 - DNA, 1323 bp, Oryza sativa
gttggtgttaccaaccgggactaaagatccggggggggcctgacaggccctgacagcattcgaatcgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtatgtattcagaccctatttagatgggactaaaacttctaagtctcagtcacatcggatgtttggacactaattataaatactaaacgtagactattaataaaacccatccataatcttgcactaattcacgagatgaatctattgagcctaattaatacatgattagcctatgtgatgctacagtaaacattctctaattatggattagttaggcttaaaaatttatctcgtgaattagttttcatttatgtaattagttttataagtagtctatatttaatactttaaattagtgtctaaatataaaaactaaagttaagtccctaatccaaacaccacctcactctctctattctttcctgattaagggtttccattagaacgcttttgacaccaataaccggtgcccgttgaaaaactttatatatatatagattgcactaaaatatcaaataaatctatttttttagtttataataactaatactcaattaaaatgatatttttgttttaggtgcccttagttaattttagtgctgatctttccattaaaggccgagtttagttctaaactttttttcaaacttttaactttttcatcgcataaaaaatttcctacacacacaaacttacaacttttctgtcatattgtttcaatttcaaccaaacttttaattttatcgtgaactacacacactgaaaaaaagaaatctaaatcctcatcaatctcgaacgggatgcgaatttcatccgatttataaccgctccaaaacccttctagaacgtctcgtcgttcaaatcgtccgcaccaaaaacccacacctccttttccttcttcctctgcaagcaaagcaacccggtcgaacaccacacgccgcgccccctcctccactcctcctctctcctccgccgccgcggccatggtgctcgagctcgaggtccgtatgccctccacccctcccctcccctcccctccccatttcgtccctcctctcgcttccccccattccgcgaggcgagctctagccgcggcgagcccggccgctacggcgattgaatttctgacgggttttggaatcgc

SEQ ID NO: 2325 - DNA, 1501 bp, Oryza sativa
atcgtgcttgctcgcttgacgacgacggcgtgctcaagcgacggccacggcggatccggtggtggggaaggcggcagcggcgaatccggaggcgagctcgggcgacggctgcgaatccagtggtggggagggcagtggcggtgaatccggaggcggggagggcgacggcggcgaatccagcggtggcggcggcgaatccaaaggtggggagggcggggatggctcggtggcagcggcgaatccggaggcgggctcgggcgacggcgacagatccggtggtggggagggcggcggtggaggggaaggcggcggcgatggcgacggcgggcgagggtgagtgctgcggccaccacccacgtccacatcgtcggtgtctctaatgtcagcgccacttctccttccgcctgcgccactggtcgccgctccttcttacgctcacgccgccggttgccgctcatccttctgccgctccgctccttttttttgctgggagtaacgtggtgctaacgtcactccctacaacgaatttacttctaatgttgtaataacttacttccattttgtgctaagttattcttatgatttatgtaaattaattttatactttattgaatttacattcataaatgtatttacttaaaaatcttctctacactctgcttgtgaattttctctacatagttgtcaggattatggataccacatacctaatagtagttgactaaatcttggcaggatccactacataccatgtcttatacagaaactgacctcaagggagttccggataaggaaagacaaccagagttctacatggaaacgacaaggactacttggactgtatccatattggtttccctagttctacttagacaaggggacacctatgggtataaatacaagccccctaggaggacagggggacaaccatgacgagacgatcaacacccaccatgggacagagaaccaccatgaaagacacccatgacaattaacatatgcccaccagaagccacaacatacaagccaacatacgccaagacaagccgccggatatcgacatcagagatacgcctggatcgaccctatccggtaccttcagaggccggccgtagggatctagcattgaatctgattccatcgggtgcgagctcgaggaggaaggctaccctgttgtcgactatgagtcagatcatcagaccgctatgtcgacaacagttagataggctaccctacatattgtactagtgtgattatggtgaataaaaagcaacatcggctccagccaacaggatgtagggctattacctgatagctcaggggtccgaacctgtataaaaatcctcgtctccatctcttttaccttagtctcgcgtataccctagcaccgatgatccccatactgtccaaataccgtagtcgagacatcaaacgtcgacagtggcgcgccaggtagggggattttggtgcttcaggatttcgacgagatgggttcaaaaga

SEQ ID NO: 2326 - DNA, 1501 bp, Oryza sativa
ataagatttaatgtgacacattcaataagatgtgtcatatccagtactagattgattttttatgagacggaaggagtactaattatcttgtaattttttaaaagttttttttgcaactatttagacgaacggcatgtaaaagatgggaggacatatcttaagagtttagaacaattttccatgtacgtacacacgtatataagctcagtcagcgtacgtacgtgcgtacttgtcctagaatatacgtatctttaaatctttttgtgggctaaatttccgtgtgtttacattgagaccatttgaataaaccgagactatcgatcaatcactttcggactagatcaacatctaataatttacacattcgtttgttctctgggtgagaacaagacatgcttactaaaaattaatagtaccttggtgtatccctaccaatatgaaaaaaaaataatttataatatatgataaacacatttgtaatatatcaggtaatatgtaattcgaataaaagggatcaaagtatagaggaagagaaattataaagttatttttctaaggaaaagagcaatgccgataaattaagaagggagaaaggggttaaaaatggagttgacccaacatgaatcaggttatgaaaccaaatgaaatgaagatattttattaattatactttgatgaaagagagaacttgggagcaagtaattgacaaattattggagagactgcatatgtccgatcttgacttgttatctgcttggtgagcaagcaattaaaagaccgaaactgcgaggcagctaactaacggaggtacggaaagaaagttctatatatactagtgttggtttggatctttattaacgggataatgcccaacgctgtgctgcgaaatatatgttagatattcgaaaagtgataaaataatttggatagaaatattataaaaatgatttagcatgtgtatgtttagttttaaaacaaaataaattgtagttgtagatataattactgtatgattgcatgttgagttttgtttgcttaatgggttgatgtgacatgcttgtatgtaaattttaggagtactaataaatactaatattatatattaagttttaggtgtttagtggacaataatagaaagaagggattgactaaatcaataacgtgcagtagttctgcgctgacgaaaaaaatatgattaattttgatcttttcttaattagtcgttcatgacgcactattaataattaaattaagttgcaccacggtacgtaacacataaacttgtacgccctttatttttgagtttacggcgttgttcacttttgaacataatatatttccgtcttatttaaaattttggtgcaaatataaaaaaatacaagtcatgtttaaaatattgaagtagaacaagtgatatacatagttggtttttcagaagacggattgtaaactgtcagatccaaaactaacgacatcatatattataaacaaaggtacaaag

SEQ ID NO: 2327 - DNA, 1501 bp, Oryza sativa
caaaactcaacatgcaatcatacagtaattatatctacaactacaatttattttgttttaaaactaaacatacacatgctaaatcatttttataatatttctatccaaattattttatcacttttcgaatatctaacatatatttcgcagcacagcgttgggcattatcccgttaataaagatccaaaccaacactagtatatatagaactttctttccgtacctccgttagttagctgcctcgcagtttcggtcttttaattgcttgctcaccaagcagataacaagtcaagatcggacatatgcagtctctccaataatttgtcaattacttgctcccaagttctctctttcatcaaagtataattaataaaatatcttcatttcatttggtttcataacctgattcatgttgggtcaactccatttttaacccctttctcccttcttaatttatcggcattgctcttttccttagaaaaataactttataatttctcttcctctatactttgatcccttttattcgaattacatattacctgatatattacaaatgtgtttatcatatattataaattatttttttttcatattggtagggatacaccaaggtactattaatttttagtaagcatgtcttgttctcacccagagaacaaacgaatgtgtaaattattagatgttgatctagtccgaaagtgattgatcgatagtctcggtttattcaaatggtctcaatgtaaacacacggaaatttagcccacaaaaagatttaaagatacgtatattctaggacaagtacgcacgtacgtacgctgactgagcttatatacgtgtgtacgtacatggaaaattgttctaaactcttaagatatgtcctcccatcttttacatgccgttcgtctaaatagttgcaaaaaaaacttttaaaaaattacaagataattagtactccttccgtctcataaaaaatcaatctagtactggatatgacacatcttattgaatgtgtcacattaaatcttatatttacttttttagggacggagagaatatatagtaatatcactctgcatgtttaaatatgacttgtaacaaaaacaaatatatatgtggatatactcataggtttgttttttttcacaactcatagaaaggcatatttaaaactgtatatttctcatattaaaataatatgtttttaactatttagatggtatatgagagacggtgaaatatcgtcgagagttttagaatcctctcccgcgtgtacgccagaatagtaaatttacgtcgttgttgatggatggctacagctaattttttactattcaactacagctatcaacttttaattggtctccatgatttcctcctaattaaatacattcttctccaatgattcagctataaaaccttaccaaatccacaaagttaatcaccatatttaggtggataaatctcatcagatcgagctaagcttggaggcaagcacaaa

SEQ ID NO: 2328 - DNA, 1501 bp, Oryza sativa
cggtgaccacgtggaagacgtggcgcgccggctcggcggctgcgcgcgccgcggaggccaccacgacggacacggcgagcacgttgtcggagaagatggcgtagtggtacagcgccgggtcggtgaactgagggggcgggacgggcgggtcgtcggggatggcggaggcgttggcgaggcgtgcctcgaggaggcgcatgacgaggcagtggagcgacttgggcgtggagccggcggcgatgcgggagttgaggaggcccgcgcggcgggcgcggaggagctgctggtcgacggcgaagacggtgtcggagagcttctggatcttggactgcgtgtcgaacgcctccttggcggcgcctgccagggagcgggcgcgcttgatttgcccgcgcgtctccttctccaagagcgcgacggtggacagggagatgcgggacgagagcgagctgagatgcccggagatagacaagaaagactccgtctgggaggcggaggccgcgctgagtttccgcgcctgggccgcgtaggcggcgagaacggcggcgtggtcctcggcgtggcggcgaatggcggccagccggaagggtgcggagttcggggcggaggcggtgcccgtcgccgacaggaggaaagcgagggacgcaagcaagaggagcgtgatcagcgccgcgagcgccgcccgccgctgcgcggaagctctgccgccgccgccgccgcctgccatgggagcgcgtgaagtcggaatcgctcgccgtcgagcaatcccgaggcgaaatgcggaggaaaagggcgcgcaacgctttctaacgccggcgaggtgggtttagttaggttctcgtgggcccttctgccagtgactcatagactgtacatttggggtttcaacggtttgacgtgagaggctggccgtgtcactgacatgtggggcttttctcccaacctccttgtgcgatcggatttgaagtgggttaatggtcagtgtgtccggtagtggcacactgagaggagcagtgagttggtgatgaccagtaaggcgccggatgacgacggccaaccatgttagtgcagaatgcagaataccgtcttctgttttgacaatgtgattgttgggttatcctagcccgatgtcagtgggtgttgcgagggtgcattgacttttttttttgtgtgtcgcaactaaggaaaaaaaggttaaaatattggttttggtttggtcgcactatcatggctagtggtggcatgtcgatgatttgcctaacaatattgttggagttgccgatatcttgacagtgtgaacgagcggactgtcaatctggatgcagataacctattcggatttaggcccaaccatcacgacaggcccagtattctaaccaaactgggcctagtttgagacaaaggtcaacccatttggtccactaataactggacaggaatagatttttatccgggccgattataggtcgaactgtcgaagcgacgaaacgtcagtcctgatgag

SEQ ID NO: 2329 - DNA, 1501 bp, Oryza sativa
caagcagctcaagctctaacactggctggctagctcgctcgctccgtcgatcgcttgctcgttgtggtaatgagcaggagtatttatagggagatcgagctagctaaggttgagaagcctgagcaactgggaggtggcaggtactagtagttacagtcctcactgccttttgattaggcaggcctacttgtcggagcaccactgggtacagtgcttgcatgcatagctcattagccctaattaatcagcataagatcattgtttctggtctaatttttcgacggggattcagattttgtttaatccgttcaaacacgttgtcggatcagcattggccgagaaacagaaacgcatacttgattttgtattctcgtcgagggcataaaaccgcgcgtcatccccccgtgaacgacaacgagagcaacgttgcctctgtctgctgttagactgaaataattgtgggttttcaattcacaaggtgttgtaaactatatgcctggataaagcgcgacgtcgaggtcatgacgccgatatatgggtgacgaacaaattctttttcttttgtagattgggggctcccctgaaagaaatgatactatagggatggatatttttggtcattctacgtacgttttccatgccgaatgttaatacgttttttttgcgaaattcgtcacctgttgtaagttgacatttttcataatctatactcgtagaagagacgaaccatgtgtgccaatgccaactaggataaaccgtaccgaaatttactattggccgaatttgccattgtccctgtcagaggttgccgccattgccagattaatgatggatccgtggcaactgaacaaattttcaattgtaggattgccatctctggtgaccaaattgaaatatccgagcagttaaggatttgcaaaggtgacattacaataaggggttatcctaaccactctattacgcagtgtgcatgcttcggttagcaatgctaagcaatgtcagagcagaggacgttgcacttggatggtcactgtcaaaactgacctgctactattgaaaaatctcatgtcagttggagtacttcagcaatttgcaatcctagcttctctcattgagcttagctcacattcagtttttctttttttgccgtactgtacctgtaggatactccctccagttcgaaatgtttgacaccgttgactttttagcacatgtttaactgttcgtcttattcaaaaacttttgtgagatatgtaaaattatatgtctacataaaaatatatttaataatgaatcaaatgataggaaaataattaataattacttaaattttttgaataagacgaatgatcaaacatgtgataaaaagtcaacggcgtcaaacatttcaaaacggagggagtactatcttgtactaccactatcagtaactgtcttcagagttcagatactacagttcaggaaaacaaaactccaattcaggcagctgaattttcatcac

SEQ ID NO: 2330 - DNA, 1501 bp, Oryza sativa
gtgtgcgaattaaaggggtatcaatcatgagcaattttgagggattatggaaggcggaaatggtgatgacttggtacgtacatactgagaatgggacgcaccaggaatctgtattcaagaacaagaggaaaattaagtccatttgtgcgttgtaagccggccagtggacaagacccatgctaactgaagaacccgaattgctccaaacttaagactgatttcctgtttaacatagccaattgtaccgcgaggccatgaacatttgatcacaaccttttctgtagcagtgggagaaacaaccaagaaaaatatgcacagctacaaaatcttttttttgctcggaaggcgtacatccaattgatcccaagcctgtgatgttgcgtgattgttatagaatacgcatgcatgatgcatccgtgaaaatacatcagaaatgaaaatcatatagtatagggtcttgacgatgcacaagggcaggacgggtccaccgctcgccttgtgcatgtgtaacgaagcaaatttttagacttctagcattaaattctctgtatggtgttttgatttagggttaattggatccatgccactgcaactttgccaaattgaaaaaatgccactactattcgtcatatcggttacatgccactcgaaatttctaaaattagaaccatgccactccagttagttcttccgtcctcctctctcacgccgtcttgttcccgtccttatccccctcgctccttcccgtcctcccgctcccaggtggccggggatagcaccaccaccttcgtcgtcctcgccggcgcaagggttggcggcggcggtgcacgaagatgaggccggcctgtgccctgtggttcccgttcgtgctcgccaactcgctggagaaggacatcttctcggacctcttctacgaggcgcccgtcgcggcggcggcatcggctgcggctgctggcccgggcgccgatggcgacggcgacggtgaaggcaagccttgcaaggacgacacggcaatggcggaggagtgtggcgggccgagcgcggcgtccgaggcgccgcgcgacctgatgccgccgcctaagtcgatgcacgcgtcctgctcgaggcagcaaacgagccttgcgaacggcggcgacaacgccggggacctgtcagagcttgtccgggcgaggacgtccggcggggcggggtggcgcggcggaagccggaggccggtggcgccgcgtcgtcgtcgatgctgagcgcgatcgggttgagcatctgcggatttggttggatttgttcggatttgttgaataaatctagctgttttgtttgttttagttttccctgctttcggttctttctactttgcttagtcaaacacaatttggctttgttttcggatcatgtgcagtaaggcttgacacgcgctgagttcgcgcggagctggtgtcgtgctcgtcgtgtcctggattgtgggatggcaagacgtggcaacggatacgtgcgcacatttagg

SEQ ID NO: 2331 - DNA, 1501 bp, Oryza sativa; identical to SEQ ID NO: 2328

SEQ ID NO: 2332 - DNA, 756 bp, Oryza sativa
tgatgcgaaaatcctgcatggatccaagtgcagccctctcatttgtcccttgcatcaggaaattaaattaggaaaattatgcaacccaaaatcccatgggcccaagttttccttccctgtcgtccaagcacccaacagtgtaagaagcttagaattaaatgagggaagaggtcacttgtagggggtttatagaggggtaattagggtcaaacctctgagttcaaatgcctaaagtcggtccgtggaaaacctatgcagttttctattcagatctgaagtgttcataccagttctatttctacgagtattccttcctgcattagtatgatcttgttacaaataactagcggtaaaaatcttgcaaatagatgtgtttttgtgctaatactccctccgtactcgtaaagaaagtcgttttggatagcgacacgatctccaaaacacaactttgacttctcgtttctataaaaatatgtatacttttatgaaagtatttttcaagacaaatctatttatataatttttacattttcaaacttaacaacttaagagttatttatgatttctattcccaaagtttgacttaaacattgttttaaacgattttctttacaagtatggagggagtaccttttaaattattgtgtgctaagcaggtgacatgcactcttgttttacagactttttacggtggagtgttaacatatgtagatacattactaatgcttattgcttcagttgtctgccctttgtagc

SEQ ID NO: 2333 - DNA, 1501 bp, Oryza sativa
ttcctgaactgtagtatctgaactctgaagacagttactgatagtggtagtacaagatagtactccctccgttttgaaatgtttgacgccgttgactttttatcacatgtttgatcattcgtcttattcaaaaaatttaagtaattattaattattttcctatcatttgattcattattaaatatatttttatgtagacatataattttacatatctcacaaaagtttttgaataagacgaacagttaaacatgtgctaaaaagtcaacggtgtcaaacatttcgaactggagggagtatcctacaggtacagtacggcaaaaaaagaaaaactgaatgtgagctaagctcaatgagagaagctaggattgcaaattgctgaagtactccaactgacatgagatttttcaatagtagcaggtcagttttgacagtgaccatccaagtgcaacgtcctctgctctgacattgcttagcattgctaaccgaagcatgcacactgcgtaatagagtggttaggataaccccttattgtaatgtcacctttgcaaatccttaactgctcggatatttcaatttggtcaccagagatggcaatcctacaattgaaaatttgttcagttgccacggatccatcattaatctggcaatggcggcaacctctgacagggacaatggcaaattcggccaatagtaaatttcggtacggtttatcctagttggcattggcacacatggttcgtctcttctacgagtatagattatgaaaaatgtcaacttacaacaggtgacgaatttcgcaaaaaaaacgtattaacattcggcatggaaaacgtacgtagaatgaccaaaaatatccatccctatagtatcatttctttcaggggagcccccaatctacaaaagaaaaagaatttgttcgtcacccatatatcggcgtcatgacctcgacgtcgcgctttatccaggcatatagtttacaacaccttgtgaattgaaaacccacaattatttcagtctaacagcagacagaggcaacgttgctctcgttgtcgttcacggggggatgacgcgcggttttatgccctcgacgagaatacaaaatcaagtatgcgtttctgtttctcggccaatgctgatccgacaacgtgtttgaacggattaaacaaaatctgaatccccgtcgaaaaattagaccagaaacaatgatcttatgctgattaattagggctaatgagctatgcatgcaagcactgtacccagtggtgctccgacaagtaggcctgcctaatcaaaaggcagtgaggactgtaactactagtacctgccacctcccagttgctcaggcttctcaaccttagctagctcgatctccctataaatactcctgctcattaccacaacgagcaagcgatcgacggagcgagcgagctagccagccagtgttagagcttgagctgcttgttcttcttctacctcctgcactcgcgtgctgcacaag

SEQ ID NO: 2334 - DNA, 1501 bp, Oryza sativa; identical to SEQ ID NO: 2329

SEQ ID NO: 2335 - DNA, 1501 bp, Oryza sativa
aataggggccaaaacaaaaaccctaaaaaatagaggcaaaaccaatattaaacatgaaagtaggggtaagaatgaaattgccccatatatagattcaaagaaatatatatagatataatattactgaaaatatatgtatagtttttttctaagaacttttagtgacatttatcaactagtgtgaatggtgtgtgcacgtgaaaacttgtatatataggatacattcatatcatacaaatattacataataaagtagaggacttccccatacaaaatagctagttaaatattggatttgtgataatactctttgcgcatatgtccatatatgcaattatattttgtatagaatagatcgatatttgaatctaggattagatttaatgtacaaacttatgtttatatttgtgtatacaattgcatctttatacaactatattgccatcgctctatatcattatggtttggtttcatcacgatctaacggcttaatattttttattctatgtggcgaacatgatatatcatttccgagatatattgtatatttaggttgtgttcttcaatgtgttggaaattaacccttcacacacgtaaaatgaagtaatggattaccgcatgattaattaaataatagtgaaatgagcgtggctcaactggttaggttccttgtggtggaaccaactcacccaggttcaaattcaagattgacacaggtgcttgcatttacggctaattattcttttagtgataggcgacgtacctgtcgatagtgaagtgacaacccaatcttccggaagtgtttatagggggtagggtagatatgcgacatacctctgttgacagcgaggtgctagcacaatcttttagaggtgctcatagggggtagggtagatatgtcccaatcttccggaagtgcttatagggggtagggtagatatgtgacgtaactgttgataacgaggtgctattttccgaaggagcttatagagggtagggaaaattaagtaatagcttaaaaatcctggaaaatggattaatatgatttttaaagcaacttcccaattttctgtatgtgctcatagggggtaaggtagatatgtcgttcagttttccagaggtgctcttagagggtagggtatttatttattacatatattatagtaaaaaaagtcaaagatatattttgttattcaaaacatcaagaaatatctactattatttattggttagtgttgttaaaggggtatttggtttgtggcaacacaattattagtttgctccctgagcgaaaagcaggcaaacgccttcgtaattagagagagagaaaaaaaaaaagcaggcgacgccagcactgcagggaagaagaggaactgaagcctttctcttctgtccgccgctgcgccctccccctctctgtccacgttcccccaccccacctcggcctaaaaccctagccgccggcggagcgggacctcaccggcggcggcgatgagcgggg

SEQ ID NO: 2336 - DNA, 1501 bp, Oryza sativa
gccgctcgccatgtgctcgccgccgtcgccgcccgagctcggaagcgccgctcgtcgccggcctcgctcggcgcagctccgcccaatccaacgctagcatcggattcccgtagccgcgtagatgctctcgccgccgggaatcgacccctcgtgacctcgtcgccgtttcccccttctcccgccgccggttgccgccgccgcaattcgccgccgtcgggcatcctccggcgaatccgagccattggctcgtctcccctcgtcctgagcaaccacccggtgcgctcgctttcgcctgtatcgccgtggttcgctccgccgctcgtcgctgtcgtccgccatccgttccggccggcgtcgtcgtctacctcccgccagcccgcgtggcaaccacgtaggcgccacgtcggcgccagctcggccgagatcgggtcgggccgaccccggtcagcccctcccgtgcgtgcgttccaccgcgagccgtgaggctgcgcatgggcccgccgcatccgcgtcctccgcgaaccgcgcgcgtgcaccgcgtctctcccccatcctagcgccgcgccgcgtgctccctccgcacggtgagccgagccgctgacaagcgggtcccactcgggaccacgcgaggtgggcccggtccaccggctctctctctcctcccctcccgcgcgcgcgtgccttgggccgccttgggccggccggcccatttagctcggccgagccgccccttttctctcgggccgcgccctagccgcccgagggaagtctaatttccctccctcttttcttttcttttcttttctttttcaaaaaggatttaattaaatccttttactttagacccaaaaatccaataatcttagaaattcaatatcttcccaaccgtaaatccgtttgactccgttcaacttccaaaattcctcaaatctcgagatctatctaatggcacgcttagaggtctttaatagggctttattttcgccgtttgttgagttgtcccgtttcgcgtgtagtttcggagcccgaagactcgcagtgcgaggatttcgaggatcaagctccagatctcgagcaaggcaagccacctttgagcatcttgagcctatatttgaatttaattatgttacttgaaaaatattacgcattgataggatcgcacttaatctgtttgtcccgtctgcaaggcagattggcggacctacctaatttgttgcatttgatccttcctttgttaattgttatatcatgtccccttgtaaccatctagttgtgcctcgatattcgtgcaccctgtgcgagtatcgacggtcgccttcaaacttaaaatctgaaaaacttcttgggtaaaacttgggttttacaaaaggcttggaaaacccgacacctgagtcggtgcttgcgaactaaatgaatttccaaaaccgcgaatcggggaacgtaccgggtgtacggtttcccgctcttgcacctaaggaccgtttccttggaatttcatccg

SEQ ID NO: 2337 - DNA, 1501 bp, Oryza sativa
aaatttttaagcctaattaatccataattagagaatatttaccgtaacatcatataggctaattatagattaattaggctcaatagattcgtctcgtgaattagtataagattatggatgtgttttattaattgtctatgtttaatatttataattagtgtccaaatatcttatgtgatagagacttgaaaattttagtctcatctaaatagggtcttacgctgtaaaaagaatgaactgattttaatttttactcatggtcacattatatttttacgtaatacttcctccatccacaaaagttacttagttttatcacaaagattaagaagaaattaaatcgtcttggatgatacaaaatccaaccaataagtatttagatgactccttggttctaatcaaatgtttaatttatctcttcatttaatttaagtcttcaatgcataaagactaaaataggaacaacttatttagaaaaacttaaatataaaatatgtgtaacttttgtggatggagggagtatttgaaaataaaggtgaatgagtactctctccgtctaaaaaataaactcaacctcgtaagggtgtgtttagttcacgcgaaaattagaagtttggttaaaattggaacgatgtgacggaaaagttgaaattttatgtgtgtagaaaagttttgatgtgatgaaaaagttaaaagtttcaaattttttttgaaagttgagtatttttttttaacggagggaataatgttgtgcagtaaaacccgtcagactgctgtgtggactgttgtcccgtggttcagtcaaagatgccatttataaacccttgccttaaaatatggagggatgtgtagctcagctcctggagctgacaactccgttagaatagtgcaggtatgtgaagaagacttgtatggccaaacgtaagggttagggtatgtactcctgagggttagagtaaagatggaagctttgccgtgacaacatttgcggaatgtatcaccgcgttaggttttgaagctgggaggggcggagggcagcgattttggttggtagtagtacgggacggcggcgaaaaaaaagaaagcaaaagcagtgctcccgctcgccgcgctcggtttcgacttccaaaggcaccgccgcggcggcagcttccccgtctttattaccccaccacgccatcccttttttttcacactcccgccacgcctcccaacgcccccgaaatctcgtgtccctacgtgccggagcagctgcgagcttttgcacccacgctgtgagccccacccgcgtacgccgcggcctacgccgcactccactccaccccaccctactgcgccgcgccgtttcaaacccgttcctttcgtttcaccgttcccaccacgcacccctctatttatccccgcccccaacaacctcgctgcactccacactccacgcctccgcccgctctcgtcgcagcgcaccccgtcgcgtgcgacgactccatccccgtcacaacaa

SEQ ID NO: 2338 - DNA, 1501 bp, Oryza sativa
caccaggttgaagtaggagtgcccgttgatggtgaaccggatcccgcccttcttctggcaagccaccctgcactcgagagcacgcacgccatggtcagtaagttccggtagatccaagaaagcgaaacgcgaaggcaagaaattgccggcgttggctactcaccggcggtaggagacggggacaatgccggccttgaagagagcgatgcgctggaagacgggctgggacatgtcgaagtgcgcgcgcggagggttgcaccagccgccgtcgtcggacgggagcgcgttgttcggcgggcagaagttggtggccgtgacgacgaccgagccgggcaggcacgagtggctcccgccgccgccggcgtcgcagcgcacctcgaagcacgcgccgcagctgaggccgttgttgaacagcgccgtgctcagcgccgccgtgttcgtcccgtacccctggctgtagaggttcccgtacccgcacgcccctcctgcacgcgaccaaaaacgcacacgcaaaacagtgagcacaacacgcagatgtaacaacatttcagcacagtgcacagcgagaaaaaaacgtacccatggtgcccgacgcgtcacccccgccgtagaacgtggcgtgcgccgacgaccacccgccgccgccgagcggcgcgtgctgctgcggcccctgtccctggccgtgtccgccgacatgcggcgcgcgccatcgcccgtgcccgtgccccagcccgtggtgccccagccaaagcccacgggacaacgccggcgggagcagcgcggccacgaggacaacagcgaggacgtctcggcgggacgacattgttgtgacggggatggagtcgtcgcacgcgacggggtgcgctgcgacgagagcgggcggaggcgtggagtgtggagtgcagcgaggttgttgggggcggggataaatagaggggtgcgtggtgggaacggtgaaacgaaaggaacgggtttgaaacggcgcggcgcagtagggtggggtggagtggagtgcggcgtaggccgcggcgtacgcgggtggggctcacagcgtgggtgcaaaagctcgcagctgctccggcacgtagggacacgagatttcgggggcgttgggaggcgtggcgggagtgtgaaaaaaaagggatggcgtggtggggtaataaagacggggaagctgccgccgcggcggtgcctttggaagtcgaaaccgagcgcggcgagcgggagcactgcttttgctttcttttttttcgccgccgtcccgtactactaccaaccaaaatcgctgccctccgcccctcccagcttcaaaacctaacgcggtgatacattccgcaaatgttgtcacggcaaagcttccatctttactctaaccctcaggagtacataccctaacccttacgtttggccatacaagtcttcttcacatacctgcactattctaacggagttgtcagctccaggagctgagctacacatccctccatattttaaggcaagg

SEQ ID NO: 2339 - DNA, 1501 bp, Oryza sativa
aacattcactatattgtctgcaatcatgaaatggatgttgttttgcttttattatcgttgttgaacctaaaccatgtgcaaaattgtgcaaggcagccaggcaggtttgtcgacaacataaagctaattttgataaatgtacctgcaggcagatagtgcaagagaggtcttcaccaaacgagttccgtgtttggtcagtgaccacatagtgtggtaatttattcagtgactcccgtgaaagccctttggatgaacaatctccaaaaatatcatacagatcatcatgaccaaaatctgaaatgctgacctgttgacaaagaacataaaaaaaatcagtaaaagaaaatgcttcaataaataacgatgtgttccaataaacggtgattctgcgaaccgaacatcgtttccaaagtacccgggcctactagccaataaatttgtaccgttgtctcaactaaataaagtggtttaaaactaccaattttgcaaatagaataatgaaatgatggccagcagatcaggtttttcacataaaaaaacattttataaaatgagaaccatggcaaacaaaattgcatcagcagaacatgtaactgacctgccaacgatgcgttgcatatcctgaaggtacaatttgctcttgcacaaaccgcgcttggaggagctgctctatgaaatctgcctgaacaccaaatcgttatgaatttttcttagaggcgtatcttacaaacacagacgagagatacatttcaaaatcatggtgtcaagccgtcgaggagtaaagtaaacggcacagcatattggaagaagttacatcaggctaatgagcatatatctttcagagaaataaattcgtcaaatacttcaggtcacatcatctgaagtcaaacgcattaatataacttcttggacaaacaaatatgcaagtatggaagaagcttactgaccatggaggatgtgccatgagagcccagccggtccgagcaccaataagcacgagaagcctcgaggacctcaatggagagcacagctccggcgaacgcccccaatccagctccccggagcacgccgctgtctgaagcccttccggccagcgcgccggtcaccgctccggtcaaggccccagcttttacaaagcaccacatcaaacaacggacataaaaaaaaatcggaacacgtacgcgacgcgaggccagcaaagaacgagctctcacgggcaatgctcgctgtcgctggcgtcaaagaatcacatgaacagctcgagcaaggggggaaagaaggggcgggtgttttggtgagtaccgagagcgaagaggccggtgagagcgccggagatgacgccggcgagaagcctggggaggtacaccgccacgccgctctcctccagcgcgtcctccgcggccgcgacctccatcgaaggcaggcgcccccccgggaagcgcgcgccgcgcggtttcttggtatgccgcgtgcgtcgcgcgggttggcgtggggaggcggt

SEQ ID NO: 2340 - DNA, 815 bp, Oryza sativa
cctccccccccccccccgccccgtatcattagttttatccgtcaacgagtttgaaaataccatcacagatataccgggacaatttactctttatttgtctactatgtaaaactaataaatcaaaatgaggattgagaaaacaagagagatcatatgattggttcaaatggatggcaacatggcatgttgtgttttcttctgctatcaagtttatctagtagctagccgtcaatatcaaactcgtgtcgtctatggtaacatttgaggcatatgggaggtttttggatatcaggtgttgagattttgatttttctgggaacagcttgaatttgattattttaaggttttggatgcccttttatatccgatgccgaattcgtggatgaacagtagcatcaaccgctgcctcatcggagccaataaagcctcacggtacgacggcgagtcggccggcggcgacgttgaggagggagaagcactaagcctcactcatatatgacaacgacgagttggccggcggacggcggcggaggagcagctaagcttcggtgccttctgcactggttttctctggtcacgacatacgtggttggaccgcaataactgactgactgattacacgtacgtcacacagcaatatggcaacttttcaactcacccaaagaaaaaccggagcaaagcagctgctggtgatagtaccaattactaccaagcacgttatgcagaaaacagtagtattcggcaactgtatataataaaatgaatgtatacagtggtccataagaattgagaaatatgctctgccatatgaaatt

SEQ ID NO: 2341 - DNA, 1501 bp, Oryza sativa
gcccaggcacgacccggtggtcgggccggaccagcatgggtccaacccccgtcgggccgtgccgtgcttgggccggaccaaaatgccatgccgtgggccaggttgtcgggccttgggccttttagccatttatacttcggtgacacgttttaaaagaagggtgaatttgaggtaatttctaaaaaaaaaacccgatgaattgaatggcaactagtaaaatttatggggagagaagattaggaaggagccgaaaactagtttggtctctggtggtattctaacatgtagacatgggttaagggtaacatttacgaagtgccatttgggtgaagcctaatataatttgataatctcatcttttactctacaatgtatcaaccgctgacaaaatttaaatttaaagttatttttaggatattttcaaagataatatttaattattttttttagcattgacattttagggctctgtttggctatagttatagcgcagccagcacgaaaagcgctgcaaacatataaacaccaagccagcagctgcatcatcaattttccaaacagatctttagtcgctaagtatcttatatataagttctaccccctccgtcccagaatatattggatacggttattaagaaaatatgtagaattaaataggaatgggttatgattggctgagaaatggaggtaggtgagaaaagtgaatgacagaagattatgattgattgtgaagggaatgttggtgaataagttgttatattgtgcaacaaatcctaagtgctcaaagttgttatattttgggactgagggatcagtatttataaattattatttgatcgctaatgagccatttgacatgcaatcaatcaacttttattcgtgaagtaagcgtagcacaactggttaggtttcttatagtggaaccagttcacccacaatcaaatcctaaatttaacatgagtgctctcatttatagctaattattattttaatggtaggcgacgtatccgtcgacaagtccgtagtgacttcgtcaatctaaaaaaatgtcgacaacgagatgtccgtagtgacttcgtcaatttaaaaaatggccagtcttttgaaggtgtttagaggagtagggtgtgtacgtttatagggatgtacatgtgttatgagtatatacatttttattatgttccaaaaaaaatgtaagcttttcttctactctctctatcctaagtgtaattgtaggtttctttgcccaacgtttaaccaaaagttttattttaaaaaaatatgataaaatttaaaaataagttattatttgtgttttatcatctaataatattaaaaattatcaaatgttcaagaaagaaaaccgcaattacacctaaaatgacacgaagggatgataggtctgcagcctgcagttacagctatcccgccctcccatgcttcgagcgttccttccagtgacttccatgaccggcagctagatctcatctcgcaagtggaa

SEQ ID NO: 2342 - DNA, 1501 bp, Oryza sativa
gggcacatggaacgacaccctggactaaggttcatagggacgcactgaagacgaaaacggtaacttaatcgagacagtcgtggaagatgacgtcgaataaccgaaattgtcaaaccgtgaaggattagacatcataccggctttaccaaccctaggaacaactcaaaacaaatgcgtgcactaatgttgccaatacgcgcgaacaagaattgaacggcgtaaacaacgttggtagcagaggggctaaaccactggtctagaacggtaacagtggcatcatgagaagatgcagcggtggtgctcgaagtaggtgaaaaagaacctgacagttgacaacgattattgctggttccatggccatccgctaccgcggagtcccgcgctgctgcatagtgatagcattccctcctagtgttcgaggcaccctgatcctggtgttctttagggcaagttttatagtggaggtgatagtcacccttaatttagtacacatcatcaactcattaattaagaggcaatatagatacaacaaattacctctagcacacttgccccacatcatactccctccgtcctaaaatataacaatttctagtctctagaatttgtcccaaatataacaacttctacaccaacattctcttttcaaccaatcacaactccccaccattcaatgttcctacataccttcacttctcatccaatcacaacccttccctatttaattgtatctattttcttaataataatgtctaactctaaaaatgtttatattctgaaacggatggagtattaattttattttatctgtttcctatcaattcattggtctctttgttatcatctctcttatagtttgtatagagattacctcttacatgagagatggctcattctctcttctttcatatctctcatccagctcatcatatgagcttacatgacatttagaggcaagtgtgtagaagcttatagtagttgcacttatcccctcaagtaaccagtgaagattgtgagctccggacctcctgtcatctcaagaaaacaaagaaaaggaaaaaaaatgaccgtgaactcgcggcatgtcgtgaacataaggccctgtttagtttcggggtgaaaagttttggcatgtaagtccagcgtgggcggaggcagtggccgagtccgagtgggctgtcgaatatgcctgattccgcggtagcactggtattgcttttgacaatagtggtaactgcagtgcagactacagaggctgaatcaggcgtatttattcggctacatttatgatattgtagatcaaacgagttcggtgagccgaaaattagattggttgttgaaattaggatgagataagattttatggatgactctcttctagagctgaacttgaaacggtgatggttgcaagataacacacccatttcaatgcaatacaaaggaatacaagattggaaaatttactggagaatgagaattggacttgagcactcaaaagata

SEQ ID NO: 2343 - DNA, 1501 bp, Oryza sativa
ttcctagagaggttactatgctcacaaacgcaaaattaatagagacatcgagcacgagcatactccaggttgttgggggaaaacctccaaaagttcaaaaccacatgcatccacatcgttcgccgcagaagatcccttgtccccgccgctgatctcataatatgcgaaccagttggccggagttaaactaaacagcaaagcaaatcgaaataaatcaaatctccaaagtgaaaaacatacatatctccagagagagagagagagggagggggggggggggggggggttattctctttggcgtatatcacatcgcaccgcaacacacttgttttatgccaaagcaaaaatcctctcccatcttccatctctctttccctaggacgcgcagcgctgtttattcctctccgctccccttgcttctcgcgcacactaaccaatccgagcatctcgcctcgccccgccccgccccgatcgatcgactcgagcgccaccccacgccgccgcccccgcgccattggccccagccgccgggaggcattcgtctgcgctgccccgcggcggtggcggtgacggtggaggtggaggcggtgtggcatgatcgatagaggagtcgggagaggcggcggaggaggagggggaggaagaggcggtggagatcgctaggagtggtggtggtggtgggaggaggaggcgatgaaggcgacgcccccgccggcgaagaggcggaggggcccgcggctggcggtgctggcgctcgtcttctgctcgctgctcgtgccgatcgccttcctcttcaaccgcttccctgccggtgagttctccgcggccgacacgttcgcccccacccctcgcgacgcgacgcggctcgagcccccccggattcgggggaatgcgggtgccgccgcggcctcccccccgatcggatcggcgccgttcccggcggatctgttccgggggctcgctggttccttccttgtcgtttagtgtgcgggatattgggttgttttggtggtattcctgttctcttattggggattgtgttttttgggggtcagttttctgattggtttggatgtttctgatgcagtgtatgtgacggatgagcgcccccaacaggtaacttgttgtttctagaaatgtgcatattgaactagtttttgatagtcttgtgtggatgttttcttacgaaaatgctgtttgtttgggacaatatgtgtcactcattgctattttggtgatttgtgtttggtacaggagattgatttgccttcattcggacgcatggggttggaaaggagcggtggagtaaccgtagtgaagccggaagatggcagtggtgctaacgcagagacaaaggttagtgattttctgtgatctttttgttacgtagtgatagtgattaatccgtacggcattgtgccttgtgctagcttggtggattttgacatagtcatgcaatgtaaaactctgacatgatcatgttgacgaaggttagtagct

SEQ ID NO: 2344 - DNA, 1501 bp, Oryza sativa
cgagtcgtatgggttctctatgtgtgctattaattgttaattggttggtttattaggcataggttatgctaattaccagctggcatgatgtcaagatatattgtataataatattcctgtgaatgaggaaagcatggccatctcatcatctctagtaaagaatgctggcttcaaaggaatttttcaaactttctgtactattgtttctataacatccaggaaaagtgagcatcttattgataatttaagttttttttctatcaataaactttagcttaagtaccccaaaattcaggtgattgtttggccgtcctcagtgtgaggttaaataagttcctggaaaggaaaaatggtcatacatacaagcttcaaaatcagtaaaaattgacaactgagcatgggccaaaatattttttttccttttgactaactgatgtactgtacattttgacatttgtcatttcctctcatatacacattggaaaattgttttgatgatcagcagatcctataaaaggcggatgcagatcagagggagccagagttggttcatcgtctatctacaagcttagagcattcagaagagaaactctgatctggatcaatctcctgaacaaagtctcaactccgctctcgagatcaacgatggcgaactccaacgcctgtaattgctcctcctggcatgcaagccttgtcttctgaaatgccttggagacaagtgaccacttgctagaatttgatgttgtgatcttctttgacaagagatgtgaagaggactcaagcattgagatggcgacctctctagcttcggccaacagcttgatcaccctggagccctcctgctcagctgaagcagacttcttgctgatcttcttggactgcttttgcaccttcttggtcagacgaatgaaatactggatgttggcctgaacaactgtagcatcccttctcttgtgaaccaactgcatctcctgaatgcttgtcttgagcttggaaacactctcttggatagagttgcagaggtcgagcagcacaagggaatgctcgagctcttgctctactgctttcctctgctgattctgacaaagttgagcttggctgcttggcaagcatatgatctcctcaatgttgttgtacacagctccaatcctgctgaaaccatcaagcattgtttcaatggtttcagcgggtgaagtgatggttgccttcaagctctgaagctgttcctcaacattggttttgttagaacgagggctggaaggagcgcttgcagatctaaatgccatggtttctatagatggtgtgtggtgtttccttttttttttctctggaaacggaagagaagagaagaaactgctcaatggtgaaagcccagcatagtctgtctctatttataacggaagaaacagaagcaacagaaagaatctcatcaatattgatggttgtgctgctgcaacaaagccacccatctccaagacaaactgatgcttttttatgtctc

SEQ ID NO: 2345 - DNA, 1501 bp, Oryza sativa
agcaaccgattgagcaaaacgaaagtatcaatcagagggaacccaccgaggggcaaagatactttttttttttttgagaacagatcaactaacccatggttaaaaacgataggcaccagaggggcgaacctatagccccaagttatttttttctgcaaacaaattgcatatgctatcagcataaataatactcaaggttaaggcagagagaaaagctcccagatcaacaagtagagaatgtaatgttatgggaaagagagaaaaatgaggcgctcaccggccggcggcgaggacgccggcgccgctggtcgcgagattggaggtcggcgcaggcggcgggccgaggagtcgaggccgagggagcagcgagtcggaggccaatacaacgtcttgtttgggctttcatggtttgagtccaggacggtgaaaggctcaaacacaaattttgcaggagtttgctctgcgtgtatctgtatttcaattcaagttatgtatatccctttcactaaacaaatataactaacaagtttctgtctttcttattcgcaacatgttttgctgataaattcattcaacgaatgctggtatgtcgtatcaacatgctgattgttcgcctgacaactcgagcctttattttccaagcaccgggaggaggcatgaaattaatgataaaaaaatagctatacaaatttttggtctcttctcttgataacaaacaatatcagcaattcagcacatagttgcgtttagcaatcttgtcaagcccccttgcattccaaattaaaatgaacgtaggattcattggggacattgacagggaggatcacactacaggatacacattcaaattaacacaggcaggtcaggtcagaagatagtccagaatccacaagataagagttgcctgcgacaaggaattgtaggtgttagaactgaacattgttaatctagacaatggaattaagaacctgttcaggaaattgattcaaagtagagtttcactttccgactcctacttcagcttgaaggtagatttgcgagctctaatcccctgtgcttggcacccgcgttttagagaattcgccgatcgttgaaatagtctcccaatgtttatataaacatgagaaaaatgtgtagaaatatactcactgaaaaataaaaacaggattcagtccatcttctattgttgattacactgtctatgcacatgctttagtaccaaaaggtaaaaaacttaatttccttagaagattgatgctcatcaatattgactgtcacaaaaaaaaaaaacagatgacattaaagttcaccttcgaaatgctttaatgtgaaatgggcaaatcgcccatgtcactcagatgacaaatgctgcctcagcagcaagcaacgatcttgctccaccaataaaaataacagggcagctccaacacaagatgttgagcgtgtaagcggcacggattgcacataatacaacacatgttgtaatcaacgagagcacaag

SEQ ID NO: 2346 - DNA, 1501 bp, Oryza sativa
tcattcgtctgaccaagaaggtgcaaaagcagtccaagaagatcagcaagaagtctgcttcagctgagcaggagggctccagggtgatcaagctgttggccgaagctagagaggtcgccatctcaatgcttgagtcctcttcacatctcttgtcaaagaagatcacaacatcaaattctagcaagtggtcacttgtctccaaggcatttcagaagacaaggcttgcatgccaggaggagcaattacaggcgttggagttcgccatcgttgatctcgagagcggagttgagactttgttcaggagattgatccagatcagagtttctcttctgaatgctctaagcttgtagatagacgatgaaccaactctggctccctctgatctgcatccgccttttataggatctgctgatcatcaaaacaattttccaatgtgtatatgagaggaaatgacaaatgtcaaaatgtacagtacatcagttagtcaaaaggaaaaaaaatattttggcccatgctcagttgtcaatttttactgattttgaagcttgtatgtatgaccatttttcctttccaggaacttatttaacctcacactgaggacggccaaacaatcacctgaattttggggtacttaagctaaagtttattgatagaaaaaaaacttaaattatcaataagatgctcacttttcctggatgttatagaaacaatagtacagaaagtttgaaaaattcctttgaagccagcattctttactagagatgatgagatggccatgctttcctcattcacaggaatattattatacaatatatcttgacatcatgccagctggtaattagcataacctatgcctaataaaccaaccaattaacaattaatagcacacatagagaacccatacgactcgccaagcgtgctccattaaacaagtgttagagcatgcatttttgtcaagggccagcactagagtaagctgccatgctgattcttgatcccaagaactggaacatcacaatgtgatagagctagtcaggagcacctaacgcatcgtataaaaatacgcaccatgtggatcatattgagattgcaacagccagatgctaaatgcactagtaaacatgccagctatgatgcacgggtggtcagagaagataagcacagcatcatgtgttggaacctggaagtgaagccaattagttgtccctcccaccaagaatcatcaaattaaccagctcctttctctcataagatcactggcatgttcaccgatctcactacactgatccggatttgacattaaactactcactcgtgcagatgagtttgccattgatacagcaggcatgacagactgatcatgaactcaaatattagagatagaaatgcatcttataccaaggagacaaaaaaaagcatctgtttgtcatggagatgggtggccttgttgcagcagcacggctttcaatatcaatgagattcttgctgttgcttccactac

SEQ ID NO: 2347 - DNA, 1501 bp, Oryza sativa
ttccacctcagatctgcgagtgtgccatccagcccttgctccaatgaaaccaacgctgaagaactgctgcagagtctaaaggtgaccatttcctcacccagttcaaccatcgagacgatgagcagtggctggaagaagcttgggagtatctacaactgcatcgatgagatcatgtgtctgcccagcagccaagctctcctttgccaaccactgcagaggaaagcagtggagcaagagttagaaggctctctcgtcgtgctagacctctgcaacgccattcacgagagcttttccgggctcaaggcatgcatccaggacatgcagctggctgtcaagagaggagatgatgcagctgtccaagccaagatacagtcttacatccgcctcgccaagaaggggcgaaaacagttcaagcatatcagcaagaagtcttcttcagcagatcaggagagctgcagggtgatcaagctgttggctgaagctagagagatagctctgtcaatgctcgagtcgtcatcacatctcctgtcgaagcagattgctttgccatgctctagcaaatggtctcttgtctccaagacattccagaaaagaaggcttgtctgcgaggaggagcaattgcaggtgttggagttagacattgttgatctagagactggagtcgagaatctgttcagaaaatcaatccagagcagagtttctcttctcaacattctcagcttgtagatagatcatacaccaactctgattccatgcgattagtatccgccttttagaggatttgctgatcactggaacaaaattttgatgtgtacatatatgaaaggaattgtacagaaactcagttgagaaacaaaaacaaagtatttgtccacttcctattgttgattacactgtttatgaatgtttgatataaatacctaattttctaacaatatgctcatcattattgactgttagagaagcagttagcagaattttcaagttcagcttcgaaatgatttactatgatacggcctcgctattcagatgctatgtgctaactcaacaagaagcaaaggatccttgagcagtggatcttgctaccagagctaagacaagccagctccaatgcacgaggttgaatgtgtgagcggcatggattgcacataataaaacaatatttaaattagcaagcacactaaaaactagaagacacacctatcaccaacaatactcagtaccactcccttaaagtaacatcttgaaaacgcaataatgtcaagatccaccaatagagtgaactaaccttctgattcttgcttccaatagttggaacatgacaatgtgatagttcattgggaggatatgtagtgcactaatatatgcagctacacatgagtgacagaatagattctatatgctgctaccagatctcagaccttgatagacagcatctgggagatgaactggagggattctacttgtctgtaaaccaaacgatgctgtcccgtgcagttcc

SEQ ID NO: 2348 - DNA, 1501 bp, Oryza sativa
acgtggtataattttcaataaaaaatcggtgcgtgttgtatacgtgagatcctttttgtttgactatggcaaatgtcaactaaggaggtcccacttgcaagacgttgatgttcccttaattattttgcaagtaaaaaaaaagattttgcaaagtaagcgtaattcaatcgattaggtttttttttagaccaatctacccaattgaagttatagacttgacatgggtgctcatatttatagtttttattattatttgatgggaatagcttattattttataatggtaaacgacatacccgtcgatagtgagtcgtccgtggtttcgtcaatctcaagatatatcggtcggtctttcgaaggtacttgtatgactagggtgtgagtgtttgcatttagggtaagagcgcatatgttgtgtacttgtgtttgtatatgtttgtaccatatttctcggaagaaaaaaaaaaggattttgccaaatgcagccgataaagtgttgagtacttctattttgcccatatatattgaaagatcagtagtgttccttcctttgcaagaagttggtgtaccattctggaaagagactaatctattgatctttcaacaaatttggaactctaaatcttgcagaatattgaactaatgtatagaacccattttgaatgaaaaaaaaggataaacacataaaaatcataaatctagagaaaaaatagttgtcaaaaacataattttgatgcactataactaatataagttttatgtaactaagtataaatgcaatgtaattgggtataactacaagttaaatctacatgtacacaaatctttgatgcaatgcaatattttacagatgaaaaatcaaaatatatactctctccgtccctaaatatttgatgccgttaactttttaaaacatgtttgattgttcgtcttatttaaaaaatttaagtaattattaattctttttctatcatttgatttattgttaaatataatactactactcaagcttttgaatattattcaaaaaagtttttaaaaaaagacgaatgattaaatatattttaaaaaatcaatggcgtatgatctagaacatatttaggaacggaggagtatgatctagaaatctattctggttcatgtacggcgaacagcacaaagggcggaggcgcccaggcttcgttccccaattgggccccttagaacaacatctaagcccgcgggccacccaacttaaaatcccaacatcggagcatcctgggcccaagtcataaaccctagcttctcccttggaatcaatcgaaccgattcgcccccctcctcactcactgtcgtgcttgcctatcgtctccgctcccggtgcgcagccggcgagccggagccgccgccccctcttcgcgccggcgggcttcttccgcctctctgccgccagtccccggccgatcccatcggcagtcggcgggcggtctccccgcgggtggggtgggggcgggacggacga

SEQ ID NO: 2349 - DNA, 964 bp, Oryza sativa
caggggggtaatttgaattatcaatatcagccaccatcacctcatattcagaaccagcaagcaggatcggtgtcacatcctgattttcgtttcaggatttataaattatttaataaattaataatagaatttatattaaatgttcattaatttacaagtgaagttaaatgtgggaaataaaatttcctaaatataaagcatggatggatttaatttttattaaattctccatggttaattatactctctggaatattctcggatttttcggagctcaattcctaatttttaatcttacaaagagcatttcagtaattaaccacatattaaattaatcattaaatggtctaattgtaattttattaagtactttgagtgtccaagtattttcaggatttttcttgaaattatttgagcattggaagtatttttaataattcaaagatcatttaagtgattattttaattgggaaagtaataaaatcctcctcctcagcttgggccattttcggcccattccttcctttccttcctctctcttccgccggcccaacctgagccgcctcctctcctctcagctcagccggaaaagtctactttccctccctgcgctactgttcatcttccaactcaggcagagcccgagccagccgtgccgtgcacagtgccgccgcctcttccttccaaatctcgcctccccgttgctctttttctccaatttagttgaggggaaatattcctcttatcctcctctatctttacccccaaaaatcggagcaaatcgttgagtatcttatccgaatcaaactcgttttcgagtttatctccaaaaccgagtttttgatttcccggatcgatttcttgcgggaggagtccgatctcttcaatccaaggctataaataggaccccctagtcctcctctttcgtttgccccctctcccgtcctcttccgtgctccgtagc

SEQ ID NO: 2350 - DNA, 1501 bp, Oryza sativa
cgtggcggaggaggagcttgaccatttcgacgctgaacgtctcagcggccaggtggagagccgtgtagccataaggatggaggccgttgggatcggcacgacgtccgcgcaacggagagctgccttgcagggccactctggcacagcgcaaagcgttgttggcgacaatggagctgagaatctccgggtaaatgaaaccacgaaggcccatcaagcgcgaccacccttggcaaagtcgattgaagcgcgtgaggctatccttctccagtataggccatagcagagggaatacctgacgcgagtactgagccaacaaattctacaaaggaagccaagaaaacagtgcataatcagtacagacccaaaaattctacaaaggaagcccaaaaagaaacattgcgtaatcaatatactgacccaacaaattctacaaaggaagccaaaaatcattggagttgctatagttgtgtcaacagattttttgcttaatcacagtaagttgtttgaccgtttgatctgtgttatgattcatgcttctatccaactaaagaagacaacactagttttctacactccataagggccctgcatgtagcagtgtgaaacaggtagctaaatcaacattttacaccgggaacagacagctagcactagcttgctttttgtttggttaaaattacagcacaatgacaccataattatatataattacaacaaagttacattgtaattgcactgtaactctgatgtaacttttatatagatagataataaaaatttgaaatttgattggagcttgttcatatgaattcttaccaccgatctagtctaggttatattcttgctaaatattatatgttgcaggaaatttaatctaactgttttgccaaccaaatatgtctctttgctgtgttgccgacctgttatcagcaacagactagtattttttccccaaaaaacatgtcgccatatttatagttagtcgcaaaatgattgcataaccagtgagccaaatgaatgtctgaagggaagatattgcaattcggtcgatcgatcgatcgatccatacggagaagggataatctgggtacctacccgctcctttgcctcgaagtaggaagcagcgtcagggaacccgagcatttgataataactctgatcgcagctgcgaagcatatcctcaaacgtcacccgagatgatgcgggagccgagtttccatccccgggagcgggagcggagggggtctccatcgggaaggagggggcgggtggcggagctcaaaaaaccctagatcgatcgatcgatcgatcccctttcgctgtgtcctcggcctctccctgtcctgctcctgccgcgatgctcgacgtggatctgccggcgatgctgggctccgccggcgagaccggcgcctcgtcgtggaagaggaggagaggtgcggcggcggtcgcctcctcgtggtcgtgcatgaggacaagagagggagggaattatagatggcca

SEQ ID NO: 2351 - DNA, 1501 bp, Oryza sativa
acggcacggcccggtgcgtcggtcgagccgtgccggcccgacaagcctcggcccaggcacggccgggcttgggccgtgccgtgccaggcggcccagatggccatctataattccctccctctcttgtcctcatgcacgaccacgaggaggcgaccgccgccgcacctctcctcctcttccacgacgaggcgccggtctcgccggcggagcccagcatcgccggcagatccacgtcgagcatcgcggcaggagcaggacagggagaggccgaggacacagcgaaaggggatcgatcgatcgatcgatctagggttttttgagctccgccacccgccccctccttcccgatggagaccccctccgctcccgctcccggggatggaaactcggctcccgcatcatctcgggtgacgtttgaggatatgcttcgcagctgcgatcagagttattatcaaatgctcgggttccctgacgctgcttcctacttcgaggcaaaggagcgggtaggtacccagattatcccttctccgtatggatcgatcgatcgatcgaccgaattgcaatatcttcccttcagacattcatttggctcactggttatgcaatcattttgcgactaactataaatatggcgacatgttttttggggaaaaaatactagtctgttgctgataacaggtcggcaacacagcaaagagacatatttggttggcaaaacagttagattaaatttcctgcaacatataatatttagcaagaatataacctagactagatcggtggtaagaattcatatgaacaagctccaatcaaatttcaaatttttattatctatctatataaaagttacatcagagttacagtgcaattacaatgtaactttgttgtaattatatataattatggtgtcattgtgctgtaattttaaccaaacaaaaagcaagctagtgctagctgtctgttcccggtgtaaaatgttgatttagctacctgtttcacactgctacatgcagggcccttatggagtgtagaaaactagtgttgtcttctttagttggatagaagcatgaatcataacacagatcaaacggtcaaacaacttactgtgattaagcaaaaaatctgttgacacaactatagcaactccaatgatttttggcttcctttgtagaatttgttgggtcagtatattgattacgcaatgtttctttttgggcttcctttgtagaatttttgggtctgtactgattatgcactgttttcttggcttcctttgtagaatttgttggctcagtactcgcgtcaggtattccctctgctatggcctatactggagaaggatagcctcacgcgcttcaatcgactttgccaagggtggtcgcgcttgatgggccttcgtggtttcatttacccggagattctcagctccattgtcgccaacaacgctttgcgctgtgccagagtggccctgcaaggcagctctccgttgcgcggacgtcgt

SEQ ID NO: 2352 - DNA, 1501 bp, Oryza sativa
tatatttttttacgaaaagtttctatacgaaagttgcttaaaaaatcatattgatccatttttgaaaaaaaaaaattaacagatacttaattaattatgtgctaatggaccgctccgttttccgtgaacactgttgagagtggggagaatctgaaaagaacgcagcctaagataaggctaataaaattggagccatattttttttgcatgatattgcatgcttgtatgaggttaaatatgtactaactattattagtggatgaactttatacgaagtatatatagatatgattctcggccggctactagtttctgggctgtttggctgcagaaacaggagatcgactacattcctgctggtttttgcctaggaatgaatcaattagtatttgctaattggcaaaattattggatagtttatttgcccttcatatccaaccagattcagcgaacgcaaactcaatcaaactatatatgcagtgctcctgcaaccgaatagcttttcatcttcactcatcactaatgtgctgttttgtttggattgagcaatgtcgtaataatgaattgaccacttaatccatgatggcttgcttggtttccgtccatcaccagggttttcaatttcgtttggaccaatattttaaatagcgggccaaggcatttagcggttagcttctcaaacagctatagcggcagctatagcgggctaaatagagctatagcgactaaattgtacatgtgaacaaatagctagaacccttctcaaacaactagagcgggagatttaaaactctggtttagaccgaaagtttcgggattttggtgtcactgtaatttccgaaaatttcaggaattttcatactttttgcatgaaattatttagaaaataaactgaatttaaataattttttaccaaattaaccaaaattttggaaaaactgaattttcggtcgatacatttgcttgttggagggggtgaaattgcggaaatttcgaaccgaaatcgtaaaccctgtccatcacctatcgatcacctcatccctcaaaactagtcatagccccccggaagcccacaagaaatggtagaaagcaggtagttagccactagccagctagctagtccgtgatatccgcaagagtatcattcattcataggtgcaaatgcaatagctttgcccacagtctgactcgatctgatcatcactgcatgcaaaccattagaacagtcaaaacaaatctgcaagcaagaacaagggttgtgatactatgtctgtctactatgttcccctgcaatatactgcaagcacatcgatctctctctccttcccttccaatcctcgcctttataagctccagccattgctcccgatcgaacacacaacccagctatagccacctacatctgctgatcgacatcgatcgatctctactactccagtagctagcaagaattgaatctaggtgaagtgagagtgtgagagtacataattggcgccatcca

SEQ ID NO: 2353 - DNA, 1501 bp, Oryza sativa
tagctagctggctagtggctaactacctgctttctaccatttcttgtgggcttccggggggctatgactagttttgagggatgaggtgatcgataggtgatggacagggtttacgatttcggttcgaaatttccgcaatttcaccccctccaacaagcaaatgtatcgaccgaaaattcagtttttccaaaattttggttaatttggtaaaaaattatttaaattcagtttattttctaaataatttcatgcaaaaagtatgaaaattcctgaaattttcggaaattacagtgacaccaaaatcccgaaactttcggtctaaaccagagttttaaatctcccgctctagttgtttgagaagggttctagctatttgttcacatgtacaatttagtcgctatagctctatttagcccgctatagctgccgctatagctgtttgagaagctaaccgctaaatgccttggcccgctatttaaaatattggtccaaacgaaattgaaaaccctggtgatggacggaaaccaagcaagccatcatggattaagtggtcaattcattattacgacattgctcaatccaaacaaaacagcacattagtgatgagtgaagatgaaaagctattcggttgcaggagcactgcatatatagtttgattgagtttgcgttcgctgaatctggttggatatgaagggcaaataaactatccaataattttgccaattagcaaatactaattgattcattcctaggcaaaaaccagcaggaatgtagtcgatctcctgtttctgcagccaaacagcccagaaactagtagccggccgagaatcatatctatatatacttcgtataaagttcatccactaataatagttagtacatatttaacctcatacaagcatgcaatatcatgcaaaaaaaatatggctccaattttattagccttatcttaggctgcgttcttttcagattctccccactctcaacagtgttcacggaaaacggagcggtccattagcacataattaattaagtatctgttaatttttttttttcaaaaatggatcaatatgattttttaagcaactttcgtatagaaacttttcgtaaaaaaatataccgtttagtagtttgaaaaacgtgctaacggaaaacgaggagaatctaatcctactagcctggaaagaacgagcaagaaatttgaagtactcaactggacgtacggccccctttttctacactgcatggaatagtttgcccatagtctgatcactgcatgcaaaccactagaatagtcaaaatagtctgcaagcaagaacaaggattttgatactctgttcccctgaaatgcatgcaagcacatcgatcgatctcactctccttcccatcaaattctcgtctttataagctccaaccattcttcccgattaaacacacatctcctatagctcatcacatctctacatacaagtgaccagtgagagtaatttggcgccatcca

SEQ ID NO: 2354 - DNA, 1195 bp, Oryza sativa
gaggtctcccgacgtggctgatccccacgggctgggtgatccgggttagtaatgttgtgtgggtaaagtgtaccccctctgcagaggttaacaaactgttcgagcagccgtgcccacggtcatgggcggatgtgaggtgattcctagcgtagttttgtttgactactgcttgtgaaattgctgttgtgaaaaggggttcgatgtttgaaaaatcagcagctgacgggatcagctaggcccgggtggccgattgtaaagttgttggcccgggtggccgtttgaaaagctgtggccgggtgccaatcttgttttaattctaaagactgatacattgcacatactccgaccggacgagacgcactgtctcatccgtgtcgtttgagaagcactcacttagttgtttttagaaaagagttcaaaaaaaatcaattacgaaaacaacagcctttccttgaagcctacattaaacacttatttccctggcttgctgagtactcccgtactcacccttgctctatataaatatcccccccccccagttgctgaagaagatgaagcggatcctgctgatgaggagttcttccaggagcaagccggctatgatgagttttagggtttcggcctagttcccaagtcgcgcctgtgttgtttggtccaagtcctggcttccgtttcccttctgtaatgcagttgtgagctcgggatctgtccgcagcccaacatgactgtacctctactctataataaagagacctctgttgctgtgatattctgtctccctgtcataccagcactatttcctgggactggtatcgattaacaggttaaattggagcgtcacgggctagttccggtcgggactagttcggggcgtgacaagagatggtatcagagcacaggcttggccctagggcgaaacccgacgtttaggacgaccctaaggatactaagttcaaaactgcttgcgaaaagctaaggcttcttttggtttccttattttcaatagtttgtttctaaaatggttactgatccttctccctctttcaaaattgtagatggcagtgaactccagcttcagttcccacggttttggtgagggtcaccacgtcgctcagcttcgtgacctcgcccgtttcctcggtttctcgtgtcccgagtacacggggtactccgtggaccgtgttccccctcactg

SEQ ID NO: 2355 - DNA, 1501 bp, Oryza sativa
tcttcacatgacatggcaatgacgtggcgcttacgtggcaatttgatttgaaaaatattaaaaattgtgggccacatgctagtttgcacaaaaaaataaattaaaaatgttgagacccacgtaggccccacatgtcattctcaccctcatcatcttcctcctctctccccccaactccgtgtgttcatctctctcccctctcatctgtcctctccgccggccgaggagggacgcgacggcgacgcgccgctccattgcagcgcgcaccggaagaagcccgggtgcgtggtgggtgagcacgcgtactccctcctcctgctcgcgcctccgccaccgccgcgtgacgacgacacgacggtggccgtggcgtgggggagcgcaaggcggaagacggattagtttttgttgcgctattgaggaatggtgcataatccgttctatggattagtttttgttggtgcatacacgcaggcgtgcctgccggcgatggaagagagatccggagtcaccaattcaccatacgtgctctctctactctcttgattatgtatttatgtgttaggttgcttggtggtgactgggtttgttcattcgtgtggtgttttgttggtgcgttggatgcagtcgcccccgaacccgtgaacgcaccggggaacctcctcctcaggctccatcctggcggcttgttgaggtagctcgtctcgtccctcaagcgagccagcagcagcagcacaaccattgccggcgtgacgcccgaacgcagcgccaagacacaaatattccgccactacgacgaagtcgaccacgacaacgcggcgtgcagcgtctgcttcgtggcactggcgccaatgcgccatggctgctgcctcctcagtagagtggtggcgcttcggttgcggcgcggcggccaggcgaggagctccctccgccggagttgatagatgatctccctccgccgccatcctccgtcggccgtcgctgttgtgctcgcgtcgctcgagagagagcatcgcggcggaggggcggggcggagcggccgacggagtggagctgtcgcgctcgccgacaacctcctgctctgcctcattagccacgtaggtgccacgtcagtcaaaaccgccatcaaaactgccaagtgacctcatctgcactggttttgatagttaagggacccgttgtatctggttttccggttgaataaaaattggattcgttgacaagttaagggacctcggatgaacttattccttgtaagttacgtgcggcctgaacaattttcggccggaacggaatttcgcttatgtgaggcccaagaacgggattgagacttattgtggggaaaaagtacacctaaggtccctcaacttgttttcgagttacagaatcgtcccctaaacgtaaaaccggatacaacgcatcccctaacttacaaaaccagcgtagattagatccctcgtggttttgcactcggttttgtccaacgtggtggctgattcagcgt

SEQ ID NO: 2356 - DNA, 1501 bp, Oryza sativa
gaagaagatgaagcggatcctgctgatgaggagttcttccaggagcaagccggctatgatgagttttagggtttcggcctagttcccaagtcgcgcctgtgttgtttggtccaagtcctggcttccgtttcccttctgtaatgcagttgtgagctcgggatctgtccgcagcccaacatgactgtacctctactctataataaagagacctctgttgctgtgatattctgtctccctgtcataccagcactatttcctgggactggtatcgattaacaggttaaattggagcgtcacgggctagttccggtcgggactagttcggggcgtgacaattctactattatcaagaggtagctagccatggcatgaatgatatgtatccatggcaatgtggatgaggtcctgtttagttttcacgcaaaaacttttcatcatgtcacatcgaatatttggacacatgtatttagtattaaatataaataaaaaaactaattacacagattgcgtgtaaattgtaagacgaatcttttaagcctaattgcgccatgatttgataaaagtattaattaggcttaataaattcgtctcgcaatttacagacggaatatgtaatttattttgttattagactatatttaatatttaaatgtgtgtccgtatatccgatgtgacacgccaaaacttttcaccgtaaaactaaacagggcctgaccacaaaatgccttttagcctagttcaccagaatgcagcaacatcagcacagctgcaagttgcaagagaaaagccacacagcttgtttggctattaatggagaggcagattgagacgtgtgcgtgccaagttgaagactggatcccccgttcgaatcttctaaacatgaagattaagggattaagggggtggttaggtatagggatgtaaagttttagcgtgtcacgtcggtatctaattacataatccctcaataaacagtgagatgaatttattaagcctaattaatccgtcattagcaaatatttaccgtagcactatattgtcaaattatctcataaattagtcgcaatttgtgcaattaattattttttaagcttatattcaatacttcatacaggtattcaaacgttcaatgtaatatggtgtaaaatttttgtgtgggaactaaacgatgatggaaaatgaggggtgggagggagaaagaagaaggtcagaggtaaattggtcgaggataacattctagcgtagattgagtaatggcattttagcgaatccatggtagatatgtaattttgtacgaatatgtggcacgcttctctagccgaacggagctttatttgtggtgccacgtcggtttataagattcctatctctatatatagcagccaagtaagttagggaaagaccaagttagtttgtagctcagcaacaactcatcctagagcttgcagagcaagagggagttgaagtatggcaacctctgttccgagtgtactactactac

SEQ ID NO: 2357 - DNA, 1501 bp, Oryza sativa
tcatctccaaatctatccaaactaaaagaaaaaatagttatattagataacacaaaatgtagctgtagaacatcagtcatacatataaacaacattaatataagtaattaagtagccatgttttcaatcaaaagtagaccgcttgacaaacctttcaccaatttctggcctagaacagacaaagggatgctgacacgcaccatatggagcttaggacgctataatcaggagttcgtcttgatcaaaggcaaaactcatgaagtgtattcacatcatttgatgctacatcatatcgatttgggggtcaaatctactggaaagccacatggagcaccgctcaaacggaattgcgtcatggtggttagctgctcgaaggactcgtagtcgtacctttagctagttggttgcggttgtgcatgggtgcagtcagctgcggttcatcctcgttgccacccaatcaaccactggagccgcatccacgtcttccatcatgctcgcctggatctcgtggcggcggcagggctactaatggatagagagaacatattagagatggaggaagagagagaaggggtaggaggaggggatctataccttttgaagatggcggcagagggtgcgggcggactggacggcgcgatcggcgttgagggcggcagactggacggccgtggaggaggcgggctacccggcgaacggacagcgagtctcgatatgtggcggcgtgacggcgcccgcacgaacctgccgaaactcctgttcgtgaatggcaaggaggcggggcccaggtggtggtggagggaggcaccggcgggcggcggcggcgaagacgggagcggccacaggagccgatgtgagggaggcaccacccggagtggcggagtgggaaggaggcggcgatgaaggcggaggaaatcagaaaatcgcgtggtgggggttgggaggaaatcacgcgattgattttggtgggaggtgggagtgggaccgagggaatgccgagcgacgttagggtgtggggtattgatgatttgactgtagcatgggagaggaatcaggtgggattgatgagatagcgatggacggatgagattagatcagatatgcagatggacggatgggattaactatgttgatttcatctgtaggattgcaagaagacaactcctcctttttatattagtatagatgtcctttgcatgttggatcatttcacaggtgtgtttttttcattaattaatctaacgcaacagacttggtcgaccaaacattttttttccttttttttaagaactgaccaggcaagatcagtagcagctagatctcaccatacacgtctgcaatgcatccaacgagtgagtcaacacatagtacttttcttactatgagagaatgagtcaacgttacatacatttgaccgacctactcttcagagtctttgaccttctacgcgttctacttctactgcttcagttcacaatttcacacctccaaccaacgccta

SEQ ID NO: 2358 - DNA, 1501 bp, Oryza sativa
aggaagctaacattgtaactatatattgtgtgtttaaacttacgaaatcattgcatgcatcctgatgaattactctgatttctttacgaagtataaaaacataatttcaacacctcaaacgtgtgttcgcatcgccgtcatgagcaacggatattttaggtggctataattaccatcgaacgatcatcaaagggaagaaaaacaagtttgttcaagctagatcactgaaggagaggatgtaaaacgtacaaaaacagaatgagaatgtcatggaacatattagaacgcgttggagtcaatccaaaattagggcctcgtacagtcgggcaccccacacttgtccacgtagcatattgtgtactccctccgtactcgtaaagaaattcgttttggacagcgacacggtcttcaaaacacaactttgacatcttatttctataaaaatatttattcaaaagtgatacatgtatatttttatgaaagtatttttcaaaacaaatctattcatataatttttacattttcaaactcaacaacttgagcattatttatgatttatatttccaatgtttgacttaaacattatcctaaacgaattcctttacaagtatggagggagtatcatttatactcctttaaaagcctttagtagtggtggcagcgaatctaccaccctattagtgcttttgaattattttttttacaaattgcccccataatattttaaatattatagaatagtacaatattatgatatgacatattatgaattttttttcttctgcctatagcaaagcttgtagatgtgtgttagtggatacattcgtggatatttatatgtggtgtgtgtaactacgccgatgttatgcagctacattatctcgagggggaaaaaacctcctaactattggtagataatcaaattaagaccccatcttgttcttataaaaagacaaaaaaaaaccatccagaaagagaaaattctcatctagaagccagtcagtctacatccatgcagctttgatcatttcaatcaggtgattcagaccaaagtcgagcagccaactcgacgactattctaacacacctacccatcaattaattaattaattaactacactttcacacgagtctagtcaaacacatattgaccaaccaacccctgcattgacctcacctcacctcactcatccctgccaatccacgcgcttaattagcttaatgcattaaagcaagtttaatagtatagctaattaataactctaaattatatcaatctaataattaatttatacaataattaactataaatatataatacatcattaataattggtccacctgttatacacatataacattttaaagtctgtactacagctagttataaatctgtatagtcttctcttttctttcgtctctcatctcttctatatgtgattatagctgatttataatctgtattatatatgttcttagcttaagctaattaatcacccat

SEQ ID NO: 2359 - DNA, 1501 bp, Oryza sativa
gccatgttttcaatcaaaagtagaccgcttgacaaacctttcaccaatttctggcctagaacagacaaagggatgctgacacgcaccatatggagcttaggacgctataatcaggagttcgtcttgatcaaaggcaaaactcatgaagtgtattcacatcatttgatgctacatcatatcgatttgggggtcaaatctactggaaagccacatggagcaccgctcaaacggaattgcgtcatggtggttagctgctcgaaggactcgtagtcgtacctttagctagttggttgcggttgtgcatgggtgcagtcagctgcggttcatcctcgttgccacccaatcaaccactggagccgcatccacgtcttccatcatgctcgcctggatctcgtggcggcggcagggctactaatggatagagagaacatattagagatggaggaagagagagaaggggtaggaggaggggatctataccttttgaagatggcggcagagggtgcgggcggactggacggcgcgatcggcgttgagggcggcagactggacggccgtggaggaggcgggctacccggcgaacggacagcgagtctcgatatgtggcggcgtgacggcgcccgcacgaacctgccgaaactcctgttcgtgaatggcaaggaggcggggcccaggtggtggtggagggaggcaccggcgggcggcggcggcgaagacgggagcggccacaggagccgatgtgagggaggcaccacccggagtggcggagtgggaaggaggcggcgatgaaggcggaggaaatcagaaaatcgcgtggtgggggttgggaggaaatcacgcgattgattttggtgggaggtgggagtgggaccgagggaatgccgagcgacgttagggtgtggggtattgatgatttgactgtagcatgggagaggaatcaggtgggattgatgagatagcgatggacggatgagattagatcagatatgcagatggacggatgggattaactatgttgatttcatctgtaggattgcaagaagacaactcctcctttttatattagtatagatgtcctttgcatgttggatcatttcacaggtgtgtttttttcattaattaatctaacgcaacagacttggtcgaccaaacattttttttccttttttttaagaactgaccaggcaagatcagtagcagctagatctcaccatacacgtctgcaatgcatccaacgagtgagtcaacacatagtacttttcttactatgagagaatgagtcaacgttacatacatttgaccgacctactcttcagagtctttgaccttctacgcgttctacttctactgcttcagttcacaatttcacacctccaaccaacgcctatatatacacaccttcccagcacatctcatttcattcaatcatccatcgatttctagcttagcttctactgccaattgcttggagattgatcgaccatcatctccatcgatcctc

SEQ ID NO: 2360 - DNA, 1501 bp, Oryza sativa
tgattgttgccttaattgtcctttgctcatctctggatatgatgaacttctgaaagaaaacagtggtttcccttcacaataatgttgcgttcatgaagaaaattagctcagtaaccatatgggtgggcctaatactgtttggactggctggtgggcccgaggttgctttcttgtacagaatagtacaaagttgtaaagaaaaaggaaaatataatcaacctaaagattgttttgaaatggttaaaaattgaatgaaagtgtttgacaaaataaactgtatttacattcctctcgagctatgttttcttagataatttgataaaagaataacaattcacgctataccaactgttggtactatattctttgcaaacatataatagatggtataatttgtaaacatatagatagatggtaaactcatttctcccctaaatgagcatgtttccgtggcaaataacacaatgtcaagctcctagggcaaagaaaggtaactaaagcacaagtatatcaatttcccttttgacttcaacacaatacagaactcgatcgatgcttccatgatttgcaaaagctgaatcacaaactgaatggaaaaacaacaggttaagaaaaaaaaaagaaggaaagaatggttggtgatcaggtgatgatctcgtgtgtgataaagtatcagcttgctcgtagcatgatctctaaggaagttcgtatgctgcagcgttggcggtgacgtagtaggcgacggtgaccccggcatggacgaagcacaggatccctccgagatccagggtatggccttgcgcaaagctgcaatttctccgggggttggagttgcgcatggcaccggcgagcagcagcgagaatccggcaataagagcaagcctgttacaacatcgaacagtccatggtgatgtcagtctgcaagcacaaaaatttcgttccttctttttcttttttgaaaaggaagtttctttagtcaggatgtatacgttacatctgatactatgaccttaaaggagatgatttaacatccgagctatacaacttacaaaagggagggtttcaataaaagagaggggttggttaccaggagaggactatcagagtcgctgccagcttcctcttgatggaagcccggatgaactccatctgagagcagatgcaggcacagcctccgagaaagttagccactgcgtgggcagctacaaggagcactgcagccgcgaggcccaactggtatactttggaggatgattgctcacattcgatgaacaacatcctcaccgttttaacctgccaataagaaacaccaacgatcattcatttagagtggaaaattgacaaagaaatgcatgtcagctgtctttggctttttcacattaacaaccagtgaaccactattcaattagagtggaagatagagttgcaatagctgaaaacatccattacatgaaaccctttcattatatacattgaatacatctaaaaaagatattgtgta

SEQ ID NO: 2361 - DNA, 1501 bp, Oryza sativa
  unsure (1)..(1501): unsure at all n locations
atcaaattacattcaacaaagaattgcataattaagtacaacaattcgagcagaattcatctcaggaaaaaaagaatataaagtatgatgaatctggtatctccaaaaagaacaaaaaaaagagagaacaaatcaagaactcatcatgcattcttgtcactctaataaaagaccatgagaccagcggccatggcgccaacgcccagaccaacaagagactcaacaacaccacccgacttgctcgccgagctcgatggcgtcaccggccggccaccgttcaccggcggcaacgccgccggcgacggcgacggcgacggcgtggtgctactaccgccaggggcggngggggcggncttaccttgacggcgagctttatcccggcggcgcaatgtccagggaagccgcagatgaagtaccgcgtgccaacggcggcgagcgggacggtgtcatcgccggagttgaaggtggtgatggggctcgccgccgagcaggcgtcgtaaccggccttggtcaccttcacgacgtcgtgcgccgccggcgagtacctgaacacgagccggtcaccggcgcggaaggtggcggcggacgcccactgcgcgtagttggtgcgcgtgtcccacgacccggccggtgctcccaccgtgtaggtggtggcgcccatcgccgtcgtcgcgagcaccgccgccgccgccgccacggccacgacgaggagagctctggctgatgctgccatggccgcgacgatcgacgatcgaggagatcgatggagcttggaattgggaggagatgatgcaagaaatgagatggcaaggagacgatgggaagtatgtgtatatataggtgatgggtgattaattagcttaagctaagaacatatataatacagattataaatcagctataatcacatatagaagagatgagagacgaaagaaaagagaagactatacagatttataactagctgtagtacagactttaaaatgttatatgtgtataacaggtggaccaattattaatgatgtattatatatttatagttaattattgtataaattaattattagattgatataatttagagttattaattagctatactattaaacttgctttaatgcattaagctaattaagcgcgtggattggcagggatgagtgaggtgaggtgaggtcaatgcaggggttggttggtcaatatgtgtttgactagactcgtgtgaaagtgtagttaattaattaattaattgatgggtaggtgtgttagaatagtcgtcgagttggctgctcgactttggtctgaatcacctgattgaaatgatcaaagctgcatggatgtagactgactggcttctagatgagaattttctctttctggatggtttttttttgtctttttataagaacaagatggggtcttaatttgattatctaccaatagttaggaggttttttccccctcgagataatgtagctgcataacatcggcgtagttacacaca

SEQ ID NO: 2362 - DNA, 1501 bp, Oryza sativa
acatatataacaatagaatcaaatcataattaatgagctgatgaattacatataacaaaaaatatattacatataaataacaatatgagccggactctaccagagaaaatactcaaagcaatcaatatatacgaacacaatcaatcgatcgccttcgaagagatacacaaagtatcttcttactctaatttagaaggccatgagaccaacaactatggcacccaaactaagaccaactagagatgcaacaccagcgggctggcttgctgagttagatggaggcacgggccggccaccagccgttggcggcattgcgttcggtgccattgctgtcggtgtgcgtggacgaggggtcatcggtgatggggccgggttgctgccggtggcggcctcaaccttgacagcgaccttcatccctccggtgcaatggccattgaagccacatatgaagtagcgggtgccggtagcggtgagagggatggtgtcatcgccggagttgaaggtggcgatagggctggagctggagcatgagtcgtagtcggccttgttcacctccaccacatcatgcgccgctggagaatacttgaacactgcacattacacatgcatatcattagctcggttagatattatactaaagttgccacatgtatcgatcagttcaactcaaacatttaagctggtgagcaaacacggacaatcacctatctgatctccggcacgaaagttgatgttggaaacccactggtcatagttagtcctcaagtcccatgagccgctcggagctccgacggtgtaggtggcgccgagcgccgttccgagcaccgctgctgccatggcgacgacgagtagagctctggctgccatgatcgccatggaatatggtccaattagctatatatcgacttcgaggatcgatggagatgatggtcgatcaatctccaagcaattggcagtagaagctaagctagaaatcgatggatgattgaatgaaatgagatgtgctgggaaggtgtgtatatataggcgttggttggaggtgtgaaattgtgaactgaagcagtagaagtagaacgcgtagaaggtcaaagactctgaagagtaggtcggtcaaatgtatgtaacgttgactcattctctcatagtaagaaaagtactatgtgttgactcactcgttggatgcattgcagacgtgtatggtgagatctagctgctactgatcttgcctggtcagttcttaaaaaaaaggaaaaaaaatgtttggtcgaccaagtctgttgcgttagattaattaatgaaaaaaacacacctgtgaaatgatccaacatgcaaaggacatctatactaatataaaaaggaggagttgtcttcttgcaatcctacagatgaaatcaacatagttaatcccatccgtccatctgcatatctgatctaatctcatccgtccatcgctatctcatcaatcccacctgattcctctcccatgctacagtcaaatcat

SEQ ID NO: 2363 - DNA, 1501 bp, Oryza sativa
tagctagctggctagtggctaactacctgctttctaccatttcttgtgggcttccggggggctatgactagttttgagggatgaggtgatcgataggtgatggacagggtttacgatttcggttcgaaatttccgcaatttcaccccctccaacaagcaaatgtatcgaccgaaaattcagtttttccaaaattttggttaatttggtaaaaaattatttaaattcagtttattttctaaataatttcatgcaaaaagtatgaaaattcctgaaattttcggaaattacagtgacaccaaaatcccgaaactttcggtctaaaccagagttttaaatctcccgctctagttgtttgagaagggttctagctatttgttcacatgtacaatttagtcgctatagctctatttagcccgctatagctgccgctatagctgtttgagaagctaaccgctaaatgccttggcccgctatttaaaatattggtccaaacgaaattgaaaaccctggtgatggacggaaaccaagcaagccatcatggattaagtggtcaattcattattacgacattgctcaatccaaacaaaacagcacattagtgatgagtgaagatgaaaagctattcggttgcaggagcactgcatatatagtttgattgagtttgcgttcgctgaatctggttggatatgaagggcaaataaactatccaataattttgccaattagcaaatactaattgattcattcctaggcaaaaaccagcaggaatgtagtcgatctcctgtttctgcagccaaacagcccagaaactagtagccggccgagaatcatatctatatatacttcgtataaagttcatccactaataatagttagtacatatttaacctcatacaagcatgcaatatcatgcaaaaaaaatatggctccaattttattagccttatcttaggctgcgttcttttcagattctccccactctcaacagtgttcacggaaaacggagcggtccattagcacataattaattaagtatctgttaatttttttttttcaaaaatggatcaatatgattttttaagcaactttcgtatagaaacttttcgtaaaaaaatataccgtttagtagtttgaaaaacgtgctaacggaaaacgaggagaatctaatcctactagcctggaaagaacgagcaagaaatttgaagtactcaactggacgtacggccccctttttctacactgcatggaatagtttgcccatagtctgatcactgcatgcaaaccactagaatagtcaaaatagtctgcaagcaagaacaaggattttgatactctgttcccctgaaatgcatgcaagcacatcgatcgatctcactctccttcccatcaaattctcgtctttataagctccaaccattcttcccgattaaacacacatcttctatagctcatcacatctctacatacaagtgaccagtgagagtaatttggcgccatcca

SEQ ID NO: 2364 - DNA, 1501 bp, Oryza sativa
ggttgtcacctgcaagatcaagaaaacacaattggtcacacgagcccactaaagacaaccatctttcatcatatttgccattaaaagagtttgtctagtatatgattgatcccagaaaaaccacaattttcatcaaatctgccgaaatgtatgccaaatcgcagattgttcgatgcaaaaggaaaatggtagaaacctcaaattccaaggaaattttactagcttttgatttccatcaaatgtcgaaccaaaatctgcgtaatcttccccaaatccacaatcttctaaaacaaaaccctagtttctctctctcttatcatttactacacttatcatttactatcattcattcacaagaacaactccaaatggcaaagaccaccctaaaaacaagatgggatgcttagcgcggtttccaccaaatttcaaaccaaaatccgttgttcccccaaaatccacagcctgctaaatcaaaaccctatttcctctctctctctatatatatcattattcatcactaataagaacaactctaaacggggaaaagaaaagaaaaacaaaacaagaaggggatgcttacgcggttgccgccgacggtggcgaagacctcgtagtagtggaagtcgaggaagttgaatccgatggcgtagagcggccgcttcccctcggtgagcttgttgcacgccttgtactccctcttcctgcttggcgccagcaaccccaccgccgcctcgcaccccagcccctgccccggccccagcttcgccatgcgcctctcctctccccccctcccgacgacggcctgacctgcccttgcttccgtcggcggcggtggcggattccggcggcggcgtcgttcggattttgggcgatttgtgaggggggttagtagggcgagcaaaagttcagagtttggaaccaaatttggaagttcataacggctgcagattttcatggatcagatttgtgagaatttgggaccggttcacacacgtctttttagcaaatctgcatttatttctcgatttgatttcgagttatctttgttagtcagatttgcttgagttacatggtctcatgagtctgtggtttagagttgaatgttttttttttgtccggaaaatggtttggagttggggacttggggtgccatcatctccgaattctcgttttttatggtttatttatgtgtttacatctcatctaagccagtgaaatttatggtcagttgtagcttttaggttgtcgatcaatggcttaacgttgtggttacttgtcgatattaaggtttattgatagagcgatcaattatatagactagtaaaatgcccgtgcattgtaacggatgaaaacaatataattttaataattaatctgttacatggtaaatcatccatttcaatcattgacacttaataaataatacgtgaaaatatttagaaatacatcaacatcattgtttattaataatatttttcctttaataattttaacttgcatt

SEQ ID NO: 2365 - DNA, 248 bp, Oryza sativa
gcccgtcaaaggtatgagcattacctttgacgggctttttttatctaacccgtttgaggtgtgttgggtctataaatacccccaaactgccaactgctttccatcccgaccattgtactgttcacaaatcggttgggagggcaaggggggcgattttttactaaaattcaaggtaaaaaacacattattctccattcattctcaacatatcgatcatcatttatttttcttcgtatgttgttgatttc

SEQ ID NO: 2366 - DNA, 1501 bp, Oryza sativa
tatatttttttacgaaaagtttctatacgaaagttgcttaaaaaatcatattgatccatttttgaaaaaaaaaaattaacagatacttaattaattatgtgctaatggaccgctccgttttccgtgaacactgttgagagtggggagaatctgaaaagaacgcagcctaagataaggctaataaaattggagccatattttttttgcatgatattgcatgcttgtatgaggttaaatatgtactaactattattagtggatgaactttatacgaagtatatatagatatgattctcggccggctactagtttctgggctgtttggctgcagaaacaggagatcgactacattcctgctggtttttgcctaggaatgaatcaattagtatttgctaattggcaaaattattggatagtttatttgcccttcatatccaaccagattcagcgaacgcaaactcaatcaaactatatatgcagtgctcctgcaaccgaatagcttttcatcttcactcatcactaatgtgctgttttgtttggattgagcaatgtcgtaataatgaattgaccacttaatccatgatggcttgcttggtttccgtccatcaccagggttttcaatttcgtttggaccaatattttaaatagcgggccaaggcatttagcggttagcttctcaaacagctatagcggcagctatagcgggctaaatagagctatagcgactaaattgtacatgtgaacaaatagctagaacccttctcaaacaactagagcgggagatttaaaactctggtttagaccgaaagtttcgggattttggtgtcactgtaatttccgaaaatttcaggaattttcatactttttgcatgaaattatttagaaaataaactgaatttaaataattttttaccaaattaaccaaaattttggaaaaactgaattttcggtcgatacatttgcttgttggagggggtgaaattgcggaaatttcgaaccgaaatcgtaaaccctgtccatcacctatcgatcacctcatccctcaaaactagtcatagccccccggaagcccacaagaaatggtagaaagcaggtagttagccactagccagctagctagtccgtgatatccgcaagagtatcattcattcataggtgcaaatgcaatagctttgcccacagtctgactcgatctgatcatcactgcatgcaaaccattagaacagtcaaaacaaatctgcaagcaagaacaagggttgtgatactatgtctgtctactatgttcccctgcaatatactgcaagcacatcgatctctctctcctttccttccaatcctcgcctttataagctccagccattgctcccgatcgaacacacaacccagctatagccacctacatctgctgatcgacatcgatcgatctctactactccagtagctagcaagaattgaatctaggtgaagtgagagtgtgagagtacataattggcgccatcca

SEQ ID NO: 2367 - DNA, 1501 bp, Oryza sativa
gtctcggccatcgtcatcgacgtggggtcctacagctgcaaggcggggtacgccggtgatgacacccccaaggccgtcttcccctcggtgaggcagaatgcttcttcttcttcttcttcttctcccctcctgggttggctcgctgtaattctgtctcggagttggaactgtgtggtctgtgttttgttggtgagagttcgtgcgggtggtgtcatggaaatgatagggctctgtgcgcaatgcaatcccactggcaattttgtgtgttttctccccataattttgagctgttttaggtcgttgactttgaattctgatttgaaaaaaaaaagaatgatgtgttagtgtgtggcgtcatgatatacagacatatgtttattatttaggtcaagctgtgaattttgctgcgtgcattagttcctcctaggtccccagccacctgattaatggttttattcgagcactggatcttagtctgggaacatgaataacagcagttttttttttaaaaaaaatgttagtagcaggctaactcagatattggatagtaccacagataagacctgcacttaccttttgattttgacatatgcgtgcaaaattatgatgtattgactgcattgttagtttacctttcagctttgtcttagctgcaaacctgtgccattgctcgcataggtagtagttagcagtgttgcatatgtgcactgagagtcaaatgccaaactgaatttttaaagtgctaaaagaatctgcattgtggtttctgtggaattgctacatgttggtactagacgttaacttcaaatgctatgacaggtgaacttctggttactgtgtttgtaacgggaagtacttttcttgtgtattatgtcaaataggattgtactctttctgtcccaaaatataagtatttctagagttttgcacgggtattaaggaagtaggtggaattaaatgggggatatgatttttttgattggttgagatgaggaagtagggggtgaagttactatattttgggatgcggtatttttttgtcttaggttctacagtattattttttaaaatttttttcttcctttagttaacagacttatattggggtaatttgaattcttggagtagattgctaatttctctttgttgccgaggaagtgagaaaacatataatttagtgacatatagcaaaacaatcagctgtaaggtactaaaaagtggtgtgtgaatcacacagaaaaagtgtttttgagtttcactatttgatgtcgctgctaatagattagcatattttcttctcctttttctacataacgtggcagtagttgcaagatatgtcattggttcatgggattatgcatctgagctacctaatgggtaatttggttttagaagttcttactgtggttggtgcacattctgttgtgttaaggttgttggttcaattgagcaaacgggagaaactgatgaagcaaaggcagacaaggaggctgaagctgca

SEQ ID NO: 2368 - DNA, 1501 bp, Oryza sativa; identical to SEQ ID NO: 690

SEQ ID NO: 2369 - DNA, 1501 bp, Oryza sativa
gaatataagatcattgtgagacctcctcaaataagtacttgtgttgacgtttaatttcagtaatatgataaatttgtatcgatccttagcatgctagcttcagctagcttggaataaataaacaaataaagatgtgtactgagggcacgttgtatgagcaagtgaattgaatagtattgaaatcctttgttactatacaattatctcccactaatttacgttaactattttctaactctttgattgagcggtactatattacctagtgttattacttgtacagttataccccaactaggatatttggggtatttaactaattgctatttataagatgtgttaattaagaatttatcgctagtagtctacaacatctgaacccttgtgtttatatgatatatggttcggtggaaaatccttaattataatatctctgtattttggtttgacagcaacgaacttcatgggcttcaccggcagtgactcttgaggcctgtacgtggtccagttgagtatatttggcaggaataagttcatctaaggtcccttaacttatcaacgaatccgattttcatccttcaatcacaaaaccagatacaacgagtctctcaactatcaaaaccggtgcgaattaggtccctcggcagtttcgatagcagttttgactgacgtggcgcctacgtggctaatttgactcggtctcgatctgacgtggcactgacgtggcgcttacgtggtaattcaattcggaaaattaataaaccctgtgggacccacatgtcagtttcacacacaagttaataaaaaatggcggggccctgggccccacatgtcatttcacccctcttcttcctcctctctctccccatctcccatctcttcatctctctcccctttcctctctcgcttcggcgctcgcgccgctctcctcatccctaggcctctccgaccgcctcctcgccacccgccatgagctccacgagcggcaggagcacctcaccgctgcctcctcatagccgacctcaccgctcgacttcgtgctgcccgcgcctcacccgtccccctcgccgccgctgccgagctcaagcctctcttggtggatcccaagggatctggatctagtcaggacgaacccgacacggttcatgatgagtgtcacgccccgaactagtcccgaccggaactagcccgtgacgctccaaattaacctgttaatcgataccagtcccaggaaacagtgctggtatcacagggagacagaatatcacagcaacaaaggtctctttattatagagtagatgtacagtcatgttgggctgcggacagatcccgagctcacaactgcactacaaaagggaaacggaagctaggagttggaccaaacgacacaggcgcgacttgggaactaggccgaaaccctaaaactcatcgtagccggcttgctcctggaagacctcctcatcagcaggatccgcttcatcttcttcagcaactggggggg

SEQ ID NO: 2370 - DNA, 1501 bp, Oryza sativa
acatactccgaccggacaagacgcactgtctcatccgtgtcgtttgagaagcactcacttagttgttttcagaaaagggttcaaataaaatcaattgctaaaacaacagcctttctttgaagcctgcattaaacacttatttcccatggcttgctgagtactcccgtactcacccttgctctatataaataatcccccccagttgctgaagaagatgaagcggatcctgctgatgaggaggtcttccaggagcaagccggctacgatgagttttagggtttcggcctagttcccaagtcgcgcctgtgtcgtttggtccaactcctagcttccgtttcccttttgtagtgcagttgtgagctcgggatctgtccgcagcccaacatgactgtacatctactctataataaagagacctttgttgctgtgatattctgtctccctgtgataccagcactgtttcctgggactggtatcgattaacaggttaatttggagcgtcacgggctagttccggtcgggactagttcggggcgtgacactcatcatgaaccgtgtcgggttcgtcctgactagatccagatcccttgggatccaccaagagaggcttgagctcggcagcggcggcgagggggacgggtgaggcgcgggcagcacgaagtcgagcggtgaggtcggctatgaggaggcagcggtgaggtgctcctgccgctcgtggagctcatggcgggtggcgaggaggcggtcggagaggcctagggatgaggagagcggcgcgagcgccgaagcgagagaggaaaggggagagagatgaagagatgggagatggggagagagaggaggaagaagaggggtgaaatgacatgtggggcccagggccccgccattttttattaacttgtgtgtgaaactgacatgtgggtcccacagggtttattaattttccgaattgaattaccacgtaagcgccacgtcagtgccacgtcagatcgagaccgagtcaaattagccacgtaggcgccacgtcagtcaaaactgctatcgaaactgccgagggacctaattcgcaccggttttgatagttgagagactcgttgtatctggttttgtgattgaaggatgaaaatcggattcgttgataagttaagggaccttagatgaacttattcctgccaaatatactcaactggaccacgtacaggcctcaagagtcactgccggtgaagcccatgaagttcgttgctgtcaaaccaaaatacagagatattataattaaggattttccaccgaaccatatatcatataaacacaagggttcagatgttgtagactactagcgataaattcttaattaacacatcttataaatagcaattagttaaataccccaaatatcctagttggggtataactgtacaagtaataacactaggtaatatagtaccgctcaatcaaagagttagaaaatagttaacgtaaattagtgggagataattgtata

SEQ ID NO: 2371 - DNA, 1501 bp, Oryza sativa
ctgtaaactgcgagacgaatcttttaagcataattaatccatcattagtacatttggaatactgtagcacttatagctaatcatgacgtaattaggctaaaaagatttgtctcgtgatttacagtcagattgtgcaattagtttttctttttgtctacatttgatgctccatatatgtgtccaaacatttgacgtgacagaaaagttggaagtttaatgagaaaagttagaatctaaacacagccataaatatcttttctagttcattttttttttgtcacgatcaagctttacaactagccgtatcacagcaaaccattttccatctctttccatccactagtttcaactttcaaatactaaaaaaaacaacacaacgtgaccaatatcctgcctacgtggatcaacccaccctgaccccaatccgacccatccatcccccaatcaacggcctcgatgcacccaccgtccccacggatgaacggccgagaaccctccacgtctcacatccaaatctcactataagaccgctataaccacagaaaaaaatttgaaaatatacttttttttctttcaatttacaaaaatatacttgcacgacatatatttgcgaaaatatacctcgtccgtatattgggttagcgggagcggtacggtaggcacggtcgcgcgtagtggggatgcgggatcgagccggtcccgcacggcggttgcgcggaagcgatgcagcccgtggaacgggtatgcgggagcggcagggatgcgggagcaccttgggagcggcacggtcccgcggaacgggcgtgctggagcggctcggttccacaatttttactgtatcagtactgttttgacactatttggcactgttcaaacagcggtaccgcggatccaatgtgcggaaccggctcatgaacagtgtgaaaacagtgcgaaacagtgcagaacagtgtcaaacagtgctatatgcatgcatgtgcagcttggctgctcggtcacgcgcggccggcctgcgtgaccgcacggccggtccgcgggaccgacgcggtaccgtgcgtccgtgctgcaggaccaccggtcccgcggaatggtagtgcgggaccgcctcggtcccgcgtaaccacactgcgggataggtatatttgtgcaaattttcgtcacataggtatataaatgcaaaataataaaaaaagaagtatattttcaatttttttctataaccacgtatcgagaagaaaagagaagagagaagaaaacgggctacagatttatagctagttgcaacacggactctaagacgttatgtgtatatgagagataggaccggtattaatggtgtagtatatttttgtacttaactattgtatgaatagactattagattagctatagatgatttagagccagcagttagctatactgttaaaacttgctctgacgagaacgcccccgccacacgtgccgaatgacccgcccccacccctaccccgatccggtgggc

SEQ ID NO: 2372 - DNA, 462 bp, Oryza sativa
aaaagacgaatgattaaatatattttaaaaaatcaatggcgtatgatctagaacatatttaggaacggaggagtatgatctagaaatctattctggttcatgtacggcgaacagcacaaagggcggaggcgcccaggcttcgttccccaattgggccccttagaacaacatctaagcccgcgggccacccaacttaaaatcccaacatcggagcatcctgggcccaagtcataaaccctagcttctcccttggaatcaatcgaaccgattcgcccccctcctcactcactgtcgtgcttgcctatcgtctccgctcccggtgcgcagccggcgagccgcagccgccgcccccctctccgcgccggcggcctcctccgccctctctgccgccagtccccggccgatcccatcgccagtcggcgggcggtctccccgcgggtggggtgggggcgggacggacga

SEQ ID NO: 2373 - DNA, 1501 bp, Oryza sativa
tgctcttattcaccataatcacaccagtacaatatttggggtagcctatctaactgttgttgatatggcggtctaaagttctgactcgtagtagacaacagggtagtcttcctcgtcgagtttgtgctcggcgagatcagagacagcgctagttccctacggtcggcctctgaaggtaccggatagggtcgatctagacatatctctgatgtcgatatccggcggcttgtcttgacgtatgttggcttgtattggcttgtggctttgtggcgtctatggtaggtgtcttccatgctgggcgttgattgtcctctcctcctagggggtcttgtatttatagtcataggtgtccccttgtccaagtaaaactagggaaaccaatatggatacaatccgagtagtctttgtcatttccatgtagaactctggttgtccttccttatccagaactcctcctatatccgcaggttgtttccgtataggacatggtatgtggtgggtcctaccgagatttagtcaactactattagatatgtggtatccataaccctgacagttatatggtttgaagggcacgggtccccagcctgcctagggacctgggcccacctttgctctggtaggttacacgtccctcccaaagaggagcgtagatgcctacaagatctatattttaagaataaggctgagggaagcctggatcctagcttgctctgggacctaggcccatctttgcccttgtatgttactcatccttccttgagaggagcgtggaaacataaaagatctacatcttaagatcataaaccaaggcggagggaagcctggtcccatcctgctctaggaccaatgcttgcctttgcccttgtattttgcatgttcctccttgagaagagtgtggaagcatacaagatctacattttaagattgaagactgagggaggccagggtcccaccctgtcccgggacccgggccctcatttgcccttgtatgttacacattcctccttggtagaagcgtagaaacgtacaagatctacatcttaagatggaaggctgaggaaggccaggaagcctgtatcaggacctaggccctcccttgcccttatagataacacgtccctccttgagaggagtgttgaaacttacaagatatacatcttaagattaaggctgagggaagcctagatcccggcctgcctgggacccggccccacctttgctcatgtatgtttcacctctttcctcaagaagagtgttgagacgtgcaagatttatgtctcaagcaaacaaaccaaggggagcttgaatcctagtccagcttgggatccggtcccccctatgtccttgtaggttacatgctcatctttgagaggagtgtcgagacatataaaatctatatcttaaaattgtaggcaaaggaaactgggtcacagcttggtctgggacttggtccctcctatacccttgtgagatgcatctctttccttgagaggagagt

SEQ ID NO: 2374 - DNA, 519 bp, Oryza sativa
gtcatctattaaaaaacgaaggtagtattatcattaacatattattaatatctcttaattgtttacatatttgtgctcacacgtagaccttgttagttccatactgagtttgtgtgagtattgacatgtgatccctctgtagccccataagttaggaattggtagtgaggataatagcagaaccaccaccactactcccttttatagaatgataaatgggttaacgtcgtctaattatccatagaagttccttttttttaattctatactatttgtatgtacatgtatataaaatatacacgcgtacgcgccatattttcatacaaggcactgtgcatatatatactggtgcatttatagaaggaagtcatacgatggagatcacagcaacatcaaacccagataagatgaaggtattaattagcgtacttataaaatcatccattatatatctagacgcgcagatacactaaataaacaaattaaatagatatatatactactacgactaaacttaga

SEQ ID NO: 2375 - DNA, 1501 bp, Oryza sativa
ctccctctcctcttcctcctcccatcccggcactctccttccccctcccttcccatctgatctctcctcagatccatctccctctcctcctcctcctccccttcctcctcccatcccggccctctcctccccctcctcccttcccatccgacgcccagcaagggccgcctcctccccctcctcccttcccgtgcccagcgggaccacacttggcaggcggccggcggggccgcgcccagcggggccgcacgcagcaggcgccgcgcatgggccgagtagcgagcggctacaggcagcgctaccgacatccatttttttcttttttttttacaatttgtgattctctgatatgtataattttgtgatttgttgtatggatctgagatgtataatatgtgatgtatttggtttgtgtgtaatttttttaaagatttgtgatgtatttgatttgtgtgtacaagtaacttaagatttgtgatgtgaatgttttggatattactttgatttggggtttgatttaggactatgcatcccactcgattggggagaaaatatagggtttaatctctggctaagaaacaatgaaaaaaaagaaaatgagacctaatgggactgctgctaccctatctttagtccgggactaaagataccaaccgggactaaagatctatttttagtcccgattatttcaaccgggactaaagatgggcatctttagtcccggattgctagtcccggttggaaaacgggactaaaggggttaccaaccgggagtataaatggtttctccaccagtgcctccggtttcattttaattgacgttttggacaatgacacggtctacaagatacatctttgaccttattttttctattataatatatataataaataaatgcatgtttacttttattatagtactttaaaagacaaatctatatatgttgttctagttcctttatactaaatatttttaaagttattgataatctaagttataaaagtttgacctcaactttatcccaaacgtcaattaatatagaattggagggagtatataccttagaggaaccgacaccattaacataactcctcgttagcacctgctcgatcgatgccggttaccaaatccgacaccatgtgaagttgataaccagcacataaaggcttttcgtaagtagtgcgtgcgtgcagttacagagctaatccgtgaccgtgatcgtctccacttcgatcgaccgtttcgtcgcggccacgaaatcgccatcaaaactgctgcatccgactgggaaaaggacacccccgtacacgagcccgactcgtacaccacactaccccgccccacgctataaataccagctctcgtcgtcctcctcgatcgtatcccaccaccaccaccaccagagctagcgcagcaaccgcgagttcagttcagttcagtttttgttacgtcgtcgttcgagtcgtcgtcggctagcttcgattcgaagaagggcaacaa

SEQ ID NO: 2376 - DNA, 1501 bp, Oryza sativa
gcacgactgcacacagtttaactgcctcagcctaagtaaagagcatgcagcttatttacatgcaacaaaaatcatcacactacacacaagtgatatatagcatgaaccttcagaaccaaataaggcagttctctgctttgagaagaactgtagggaagttcagggcgataacaatgaaaattccatatctagcctgatgaaagattcaataacaaatcttagcaaatggcacaataagaaggagaagcatcaggaattcaagttaaaaaaacaggagttcaactcgaggaggaaaatccatttcgttaggtgcaaatcaagagcattggcatgattccaacttctcagtatcaaatccattcatcacttctagccccttcttttgcttttcatttagtctggtttcttcagcttcttgatagaaccaaacatctccatgtctgaatctttatccagggaaaaaaattgcttcagttccagaagctgaactgaatgcaccacatcttttagtattttttcttcagatctttctgatagacgtaataaactggcgtctctgtaacacctgagcataataaggtttcatgtgatttagcttgtgtagcaaaaaggattatgcatgcatagtgcagttttcggtctgtaagaaaaaatatatataaacctgtactgcatcttcatgagtggtgtctagtgccaaacagctacagatttctttagacgatattgcaagaaccagtgtctcagtgagtaatcattggcagagttgagcatcacctgattgtatgctggaaggaaaagacaaatgctatatatgttatcaattaaaaaagtcgataggtgatttaaccactcgatcgggcaggcttagccgtccgaatattggtttatttgttcaacaaatcagacaataaaatcaaaataattttatttcgtatgcttgtagttttcaagggtaataaaacatatcagttaatttaaatcaaccaaactcatatgttttacctttgtgtatcttctttcttacgttcatatatcaggtaaaccatgacacactatatatatcatcatgctttgcttccctttgcagttacatcaatgtctgtaatcatgtttattcgaaacctcaaaagtaggttttgcatcggattgttacacctgtcctgtccacgagattgcatccatccagaagggaatgaaaagagcatcaaggcatttttggcaaattcttgattttgttcttgagcgtggcatttaccaatccattatatatattttctgaaatcgcatatgcaatgctgtattgctgctacttgtttgcggcgatggttagggttcgacattggatcaatcgtcagttaatgtttattattctttggtttggtgtgtgtcaagtaggaaacttttttttttcgaacggtataatcgtctcttcggcaactgggcaatggggaagtagtagatccatgtgattgcaaatgatactgcattcctttctcag

SEQ ID NO: 2377 - DNA, 1501 bp, Oryza sativa
ataaatattagcacagggtttgcattaatacaggaaacaaaaatcattgaagcatcacctaagctaaaaattgaatctgacatataattacattgtcagaaatatctatagtaaattgagaatcaaatacacgtgatcatattgacatgccatcaccaaagtaatttatcctcaccacttaatttattgtacataccagtatttgcaatgttctgctgcacacatatcgtgttggttgtgcaatggacatgatgatgaaatcaacactgcctaacaaacatagaatcatttctcagagtttagttcatcaagcaaaatcaattttagagtttgtttagttcaggatagcaaaatgatttcagatttactttcacatctttgttatccatatttttatatacaaatacaagtaaattgttgctctgatcttgaggtcacaccgtcacagactcatatcctgagaggatttacaaggaatcaacagacttacaacataaatgcatgagcatatggtttacgagcaaccagctatgatcacaaacatctgcttcttttctgtttttttagtagataagctccacccatttaaaacccatcctttgtaccttcagaggagcagctacccattccttttaccacaaactgaaaaaattgtttagtcatctcagaaatccaggtagcaaataagattcattcgggcatgtcatatgctgatggcctcctagcacttacaaatagaaaatgtccataaccaactaattcggggagagaccaattataattactagttgcccacccatgcattgcacgggttgaaaaaattagtaaaaatctaattaattagtttgagaacttaaaaactcaacaattcatcatcaatgtaaatcataaaaaaagtatcaccatgagcattgtgcgaaatcttaaataataaaacatcatttttttcttattgtattgaagagtttttttttttacatttgcaccatatgtccataatttgtctgatttaagggtcagcatctcaaaatccaaatttatgataagtgatgatgttagtactggagactggaaagctcccgtgtgacaaaaacacacggtaactagccaaaaacgccccggaacagcgttaccgtgtgccatcacacggtaacgaacacacggcggcttcaccactttaccgtgcgcagttcccatggggatatgcaaaaagcgcacggtaacactagggaccataccgggtgtccagaaactcacgggaacacctgtccctaccacgtggcaaattttaacgtaacggagttcaccgtcaaatgaacggtaggttcccgggtgaaccaaaaacacggtaacataccgtgcgctgacggaaactctcggtatgctccggtgtgttaccgtgcgttatagtataataaacacacgggaagcaatcgttactgggtttgtacagtggatataattattttttatttctgattttcatttagtttctttttta

SEQ ID NO: 2378 - DNA, 1501 bp, Oryza sativa
ataaagtgcaacaacagcacttctcacgaaaatctcgagtactaaacttgaaaccctaactattctcccaactcaatgctctctaaaacgataccgggaggccacacccttcttctctatatatacccgaggtaggcagcctaaagccacgaaccaaacttgtacaagaagtcctaatcccctaggaaacctttctgtataagaaactaactttacaaataacaattgtaccaaatttggactccctccaaattcgactccgcaccccatacgcacacaataccttcatcgtatgccatatagaatcttcaccaaccatgtgcattgatctttagcctaagtatctgtcacgcccagaatttctatccaaaactccaaacgcttacatacgtgtaaaccctcgtccaggaatcagctgagacacacaataacaaattgataatagagtgcaattattattctatttaataggcgaatataaagtcattacagaggtagatagttcctctcaaacaataaagatctaagcagcggaaaataaaataaaaagcgtaggcgactccatcccacaagtagctagaccagggctacgcctaatcctccacaccttcagcatcactgtagaactcctcctatgatgaatgattgcaaggtgagtatatgacatactcaacaagccacgcagcaaatatgcaagtgcaggggataacaaaggattgcataatatagtcttatttgcataaatggcattcaataaatacttaagaatatagaaaaaacagtaaagtatttaattaaacaatattaatccaacgctatacaacatacccgttgtataggtccaaccattctgaacaaccattcccggctgcacagttctatctccaaaccaggaatataccattccaaaccaggagctaaacaagttattaccaattacagcatcatttattatggtgagaggtatgagactaatcacgaaagacattgttagacccgcccataacagcggtgtggagattatggataccccatatctacatggcatgtatagtacgactaggtacagggtgccatatatagatagaatatctttatgaggactcgggttaagtttaaacttgtatgtcaaagaaatatacgagatcctagtcggtgacgattgtattttatctgtaattgcatattccgttagggatatggactgtattttgtaatactgaccccttcccctatataaggaggggtccgggtccctctagggacacgattttctcccagatcatacgatcaataatacactcggcggatcaatccctggacaggagtagggtattacttcttgattaagcaggcctgaacctgtataaaattatttgtctccaaacccatccacttttctagcttggtagccacccccttttagtattgccgaaatcttgtttcgacagttggcgcgccaggtaggggtagcgtcaagttcttcgccgattaagtgcga

SEQ ID NO: 2379 - DNA, 1501 bp, Oryza sativa
tgcacgtctcaacactcttcttgaggaaagaggtgaaacatacatgagcaaaggtggggccgggtcccaggcaggccgggatctaggcttccctcagccttaatcttaagatgtatatcttgtaagtttcaacactcctctcaaggagggacgtgttatctataagggcaagggagggcctaggtcctgatacaggcttcctggccttcctcagccttccatcttaagatgtagatcttgtacgtttctacgcttctaccaaggaggaatgtgtaacatacaagggcaaatgagggcccgggtcccgggacaggctgggaccctggcctccctcagccttcaatcttaagatgtagatcttgtatgcttccacactcctctcaaggaggaacatgcaaaatacaagggcaaaggcaagcattggtcctagagcaggatgggaccaggcttccctccgccttggtttatgatcttaagatgtagatcttttatgtttccacgctcctctcaaggaaggatgagtaacatacaagggcaaagatgggcctaggtcccagagcaagctaggatccaggcttccctcagccttattcttaaaatatagatcttgtaggcatctacgctcctctttgggagggacgtgtaacctaccagagcaaaggtgggcccaggtccctaggcaggctggggacccgtgcccttcaaaccatataactgtcagggttatggataccacatatctaatagtagttgactaaatctcggtaggacccaccacataccatgtcctatacggaaacaacctgcggatataggaggagttctggataaggaaggacaaccagagttctacatggaaatgacaaagactactcggattgtatccatattggtttccctagttttacttggacaaggggacacctatgactataaatacaagaccccctaggaggagaggacaatcaacgcccagcatggaagacacctaccatagacgccacaaagccacaagccaatacaagccaacatacgtcaagacaagccgccggatatcgacatcagagatatgtctagatcgaccctatccggtaccttcagaggccgaccgtagggaactagcgctgtctctgatctcgccgagcacaaactcgacgaggaagactaccctgttgtctactacgagtcagaactttagaccgccatatcaacaacagttagataggctaccccaaatattgtactggtgtgattatggtgaataagagcaacgaccggcttcggccaacaggatgtagggttattacctgacaattcaggggcccgaacctgtataaaaatcctcgtctccatctcttttacctcggtctcgcgtatatcctagtaccaacgatccccatactatgcaaataccggaatcgcgacatcaaatgtcgacagtggcgcgccaagtaggggatcttttggtgcttcaaggtttcgacgagatgtgtttaagaga

SEQ ID NO: 2380 - DNA, 1501 bp, Oryza sativa
gctgcgctatgcattgtggttgtcgccattgagggccgtcggggttgccatcgctgagggccaccaggagcagatcaactgccaagtcccctgcccatgaagatacaacgatgatgctacctctgcaagcatttcagtcgctgtagtcgttcaactatgctcgaagttgccattgaactcgttgcattggcacaagcagatctgaagcagcagcaagttcggatcgccacgaccaccgatgtagccaaggccacctcgaccatcggtgcggcctcctagaggagtgctacacatctgtaggcaccgtggttcctcttcttgttggtggtagcatcggcggtggccggtgagaggatgacgatgccggtgtccttgtggagcatgagcccttgggccacaccgtcgatgtcgcggccgtggacaaagaggagcacgagctcggtctgtgccatcggagctcgatttggccccgtcaaagctcggttcgtggaaagggagaggagagggaggttgttgccatcatggcctcctgtcgcccttgctgccttcgtctgctgagccgccgccgctaggttctagggaggagatgcaccgggggaaggggagaagggaacaatggctgttggtgaaatggtaactagggtacccctttccctatggatctagcactcttttcatattaattaagatgaaaaagcttacttagaccatcataaagctaaggcgcataataacggggcttgggacccactgtaagggtgagtcctagggcccctatctcgcgttacaagatggttattgtcgacatttgatgtcgcgattccggtatttgcatagtatggggatcgttggtactaggatatacgcgagaccgaggtaaaagagatggagacgaggatttttatacaggttcggtgtcatgtccgaaaacgactctaaaatatatcctttaaattatgcctagaataattaaaatccgtatgtgaaagcctccaaaaattaaaatgtgcaaagtaaaagtcaaaaagggcttagaggatttttgtatatttcctaaaagcctaaaatgtgtaaataaattttagtggaattttcagagcacaaataataattaagaagaaataaacaaagttgaaaaagttttaaaaaaaagaaaaaccctaaaagtcccccttccctcccttgggccggctcggcccatctctcctcccccctctctctctcctctccccgcggcccactcggcccctccccgcgcgcgcgccgctgacgggcgggcccgcctgccaccctcgctgacgggtggggcccacccgtcatccccgacctcccgccgctcccgccgcctcgcccgcaccctagcgccgccgccgccgcgaatccgccgcatcccgccgtccccgcgtgcaataaagtgggggggggaatactccccgtgattccctctccctttccccccatttttccgtctctctctcgcattcaaacgggcggatttgcc

SEQ ID NO: 2381 - DNA, 1501 bp, Oryza sativa
tattttcttgcacatggaaagcagcgtttacaattttggttcgaaatttcgataattttggtccccaccggcaaatcaatataccgatagaaattttcagattttctcttttttttgtggaatttggtcaaatttactcaaattcgatcaaaatctttcaaaatttcaaaaaaataatggtccgaaaagtgccgaaaatcatgaaatttggtaaaatttcggtcctaccgaaatcaaaattgtaaaccctggtggaaagtcgaaaggatctctgcaacaaaaagaaaaggggaagtcaaaagtaatatcactggtcatggactagccataggaactgccactggtgtctcatgtaagcatggactaaattatgcaatacaacgttcggtaaccaggaaggagcctataattagtcaactaatgttttcatgtatgcgtcgagtagtgaatagtttaattagaaaaggcacactactaaaaaatagttttcgctgacagtcaaaatggattttcgctagcggctagatgtgccgccagtgactaaaggcaagtgaaaataatgctggccgccagtgaaaattgagtttcgcaagcagctatgctaagacaaccgctagcaaaaataccattttggctagtggcaaaattagaccaccagtgaagacaattttggggataaaaaaaattcaaaatggtgctgccaactgccacagccgcaaacaccgccggctgctgccacaacacctcaccgtggccgccgcctgccaaagcccaagccatggtcgccaagtggtagatgggggggaggggttggagtagcctagccatcatcgtcgttgtggcagcccccatcgtcgtcgtcgtcgtggcagccgccgccggatccacctccttcaccgccgtggaggaccgcctgagcaccaccgccggcggatccgcgcccaccctcctaccaccatcgcttcccactccgttggcctcccccgttgctgtggcggcggatccttggtagccgctagcgaaaatcctattttagttgtcggtaacctataaaaagatctctatttttgcaagcagacctcttaagtgaccgccagcgaaaatcaaatttttgcaagcggttgataaccggaatccctccaattattttcacaatcgtattttcatcaaacccgacagtaaaaataaaagggtaatgctataaaaaataatttttctagtagtggcagcttgaattgggtgtaatgtatccttgagctgaaagagatgatgactagtagctttcttgtgtgcaggatttttatgaagaaaactctcaactctgtacagcgctgaaaggaagctagttttcagataatcttagcctaattaagctaaaccattcttcaggtatttcaactactaccaactgagtgtccgaacattttatacaacattgaaaatttaaactttccgatccgtttcaatgtatgaacacaaccaagatcgatcgaaattcgag

SEQ ID NO: 2382 - DNA, 1501 bp, Oryza sativa
aatgacgatgtcaaattgatgcgctctccaattaaagcatatgctaaatgtgtagagtaatggccaaactcgtgaaaccttattcggttaatcttctcttcgagcaatttaatcccctcaactccttccatatttcaacccctttctcttgggattaataatttcgaagcttcgtttatgtgaatataattaaccacacgaaaaataagataagtgattagagcatgattaattaagtattaaatgttataattttgagaaatggatttatctgattttttaagaaactttcatacagaaagattttacaaaacaaaaaatatttagcaattttgaaaagtgtgttcacaatagtccaaggagttgctatcctaaaacagctcaaacaaattgagtttaatcaatgtatctatacgatgttctgcgacatgatgtgattaaaattggtcctttaatcatctgctattaattttaactgttgctatcgaaatctttagtcggatggcacgcaaacaattataaaggtcgcgacgaacgatgaagaacgcatgcgactacaaagatgacgatcacgatggacgaggcgaactcaagcatcggtgacggctgcgacggatgtggaagagggcgaaggtcgtggctgacgatgggcacgaaagacaagggcatcgacggatgaggtggatgcaagcaagttgacggtggcgtagcgtggatgtctagcctacaaacggtcaagcggatcccacaactttaagctacgtgtgccgctaggcgacaagttaatcatccgctctcgttctctctcctctcgtcttttttactcgtcctcacaaaatcctacgtgaataggagtttttatcatcaattattatacctgctctaactattgtgcatattgctgttattaatcccgactcccgaggtgatcaccgcgccgctccaccgaacactcgctcacactcacgtccagcaacaacacacgccacttcactaccgacgatcccaccgactactcgctgtcaaaacaacatggccatcccatacaacctttctttaaccacctctccacctcactaatcatcatcatcatcatcaaatcaatcaatcaacgccccctccccctaatttaatcaacccccccccctctccatccagcctagcatcgttagttagtctcccctggccccacccaccagacattccaccaacccccttcctttctctctccctcttctaaacaaaaacatctcccgtttcagtcgcccacacaccgacactctcctctctctctctctcctcgtgaaaatatttgtcacaaaaaaatttaaaagaaaaaaaaacacacccttcgctgagctagcaacgcggtggttgctgctctgctctctctccaagcaaacaccattattataccaccacctccccttccccccatttcctcctcctcccccacgcggcgcaccagctatcgccgccgccgccgacgaggagggtgcga

SEQ ID NO: 2383 - DNA, 1501 bp, Oryza sativa
atttacagaaaattcgaaactaaaaaaagaaatattaaaagacgagtctagaatccatataagaatatatataatttacaaataactaaaatttaatattaaaaataattaataactaacacgtatataaaatataatatgaacattacacattagtagttttgtagagttattgcaaaatttaaaattatattgttattttaatatatttgaataatataatgagaaaacatataaaaatataatgatgctagccgctcaatctgcgtgggccacaatactactttgatatgaaattaaacacaccctcgatcatcttccgagtatagatgtggcgtacgtgaacatggatggatttgtttctcctgattttaccccgtttgcgtgtttcagaacagtgcctgtttctggtagttgtaacatggagaattttgcttgctgtaaatctgtaattctctccggcagcgcgctctagctcctggcatcagcggtctttcttcaccattatggagctcatgaattttttttaaacacatcacattttattaaaagacaaagtttaggggaaatgaattccgaacacatcaccaggagatagataagagttgaaccatctttaacaagagagaggtcaactgaagaaagaaagcaaacttcctaatgaaactagacagcaataaaggagcaaatctacagggtactgcagcaatgccgtgatgactgcatcgtagggcctgtattgatattgatgtgcactccgcttgacaagccgttaaatcccttcgactgcctccaccggaacaacacatatgaaaggtttgttgctgagccgtagattttggtgtgagttccaaaagtttccatatccatacctgttttcaaaaattttaaggccatataataaacactaaatctcccaaccctatccaaaatagtatactactgtaagacatctcaatttttttcctctggagggggggggggggggctactcattttgaaatggctagagatttctttgagtgaacacaatccaaagtctcccaaccctatccccgatgagatgttatgcttatgatatagggtggtactgttggttactaaaatttggaattttttgttttaaagaaaaattggaagcttagtttgcctaaggttgttagaactgaggggatcacctatacatttgtcgataaaatttctcctaaaaatttgacaaatgtaattacaatatagtcgtagtgtagttacactgtaaattacgtgtaattacactgtaactacaatgtaatttgtatgtaactttcacataattttaaaccgttagatctaagtcacaacacgtacatgtgagaggatttgttcccatactctattttaccgaaataacatgttacgtagagatttttaaaagttacatacaagttacattgtagttacagtgtaattacactatggctgtactgtaattacatctgtcaaacttttaggagaaaattta

SEQ ID NO: 2384 - DNA, 195 bp, Oryza sativa
gatcaatcacagaagacacgagatttaacgtggaaaaccctcccaaagtaggagagaaaaaaccacggacgccagccagcaaaatatcttcactatatctggggtgaggttaccacgccgcacggcggcttacaagaggtatatatatggtggaaccctaaaagggatgacgatccgttttgctccggcccaagc

SEQ ID NO: 2385 - DNA, 1501 bp, Oryza sativa
atactagtactcctatacaacactaatactaaatactaaacacaaaatctattgacattgctttgcaagacagtaccgttgtacaatcctatccaaatcaaaacgcaaaaaagcttcctccacgaatatgagaaactaaataacgacttcaaacagcttaaaacaaccaaatcacaaaactacagaaaattcaccccaaatgtatgtttctacaactttcaagtaaagatcagaggcattttttgggtgggcgtcaaagtatcttgtttatctccaaaaccctagaaatccatgataccctatgaaactaagtacataagaatatcttatccctaactcaaaattaccgcttaacacatgattgaatggtccatatccttcagaaaactctaaaacacaagcacataattcacatgaaaatttgcaggctaaatccaataccgatgatttcaccgaactatagaatactcactttgccattcgctcaggaaacaccgtaaaatccacagatcctgaattgagagagagggcgaggggaggtagagcaccttccagagcgcgtcctaggcggtggaaaacccggaaccgaagaggaactcggatacctcggcgacgagcccctttctcgcatagcacgtgcctggaaacggcgtggtcgcggacgacgacgaaaccgcgcggccccactcgaggagagggaggagggagaacgcgccgccgaggaggtcaccgcacgccgtcgagctcgaccgacgcgatgtcacccccacaccttatgcggccgtccaccgacaggagaagcgccatgatccggtcgccgccgccgccgcctctggcactggcacaccgctcctcggtgggggaggcatgcaaggggcggaggcggccgtcgccgccgcagccgcgtggaggtggccatcgcggtggccgccgcgggctagggtttggttgatttgggattcgcccgatttgggggaagagacgaggcaagaagagattgagagaggaagcggaagggaagggattgcagtgcggagtgggacccacctgtaagcggcggaagcgcatggcacagggcgcgagttttgaatgctacggggggcaacgcggaatcccgttctagaagctaggaagcatatgggccgaaacctatctaaagggctaaagggaggtgttatttcggcccatagatatgttagttgaaagtttttgggattttggattgaatgaacttttttatagttcaatatgaatgtttgaggacgcaattgaaagtttcatatgatcttgagttaaaagttgtatgatttgattataaagttttgtagctttcaagttaaagtttcgaattttgaattgaaccttttgtaaattgtaattcaagatgaaagttttttaggctatggcgtgtatgatgtgagttgaaagttctgtgaaaatactactaaaagaaagaacaaaaaaaagtgtgcgctacgaggtgagtgtagctcaactgatt

SEQ ID NO: 2386 - DNA, 1501 bp, Oryza sativa
ttgtatctgctgactaatacttgttctgatcgagcatttctgacatagttgcatgccttggagagtttttatttttgcctaaatgtgcatcgatatcgtagtgtcatagcctccttaatttcttccaccattaatctactactggccggatcggagctagcttaagcagagtcactataatgtatactctatatatacacgcatagtgacctccatgaaaatttgtagcccagctgaccatgcacgcgcacttacctgcacgtagcgaccgattttaacttccgtttattagctcttaggtctttaatgaacaaattaaaacggagttctgattctgaacaaattaagtacaccagctgtgaattcttgacctctatgcctccagaaacatggtggacaagaaattatgggcttaattaatttggctactggaatcggagctgtgatctccatgaccacgttaaaggattatattaatttatcagatcagtctaccatgcttatccatgtttacagatgaacacacgtacagatcggtgatcgaacaaaatcgctggaagagagtaagtccgagccagacaaattaagtagctagcaacgtaacatgcttacatgcatgatttgggctccatgatttaatgtgctaagcatgcttgtttctttagccatatcggtttagttaattaatgctagcaggtctccgatcgtgttatcattccacactgtttattcgaaccattacgttctctgtcagtatttcagcatatcccatatgcaagtgttctgcagtctacgaacatatacaaaggaattttgctcaattaccactataaacatgtaggcaagatttgcggcatgacatctaaagtttataatttttcccgtaggacatatgttgcgtaccctgaaaaattgaaaattagctgtgcgacaatgtaaccattattttttttattttcgatataattgaagaaaaacatttagaaaattaaagacaatttgttcctagggtcagatgcttgtaaagccgatcagggctgcgttcatttccatgagttcccaactccctcctcttgttttccgcgcgcacatttttcaaactactcaacggtgtgttttttgtaaaaagtttttatacgaaagttgcttaaaaagatcatattgatctatttttgaacaaaaattagctaatacttaattaatcacgttctaatgtaccgctccgttaacgttttcgtgcgcagcagctgtgttgggaacacagagtaaggccactctcccagccacgatcccctaaccctagaatctggggacggtaatagcttataatctagttcttgtagttggcttagaagcaattaacttcagacataaaattgtttttttttttgtgcaaagactgggttatgacacattgttctgtgggttgctctatttgaagtggacctagttagacacatcttgtcatttgggtcattcatcttttctaaccctttttaga

SEQ ID NO: 2387 - DNA, 1501 bp, Oryza sativa
gttacatgaacttagcagaaatgttgaaacctggatgtcccttttctattcaaactatcatagttacattaggaatatcatatttgagaaaagaattgtcaccacttaccaaagatgaccttacatatttggagcctgcaaaaaatgctcataaagtaacttgcctcccacatcgtactaatttaacctcccacaacctcgcgatacatattttcttgagaacaccccatgatgcataatcagattaaaggtccatcccaactttccacgatcatcattacactgacctttcatctaaaacaaatatcgtcgcattctcttgccgaatcaaaacaaaacagcatggctaaggagggaaagtattccatatacatttcttttacttacaagcaatgcgtgttgtaataaaactgttcaacgcattagcaccagtcacaacattgatttttttctagtaaatttcacacaacaattgaccattatcgatagtaaaatgctcaatctcgcaacagaccacgacatagggtcgtacattcatcgctattccccggatagactgatctcctacgaatcgctcaacaatgcagcgctgctcaatgcggaaaaaaaagaaaagagaaaaaaacatttgacctgaacggcgcggaagccggagaacctgaacttgacccgctcgcggagccgatccgatgagccgcgacgatcgagctccgtcgacatctcgccctccctctctcaattccccaaacctattcgcgcccaaacggacaccgaatcaccccccgtccccaaagcggggccgcccggatcgccctcctccgcgcgcgcggcggcgcggtgcggtgcggatcatcgattcatggccgccaagctgcgaatgcggagacgaggcggagccgaggattgaattggggcgccgaggcgaggaaatcgtaggaggcggtgaggatgttggcatctttttttagcaaatgagccgcgaactcctcgttttcgcttccccatttttgggcagtattttcccccctctctctctcctccaatattaacatttgttttttttattttgattttttttggtagttagttttgtttgtgtttgttcacttcggcgatattgccttatccagtttatttggcatgtactactaccactgcatttgccactcctctgcttttcaaattgcaatgagaaactttaggaaaggacttggattccattacctgaactatgaagtgctactcttaatttgatctttggctctttacacatatcgcgcagtgatcgaatattcggatcctttgctcatcgacaacgtctcagtgcatttgcaagtttgcaactttctacccaacgctaggtgacacgcgttacagcttttgttacgagtactttttacaggtcctactacttagccaaaagaaaatgagcaaaggttataatcactcccgttgactctaaacacaattcgttttacatttgtgtgcataattctctcct

SEQ ID NO: 2388 - DNA, 1501 bp, Oryza sativa
cgagtcagcacttcagaccgccaagtcgacaacaattaaataggctaccccaaatattgtgctggcgtgattatgatgaataagagcaacgaccggcctcggccaacaggagtagggttattacctgacaattcaggggtccgaacctatataaaaatcctcatccccatattttttattacaatctcgcatatatcctagtaccaacgatccccatactatgcaaataccggaatcgcgacatcaaacgtcgacagtggcgcgccaggtagaaaaataacaacacttataacaccaaattagtctcattacatctaacattgaacatattttgacagttttcttattatgtgataaaaatattactatgtttttctataaatttagtcaaacctaatgaaatttgaacaatattgtagattgtttgaagtagggagcagatcatagcggctaggctaaaaaatgcctttctttcaacaaactagatccactaacgtcaagtaggtgtagaaaaaaaaaggccatatcacgaataatgcctgatgcatgttatttaaaacgggaatgctagaggacgggatatcatcccccaacggaatagctcttctccagaacgcgattcttatccatacactcactcgccgccgtcgccgtcccccgccgctgccgcgcccgtcccctgtcgccttcgcagccgctgccaccgccaccgccgctgtgcccgtcccccgtcgacgccgccaccgccgccgcgcccatcccccaccgccgcggcgtccgtcccccatcgacgccgccgctgccgccgtgcccatcccctatcgccgccgcacccgtcccccgctaccgccgccgtcgccgcgcccgtcctctgccgccgttgtcgccatcctcgtttgcagggggcgaccgcgcgtgtcggggtgctcctcccccaacgggatgcccagctatatccagtaggaatcacctgatacctggtaggtatcatccgttaccttgcaagtatcatgtgatacatggtagaaatcatctgatacctcgcgagtatcacgcgatacgtggtagaaatcgtctgataaatgacaggtatacctcgtgagtatcacgtgatacgtggttgaaatcatctgatacctaacaggtttcacatgatatcgagatcatcttgttgtgtagaatcgtctgatacctgataggtatcacacctgatacctactcgagatcaacccgttcgaaaacgggattccgttatatagcagccccctatttaaaaaggagagaattatgcacacaaatgtaaaacgaattgtgtttagagtcaacgggagtgattataacctttgctcattttcttttggctaagtagtaggacctgtaaaaagtactcgtaacaaaagctgtaacgcgtgtcacctagcgttgggtagaaagttgcaaacttgcaaatgcactgagacgttgtcgatgagcaaaggatccgaatattcgatcactgcgc

SEQ ID NO: 2389 - DNA, 1501 bp, Oryza sativa
ccagtagaaggatctcatcggccgtaacgatcgccctgatgaattctaggttgatcaccatcgccttctctctagctgcacaattaaacattgtgtattgtcacaacaaaagcgaccccctaagcagcaatcgatactaatgggggcgtggtcgagctcaccgaggatgctggaggagtcggagaagacggggccgaggatccggaggtcccgcggcggcaggccggcgcgtcggatgatggagcccttgtcgagatggagggtttcggagacgccccaccggtcgagccgcatccagaggcgcgccccggccttcttcttcccgaccttaccggcgccggcgggagatacggcgaggggaggggacggaggggcggggtgcgacgcggacggcggcggcggggacggcgacgccggggatggggagctcgacgcgcgcggcctggtgagcgaggggaggcggcgcgccgagcgggtccgcttggtggaggacgacgtggaggcgttcgaggcgaaaaagggcagcttcctccccccggatcgcctccccatggcggtggtggcggcggcgacggcgacggcgaggtcgtcgcgtgcgggggagaaaagcttcggagaccggagaggcgaaggcgttggcccgcgtgtaatgcgccgcttgatgggccgtactgggccagaagcgattgggtcgggcccggcccatttgggagcggggcgcgaagcccaacacgaaccgcgcgatttctcgcaggctctgcctcctccactctcagacgcaggatggtgatcggacggctgagattgcgtggtggtggcgggaaaacgccgacgaagcggagaccacacagaggaggatagctcccctcgtcgtcgtcctcaccgccggcgccggcgacgatggccatggccgcagccacccccgtactcctcctcctccgccgttccgccaccatcttactccctcgatctcgatctccgcgcgcctccgcttgcgtcttggcgccgcagcggaggagggggagaaggtggcggctgctccgatcgtcgccgcctcccgaaggtgcggatgcatccacggttagctgattggtttggttgcgttgatctgatggacgtccgccgcaggggtccccggcgaactcatggaggaggaggaggactccaagttcgtgccgctgaacgccgaggatcccatgtacggaccgccggtgagttgctagctgcggctcctcttccttgctatttgctgcttctgtgctgatctccatctgaattggttgtgttcgtcaggcgctgttgctcatcggattcgaggaaggcgaaaccaacaaggtaaatacgcagtcaatgaactgttcacgcagaacagaacggtcctgtttgtctgaaattaccagacatatggtgcattgatttgtatgtttggtgtgtgtgcttcttgttgttctgaatgttcgataagcttacctgaaatgcataattcgtgcaggttcaggag

SEQ ID NO: 2390 - DNA, 1501 bp, Oryza sativa
taatattcacgcgtattttacagcagtactgctaaactgcaacgtaacgcagttcagaaacaagaaagaactccactgtgagcagtgactactccccagcaatgacacgttctcccagagagccaattaaaataccctttgctactaattgagcactaattaatcattaggtggcctaatcaacagctggaggaggacaccccctcgagctcgtgatatccgaggccactcacttcacttcctacacaatcttgcactttagtccttcgtgtcaggacgatatttcatctccgtatctggctagtatagctagtaaacgcgcaaagagatttcagaatatttcgccagccgccagcagcaagctcagctcaggaagaggagaggcgaaaccaagaagagtgtgctggcgactgcccccaatgcctcttgcatcctcactccactcgctcaagagggagagtgagtgagagaggagctcgaggaatcttagctcttcttcagcgttgatctggttttcgccttgcaaaggtaatgggcgtttcttgattcattcttcagaaggtttttcagttcatgggagatgttgttcttggctggctgtgttcttgaggtggttggttggggatttgggttggggtgattgagattggattggttttgcgggtggagtctggagagggacaactcttctttggaggaagctgtttatgtgtttcctcaagagctcccagtgggacttgtattggctggatttgctgcagatgcgagagtgctgtggagtttttggacaggaagagttttggctgtttggtggagggatttgactggcattcatgtggacatgttcatctttctctcagattttgtttaacagattcgaggtttccttggatgcaagaaatgcattgcactgtatttatatgagaaaagaaacagtttgcgcttaaaaaaggaaaaaaaaaagaacagtttttttaatccttcctgataatatagggtggatattcagtagattaagtagatcttttttttagttaggcatattgtgttcttcctcttaaacttgtcttgcctactaggctactaatatggagtttatagtagttgccttttatggttctaagattagggatgacgccactgcgcccaccttttcctttactgatgagggcatcatttcaacatttcttctattgtctatctcgttttgcatcccagcatccagtttgttaccccaatttctcttggttagttattttagtatcattccctgctcaaactgcttgtatgcttgtgtatgactgtagatttctacctttataagatacagaagggtgggtggatcttaagattgatccacctttttcattgcagtgtactagtagaaattatttgcttggtggcaaaacaaaagaaggcggtaatcctttcctgcagcaaaaaaaaaaaatgattctttgaatagtgctacggacctaaacatctaataatgtataatggt

SEQ ID NO: 2391 - DNA, 1501 bp, Oryza sativa
ttacttaaattttttgaataagacgaatggtcaaacacgtactgaaaagtcaacggtgtcaaacattttaaaacagagagagtatatgcccgacacgtcgctctctaggaaagaggttgacgggtaggttgttgaggaaaagcaagtgcattgtagtatttttatagcattgaattgaaatgagaaatgatacggaataatggtggagtcatcgatatataattttacctaccggatttaaatcctcgcgtgtatgaaaattaagctacgagtatacgtaaatgaactttcaataaaataataataaatttatataagcattgttggttttcattttgtttagtgtgtgtttattttgacgggcgtgcaagtgtgatgttacgtgtagtggtattgtacgtatatttctgctgggtaatcgggaaaacaaaatataacgtgacaaaatgcacattgatggcaacattttgaatttgttcttttccctagccgtagtgctcttatgacatcgacatctatggctgctggtggttggactcttgggaacgtggatgcataggtggcatatgtgtagttgcatttcgcacgtaagaaatttgcattggctataaatacggatgaccaaacaatgcatgcatcgacgattcgacgtacgtacgtacgtgtgctgctttaaaagcacgaacatatttgtatgggcgatcgaacaaattaaatcctatatactcacattgttgtcccctgatcacttattgctactatagctcttttattctctgataaaactattgccatctcaatagtttccagtattttaatagctgttctaagatgtaaattatatataaaaaaacccccataataaatgaaatccatcttgtctatgacctgtagcactggatatctttttctctctatcatgaatgcactggctaggcacgcatttgtgctgaaatttggaggagtatccaacgcttcagctgtaaaaatatgatttggtggtttgattaatttgatctgccaccaacttgtaacacaaattgcagctaatttgtttcttaatctccagatcgaacatctgattactccacagcattgaacaaacaatcgaattttcgagtatttgtagtttttggagtggattcatggccacagaaagtcaaagagcaacagatgctctctccaatctccatctccaattctccataccatatatgcatgcgagatccagccacacagcattagcaaaaacaacaaaggagcagcgggccccactcactgccaggtggagcccaccgcacaccgcgccttacgtgggccccacatgtcagtgagacaaacatgccatcataaaaagcagaggacagcactgtccagctgtggacgacgacgcgaggccactcgaagcggcattttgcacctaaccccctagagttatcgggaatcgcaaagagggggccatctcgagtggctcgccggcggcggcggaggcggggagaga

SEQ ID NO: 2392 - DNA, 1454 bp, Oryza sativa
ccacctactcactgtcatgtgggcccatgacgatcctactttcaaaatttaagcaacttcttcagagttggtcaatacccaatatacttctccatgactcccaaattgtacaaggttctccagtgtagcaagtgaccattccctctacaatgaatgaggtctctaaaaaagtgaagagttttctccttttagataaaatgaagttccccattatgatgtctatacttactatgcctagactcgaattaaaacagtcgggtatatgtatcaactatcaattctaacatgtcctgttgaaactcctatagtttattattatttcttcaaaatccattacaacgcatgggcactctgctagtaaaagtaaaagagtacatggagtacgatggacctcattccctttattggacgatcacttggtttaagtgtgcaaaatgttcaacaaggcataagctaatgttgtttcgtgattttcggaaaaccctctcatgattacattagtttgtcatgattcatgacctgaagagtgcaatttaataaacgaatttcagattcctgtcaatctgcaatgtatctgagcttttgtatcctccacttctttgttttcttccctgcagatttcctaatgatttgtgcaacaattgtaagcgtccaggacattttgctagagattgtccaaatgtggctctttgccatgcatgtgggcttccagggtaaggactatttgttattctgttttgcagatatttcatgttcttatagcctttaaagaagtcttccattattcagtatctatttgtggtgtacttgtgtttattttctcttatattgttttgccatgcttttaaaattctgtattctcaatagcactgcttgtttatgtcattgtgtatttagaaccatatccatctagattacaaatgtgcagtgaatgagacgtgatctcaataattgtgacagttcaaccgtaatgaagttgatgttaggtgaacatgatagatggctacattgatttgctaatatttaacagttttgaggtaccccatgctcctttcgtgatggatgagacttagtgttggcatcaccaattatttgagatttgttcccaaaacacgaaacatggttcattgtcttttaacagttcaatttatagtatgcatctaatatttttttattagcttattcatatttatgacaaatcagcaaaaggtagctaaagaaactgaaatgttgaagcttaagccatgcataaagttgccagaagatggttagtaacagttaagcaataacttgtggaattaaataattgtaatttaagtcacagattatagtttcatgtgatcaagaatgcttacatgcttcaccttcttatctgtgagctagcattacttactctaatgcttactttggcaggcacattgcagcagagtgttcttccaaagatctctgctgga

SEQ ID NO: 2393 - DNA, 1501 bp, Oryza sativa
gcgcgacggggagcggcgcgagcgtgaagacgacgaagaggaagaggatgttgtgccagaagaggacgtagtccgggatccccgccgagtacctgaaccacagcgactccgccgccgtcatcgccctccccagcgccgcctccgcctccgccgccgtcgcgtagggcagcatctctccccgcctccgccgccgccggcgagccactcgagatggccccctctttgcgattcccgataactctagggggttaggtgcaaaatgccgcttcgagtggcctcgcgtcgtcgtccacagctggacagtgctgtcctctgctttttatgatggcatgtttgtctcactgacatgtggggcccacgtaaggcgcggtgtgcggtgggctccacctggcagtgagtggggcccgctgctcctttgttgtttttgctaatgctgtgtggctggatctcgcatgcatatatggtatggagaattggagatggagattggagagagcatctgttgctctttgactttctgtggccatgaatccactccaaaaactacaaatactcgaaaattcgattgtttgttcaatgctgtggagtaatcagatgttcgatctggagattaagaaacaaattagctgcaatttgtgttacaagttggtggcagatcaaattaatcaaaccaccaaatcatatttttacagctgaagcgttggatactcctccaaatttcagcacaaatgcgtgcctagccagtgcattcatgatagagagaaaaagatatccagtgctacaggtcatagacaagatggatttcatttattatgggggtttttttatatataatttacatcttagaacagctattaaaatactggaaactattgagatggcaatagttttatcagagaataaaagagctatagtagcaataagtgatcaggggacaacaatgtgagtatataggatttaatttgttcgatcgcccatacaaatatgttcgtgcttttaaagcagcacacgtacgtacgtacgtcgaatcgtcgatgcatgcattgtttggtcatccgtatttatagccaatgcaaatttcttacgtgcgaaatgcaactacacatatgccacctatgcatccacgttcccaagagtccaaccaccagcagccatagatgtcgatgtcataagagcactacggctagggaaaagaacaaattcaaaatgttgccatcaatgtgcattttgtcacgttatattttgttttcccgattacccagcagaaatatacgtacaataccactacacgtaacatcacacttgcacgcccgtcaaaataaacacacactaaacaaaatgaaaaccaacaatgcttatataaatttattattattttattgaaagttcatttacgtatactcgtagcttaattttcatacacgcgaggatttaaatccggtaggtaaaattatatatcgatgactccaccattattccgtatcatttctcatttcaattc

SEQ ID NO: 2394 - DNA, 1501 bp, Oryza sativa
cttagacgcaggactagctaacatatttctaattgtcttactcctatctccaccccttattgtttcgtttaattttttcgcgacttatcaaccataggcaatcgatgataattatagatgatgtgcgctgcagggagcatggtgggcatcacctgcctagacaaggagacgggaaggacggtgtaccacgggacagacaagacggatgacaagggtatgttcaatattgaggtgccatacactgtcggcagcgcccacctccacccatcagcatgcctcgtccgcctcgcctcctccggggaccacggttgcgccgtcttcaccaacttcaatggcggtaagactggcgagcggccgtgccgcccctcccatgtctaccccggaagggtcacctactccgccggccccttctacttcaccctgtcccagtgtgacgttaaggacggtgccacctactgatcgaccgtcttttgatcttttcagtagcaggcctataaattaagttttttccgttatatgatatccaatggttttgagaacgcgcagaaataattccgttggttgttagtgtgttgtttggcctttgtaaacggcgatggactgatggtgtgtctgtgatatgcaatagtacttttgagctaatattgtcggattgtgagtttctgattatactttgttttattccaacctaaagctctatgaatctcgagtgtaaatggcaataccgattatggcatttgcaagatgtcaatacaaaatagtactaaccaaagaagtactccctccgtttcacaatatatctagatttattaacattaatatgaatgtggaaaatgctaaaatgacttacattgtgaaacggaggaagtacctggtaatacaaagcataacacatatcacgtatgcaaaaaaacaattacacatgccaccatcatgcgcaatattatccaatcattttgtactataagttcatatacagtccttccatttgtccaaaaaataaaacaaatactaatattattttgcacttgtacgtttttagttcaaaggaaaagttcttttagccacattagtgttagattcaaaatgtttagatttcttcgaaagcctctgattggttaaaaattatagatttttgtgtactagtacaaaattttcatccaccctccgctcataatacaataatctaatactggataagacatttcatagtataacgaatcttgactaacattctatctagatttattgtactttatatctaatactccattcgtcccataaaaatcaacgtagtatcagatgtgacacattctagtattgcgaatttagatatacgtatgatttatcgtattagaatatattatatccggttctagattcgtttttttataggacggaggtagtatgttttcaggagattaagtttcaaccacatcgacatgcacaaccaacccatcaaatcactgtataacactgtttgacattatttcagtcggca

SEQ ID NO: 2395 - DNA, 1501 bp, Oryza sativa
caatcagtttcgctacagcacttgctgctctagctaattgcccaccctttccacatgtgatttctatgttatgtatggccgtgcctaagggcatatcggttgaagtagattcttcttttctctcaaaaaaccccttcccaaactgtacaagcttcttccaaagcatacgactttctatatgtatatgaagatctctagacagatggatcttatatgaatcgtatgatgaagtaccacatgattggatatataggaaaggaatccaaatctgccgaattgctcatgttatgatcttctacatcctaggtctccgcgttccgtcatctggcttatgttcttcatgtagcattcagatcgaatgactctatgaaattacgttgatacttctacatataatgggtaacgtaggagacatccctattttcctccgggggtcttaattaccactgcttagctttcaattcgcctctgaccatcaaattaaatatgaataacccgtcctcctctctttgaaacaaggggtgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattagaacgggaggagaggaggtgagtaggggtagttcaatggcatttttatgtaaatacactaaagaattaaagggtagtgggtcttttggggtggagtggagctgtggagcagcaaaaacccagctccacccccgtagtacaattttatggagcagctctcccaactccgctcccaaaaacggaggatctagactgtttggcacaactctagctctaagtaagttggagttgggagctggagctgtgccaaacggggccttaatgttctatgaataatgacaaaatggttgtaaacttgtagcgattgtttgagttggtgctttcatgctgaaggaaaacatgccatcaccgacatgctattcaattcatcatgatcaaatgactattacctgttccctgatgggttttgcggaatccctgaaactgctagatgacttattgtagctacatgagcaaaacacaaaatgcaaatcaataaacctgactgcatgagaaacagagtttgttttctgcttttctccgtcatttcattttgtctatgagcatcttgtagcctcaagctctattttctcctgacgggcatcttgtcaccctggggcctgggcggccgtgtgtggcctccacgacggaccaagtaactcgtcgtgccatcaaaccaggctacctagctagcttaccgacacagggggggagactagagagagacgcatggcgcgcacgtcttccgcccatggccatcgtcgtcaacaactcagaaaacaaaaaacaaaacaaaaaaaaacatttgcgcaagtcgggttcacgtcgtgcaccacgattt

SEQ ID NO: 2396 - DNA, 1501 bp, Oryza sativa
ccacaggctgaattccagctccatgagcccaaacaacagcaaccatcctttcctaagcacaggcccgaattccaacagtagggcaaacgactctccgaatgccccaccttcctccatccttgattactacaaacaaggaccatcgagccatttgctcaattgctcatacacaagatttccctcctagtccccccaacacaaccgcccaatctacaacaaatcatcatatctttaccataggattcaagttcaacaaccatactacctatgctcccatattcctactgcttcgactattccacaacctatgctcccatcctactgcttcgactactccacaacctacgctcccatcctacaaacatgcacgcgcgctgaaccacgagtccacgaccaatttgcgagagcagcgaacgaaaccctacctgacgagcgagcgaccaaaccagtaacagcgagcggatttacagatactaccgagcaaatcgatcgatcccacactaaccgcacgaaacctcgtcgatagatttgatttcggctcgcacatcagcggcagattagggacagacgaaaaccaaccccaggtccagggcttaccacgggggtcggggggcggatctccagcaggcgcgaggcggacgaggagacgagctagctagccgcggagcggcgagggctgctgctcccgtggcgctcgccggcgcagcgcggcgacggcgaggggggtcgccgagtggattgggataggaagaggaggagaagcgtggcgtgcgaggtgccgaggtctcgaggaggaggaagaagaggacgcgtcagatccagagctccaccgaagcgagagcacgtgcgttttatggctgtccgatctcgaatggacggtggagattactcgtaggtgttggggattgccggatttggatttgggccgtgagaagaaaggtcggcgttgctgcagccgacacgagccatacatcccacggcccaacaaggaccaagcccaatacgccaaaattggtatctaagtactccctccagtccaaagtgatgaggttatcctgatcctccatatcatctggtatccacggtattaaatatatttttacataagaaaaaaaattgatgtggcaagagagttaacaagacaaagtaaacagatgaataaaccagttctcatgcaagaaaccatctctaagtaaaaaccaaaaatgaatgagatatatagataaaaggagatagaaaaaatgttattggatgattatttaatttgaagagatcatcttttagatatatatagtttctatacatataaaaactaattgatggtttctgggttgcatgtaacatatttattagggtgatacaaactagtgatctttgagttaagagttgtcgtggcttaggccatccctaactctgaaactatcaaataattattatacttgtcatgtcatataaactatatagaatatatattcaatagatggtgtttttaaattaaatt

SEQ ID NO: 2397 - DNA, 1501 bp, Oryza sativa
atttgcattttgtgttttgctcatgtagctacaataagtcatctagcagtttcagggattccgcaaaacccatcagggaacaggtaatagtcatttgatcatgatgaattgaatagcatgtcggtgatggcatgttttccttcagcatgaaagcaccaactcaaacaatcgctacaagtttacaaccattttgtcattattcatagaacattaaggccccgtttggcacagctccagctcccaactccaacttacttagagctagagttgtgccaaacagtctagatcctccgtttttgggagcggagttgggagagctgctccataaaattgtactacgggggtggagctgggtttttgctgctccacagctccactccaccccaaaagacccactaccctttaattctttagtgtatttacataaaaatgccattgaactacccctactcacctcctctcctcccgttctaatttgactacctctacgggatagacctcaacagaaaactgttgagtaacggcagcaagtgattgagttcagtagttcctcatagaaaattattgactctagagatatggtaatatggagaagacaaaattgtttgaagcacgcacagaaccggaagcaccccttgtttcaaagagaggaggacgggttattcatatttaatttgatggtcagaggcgaattgaaagctaagcagtggtaattaagacccccggaggaaaatagggatgtctcctacgttacccattatatgtagaagtatcaacgtaatttcatagagtcattcgatctgaatgctacatgaagaacataagccagatgacggaacgcggagacctaggatgtagaagatcataacatgagcaattcggcagatttggattcctttcctatatatccaatcatgtggtacttcatcatacgattcatataagatccatctgtctagagatcttcatatacatatagaaagtcgtatgctttggaagaagcttgtacagtttgggaaggggttttttgagagaaaagaagaatctacttcaaccgatatgcccttaggcacggccatacataacatagaaatcacatgtggaaagggtgggcaattagctagagcagcaagtgctgtagcgaaactgattgcaaaataaggtaaatcggccactttaagattaccatctggggaggtccgtttggtatcccaaaactgcttagcaacagtcggacaagtgggtaatgttggggtgaaccaaaaaagtttgggtagagctgggtctaagtgttggctaggtaaacaccccgtagtaagaggggtagttatgaaccctgtggaccacccccatgggggcggtgaaggggaagcccccattggtagaaaaaaatccacaaccccttgggttatcctgcgcttggaagaagaactaggaaaaggaaaaaatatagtgatagttttattcttcgtcgccgtaagtaaatacgtaactaggaata

SEQ ID NO: 2398 - DNA, 1501 bp, Oryza sativa
cgaacagagaggaggcgcttacctccaagcgaggaggtggcgacgtcgccggtgtgggatcagccgtgcagtacagctccctcagggtgtcgatgagggggcggaacccgtcgcggagaggcacgacggagacggcgcggaaccgctcggcggctcccttcgcgaacgcgcgcatcgccacgcggcacacctccccctccagggcctcctccgcggcgcgcgcggcccccgcgtgcgccgcgaagaagcgcgcgagctcgtcggcggggcagccgaccagcacgcgcgccgcgcggtcgaatagcacgacgggcacgacgcggtcgtgggtggccacggaggcgcgcaggcggtagacgcgcgcgggcaccgggcctccgccgccgccgcggccggtgcaggcggcgcatgcgtcggcgtggtccgggagcgcccgctcgcagcgcgggcaggagaggtagcagaagtcggacatgtcggccgccacgacggtgcagtacggcggcgtccacgtcgccgccggcgccgccgcctcgccgttgctgcagccgacgagagccatgacctcccacggcccaataaggcccaaggccaatacgccaagctacaacggagtactacgttaggccatcccaacctttcagttagtgtcttgacaagagaatttagcgaggagaggcgtaaaaaagatgaataaccatttctcatgcaagaaattatctctacacaagaaccaagaataaaataagaagatagttgaatgaaagaagatagtagtagaagagagatgattagataggaatttaatttaaaaacaccatctattgaatatatattctatatagtttatatgacatgacaagtataataattatttgatagtttcagagttagggatggcctaagccacgacaactcttaactcaaagatcactagtttgtatcaccctaataaatatgttacatgcaacccagaaaccatcaattagtttttatatgtatagaaactatatatatctaaaagatgatctcttcaaattaaataatcatccaataacattttttctatctccttttatctatatatctcattcatttttggtttttacttagagatggtttcttgcatgagaactggtttattcatctgtttactttgtcttgttaactctcttgccacatcaattttttttcttatgtaaaaatatatttaataccgtggataccagatgatatggaggatcaggataacctcatcactttggactggagggagtacttagataccaattttggcgtattgggcttggtccttgttgggccgtgggatgtatggctcgtgtcggctgcagcaacgccgacctttcttctcacggcccaaatccaaatccggcaatccccaacacctacgagtaatctccaccgtccattcgagatcggacagccataaaacgcacgtgctctcgcttcggtggagctctggatctgacgcgtcctcttc

SEQ ID NO: 2399 - DNA, 1501 bp, Oryza sativa
tcaggcataccctctacccttcgatatacgttacatatcgacatggcatacccacgcgcacgcggatgttttctacatatcctaaggaaacctttcacgaaatctactgatgggaagagtccttctcggacagaactaggtcgtcgacgtatcgtattgggtctgatatctccgagtcctacttggagacctccagatctgtgatataaaagggacccccccggggagggcatagatcatcgaatctcagagccaacacaacgcacacagcctacaaagccgaagtctgcgaggagccaagtcatcgagagctagtcgaatccactcgactacgatctcgccggatccgacaagttccatcgttccctttgtaacctgtgttttccaccatataatcccatatcaactggattagggctattacctaccaaggggcctgaaccagtataattcttgtattttgattgttcgatgtcgtactacgtagatccttgtaccaacgtaccccaataccctttatatccggtctacgggtatcacccgtcgacagtggcgcgccaggtagggggatttggtactcaaggttctactactatgtcatccagcttcgtcgacaacaacgtcaacaccagcctcagccaagcgctccctgcttcaacaatgctggtatggactcaagtcggcgaaatcgtcttcccgttttacaccacgacgctgatctcaaccggtcctccaatgaccggaaacgagaacgcagtggctacaaaccaaggcgacttcatgtcgaaaaatccacctgtcgaaacggagaacggatcatcgacgacatccaagctcgggaaggattctgatacggccaaaccttgcccttctgacatgaaccacgagccggcaaagatgacttccgaagccacaaggtcttggtgtcctatccacaaaaccaagaaacacaccctgcaagattgctgggttttcctcaacgtccatgctgaaattcgcgcatgcaaagaacgtggaattcagcgtacttctccaactcgggatgtctattgtcctattcacaagacaaagaatcacaacctctcgagctacaaagtcttcctcggcgccatgaaagctccgtctcctgagtcatacgtccccgtcagggataacggcaaggaacaaggagcgactccagcctcagatcgattcgttgaggtaatcgatatcgatcctcatgaaccaccggtcttacatcttctcgaagactatgggtcatcgacaatgagcgtgccgcaggaggtattggctatcgatgacgttggcacgtcaacgcaagccaacgcagaagcggcgaatcaatcgactactccagcccaacacatcagggccgttcaagccttactaagggaaactccttacgatcccgttctgaatgatgacctcgagcgttgacagaacgactacgggaatcggtgaccaaccttagcaacgcgtttgaagaagtcgctaccgcagc

SEQ ID NO: 2400 - DNA, 1501 bp, Oryza sativa
taaaagttcttatattccttcttgaccagattcatagtactaaaatgcatcacatctatccaaaatcctttatattttggaatagagggagtatatatttttgtgacttcaacagatatgtcgctgaaattgaccatatgacaacgccaagagtgaggtgacgtgtcaataacaaaagaaccactagcacatctctatcctaaattgtaggcatttttaagatgggcatgtgtatcaagaaagttgatagaaatgattaaaggaaggttgtgattggttaagaatagaaagttgatgaaataaataaatgaaaaatggttgtgattggttgaaggaggtagatgaaaaaaaatagtttcattttaggacaagctactgtgctataaatagctacattttggaatagaggaagcagtacttagaaatcctaaaacaaaaaaaaaacagagagagaaataaatcatatccaagaaaaaaacaaaaaagaattgccatccgacgtggcgaaagcgagctagccaaagccaaagctaagttagcctattcttcaagccaccacttcttttttcccctttcgataccagcggcacggcggcaaccacgaacaacagagagtgcgaaggtgcgcgggccccacctgccagaaaacggtgtgaataaaataaaagaactcttatggagtaattttagatgaatcattactcctctcactagaaaagcattatcatggtaatgcccgaaatggcatgataatttcttgtcagaattcatgagagatttattgtcatactattatctaggtgtagtttcccaataaaatgataaatgcctttaggatcaatcgcattacctcttcaatgcttgcattcctcaacatctgcatatagttgtagtgcaaaacgtgagtccccttgcacagaagtttgctcaacattacacaagattccagcatagtattctcaccgtgagatcgtcagaccccaatttgaagctcatgcttcctaaagatgtgtggagattatggatatcccatatctacacggcgatggtatttggactgaatacaggataccaaatatagatagaatatcttatttgtgtctcgggtttgtttctcaacttgtacatcaaggaaataccttgagacttagtcggctacgactgtattttatctgtatctgcatattctgttagggatatagattatcttttgtaacacggacttcttcccatatataaggggggtccgggtgcctctagcggcagatgttgattttctccaaatcatataatcaataagacattcggcggattcatccccggacaggagtagggtattacttcttcaataagaaggcctgaacctgtataaatcctttgtctccaaacccatacacttttccagcttgatagccacccccttttattattgccgaaatctagtttcgacagttggcacgccaggtaggggctgcgtcaagcttttcgccgatcagtgcaa

SEQ ID NO: 2401 - DNA, 1501 bp, Oryza sativa
atatatattaataacatgattatatatgtttatagcatagccaatcagatagatctggcatgtatcggctaatactccgatgctactctatatcaggatattaaaacaggaataatgtatcaaacaaaggcttaatatacttagatacagcaatatcttgacataaagggcggatttaacatgtcaatgaagcatatggagcaaatatagttaaatcagataagatcggctgaaactccgatgctaccttaatcggcaaccaaaaggcaggctagagattaatattctaagcacgacttaatagatcaaactaaacttatgcagcattaagtatgaaaagaagaacaatatctagacaatcaagccactagaagtttcatagagtggtagatatcttatataatctaaactaacgtcgaaatctaacctaatcggctgccctctactaacaaatgttagccgattgtaggttagataacaatattgccagagattatgtaagatatgtgataactcaacgaattacataaacaagattagagtgtcataaagatggaagccctaatcccgagaatacaagccgtcataataagttttacctcttgttgaagattgaaaccgatgcagctcaacccgaaagtaagaactcgtcgaaacaaaactaaagcaaaaagagtggcgatgtgccgaaattgtattgaacgtgtgtgttaaaagttacatagggctcgggtctatttatacccgagaattacaatatatgtccataacggacacgactaatatctctaacaaactctaagataccataagtctttacggtagacttttgcccaagcgtatctctaaagaaattacataaaacatcctaattaatagatacaattgccttctcaggactctatccatgtgcggcaatcaccttgaagtgcctcaactcaacccgatatcatacatcaagtcgcattgccggaatcggctgcatcagcttacctagtccgactcagacccagccgatcctaatcgtagctgatctggactctagccgattcctgctctgtttccgaacccgatctccgcctccgactttgcttcgatctaatcttctttcccgatgccgatattaccaaatttggttgttaacacatatatgggtggtttcgctgatgtggcatcctagtcagcaaagaaaaatttaaaaaatatgtggggcccacatgtcagccgtcctctcctcttttcttctcctcttcttttcttctcacttctctctgctcttcttcggtgagggaggccggcggtgggcagcgtgcgtggcggccggggcggagcgggcgcgacgtgtcacgcccagaaattctcgagccagaatttctaagctgaatgtgcattaaatccctgtccaggaccagccagggtacacaaacgacaattgttgacatacagatccacgccttacaaaaatagaaaagattacaaatgcagcggaaaagataaaagc

SEQ ID NO: 2402 - DNA, 1501 bp, Oryza sativa
atcagcatgcacagacctagatcagtcccggctccctggtattggatccgaccgatcgagtgatgtgctctcatccatccatagccatattatccctgcaattgtttattttcattgccaaatgaaccttaagtgataaaacttttttttgtttgtgtcaatcgcattgtttattggttaattctctgaaagtgataaaagggcattttatttgtgtaacctaatgaaatactagtttttgacatgcatattgtgtttctcgtgactgcaagaatatgaacatgtcactagtttaaggtgtgtttgaaagatagagaataaaaaagaataaaaggatatgcaaaacaaggtgtgtcattagcgtatgattaatcgagtattaatcattttaaacctaaaaatatattaattttatttttaaaataacttttctataattatttaaaaaacgcacacaccgcttagtagtttagaaagcgtgcgcacgataaaggaggatatttttttccgaatatgcttgaaacaaccaaggattgttgacatgtgtcgacgggtgatacccgtagaccggatataaagggtattggggtacgttggtacaaggatctacgtagtacgacatcgaacaatcaaaagacaagaattatactggttcaggccccttggtaggtaatagccataatccagttgatatgtgattatatggtggaaaacacaggttacaaagggaacgatggaacttgttggattcggcgagatcatagtcgagtggattcgactagctctcgatgacttggctcctcgcagacttcggctttgtaggctgtgtgggttgtgttggctctgagattcgatgatctatgccctccctaggggggtcccttttatatcatagatctggaggtctccaagtaggactcggagatatcagacccaatacgatacgtcgacgacccagttctgtccgagaaggactcttcccatctgtagatttcgtgaaaggtttccttaggatatgtagaaaacatccgcgtgtgtgtgggtatgccatgtcgatatgtaacgtatattgaagggtagagggtatgcctgacccgtaaccctgacagtagcccccgacttctgcttaaaatgaactcgtgcaaccatttatgacttcgggtgtcgagaacgttgtcattcttggcgcgaggaccgcggagatagaacgtagtcgagcatgccgtttgaagcccaacggtcacgagtgaattttgaactgaagtccagaaaactaccgcgcgtaacgggcccagagatttccggcggggatctctctccgttccttggaattcgcaccgttggtagtgtgcttatttaaaggaattttgggagctcattttgaagtctgccaaccttgttgaacacacaccacctgccagcgctccttgccttctccgccgccgcaagaaaccctagttcgccaactcaggcttgttttccggcgatcttggaacaacaa

SEQ ID NO: 2403 - DNA, 1501 bp, Oryza sativa
tcgccgcgcgcccttgctctgtcccgggcgtcgctcgccgtcgccggcctctctcggcgtcgcccgtgccctctcgaccggtggaatgagctcgcgacctcgcgtagatgctccagctccaacgaatcgaacccccgttgccccagtgaagttttccctctttgctcgccgtcgacgatcgccgtcgaaatccgccgtcgtcagctcctctcgcgtcgattcctctcgccgccacgctcccggggatccccttgacctccccctggctgccccaaggccgtcggccttctcctttgtctccgcgccgtgtcgccgcttccgccgccgcctaacgctgccgtgcgtgcgccgccggtgaccatcgggtcccgcgtccccgcgtgcgcatcgcggtcgcgtaccggttcggctaagcccgagcccgcgcgcccttcgctcttctcgcgcgcggccacgtcggcgtgccggcgagattggtcgccgccgccagccgccgtcgtttttcccccggctaatccgctccgttgaatcgattccccttggcctcctctctcttccggtgctaacccccccaatccacctcgccgccgttcgccggttcacgtcgctcgtcgccggccatcggatcagcctgcccggcctcctctcccttccccatccgacgtggcatccacgtggatgccacctcagccgcccggccccgcggagaccggtcaaaggtctcccggtccaccgatccaacgcgccgccttgcgtgcaccccgctcgcgtgagccgtgtcgccgccttgtgggtcccaccttgcgcccggcacggtggaccgcgtccaccggcttgcgtcgcgtgggccgcgcctcgttcggccttgggccgcctcccttccgcgcgccggcccgctcgcctcggccgcgcccgcgcatctcttcgggccgcgccccttcgctcggcccaagtccaattaacatccctccatccttttctttttccagggatttaataaatcctttttcctttgtcccataaatcaattccttattccaaaattccataaaccgtttcctttggtcccgcatgacagtgactgtcaataatattcttgagaatattatttctataaattccataaaccatttctcctactccagaaactccaattaaacttccaaaattcatatcacccaatccgtaactccgattgactccgttccacttccagtaattccgtaaaattgagatcctatttaatggcactactaataggtctaaacaggatctttcttttggtcttttgtttaggttttcgattgtttgcgtatagttgcggttattggattttcgtcgatcgcgggttttctcgaagattcgtgaagcttcgtgaagaccttgagcaaggcaagtcaccctttgatcaattgctcctataattgaaaagtcattattattttgtttgcaacttgcattattagaatcacacacttaacttgcttggcctcggtttgcg

SEQ ID NO: 2404 - DNA, 1017 bp, Oryza sativa
ggtttggctgtggagtggagtcgcccgctgctgaagtcaagcttcccggtttagctcgcttttatcttttccgctgcatttgtaatcttttctatttttgtaaggcgtggatctgtatgtcaacaattgtcgtttgtgtaccctggctggtcctggacagggatttaatgcacattcagcttagaaattctggctcgagaatttctgggcgtgacaagttggtatcagagccgaccttgaccgtaggacaagccaactggaaaccctaagagccctctgaacccctttttcatctgcatatgcctttttgcacctggaattgtttcgggaaaatttggagttttgcctctttggtttgcgggaaaaatcttggtcgttctttcggatcggattttttttttaaaaaaaaaattagctcagtctagggctttagaaaaattttagttggagtttattcgacagtcagtcgggaatttattgggggttatgcattaggtcgtgtctatattcgatgggggcaatgttatgcgcatcattttccatgcaactagtctatgcattaatttattgtttagttgcattagtgtctttatttgagttcatgaaaaatgttctatgcataaaaatcatcctgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagttggcggtcgatattatgtgtcagtggtatgactgcctcaattaggagttgcgtgcctctttttcagtgttttaatcaagattaagataattgcacttaaattcataagcaagattagtttctgagccccctgtttttcttccttttctcatatttctacctatccccttcaga

SEQ ID NO: 2405 - DNA, 1501 bp, Oryza sativa
aaaaattaatgtaatgcaaattggtgttgtctcatatagcctcatgcaaattggagtagtttgctgactgccgagagttcaataattgcgtgcgtaaaggtgtccattctctcaatttactccaacatccccatgtatataactatatggaaggtggattttcattcctcggggatattgatttccttgttttatgcatgtcacacaaaaagacataaaaaaaatgaaaaaaatgataacatagatcaattaatgtgtgatatattactttacaaacatgtaaattcaaatttaacttatatagataaaaataaaaacaacaaatttgactataaatagtatgtactatttgcactaaaatttgttattttcatttctaattgtgtaggttgaatttgaatttgcatatttgaggaataacgtgtctcatattgatctatcatttttttatgaatatttaaatgacatgcaaaaatgaggaaaacccccttaagagatgaaaagagtttcccagttcttgtgtcagtgttcaatccaagtaatgctttatttttcttcccgaaaaagaaactaatataagaaccacgtcatttttcttcagccataaagaagtattactgtattagtaatagtgtaaaacctatactaagacaaaccgatggaatcagtcactgtctaatccttgtatgatcataccacagcaattgtcagcagcctgaatttttctaacagcagaaaccaatgcatgcatattgtcctgcaatacagacaacacaagaaaccaagtgccaatagaatccatggccagcagttgagcacttggaagttggaataacgagggtatactagaatatacgagtatcataagctacatgacatgtcatcaatggagatggctactttacttgtggtcagagaatatacagtccacacattaaccctagctagttaagctagatgatgacctagctaactgtctttttgaatcagcaatttggacggcttatatattcgccctctccttgacttaatttgctgcatcataagatgtgatgcgtatgtctgattatctgtctcgttcaagttggggtttaatttaattacttgcccggctttctgcaatcgaaaaggctatctaatgcaaccgttcatcgacaaaaccatttctggtaattcatgtccgtatgcggcagctggattatatgagcaattaatcaacgcaaaccctagataatagattctacgtatataaaatcatacagaaactgaactgattattcctattaaaatccctgcgttaatttaaatagacctgattaattagctattgtagtacatatatgcacatggtccagtgaaaattatccacgtcttgttgtgttctatacttgattctcttgtctatatatgtttggtttgcgaaaacgaaaattcagacatttcaaaaacagttccagagaaagagacttgtatggacacgaacatgcagagaggtgttatc

SEQ ID NO: 2406 - DNA, 1501 bp, Oryza sativa
gatcgagctgaagcagacgaagcacatggtcatggagatgccacagcaaagaagcacaaggccaccaccagctttagcatggatctaccgctccgcctccaatacccccacgagctcgccattggcgcctccccaaaaacccgctccgtttaggctgaccaggcggccggtgccgcgacgcaaagggaagttcggcttcgctcccactagccaccgtagccgcatcagatctctcgaaatccaccggcttgcctatcttagacaaaagcctccactgcatcgatcgattgggcttaatacatcaacgagaaagaacagcaacaacgtactccctctatttgccatatctttgcatcctcacctgagtcctcactcactcgtcacttcacttcactcgtgtgtagacgtgctccggatttgtctatcgttgcggggcgaggagataggagcaaaattcccgccgttgatttcatcgccgtgatcagattgagagaccaccgcccagtcgccgtgcgcgtgcgcagcgcgtcggcggcggctgagagagagaagggaggaagaagagaagatggggggggggggggggggggctgtcaagcggttcccgcattttgttacttttacccctttcacttacacgtgtgacccacttctatttttaattcatttgatgattggctaccacgtccatatttggacaagtcacaacatgctacgtcagcaaaaaccacatccaaagccaccaaaggagtttatttataccgatttttgaagttggggtatgtgttatacccggttttgtggttaggggatgcgattcgatcgaggacaagagatgagagaggcaaaatagacttattcatcgtgccttatatggtttgatcagtctactttggctcactcatccattttgcctccctgatctttggaccgtgccggaccggtccaccatgccgaggcagaggtacaaacacgacccaacaattgggctgtgtcgtaactaagccggatcaaaatctcatgccgtgagccgggctgttgggcctcgaaccttttggccaactgtagcgtggagcaagctgcagtggccaggcccctggctgcacacacagacagcatgcagcatccaacgatcgatctagctagctagcacattaacgccaattctaccgttcggccattcacgtgaagcctcatgccggcctgtatatagatatgcatccatccatgcatgcatcaatggttgctaccctgttcagctcatgcatgcatgcaatggtccatttggccttgtttcttctctgatgaactggtgaatagattagcacacgtatttttaggcttctaaacggtgtgatttaattttacaaatccttttgtacatgaatatggtttactataaaatcatttttcatctttatattagtttaattcatttgtttataaccttgaacaattatgataaatcattaagctatattaattctgccatccaattaag

SEQ ID NO: 2407 - DNA, 1501 bp, Oryza sativa
tttactattaatctagtctattgctgagatgtacatgttttatagagaacaccttactttaccattgcgggtgctctaattcactattcacagttactaatggatgtgtcagtgtatatactactatataaccagactcaccagccagagcccaaagcaccgtatctcgatacggtgcatatgtcaatgattgtatcactgtgtggatgtgatcggtatatcctcgcatcattttttttacttaagagcacctgtaatggtaaagtaaggtgttatctataaaacatgtacatctcagcaataaattagattaatattaaaccacttcaatggtatgtctacatgggaatctatagctctctaatctattgtctcgtttttctctataaactatcttcaggttagtagatagctttgctctctctctcttcatttaatcacttccaagtagaaaaatatgctgacatggatctcttgtaaagagcttataaataatcattgcgggtgcccttaaaacaccggtgggaagtcagcaaagtcgtgcttggcatgtgtcctgaatcttagtgagatgccttctttccattcactttttgcagggtatcctgtaagttgtaactaccatatatatccacatttttgtaagggacaaaaatacggctagtatgcaactatgctgtctatgcacatatgtatcacactaccgtgtcactctgtcaatacaatattagagttggcgattatatttaggacggtcactaggtggtttcacactacctacgcgttagttacgcacaatggtgatactacaatgatatggtcaccctagaagagcgttgggtacaaatgattgcttcaaatgataccgagattattgtccctaatcaacctgcccctgctgattgatctctctctgtgattgcgtggttatttctggtgccttattatggaatctcttccgttccccgaaacaacgtcaatgacccatcatgcaatcgatctgtgcatgcatcgatctaaatctgaaacgagaaactatatacatattctggaatataatcgatcattcatcttccttaccacaaaaaaaaaattcatacgatcgatcatttggcaggtacgtatcgtccacaatatcataacatgggataactgccaaagatgtgattttataatggtacgaactcgtgaaccgaaccctccatccgtccatgattttctccctagccatgtgacacagctagctctctctctaccacgccggccggtggccacgtcgggtgcaacgaccccttgatgccgccgtgttgctcgtccattacatttggttcccttcccctctcgttttgccctgcctataaatacaccggcaatggcctccgattccaaccatcaaaccacacaccagacaatacttactaccactactactgctgctgctgccagttctagctagcctactgctcttctccgagctgaagatttttcgagctagctagga

SEQ ID NO: 2408 - DNA, 1501 bp, Oryza sativa
tgcaaggaaaacgatacatttcttcttctcgcgtttttctttaagcattttggcttgtccatggtgctataagtggtacacattagcaatgatgtggtgtgcagggaaggggatggggcaatgactagggagtgtgtcatgaagataacggtggtgtgacacgaaaaataattgtattatagggctgctgtatgacacgcagtggaaagaaccgagagattcgaaaaataccatgatatttataaggggtagaaatcatattctcctaaaccttccatttttatattatcacagcgaccatattaatatttttttaccagctcaattactagaaacttttatcttttttttttgcaaaacagggcagctcatattaaattataaaagagattacaactctttttgttgcaatatctggaaataaaagaactaccaacacagaacaaggaggctccacatattgaaataccgcaagagatatgagcaaatgagtgtagccacaatgctgacattgtaacacacgcaaaaacatgtaaaatgaatattgctcaccatattcatatatccttcgacaaaagagcaaaccaataccaccgaacaagtcgacaatttggaacctaaaactaacgccaacaatgtaatatttgatgaccgacaggcaagtctccttgatttccatcgaggacctcacgaatgaagtagccagcaacacatagattaaaaaagacaagaaaaaatctaaatagatttaattccatgaaaaacatgaaaggcaaaccttagacaccaaatagttccaacctacattgaaaaaaactcaaaaaacttacgagaagctgtccccttcctcatcgtatccggcgaggacagaggagaggggaggggtaatatgtgtccaataataaaactgatttttttttaataaatcggtcgtaactcgtaacggtagagaccacggtaagaatgttagggcagtactgtcacgtacgttagctacctatatgagcgagaggagggatatatacacgtgttaacaatccaagcacggtgggtgttgagatccgacggtttacgaaaaccgaccgactttctgcaagcgatggttgacttgtacatagtaatgattggcaggtaatgacgtactgcactgtacgagagtgtacctccccaacatgccataaccgccctgccaagatgcgatttgacaataggaattctcgtttaccgaggcttaatctccattcctccacgattcgctccagcgccatgtgactagaccgagctagctcgctcgatcgatctctcacatacacacggcacgcacgtcgggtgcaacgacttatcggtgccaagttgccgatcgatccggtttttttcgtttttgccagttagcctaattctgcctataaatacacgggcaaatctcctctcgccaaaacacaaagcagacaaggtagtagtacaggcttttgtacgtacgtagcagagggagttcccaaga

SEQ ID NO: 2409 - DNA, 1501 bp, Oryza sativa
agtgctagctgttaattgttggattatacaaatgtgttttaagatgttaactatatcatcagtaacgagagtaatttatagaaaatttggaaaactcaataacataaataagatttatgctgcaaaaaaagaacgtgatgacgatatagccgagtaggtccgagacatcaaattaaggttctgatccgatatacgaaaattcttttaatagtattttataatttaagagtttattgtgaaaaacatataaaacatttagtgttttttaagaaataatattattatgatagaatatatgtgtattagtatgagaaaaaataaaaaccctaacaaataaaagaatctttcaaatattttgtgattgtaacatatgaatattgtaaatatttaagtgtaaaattgaagcgtaaccgcataagaacataattcattttagtggaggagagacagtgagttggtggtggttggagatttataggaggtaggggtgtaggccagttgtttatctttttttttttttcattcttactacacttcactttttgtgaggcattggaagggtctagagcacccttgttttgatattaccgtttactctttactacctctccctatacaatccaatggtcttttttcatttcgatggacatccaacgggttatatgtgtttgatgacgctggctattcttgtgctattttggggttcacttttcaatgggaaagatgtgcatatgagatgccaagtggtggcacggcaacgctcgccggcgcacagacagagcgaacggtggggatgaagggggaaaaagaagaaagaaaggcagattcggcggtcttgggatttccgcgtaaacgtcaacaatttcagcccacggatccgctatagcaaactccttcgggccggaacgggatttctggtagcctatgaaggcaccggaaaatatttgggagaataagtttgcattaggtccctctatttgtcgttttcgtccctgaaccacaaaaccgggtacaacatgtcccccaacttacgaaaaccaggcaaacgaggtccctcgatggttttgatagcagttttggctgacgtggtgcctacatggctaatttgactcggtcttcatccgacgtggcacagacgtggcgcttacgtggcaatttgatctaagaaaaataataaaccctgtgggaccacatgtcagtttcacacataaattaataaaaaaaatggtgggacccacatggcccccacatgtcatcctcactcctctccttcctcctctctcccctttcttcatctctctcccctctcctctctcaggcgcgatggagagggagcggtgcacgccctgtgccgcaaccagcctccaccaccgtcgccttctcacgcttgtcgatgccatcggcagcagcaaagcagtgtgcggatgtggagaaagagggaggggagagaggagaatacaacctcaccgtcgcccctctcttttccaccgccaccaagctt

SEQ ID NO: 2410 - DNA, 1501 bp, Oryza sativa
aaaatgaaattcctttgtttcgaaggagatgtacgaatgcatgtcctcgggacaatgattgggagagtacgagacgatgaggttgtgttaattaattggtgaggttacctcgtagcatgagccgcatcccctgccgtccttgaagattgggacgttgccgcaggagatcatgccgttgtagggaggcaggttgacgttcttgatcccgcacgcgccacctggaaaaaaacaaaactcaaccaattaatcgatcgatcgccatagatcatggatgagcttcacagttactccatcgccatggatttagacactgttcagattcgttattctatcgtactatcttgagacaaagatagtaacactacatgatgagccagtaaactaatattttgaagaggagatagtaacattacacgataagatagtaactttaccgttgtcggcggaactaatattttgaggcggagagaataacattacacgataagatagtaacattaccattgtcggtggagccggagccgtagggctggccgtaccaggtggccctggcggggagccacggggcgttgtagttggtcgtgatgttcgggccgggtggcaccttgggcgggccgcacgacccgccgccgaccagcgctgccaccacggcgacggcgaggacgatgttggtggtgagcgatcccattgtcgcttttatttggcttggtgtgttttgtttttttttccttttttttttggtggtgagatggatgacaagatcaagcagatgcctacgtatttatagtcggcgaggtgagggcgcgggtggacggccggtgtcgccggcgtcgcgcgcgatcgtgtcgtggggttgggcgtgcgtgcgtgcgttcgtacgtgcgcgccgccgccgcgcgcgggagcgattcttctccggtggttttgatttggtcatgcgttttgtacgtaatttgtgcctgtgcgcgcgccgagttgacatgtacgatgggtggctgagaaagctagcctgagatggaaggccagtgtgcgacggtgagacgacagttaagctggctgctgcgtttatgcgtacactgtcagtgtgtacagtgatcaagatggagagatatatattctgctggagaaggcgaaatatttggtgattaatgttgagtcttttccagtcccgtatttcttattgctttccagttttgtagatttgctcatgaaatcaatactatatagtatgtagtactggtataagtaatgacaaggttacttcctaatggatgaacacgcttacacgcccgcatgcaggctgtcatgcatatatgcagcgcaattagtaagattttgcatgcggcagatacgatcttgcattaattctttcatgatcctgcatccatccatcgtaggtacttcgtccatttcacaattcacaatgtaagtcattctagcatttcctacattcatattgatgttaatgaatctaaatagatatatatgtctatattcatta

SEQ ID NO: 2411 - DNA, 1501 bp, Oryza sativa
ggagaggggagaaagatgaagagagggagatggggagagaggaggaagaagaggaagggtgagtttgactgacatgtggggcccacgtgggtcccacaattttttattatcttctatgtgagactgacatgtgggtccctaggtttttattatttttccgggtcgaattgacacgtaaagcgccacgtcaatgccacgttggacgaagaccgagtcaaattagccacctaggcgccacgtcagccaaaaccgccctcaaaaccaccgagggacctgatctgcaccggttttgatagttgagggacccgttgtgtctggttttccgatcgagggacgaaaatcggattcggtgtaaagttaagggacctcagatgaacttattccggagcatgattgggaagggaggacataaggcccatgtcgcatgtgtttggacggtccagatctccagatcactcagcaggatcggccgcgttcgcgtagcacccgcggtttgattcggcttcccgcaaggcggcggccggtggccgtgccgccgtagcttccgccggaagcgagcacgccgccgccgccgacccggctctgcgtttgcaccgccttgcacgcgatacatcgggatagatagctactactctctccgtttcacaatgtaaatcattctactattttccacattcatattgatgttaatgaatatagacatatatatctatttagattcattaacatcaatatgaatgtaggaaatgctagaatgacttacattgtgaattgtgaaatggacgaagtacctacgatggatggatgcaggatcatgaaagaattaatgcaagatcgtatctgccgcatgcaaaatcttactaattgcgctgcatatatgcatgacagcctgcatgcgggcgtgtaagcgtgttcatccattaggaagtaaccttgtcattacttataccagtactacatactatatagtattgatttcatgagcaaatctacaaaactggaaagcaataagaaatacgggactggaaaagactcaacattaatcaccaaatatttcgccttctccagcagaatatatatctctccatcttgatcactgtacacactgacagtgtacgcataaacgcagcagccagcttaactgtcgtctcaccgtcgcacactggccttccatctcaggctagctttctcagccacccatcgtacatgtcaactcggcgcgcgcacaggcacaaattacgtacaaaacgcatgaccaaatcaaaaccaccggagaagaatcgctcccgcgcgcggcggcggcgcgcacgtacgaacgcacgcacgcacgcccaaccccacgacacgatcgcgcgcgacgccggcgacaccggccgtccacccgcgccctcacctcgccgactataaatacgtaggcatctgcttgatcttgtcatccatctcaccaccaaaaaaaaaaggaaaaaaaaacaaaacacaccaagccaaataaaagcgacaa

SEQ ID NO: 2412 - DNA, 1374 bp, Oryza sativa
ggatcccccgttttttacagatggccgacgtcgaccgccgcttgccggtgcggcctgacttcccgcgcccctgccgccgtagccccttcctctcccgcagcgcgcttgcccaccgtcggccggccgctccggccctcgccgtcacccgcttcgcccaccggccaccgcttgcccggtcctccggtaggccggtgcggctgccacatcgccggtcgccggccaccggccactgaacctcttcctctcctgcctcgcctcgttggcttcctccccaacccgccggtcggcctgtccacctagacgaggagaaaactgagagagaagaggcgacgggcagagtggcggcctcgctggcgcgtgcctccactctcgcccacgccttcttcttcggcttccacttttgggtcggtgccggcctctcatcccgcgtggcggccatcggtgcctctccgccactgtcgcctccgccctctccgccacacggctcgctcgcccgccaccacctctctgccacgacgctggcccgctaccttccccttctctcgtgtctcagccaccgccgcatcgttggccggccgtcaaacctctcgccctggcgaccccctccccaccgccggccagcatgccgacgacgtggcatcctaacatgttgagaggaaaggtagggagaggctggcttgccaacgtggcatcctgacatgtgggtcccacgctgactcagccgccacgtcagataaaaccggggtcaaaatcgccgagggacctagtttgcactggttttgtaagttgggggatgcgttgtattcggttttgtgattggggggcgattttttaacctgatgagggaccttcggtgtactttttcctaagttgggcgggggaagaaatccaaacggtccaattaaaagagcgaagtaaaattccaaattaattcgaagaatcggcgtcaccaaatcaatctcgcccttggttaatcttgtacgattgttgtgaaaatcttaacatcaaattaagagattgatttaatcaaacattacaccaaattaaccgatacacgtttcagcatgtacgtaggagttaggataggagaaaatcaccagcaattaagccattaattaacaatgaccggaaaagggagcgcgtgatctacctaccaataattccaattcctaagccaagaaactaactaactaacgtacgtgctcactgccattgtcgtcatcgataatcgtcggttgcaatatcctcttttccgttgccatttcgctttccaagcctccaacttttatgctgttcatgagcatgacagcgtgcatacatggcattacagaatctacagatgcacaggctagctgctctgctgagataggcgca

SEQ ID NO: 2413 - DNA, 1501 bp, Oryza sativa
ggccattctgcacgcaaagttaaactgtagttagttgctcgtacctaattactgaatgcatcgatgattagtcatgagtgtactgtgacacgctgcactggcaaacaacctggcctgatgagttcatcgtctaatctcaatcatcatctctgctgggactgttagttctgaacctgaacctcgcacgaatgcctgaataatttgagttgcgttgcgtcagcgtcatacattacactaatcctgtcaaatctatcacaattcacaactcatcaggccatgatttgttgctcatcaattaatattgtaaccaacttatcatccaatcattagaatctctgtggtctgattagttcatttcaactggtttggttgaacgtgatgtgaagatgctgtcaaatccctttgtttttaactgaacttccatgtgtactttgtatagtttcagagcaggaatatcagtaaggatcaaatccattaatatcatggttgactctcccctaacatcaagcaattactactactttccaaggtcattaagcaaacataatcttgccatgatttttatacccatgcacttcctttccacgcctaataaaaaataaacaaaaatcagcaatgtctcccaatggcatgatcacttgccatggaccagaaaacacaaaaccatatgcaaaacagcacatcctttgcttaccattgactcctttttccatccaagcctaagcaagagaggaagctgatgcaggaattcttcagaggaaacatgagcttccaattcatggcaagaagatcattggcttgagtgtcttaggaatcaaatcaacatcacaaaaaaaaggtaagaatggccaatcaatccttttcttgtgccatctttggggggtgttctatcctttccatctcctttgcagcagtcaagaatattgcaaaagcagtgcttgttttctttcaatgtttttttctgaatcttggagatgacgacgacgatggcaatgcatgcatgcgtccaattgcacaaaccctgtatgtaaagaaggttcaaaagcaaaagcttctgaaatctttagagcatactggtcctctcaattccatttgcatctgcatctttatctgcatgagatgatttagtttatgacttggtgtcgagtagtactactagtaacctcactatcatctagaaagcagcgagctttgttgctaaacaaacaggggcattttgcaagattttctcaccgctgtcctacataggcacacaaacattggcaaaatgtgtttaaattaagctacagtttcaaatttaaacctaggactaggaggtttgaaatttttttagtgagatgggtttctcttgtttcgatgaacttgtcgtgtccattgcaaagaagaactcgttatatataaagctctctctcttcttgtttcttgcagcgttgagagctcgtcggcatcaatcgatcggcaatggagagtagctcgtcggtgtcggtgtccgacgagagct

SEQ ID NO: 2414 - DNA, 1501 bp, Oryza sativa
ccatccttcctaaaatataacaacttttagccctctgggtttgtcccaaaatataacaacttatccaccaacattctattcccaaccaatcacaaccttccaccattcacttttcccacatacctccattactcattcaatcacaaccctccaccatttaattctacctaatttcttaataaccgtgtctaactataaaacttcatatattctggaatggagggagtaccttgttaactgcagttttttttttaagaaaagaagaagaagaagaaaagcctgttgctgttttgcacaagcacaactgcgaacgcgagaggtccagtgactagtggtttaggcccatcttgcagcagactgaaaataaaataggcccagtagcccatcctcacaagcccataaatatccggcagggctagtggtttaggcccatcttgccgcagaatccgccagctttattaattattaacctcttctccgccattttttcgctccaccattttcgttctcgcgctctcgacgaaccaaccatggcggacaaagtgagaggatcgtgttcgtctcgtcgcccaccgaggagaggagtccgctccagcctccagctgcagaccagccgactaggtgagtggatcgatccccaaaatcccaatgaatccgcgttctcttttcggggtttattcggttggggatgtcgaaaatcggcagcggcatttgggagtagtagctgcggctgccctcgtacgtgccgattggagggagggattggtgtttggagtgaccgatttgccgttcgaatgcgtaaaatttgggtgaattacgcgagagatttgataatttaacactcttttcaatgggtttctattatttgacatcctagcccactttcattcactcagatggtcccatatattatcctcacaaatgtcaattaaagtaattggacaacgaagaaagtgtcaaattatcaattttttcgaattaagcaccgattggtccattttgtaggaataatttgaatcgcttcattttattttattttattttttgctgggttgttgggtttgggggcagtttaaacccaatgcggcatacatggggatctcacggtgtctggaattttgaacaacggatgaactgcgtcctgtgccgactgccgagtgcttgggtggtgtgtagtgaactggttaatcccaagctcccgcctcccggaacttctggattgggtggttttgacagctgagccgcgttgcaactaatgtagtttgcactttcactcacattaggagttggattttggatctacttgttttaccggttggtgtgcatgttggcaattgatttagtagggatgcttatttctcatcctttcagttgcacaaatttagcgcgcaagtgattctgttatttgtgctgtttggatttggcatgctcatgcttcttggaggtttacatgtattttgaagcataattcaaataactgaatgcatgaaaactgtaagct

SEQ ID NO: 2415 - DNA, 1501 bp, Oryza sativa
ttttctattttgataccgtaatagctaggaacagcatgttgagatgaaagagtgtaaatggtgtaattaattcattttctagcaaaagaaagaaatgaccgtggccagccacgttgaggcaccgaaattaccgatccacgggaattagaccgtagactctgtaattcattaatttgagaacaaacaatgattgggaaaaaaatccatgaactatataaatactcctattgtttttcaatagatgacgtcgtggaattttgaacatacctttgaccactccatttgtcttattaattttttttgcgcaaatacataaaatataaatcatacttaaagtagtttttagtcataaaataactcataagaaaataaatgataattacataattctttgaataacatgatgattaaacatgtgtcaaaaatcaacgacatcatgtattagaaatgggtatattactacttaacgttcgtatggttagtttcttcattcatcattttgccggattttccttttttgtctgaataagagcacgcgcagaggctcccaaggaaaaagatgcagcagtgtaggtggagggccggtaagggcatactgggcctcggttgtctaggtattgggcctagctctccggacgattggtgaaactccaacaaaaccgacgaacgaatgtccccaatggcctaatcttttcttagtgtccggagaaggattatttcagcctttttaaaatgtactcccatcatcaaacaagtgttaagcatatttttttctaaaaaaaattgatcatatttgtagtttttatgtactaaattaattgttaatctaaaccctagaagccatcataattcattggttgcatgcatacatatagtttattggttttgttaaatggtggatgagttaattcctccttaattttgatgataaaataaaaggttttatactttttagatgtaagagtactccgtaggtacttcggtagagtgtatcctatcatcattcacgttggacgtggtttaggggtgcgttgtcaaaaacaactttttcatttgaaaacagtgtatatccacttattaatgtagaggctggttttttttatctactagaaaataggcgtgtcatgtgtgcatgataacgcggtcgtccgagtccaacttaataaagcatcgtgcgtgcacaagaacgcaactgagtgcgcttaggacacattttttttctcacccgcatcgcttccccacgcaaaaaccaccatattcagtcaatttatactattattatatttgagcttgctatgatctaacaagttaatagtaaaaatcattataatgaaaatagataaattatttttacctgttgcaacgcatgagcatttttgccagtacatcttaaaactgagtcactggatcactgaaccgatatctatactttctataaagttacagcccactaattctaaatctcaacatgcaaccatgccacatcatcatctattagcaa

SEQ ID NO: 2416 - DNA, 1501 bp, Oryza sativa
tcagctcgagcgacgggagcgcgaaccccgtgtccctgcgctgcaccttggggttctcgtccgcgagatcggcgcgccacagccgcctccgctcgtcgacgaggtacaccgtggcgccgacggcgacgacgtcgctgagggccgcgtggtggcggaaccccggcgcgcgcagcgtctcccacccctggaagtcggcgccggggcggcagaaggcgaggagcctgtccgcgaccaccccgaggaagcaccccgcctcgccggcggcgggagacgcgtgaggacggcgtggaacagtgcgttccacctggcgattgtttaagaaacgatcctctggtcgccggtgatggggttgaaaagcatcacgcggcgcggcgcgtccacggcgaccatgacgacccacccgtgccccgtggcgacgcaccggtgcatgtccctcgagggcacccggtacccgtacgaccgcccgccgggcacgtcgtagaacacgcggcgcgccaccgcccccgcccccgggggcgactcccgctcggggagcatcagccaggggaagggcggcggggcgtggccgacgcggcggcagtagaggcgccacgcgcggtcgacgaggcggagcctgaggtagtcggcgaaggcgaggaagggggcgaccgcggcgaggatggccccgcggcgcctagggtttcgtgggttgcgcgccgccgccatcgccgcctccgccgcgcgccgccgcggcgcgagcgaccgacgcatgcagcccacgcgacgcgacccgacccgacccgaccgaacgggttcgactcagccgcgtgctctctctctctctctctctctccgcgtctcctcgtgcgcagcgcacgcacacggccacacgcctagcctttgtatgatcccgcgacgccacgcccctctcctatatacccccctccgtcccgtattattgtcattttagattgtttagcacgtattaaagttaaaaaaaatataatagtaccctttattatttaataaaatatattgttgtatatggaatgatggttgagggtagaaaagagacaaatttaaattagaagtgattgatgggataagtagtactctattgtgaaaactattttaaatcccaaaaagacaactaatttggaacggatggagtatatttatatgaataaaaatgtgaaatggggaatttccagaaaagcaaacttgaaatctaaaattggatacaaatgaaatggtttttatttcagtatagtgaataatattgagggagtctataaataaataaataattaaagagctttcaagagaagtggattaattatttaatgttagtctatatggttattcaacaggtggtgatcaattagtcattcccacattcttcatgtttttcttcaatcacaggaacatgttgagcttgaataccaatgcataaaaaacacgggtaaatttatcatgaaaaaaatcattgtacaatattattttttttaaagaaaaatcgtgc

SEQ ID NO: 2417 - DNA, 1501 bp, Oryza sativa
ggctcgcaagtgctggatttaaatgggcttctcttctatggcctgtggcaatctggcccagcagcttatcagcgaaggaaaaaggaataagttcatataagttcccttaactttacgctaagttcgattttcgtccctgaatcacaaccggtgtagatgaggtccctcagcggtttagatggcggttttaactgatgtggcgctgacgtggctagtttaacttagtcctggtcctatgtggcggtgaggtggcacttggaagcaaaataaaaggtgagacccatgtgtcagtcttaaaaaatagtaggacccaccctgctctctatcttcatcgcgccgtcgtcctaatcccttctccctcctggccattcttcatccttcctcgagctccctcgccggccggagaaagcgcggagagggagaagggcgccggcggggagaagtgcggagggcgccagccattgggcggggagggtaggccggcatgcgcgcgacgggagaggagggagcggcggccggagctgcacgacctcggccccgccgccgacgaagactcctgctgcgccgccgcatcgatctgcacgagttgcaatcttcatctacggccttgccttcaggccagttaggattcaccatcgcagcagatacatatgacaccaccacaaccctcccaagtcccaaccttgcttctgaacaagccttccgcacattcgtcgtgcccgttacagcagcagcatgtgtatgaacctacaacaacatcaattcatttagctacaagaacatgacgatttaattacaactctgcagacttcagctactactgcttgttgagaaatcaacagtttcgacaaatcatttttagtagaaactgttgattttgtcgattttcagtaactgcagtctacagtttgaacaagtcaatggagaagaaaaggaattattttgctgaaaaaagagagaggtgtgcccctgggttaggggcggagaggagcacggggtaggccacatggaagacgttgttgcagccggcgatggccaccgccacgctaccgtagtcgagcaggtcggccttgaacagccgcagcctctccgcgacgccgtccagagacatcaggtgggcgttcttggcgtcgccttcgcacaaatcatccgcacaagcacaccaatcaatcaatccaccagaacaagagcagaatgccatgaatatcaaaaactttgacgcaggtggagggggttggggaagtgggcagcggcggctacgagctcgagtcccgggccccgtcaacaccacgctgtccgtgtcccgcggctgtgagctcgccgtcgccgcaactcgtgcagatcgatgcggcggtgccgggggtggggggggggtcgtgcagttccggccgctgctttcttgcctgccgccgcgcgctcaccgacctacccgtcccggttgtcggcctacccgcctgcttcttctccacgcacgctcgtcgggctccccacccgatggttg

SEQ ID NO: 2418 - DNA, 1501 bp, Oryza sativa
tcattcgttgcattgatgggtgattatctattccgacgacgctaacacatcgattggatcagcagtgcatcaatcaatcaatctgctctcgcgtcatgtggccaggcagatgcaacatgcctccccgaaacggcggcagtgaaaggaaaccccccaaccaaccagaactttcagcgcgcattatatgcgacgacaagcccatatgtactgcgaaaatcatcaatcaaataaaaaaaagaaattcttgaaaggaaaaaaacaagaggatccttttgtcctctccttgctaatgcatccaaacaaaaattgaggaaaacggcaagagaagctactgctactgttcgtcttcgtcctcgtcctccgccttcccaccaattgaaccaaaaacaaatttgcatatattttttttcggtttcgtcccgggtttggacagctcaaactcgtggccgccgtcgcagacgtggaccgagcatccaaccatcgaacacgccaaaaaatggcacacacacacaacccgatcacgacgagcaatcctccccacccgagatctaatctagacctcccacaccaccgcatcaccacgcgcgtcagaaaccccacccaaaaaaccaaaaaaaaaatcaatcaatcaatcaatcaaacaacgggaagagcagaagctgatcccggagagagaggccggccttaccccaatgccggcgagcagcccgacggcggcggcgggagcggcgatgcgaagcgaggaaggcaatggaggggatttgggaggagtgagaggggagaggagagaagatggcggagcgcgtgtattaataggcggcgactctctctcttgtttctctctctagagcttctctttctttttcttttcttttttttttctttttttctctctctagagagagaagaggaggagagggaaaagtagttagcggttgtttcggtgcgtttccgtttcgttttctgcatcacgggattagttgatttttttttaataaagcgaggcgatggggcccacggggtgtggtccgctgacgtgggatgatctgggggcgccacgtcgacggaagcgacggcgatggtggttcgtggggggggggtgtggggggaggggcgtggtgggcccgggatccgtgcgggcctcgattccttgaccgtggccgaggccactttctcggctcgaccatgggccgacgcgtcgacgcgtgggcctgcgtgggctccacgggatctccacgtgggcggaccgtggccacgagtggcgccacgtgaccagcttccgcccaaccccacccatgattcggcccgggacaagtcgaccgccctcgtgcgtcgcgcgtgacgcttttgcccttcatctctttggttaattttgcttccaaacatatttttttattactataagcatgtgcacacatcactgtatatacaacaccacactttaaatgtgcaccatgcgagcgacatatccgtgatctcgctaaaatcctgttgaaagtct

SEQ ID NO: 2419 - DNA, 1501 bp, Oryza sativa
gatcaaatgacagtacaaacgatagtgaggtgaggtcgttatcctacccaatctatcgatggaagtccggaggcaacagcccacatggaaccgatcgagaatgcccacattggtgctggtggatcaaacgaggtagcactactacatttccactgtcgttgtaggcttgtggagtagccacgcaactctatcctcttgattagataccccgactgattacggaagactgatgtgtagtagccgtgtacccaacggattggcagtagccactgatccaaccatccatctgggaaggaacgttcaggatttaatttctcctccctcttttaggccccatttgattcaaaggaaatttataggaattttaggccccatttgattcaaaggaaattcatagaaattttaggccccctttgaatcgcagtattgagaaaacgtaggaataggaaaaacacaggattttgataggaatacaaaggattgcaaaacgcaggaaaaacataggaatgaacgtttgattgaaccgcaggaaaaatgcaggaattggatgagagagatagactcaaagaaaagttccaagaggttgaagctcttgctaaatttcctccaaaatctctataggattgtccattccataggaatttcaaaggattggattggattcaatcctttgtttcaaagggcttcataggaaattttcctataggatttaaatccttcaaaattcctatgattttcctccaaatcaaaggggcctagaggatttcattcctataggaatttttcctatatagccctttgaatcgaatgaatggatcttatggaatcctatgaaaatcctatggattgcctaataccatacaaggtttagaggaattctaacaagaggtaaaatgtcttggaaactttctttgagtctttatctctcctctaattcctatgttttttctgcggtccaatcaaacgaccattcctctgtttttcctatgttttgcaattctctgttttacacttacattcctatcaaaatcctatgtttttcctattcctatgttttctcattcctgcgattcaaaggggcccttagaggatttcatccctataggaatttttcctacaaagccctttgaatcaaaggaatgaaccctatggaatcctatgaaattcctatgtaatgcctcttcccatacaagttttggaggaattttaacaagaggtagaacctcatggaataaatcgtttgagtctttatctctcaaattcctgtgtttttcctgtggtccaatcaaacggtccttcctatatttttcctgtgttttacaatcctctgttttacacttacatttctgtcagaatcctatgtttttcctattcttctgttttttcattcctgtgattcaaaggggcccttagttctttcacccctttgattggcaggattgagaaaacgtaggaataggaaaaacgtaggattttgatagaaatgtaagtgtaaaataga

SEQ ID NO: 2420 - DNA, 1501 bp, Oryza sativa
ttccccggcccgacgacggggaactcgcttccgcgccgttggctgctcgtcaccacgccgtcccggctcggtagtgcctccctcccgttccccttccccgctcacccttgtcccctctagcttgtgtggtagctcggtagccctgccgaacacgcgtagatgccgccccaaggaccgccgccacccggcatggccccgccgccattgccgcccacccccggaggccgcctctcgtcgccggctgccctcggtgctcctccgtcccatccggcgccggaaacggattccttgaatcccggatatgctcccaccccttttaatcgaacccccgttgctccggtgaagtccccccccttttctcgccgccggcgtgcgccgccgcgattcgtcaacgccggcctccctccggcgaatccgatccggtggctcacttcctatcgtccgtcccatcgttccggtgtactccctctctctcgaatcgtcgcgacgagctccggtgaactcggccgtcgtccgccgtccatctcggccgccccttcttcctcctcccgccggcccgcgtggctgccacgtaggcgccacgtcggcgccacctcggctttgaccgagccgagccggtgccgcctccttcctcccccccctcccgtgcgcgcggtccacggtgcgccaaccggctgcatgtgggcccgctgccatccgatccacccggcgcaccgcccgcacaccgcacccaccaaaccctagcaccgcacccgcgtgcgctctccccaccgtgagccttgccgccgacatgtgggccccacccaggaccccgcgaggtgcacccggtccaccggaccgctccctcccccttccgcgcgccctaatgggccgcctttcccgcgcccgcgccggcccaaatggcttggccgagcctccttcgacccttgggccgcgcccttgccgcccgaaaaagtctaatatacatccctccatccttttctttttcagggatttaataaatcctttttcctttgtcccataaatcaattccttgttacaaaattccataaaccattttctttggtcccacatgacagtgactgtcaataatattcttgagaatattatttctataaattccataaaccattcctcttattccagaaattccaattaaacttccaaaattcatatcacccactccgtaactccgattaactccgttccacttccagtaattccgtaaaattgagatctatttagtggcactactaattagtctaaataggatctttcttttggtcttttgcttaggttttcagttgtttgcgtatagttgcggttatcggattttcgtcgatcgcgggttttctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgcg

SEQ ID NO: 2421 - DNA, 1501 bp, Oryza sativa
tcaagtgtgatgaagtgatcgagcttagctagtagagttaattagctagctaaggctgctttaattagcttgtgttttggattggggctgaggcgtctggtatttatagatgaacactgcagctagttgcatgcacgatgcatgtgcactgggtttgtgtccatggatggatttgcatgcatgggcatgggccgcttgttttgctagagatcagatgcgacaaggatttttccgtgaaggaaatggctagctagattggttgttgattaattatttcagccatgcataggcgtacgtgcagagcagcaatttatcaatcatgtccagtatctaagcctaatatatttgcgcaatatatatatatcacacaacttcacgatcgatctatcgactattgtttttcttacagttttatatatttcagctaagtggcctgtcacgttgtttatataccttatatatatacgagtaaatatctcagatcaagcgccgaacttgctgataactaactacaatatctgaaatcacacatatatcagtacatatacatatattcagaatatcacatataatggttcattagcaggtataggcgtatagttaactgatacttcctcagttttagggtataagacgttttgactttggtcaaaatcaaactgctttaaatttaaccaagtttctagaaaaaatatatttaattattaatttgatgaaactattttagtgttataaatattattatatttatttataaacttagttaaatttaaaacagtttgacattaaccaaagttaaaatgtcttgtaacctgaaacggagggagtagattattatctgcagcttgatgatgagtttggagcttagcccactggaggatatgcgcgcgcacggtatacgctatactccacacgcacatagtatattcagctctctgattaataccccagtttgtcgctcattttcatgcatgcatgcatgtggcagtggatgtattctggcaaagtattactcatttccaattaagcaactttgcataatttcctgttgatttgattttctctttagctgtagcctgtacgtataggtctctacagaaaaaagaaaaacagagttaattctgaagaaatgtacagagaagcattatgcatgggcatatctaaggcattattaattgaaagatgggaattgaagctggtatcccgaggagattacataacagctttacaggattatattgtatatccacgcaagatatatatatatatatatataaataaatacgtacgactggctggacaatttgatgaataatgcagggatgcgtgggactaattgccgactggtctgaaagtctgaactctgtacaactctgaagtctgaagtgagaactgaaaacaaactagcttatagctggaagtcgtctgctgtctctgcaccagacgacgaacgtataactagctagagctacgacctttatccccatgatataatgagctg

SEQ ID NO: 2422 - DNA, 1501 bp, Oryza sativa
aggtctcagcccactctaccctattacacggcccattccggcccaacatatctaggattagtaatactctggcgcttctctctttcaaagacgccttctgctcctccgtcttctgctcctccgccttcgtcagagtccttatcgcgcctcctattggtaacgtcagcttccttgcttatcctgacatttttcttcaaacttttaactttttcatcacatccaaacttttctacacacataaacttctaactttttcatcacatcgttcaaattttaaccaaatttttaattttgacgtgaactaaacacacacggtgatgcatgatctgcatcaattctcggatgtcagaggagatctccgaattactcgttttcagatttcggatgaaggctaaaccccgaacaaatgcaagtgcccagtggttcgtcggaggtggaatccccaaggagacatttgggctaaaaagagactgggtccacgcggcccctctcactgtgtgtcaatcctaggaggggtcgccgccggagacgtacggatagcacggacgtcggcgagtgcgaggagatttcttgcagactgtacgttctgaattttcatgttttcggtgagcgagtgagactggatctctgtctcattttactcaagctgttcttggaaccgcattacagattatgcaatttgatgggtaaagaaccgcgcgcaacttagccgcttaattaaatatgcagttagtcagttaactaataagttgcttctgaacgtaggagtactcactaataagtaataaagtactaattgcattatgatatcacaataagcaacagtacttgtcaagagtatatgggactataggactagattctacagtggagcacgtaggattgacttgtgccatttgccgtgtggttttcttcagaaataccgtagagacagatagcactcatgagtcatgacctgaatactcctactccatccgtccaaaaaaaagataaaccctagtttccgtgtctaacatttgatcattcgccttatttaaaaaaattataaaaaaaattaaaaagataagtcacgtataaagtattaatcatgttttatcatctaacaacaataaaaataataattataaaaaaatttcatataagacggacagtcaaacgttggcacggaaacccagagtttgccttttttttgggacggagggagtagctgttagggcacccacaatggttatttataggctatctataagagatccatgtcagcatattttcctacttgaaagagattaaataaagagagagagcaaaattatctactaacctagagatagtctatagagaaaaacgagacaatggattagagagctatagatacccatgtagacatactattgaggtggtttactattaatctagtctattgctgagatgtacatgttttattagatagattgtgggtgctcttagtgacagagatggagggactgttatctcatgacct

SEQ ID NO: 2423 - DNA, 1501 bp, Oryza sativa
ggttgacttatggcagtagggctgatgctgaaagagacgtcagtgttgtaatctcaccgacttcgaaaatagcgacctggaattaaacaaaacagtgctgcatggtctgcattaattctgtctcttccgacatggaaccagtcgattagcaggtgtggttaaggtgtgtttagtttacgctaaaattgaaagtttggttgaaattggaacgacgtggcggaaaagttgaaagtttatacgtgtagaaaagttttgatgtgatgaaagaattgaaagtttaaagaaaaagtttgaaactaaacaaggccttagttgaaattaaacgtcgtgttcttctgaagctttaaacttgggtttcaatgtttactagggatttaatttcaatttcaacaaagagcagtacttgtgattggattgtacggatctgatgcagattaaactttttttctcctaatattcggcatgatttattgatttgcacataagtcattcatgaattttttttttgcagataataccagtggcggaggggccaatcccaagaggagtttgggccaatcgctggcccgtctctctccatcaatcctaagaaaagttgccgccggcgatggcgacgacgagcgacggattatggagcgcggggagtcgccggtagctgcgacgaggcagcgccgatttcgcgcaaaggttgttcagatattatcagaatcagcagcttccctgttcagtaagactgattatctgtcaggttttccacttctcctagctgaatgttcacggcttgttcttcgactgcattacagactagagagcagaatgatttcaggcttgttgttggactgcattacactgcaacctggctttcttaattatgcagtgatagttcggttaagtagaattttcatttcaatatgtatgacaccgttgactttttgcataacacttgactattcgtcttattaaaaatctagtataaatatgtaaaaaaaaggtttagactgtagtttcttggatgataaaacaaatcacaacatatttatacatttttttatggataagataaatgtccaaactttataccaagagtcaacagcgtcatatatttaggaggaagagagtagttgagttagctcgcttcgaatgtaccactaagcaattgagtgacgatatcgcagtatctgatgaatgatatcacattttgggagatattcaacggtaaatgactctgatgctgatatatatagacatcaatgactcagggtgctcttgttattatgtgaccgacttggataatggcggcctcgaatcaaccaaatagtggctttagttccaaacttttttgttagaaccctagcactcgatttcaccacgaactcaagaacacgataggtagctggaactttgtatttctctcacgatccaacaggatcggagccgccgctgccttcaccgccgagttccagatcgatgccgtttcagacagtacacagtagtttttaat

SEQ ID NO: 2424 - DNA, 1501 bp, Oryza sativa
tcccgcatcctcctcacctcgccctcgcccaccgccgccagcgtctcggcgatcttgacgccgccgaacaccaccgactcctttggtatgtacaccgagaactcgtcgtacctctccgggggcaggtgccacccgtactgccgcctcgccgccgcgtcctcgaagaacaccgggacgcagccggcgaggatggcgtcgaacgtggagcgccgcgtcggcgtgtcccccggcggctggaggcagaacctggagtgcagcatcggccgcatgtaccggatggggtcgtgcgagcacctgccgccggagcagtccacgacgacgcacgcgtcggtgcggttggcgcactcggcgaggatggagccgcggatgttgggcctggaggggcgcgacacgccgccggagaagagcatcagcgcggggcggcgggcgcggcgcgcgcgcgccagccacgcgcgcagccgcggcagcgacgccgggtggaacgacgtcgggtgcgggatcgcgtgctcctgccacggccacgcgcgggactccagcgtcaggaacgtgaggttgccgagcgccgggagccggagcagcgacgtggtgccccacagcctcgcctcggcggcggcggcggcggcggcgcgcaccggctgcgagtagtcccacgcggacccggcgagcaccaggaaatggtcgtggccatggcggcgcgccaggatctgcggcctgtcccgcgccaggaactcggccagctccgcgccgtgctgcgcggaggagtcgaggagcgccgggtcgagcacgtaggggagcgagtcgaggcccgcgtagtaggggaggtagacggcgtcggcgagggcggggtcggcgacgaggcagccgcgctcggcgacgcggcggtggaagaagacctcgaggaggcgcgtgtcggtgcggtaccaggagcggctgctggagtgggtgcgcgggccgaggccgtggttgacgagcgactcgcagggcggggacgaggtggccggcgtcgacgggtcggcgagcgggaacccggcgtcgcagtggcggaggaggtgcgcgttgaatcgaggcgggaggcgacggatgtggatccgtcggccggcgcacgggtccttccgcgtggcgccgccttcgccggcgccggcggtggcggcggcggcggcggcaaggaggaggaggaagaagagaggattgggcattttgggaggagagagaatgtgtgggtggtcgtgtaactgaaactgcacggttatttcagcggatgtgtggctcagatttcacactttaatatttttctcctgtgcagttattttcagcggttaaattgcaccggttaaaactaactgccatcatgtcgtggattaagctttagtgcatgttttgggggtagtttttggcgagttgcaacttttcttagaatttttaggtgttagaatctctctcaaacagttcagatttttatctaaattttaaaaatttgtatgaaatagaacttagaagttag

SEQ ID NO: 2425 - DNA, 1501 bp, Oryza sativa
atttgaaaatttttacaattagtatttttgttgttatgagatgatgaaatatgaatagtactttacttgggacttatgtttttaatttttttcaaaagattttcaaataagacagtcggttaaagttgggcgtggaaaatcgtggctgcacttaaaatgggacggagggagtaataataactagtatggtgacccgcacagattacgtgggtagcattcttttttctcgtataatggcgccggcatatatatttccatattttattattaaaatatattaaaatagcaacataacttttaaattatgcactaactggaccaaactaactaatgtgtactctcttcgtcccaaaaagaaacaacctagtagaggatgtaacccctcttgtccacatacattgtcctaggaggggtcacattccctcctaggttaattctttttggacggaaggagtaatatttatattgtactatatatgtgtgatagttattaattattttttaactccaatcttcttttaaacatctaaaaaagtattaatagtggcggagttgacggtgccatcaagcccgggtgactaataatgtctttcggtgatcgattataggtgccaattgctaacgagagtgaagatggcggagcctgggcggtcgcccaacctggccatgaagtggctccgccaccgagtattaagcttcttcccaaatgaaaaataagtgtgcaagtattacactttgaattggaggaaaaacataggaattttagaggattttaatcctataggaaaatttcctatgaagccctttgaaataaaggattgaatcctatcaaatccttaaaattcctatggaatggacaatcctatagagattttggaggaaatttagcaagagcttcaacctcttggtaaatttcctttgagtctatctctctcatccaattcctgtgtttttcttgcggttcaatcaaacggccattcctgtgttttttctgcgttttgcaatcctctattttacacttacatttctatcaaaatcctacgtttttcctattcctacgttttctcaatcctgccaatcaaaggggtgaaagaactaagggcccctttgaatcacaggaatgaaaaaacagaagaataggaaaaacataggattctgacagaaatgtaagtgtaaaacagaggattgtaaaacacaggaaaaatataggaaggaccgtttgattggaccacaggaaaaacacaggaatttgagagataaagactcaaacgatttattccatgaggttctacctcttgttaaaattcctccaaaacttgtatgggaagaggcattacataggaatttcataggattccatagggttcattcctttgattcaaagggctttgtaggaaaaattcctatagggatgaaatcctctaagggcccctttgaatcgcaggaatgagaaaacataggaataggaaaaacataggattttgataggaatgtaagtgta

SEQ ID NO: 2426 - DNA, 1501 bp, Oryza sativa
ttttttagaaaacagccgacataagatttacctaatatattagagagaataaatggcctggccgaaggccttacaaaagatttgcctattatttttcatttggattggacaattgtcatttctaatttgtatcagccaactctcttttctatacatagataagatatggcctacatatagataagagagttgttatttgctcgaggttgttgatgtgtattgaaaaagtttaggtggtccaaactgcaatattgatttctaagagtaaatatcataaaactgcagatatttgatgaaactatcgcaaaactatagatttaaaaatgtgtatcacaaaaccacatatatatcgtcaaatttatcataatactacatatttaaggcatagtatcataaaaccgcatatttaatgataaagttatcaaataactacatattttagagtttatatccatagaacttttatataagtcatagtatcataaaaccacccatatttaaagatgaaatttactcattttctaatatactccatatacatgataccaatatacatcaaatatttttacaaattcccacagctattcatatgtagtagtttgggagaacgaaacatatatatctcctcaaggaatatgaaacccccccttagatggcatatagattatcgtaccacaaacacatggttaggccagtaatcagtactccgttatatcatcgaccgtattcgagctatctcctatttgcattatattgcatccctcacatgcatgttgaaccatacagtaagctagcaaacaaacacacaagaatatttgtgatctggacacaacgtgcagaggggtcacattctcagagtacaaagctcactgctcaccacagctaagggactgtttagttggcaaattttttttttacctatacatatcacatatatatcacataggatatacggatacacatttaaagtattaaacatagtctaataacaaaacaaactacatattctgccagtaaacgcgagatgaatttattaagcttaattaatccgttattataaaatatttattgtagcaccacattcttgaatcatggcgtaattaagtttaaaagatccgtctcgcaattttctggcgaactgtgtttttttttgtctacatttaatactgcatgcatgtgtctaaactctaaacattcgatgtgatagcgtgaaaaattttgtttggaaactaaacaggccctaactccacacactgatcaacactaatcagcatgtacatttggccccaggcacgtccaaatccaaaccgcatttatcaattagcgctatgattaattaatcacctcgatccgccagctcgatccacatgcattgcctcccctcccatctccggcgagctatatatacccccctcgccatgcacactccccaaccacagcaaccaagcagcagcaagctcgagctactagctagctacactagctcgattagttgcagcaa

SEQ ID NO: 2427 - DNA, 1501 bp, Oryza sativa
tcatattaatagataggcccaaactaacatcatgcatgaataatcttataaaatattgaattgcattcaatatatgcaccctttggtggcttggcatgcaggtgaagtcatgtacaacaccacaaaccacacacacccaagaggtagttccccacctaacgtacctagcttgttcagcatgcaagtggaatggtttgggccctcatatatatctgccttattccagcaaaagagccaaacttcttgcctaccttttgtgctgatatataattaagctgttagattgagatgtgaattgaaccagttgtccatgctccatatatatatagaaacatagctaaaactttaggtctctttttttttggccttggcttttatggtagctctttggctagagcatgcggttttcaagtagcaagtttaaaagtcgagacgtaaatccaaatcaataaaaagttttttttttaaaaaaagctactcaaatctagttttcaacttcttagagagctacggttacttacaacaagtttaatagaaggttaatttaaaatctgcttttttgtttaagtttaggcattctaacttatatactttagctatgagacctaccttttgtgtgggtggtcttcaataaccacagtctttcgactgccaatgaaccaagccagcatacatgtggcagtgagaccctctggcaccttcaattcctggtgtttaagtctgcatgtgaagtggatgatgtcgatttagggttctagcattagtttgatttgaaatttgattgggtgtttttgcaggtggcaaacgtcaaagcttctcagtttatctctttgccgctgtgtgtgcgcatggtaggaaggttatgacgtgtttgtattctcttctctgtgtccccggccgtgtattttttcctattatcctctagggctcctgcgcttgcataggcgaaacccaccttgtgtaagatcgttggaagtaatatattcaggtgggtatttcgccctccggtgaccagtctaaaaaaaacttatatactgatcaatatataaacccaaacagaagttacggaccttagctagatgatctgaaaccataattgtacgagctctaattgtacagtacccatgtattacactagtattaattgatccgggaaaatctagcaatatattgtgatgaaaagaatatattgcaactaggacacacggagaatataaatcacaatcccaatacagttcatccaatcaatcatccatactcacggtcgatcgattcttgattcgccgattgggtaccacacgcatgatcatctaggcccccattcacgtactcatccatctacacatcttcttctcatcatctcctcctcctccatggccactataaataccactcgccatgcacactccaagcacacacaaagcaagaacctcgagctgatctactagctacctagtactctcatcttcttcactagcttttgcttgatcaattgcagcaa

SEQ ID NO: 2428 - DNA, 1501 bp, Oryza sativa
cttgattaatcggctcccagagcctttttcattttctcggactcccagagtccagctgcccagcagcacaacaatccgcttccactcggaaagcctagtctatgatgcccgcagacatcccgaatcacacagattcgtttctgaccactcaggtcatccatctgccacataggctgattctggttacaattcccacaccacaacaacttttcacaaagcacaggcaaacaaatctatgcaacgggaaccacctcacatccgcccatgaccgtgggcacggctgttcgaacagttagttaacctctgcagaggggtacactttacccacaagacacaaacttactccagacactggccggtgtcagaggttcgcgacaaagcctttcccaagccgacccagggatacctcatgccacatagaaggatcaaatcctcacataaacataggccattttaggcgttcacaaatcaaactccaaccacctcgatcggtaattcagcaagcttctcgttcttgcattaccaggaacccggtttggctccaaccgaccccgccccggcgttcccaactattggcatgcgaggtttccctgaaccgactagctacttagccagggtgtcccattccaccttgtggttgtactttgattatgttcgatgagtttcccacaggaatcggtccttatatgcgaatacgggacagtgccacataggcacaaccccccgcatcgcgagttttcacaattcattttattttcaaacacaccgacaccacatgtcgggttttgaaggcttcacaaacccatttcccaagttttcgacaaacaacggtgtatgtgggatatttggtatacgtgctcagagagcacgaataccgaggtaccacaagggtggagcgacaaggattcagggtagtacgacctacgaaaattagtacgactactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataaccgcaactatacgcaaacaactgaaaacctaagcaaaagaccaaaagaaagatcctatttagactaattagtagtgccactaaatagatctcaattttacggaattactggaagtggaacggagttaatcggagttacggagtgggtgatatgaattttggaagtttaattggaatttctggaataagaggaatggtttatggaatttatagaaataatattctcaagaatattattgacagtcactgtcatgtgggaccaaagaaaatggtttatggaattttgtaacaaggaattgatttatgggacaaaggaaaaaggatttattaaatccctgaaaaagaaaaggatggaggga

SEQ ID NO: 2429 - DNA, 1501 bp, Oryza sativa
aagaaaacctgaaccaaagtgaaaatgttagatataacctagtccaaaataaaacacaggcaataataatcggcccaaagtgcaattcactcaaaaaaaaaaatttatagctagcttagctcgatttgcagagcacttgacatactgactgagtgactgatgacgtaatggctcgaacaaactgtacacacgcatgtggaatgacgacgatgattcgacctgatgctagtattaattatttaattaaacccatactgttaaacaaattagcatgcttagcacattaatcatggagctagcctaataatgcatgttgccacctttctctgatgctggctagccattttgttcacatcgagtcagcctgttcatgtgatcgagtattcataatctgatccataatagtactattttgacggtgtgattaactaatataatcttgttcgtgatcctcgggatcagctccacaaagaaatatcagagtctaaactaaccagacaaagttataacgaccctcactttgcatgcatgtatgaaaaaaaaattagtgggaattcctcgcatggaattaagctcctatgatcatattgtcagtagcgaaggctaagacttagctgttctcaagctagatccatctttaggtacatccagctagccaatacaattcacggaggccatcccggctatgcgtgtacaaatggagcatattgactctgccagctcaagtacctaaaataatgcaggagagaggaatggatggatggttacgtatgacacgatgtatgcaaaattacaagtccatagcaagcatttcagaaagcattatattcagaacaagtattattcggcagatatataaagcacacatccatatattaatgtcaacaaatgcaactggtcaacttgcttcttccccatgaataatcgaattaattaaacgagaatatatgttctctctcctggcaaaatcttgtcctatctctcgtaaatacctggcccatgcagtacacaaccaagcaaataaatcatcacgtacatgcactacacaaccaaacaattaatcataacggatgcaaatattctactccctccttcaaaaaaaaaaacaaactctgggtttccatgtccaacgttgactatctattttatataaaaaattttataattaatatttttattgttgttagatgataaaacatgattaatattttatgcgtgacttgtctttttaatttttttaacaatttttttaaataagacggacggttaaacgttgaacacggaatcctaagatttgttttttttttgaacggagggagtaagcttcagctagttcagtacgtgtatagttccaaacagcaagctcgactcgatcggctataaatacctgacgccccaagcaaacgatgcaaagcaaacacaagctgaattgaagcagcctagctagctaattaacaccactagctaattaagctcgctcgatcacttcatcacttagcaa

SEQ ID NO: 2430 - DNA, 1501 bp, Oryza sativa
tcatggaaatgaacgcagccctgatcggctttacaagcatctgaccctaggaacaaattgtctttaattttctaaatgtttttcttcaattatatcgaaaataaaaaaaataatggttacattgtcgcacagctaattttcaatttttcagggtacgcaacatatgtcctacgggaaaaattataaactttagatgtcatgccgcaaatcttgcctacatgtttatagtggtaattgagcaaaattcctttgtatatgttcgtagactgcagaacacttgcatatgggatatgctgaaatactgacagagaacgtaatggttcgaataaacagtgtggaatgataacacgatcggagacctgctagcattaattaactaaaccgatatggctaaagaaacaagcatgcttagcacattaaatcatggagcccaaatcatgcatgtaagcatgttacgttgctagctacttaatttgtctggctcggacttactctcttccagcgattttgttcgatcaccgatctgtacgtgtgttcatctgtaaacatggataagcatggtagactgatctgataaattaatataatcctttaacgtggtcatggagatcacagctccgattccagtagccaaattaattaagcccataatttcttgtccaccatgtttctggaggcatagaggtcaagaattcacagctggtgtacttaatttgttcagaatcagaactccgttttaatttgttcattaaagacctaagagctaataaacggaagttaaaatcggtcgctacgtgcaggtaagtgcgcgtgcatggtcagctgggctacaaattttcatggaggtcactatgcgtgtatatatagagtatacattatagtgactctgcttaagctagctccgatccggccagtagtagattaatggtggaagaaattaaggaggctatgacactacgatatcgatgcacatttaggcaaaaataaaaactctccaaggcatgcaactatgtcagaaatgctcgatcagaacaagtattagtcagcagatacaaacacttccggccatatatttcaacaaatgcaattcgtcaacttgcttgcttggccatgaatcgatcgacgatcgaactgaaagaatatcatttttccctccaggcaaaatcttttgtccaacctctcgcgaagtacaccagctggtccatgcagtacacaaccaagcaatcatatatatgtccatcatgcatgcctaacaacttagacagaacaaatatgtctttttacttgagagttaacggtcaacacacggttaaactgacggtagtggcatgaaagagtgcgcaaatttggaccaatggcatataagaaaagagccaatttccaatgatatataagagatccgaccaattttcagtggcatataaggatccgaccttattctagtcctctagctactactagttcagtacgcatagtttcccaacagagctagctcgatcgg

SEQ ID NO: 2431 - DNA, 1501 bp, Oryza sativa
tcattatatcatggggataaaggtcgtagctctagctagttatacgttcgtcgtctggtgcagagacagcagacgacttccagctataagctagtttgttttcagttctcacttcagacttcagagttgtacagagttcagactttcagaccagtcggcaattagtcccacgcatccctgcattattcatcaaattgtccagccagtcgtacgtatttatttatatatatatatatatatatcttgcgtggatatacaatataatcctgtaaagctgttatgtaatctcctcgggataccagcttcaattcccatctttcaattaataatgccttagatatgcccatgcataatgcttctctgtacatttcttcagaattaactctgtttttcttttttctgtagagacctatacgtacaggctacagctaaagagaaaatcaaatcaacaggaaattatgcaaagttgcttaattggaaatgagtaatactttgccagaatacatccactgccacatgcatgcatgcatgaaaatgagcgacaaactggggtattaatcagagagctgaatatactatgtgcgtgtggagtatagcgtataccgtgcgcgcgcatatcctccagtgggctaagctccaaactcatcatcaagctgcagataataatctactccctccgtttcaggttacaagacattttaactttggttaatgtcaaactgttttaaatttaactaagtttataaataaatataataatatttataacactaaaatagtttcatcaaattaataattaaatatattttttctagaaacttggttaaatttaaagcagtttgattttgaccaaagtcaaaacgtcttataccctaaaactgaggaagtatcagttaactatacgcctatacctgctaatgaaccattatatgtgatattctgaatatatgtatatgtactgatatatgtgtgatttcagatattgtagttagttatcagcaagttcggcgcttgatctgagatatttactcgtatatatataaggtatataaacaacgtgacaggccacttagctgaaatatataaaactgtaagaaaaacaatagtcgatagatcgatcgtgaagttgtgtgatatatatatattgcgcaaatatattaggcttagatactggacatgattgataaattgctgctctgcacgtacgcctatgcatggctgaaataattaatcaacaaccaatctagctagccatttccttcacggaaaaatccttgtcgcatctgatctctagcaaaacaagcggcccatgcccatgcatgcaaatccatccatggacacaaacccagtgcacatgcatcgtgcatgcaactagctgcagtgttcatctataaataccagacgcctcagccccaatccaaaacacaagctaattaaagcagccttagctagctaattaactctactagctaagctcgatcacttcatcacacttgagcaa

SEQ ID NO: 2432 - DNA, 1501 bp, Oryza sativa
taaatgcctacacaaattgtgttgggtccacatttcaaaatgattcgtattaacaattatgtactagagctatgccaattgtaaaagaaaacatgtaaagttgtattttctggtcataagcattgaatttgtatttttttttgtttatattcagtagttagatatgtgaaccattcctttgttaggaatgacttgtaaactcttattacacaatttaaatatcaattacctgtgaagatcatgcatttcaatcataccacattggtttttcaactcaagtttaattaattgtaatcaaaggacagcctaaaatgtctaaattttgaaggaagatgccataaccattgtgttgatgattgtcagcttgctatttacaaagtcgttatttttttgcatggttaattatacatagcaccatggccctgttctaactccataaagatacggatttttcctcattttccgttagcacgcttttcaaactgctaaacggtatattttatgcgaaaattttttatatagaatttgctttaaaatatcatataaatccattttttaagtttttaataattaaaacttaattaatcacacgctaatggatttttcgttttgcgtacccacttttagtcttcatctatagaagattcgaacgcaaccaaactaatatacatgtatatatagagcgttcatacaatgcataagtaagatctgtgcaaataaaacctctcaacatattggtgtttaacgagatatcttagatttaattgaataacatggtcctcattttacctccaagttatatagatttggaaccaaattccaaacaaggaggcttatttggctactcatgaaactgaatgaaaactttaaggctgctttggaacgtaggattgtgaagataccataatctgcgttcgtttgtgctggtagggagcctatctctctagcacggaaaacgaaatgacttgttatcgtataattaattaagtactatcgtataatgaattgtttgtaacgtttaaccatttgtcttatttgaaaaaattggtgcaaatataaaaatagataagtaatactcaaaatgcttttgataataaagcaagtcacaaacaaaataaataataattctataattttttgaataagacagatgatcaaaagttacaaacaaaaattcaaagcgacaagtattttggaacggaggtagtattagctaagactaacctgaaaaatagattaatatgatttttaagcaactttcctatataattctttattgaaaaaaaacatgtcatttagaagtttgaaaagcatcgcgcgaaaaacgagagagatgggttgggaacacaggctaccgaacacaacctaaaaaagtatggacaggaactttatatcatgggaagaaacctcatgctacttttttctccaaaattcctataaaatggttcattctatagaaatttcaaagaaaccctagaagatcattcctttatcccaaata

SEQ ID NO: 2433 - DNA, 1501 bp, Oryza sativa
acggcaacggtcggggcggcgccgactagctacggggaggctactcgtgctaccaccgaaaactaagggggggagatggagcgaggaggaagaacggagagaggcactaccgtgcgggtcggggcgctgtgacgagaggccgacggcgcgggagtaatctctccggcctcgggccggggaagaggaaggagagggcgcggccgaagtccccttccgcgtccttgctcgtgccggctcctccggcacgcgcaacgacgaacgacgacggcgaacagagcacgggggcggcggcaatggcgcggaggtgaatgggagaggaagggaaagggggaggctggggtttaaatgggcggcaatgtcggtttgggaaccgacttagggcggtcaaggcgcgagctggcgctcagcgcttgcgtccaaatcggcgacagggcggtgacgccggcgagagggaaaaaggaggaaaaagggggagagataggggggctcgcccctttcttctttgggaaaaggaggagggagcggaggcgtcgcggcagagggaggagggaggctctgcctccgtcccttggaggctagcgcgggagtggcggggccgaggcgatgacgacggcgatgacggcggggcggtttggagcggcgcgacgtcacgggcgacaggcgcgggctggcgcggcagagggtgacggcggcggcgaccaggcggtcggccactcggcacgcgcgcgcgggaaacaacgggcggcgcggctgggcacgcgcgctggctcgcggggccgagcggctgcaggcgcggcagagcagcggggccgggcgacgcggacggcgcagacgacgcggctcgggcggggaaccacgcgggcacgcgcgcgagcgacggcgcgcgggggccgtcttcgcgagcggggagctcgccagggagaggagaaggagagcgaggggaagggacactcggcgcggcgcttgcgcacgcgcgggcagagcgaggggaaagggaggggcgctcggcgcggcgctcgcgcacacgcgcgcgcggtgcgctggcggggcggaggggagcggagggagagggggagagggagcgcgccgggggaggggagagggccgggggagagagagagagagagagagagagagagggagagcgggagcgcgccgggggagaggagagggccgggggagaggggaagatgggccgagagaaattcggcccatcgacccggggggaggcaaaatagacttttgcggaggaattgatttgggaagggtttggattcggaattgaactcgacgatagatcggggattgagatcttgagatggcacggacactagacgacaagcgaagaaacaaatttcgcaattagggtttttagagataattttcccgctaggcgccacgacggaacgggcgctacaacagtccaaattattttttctgtgaaacttgcatgtttgcgaagtgatacatcacatattaatataccttaatttttttggca

SEQ ID NO: 2434 - DNA, 1501 bp, Oryza sativa
tttccttttcgccaatgacagatatatagtttgtgcctaatggatatcgactcatcaagaagccatttccttttagtgccaatacacttatacacgtcatggggttcaaatagttaatcttcccaattcgcagcatagaacgttcagagaaccaaaactttctgacaaaagaaaaacgaccttcagattagcaaagctttctgaacaaaagacgactctcttccggagggaaattagctgttaaataggctactgggtccttgtacaccgatcactgatgaggacacatctccatttctgcgctttgcggaacatcctcgcagtgaatatcttcatcgcacatgccagcattgtcagaatccgtctgcatctcgtataacagaaacaaacattcagcaatgcgatatggttaacactaaacactggcgcggaagacatgtttacctgcaaagccgtggtccggccggcgctccagcccagcagccggccgacggcgtccgcgaacgcccggtgcgccatcctcctcccggcccgggcgaccgatccggcgtgctgcacgagcgccgcgcagccggcgaacctctttgcccgccctggcgccgatcccctcgcacacgaggcacaggaaccggcccttctcccgctccgcctcgtagaaccccctcaggcccgcgtccttctccagtagctcctggaagaaccgggccacattgccttcctcctcttcctcatcctcgtcgtcgccgtcgtcgtggtcgacgtgctcaccgaagaaggcgcggcaagcctccacggcggcggcctgcggggacacggccgccggcaccggcggctcccgagggggttccgccgccggcgggccccagccacagccccaggacgcggagggctcgggttccgggggcgggtcgcacacccacggcttgtccggtagcgcggcgcgggatggggaggccgcagcggcggcggggcggggcggggcgccgaggggctcccaccgctcgagatcgagggcgaggcgctcctgctgctttcgctccttgcgcttgcggcgctcctcgcgcttgaaggccgtcgacttgcccggccggaggagtggctggcggcggctagggtttggagcgagggaggcgtcgacgcggtggggctcggggtccatggccgtcgcgccgcgatgccgcctgccgcctgcggctgcgggtgtcgctgcttacgccttacgggccaagtggacaacctgggcctcggcctttttcccatgggggaccaaatcgagcgaagcgtggagagcgtggtcgagttcgggacagtgtcactgcttcgatgttgtggagctatcagatgttctgttcttgaaacgtgacagaacggatgtgtcaactcctgcgtatgcacgccctgtcacgtcatttaggatacacattttgcttggctatgcaacaactaaacgttggcacatgagctcacctaataaagaaactttactcgaaactatatagat

SEQ ID NO: 2435 - DNA, 1501 bp, Oryza sativa
ttcctcggattacactaacttcgtctggtgaattaattaggttgaactaattaaagagtttttagtgttccatgagtatagctatatcagctggaattttaattgtttttctttgaattagtatggtcttgaaagctgatgagagttgtttgcaaaaaggaagatccttagatgttatatatcaaaacatttggtgtgaaagggcacgtaatctagtggttgcagtgaactaagtagcacttcaagatgctgagttcaaattttcgtagaagcaaattttagattggattatttgagggctaagtttctaaattaaaaaggctgcatatatccggttggatttagaggctgggtataaatacccttctctaaaaaaatcaacatttagtggcaggtagtatgtatacttgattttgaattttgttagattgttgaataatattcttcttcccactaaaatacagtacctttacaaatctttcaacatcgaaatctaggaggctagtttagtctagggaccatccatcttttgagcatcaactagtagctagcaggaccacacctacttttatcctcagtaaagacataaatttggacccaaaaaagggagaaataatcagataagatcatttctatgaaaaggaaaaggatttgggattagtatcatcttctcatgctcacagaaaactgtcagcaataggtcagttcagttgtttgattttgattgttcattgctctagctaattagcagtatcaaatacataatgctggctcaagctatcctaattactaattaatatctctcccgttatgttaagtcaaactatttttaattacccaataatttgcctttaaaatactttatgccatccgtttcaaattatttgttgtttttagctttgttatatatgccaaatattactaactttgacctttttttagaaaattatatactttaacatttataaaatttagtattgttttaggttcaccatgataaatactttcattacataaataattcatatattataaactatatgaatatctaaaattaatatatagctaaagtacttaggaatatttgacttaggacaaagctaaaacaataaataatatgaagcggaggagtaaatataattgaagtcatttcgacacaaaaggatgaattttgaatgtatcctcaataagcgtacaatattattattgctttatttaaaataaatcaaacttttatatataacacttttagagagatgttatatgtacttacgaaatatatatgtatattgagctgcagaggtatactccctccatacatgaatataagagatttttttatcaaatttgttccaaaatataaggggttttagaattccaagacagcatcatgttctccaacttttgtactaatttattcatctaccatctacttttatactaatttattctcccacctactaatttttatactccctccgtcccataatataagggattt

SEQ ID NO: 2436 - DNA, 1501 bp, Oryza sativa
aattaatacaatgacgacgcatgtatgtattattcatacatatccattaacccatatatagatatttcattgcattatgtatattatgactgcaattaatagccttgtggaatcacatggattgactattacccaagctcatatatgcatgaggtgaaaaattgtttactttgtgtgagttgtagccctttataagttttaattcctcgaaaaacattcaagcatagggttaaacatcaaagcacactatactatttccatgtttctgaaataatttaaaaataccattttaatttattgggacagttaagaaaaataatcatgtgtatatatatgcttccttcacataagaaaccagcattttttttccaacattaagaaatatccactgtaagtttctttgtttcacatttagaatataaataatgtatacttcagggttcagtctacatatacctggaaggaaattagtattttgcagggagtgtatttatatttcgcagaatgaactggaaaaagggacatacttcctcagtatgcagtgtgtcaaccagatattcattgcccaatgttttgtgtacagccaggaagcttgggatgcagcaacggcgtcagaaaactgaatacacacacaaagaagtttcccttttgaaaaaataaagaaaattaaggctaggcagaactgaaaggttcaaaattcagaacttattaattattacacaagccaatacatcaattacttctttgcatataaaaagaagtaacaaatccgtattgcacacaggcatatgcagcaaagccctgcatatttcttgccctagtttcagagcaaaagaaattagcagccagctagctggcagtatcttccttcttaaatcttaacccacaagcttaattgttcccttgaaagaaattaatacatagatcaaagcaatgcacacacttgcactagctagcttagatttgttcttttggtagagctcatcgatccttaccttgtcgacgatcgaagagtgttgttccagtgtgtgtactgtgtagatcgagcttgcttagcttcctgtctgatcatggaaagctctcgccgagctcagggacaagccctgcgagccaaggttgtctactgtgaactgctcggcctcggaggagtagaacaccagctgatgatgcggccctggagccaaggaaagcagtgaagggaacggcgaggtgtggtgagccgcggcggcggccacctgcggcgagccggcgccgctgtcttgcacgctgccattattccatgactcaccggcgtagtggaacggcatggcggcgccggcggcgctgttgaccatccccagcgggttgttcagccccatgaaccggtggtagccaccggcggggaacctccccactatgtgcgccgctccgccgccgcccccgccgtcgacgtcgtctccccctcctcctcctccgccgccggccgccgccgcctccttctccgcggccagcgcggccgccg

SEQ ID NO: 2437 - DNA, 1501 bp, Oryza sativa
tcaatttgactgagaaagttaatttgggaacttaattgacatatatattaatttgacaataatacgtatgagaaaacatagtaattgatgatttcttaagctatataggattagccggcttatcaatcaagtgaaaacatatatgccccaatacatatactaggagtataatttattgatcctcctttttcacatgtcaatctgatcatcaatttgatcagttggtacggttatacgtatctttgacctaattaataaatggatcgaaaatcattttgctgcatttttacaatttcacaattaattgcaacgttgtgctgatcctttcctagcctcaatatactttttcctgggtacttcagcatcctcttcgaatttactttgctactagcttctaaattaagttcttaatttatttgtgactaggcaatataatgctacacttgcacgtacgtacaacaataagatgatgcttagctagattatgtttatcttcctatcatgcttcagtgagctgcttgccgttttcataattgtaggcatgtactatcaatgtgtttcatggaagaatgcctactattttacataactctatatattcatgtggaccatgtccctaagcggcctaaactctaaactgaactagctagggtaagagttgtaaagaggttccttctctagttaaacttagctaggtaggagttgtaaagatgtttgggtgttaataaacattaacctgcagatagaaccttatcttgttactttggcacggtatatatctagctatatatatgtgacctcatgtgtcgttcaaaataacaagatgtgtacacgtaagattaattgtactggtagagatctcaaattaatacaatgacgacgcatgtatgtattattcatacatatccattaacccatatatagatatttcattgcattatgtatattatgactgcaattaatagccttgtggaatcacatggattgactattacccaagctcatatatgcatgaggtgaaaaattgtttactttgtgtgagttgtagccctttataagttttaattcctcgaaaaacattcaagcatagggttaaacatcaaagcacactatactatttccatgtttctgaaataatttaaaaataccattttaatttattgggacagttaagaaaaataatcatgtgtatatatatgcttccttcacataagaaaccagcattttttttccaacattaagaaatatccactgtaagtttctttgtttcacatttagaatataaataatgtatacttcagggttcagtctacatatacctggaaggaaattagtattttgcagggagtgtatttatatttcgcagaatgaactggaaaaagggacatacttcctcagtatgcagtgtgtcaaccagatattcattgcccaatgttttgtgtacagccaggaagcttgggatgcagcaacggcgtcagaaaactgaatacacacacaaaga

SEQ ID NO: 2438 - DNA, 1501 bp, Oryza sativa
ccgtatatacactccgctaacatatggcattgagcttaatgagcttatcagctcgccaggtcagctccgatcctctgctggccaaattgccaatatacgatctatacgatcgatcgatcagggagagtgaagtgagccgggggagcaacaagggagagagcatatggtggtaaaaggacagtgacgcgacagcgacgacgctgatcatttattcctcagtgtaaatacccaccacaaagcttcacaggtcgtcttccacatccttctctccgacgacgctacctagctaagctgctgctctgtagctggcaggctagggtttacgctagctgatcggagctaccaccaacgccggtggttggtagctcggcggcggcgggatcttcttcttgctcgggttaattggcgagctatatatatatctagctcatcggcgggaaggggaaatctcggctgacttgaagggatcggaggaggccatatatatgcatggctgagttcttgtaagtgtttctctctctgaatacatctggagccggtttgggtgtttgatttgttaattcttggcgattattctatggatttggggatcacaaaattatgtgtgtgtgtgccttttgagagtttttaatctccccagctttccgtggtccttgattaggattttatgctgtggatctgagcccagatttgttaattcttcttcaattattttctgtgagactgtacaattccctcttggatttctttcgtacctgagttccatttctttttccatggaaggtttcttctctgaacctgcagtactgggtcgccaaccaaataatctttgtttcaattgcaccggatcgcctctctctgatccttttgcttccggaacgacctggttgatcgatctgtcaatttaattatccattttgcccactgctcttcatttttttcctttttttttcctgaatatagtgttcagttctaggaatccccaactgagtaaattaatcctctgtcaagcctccaaaaaatttcacctttttcgctcgccacacaaatttcctccctcgatcgattggtttcaaagagcacaatttaaaagctaatgactgctacagttaaagactgggtgcatgctgcaggccctgcaggattagctagctagcaaaagctattcgtctcggcataaaggctagcactcaatacaaaccccccgacccagccttctcctgttcctcattcccatgggcaaatagtgatcctttgtacgatccaattcatagctcttcttcccaccggcgagacgaatcatgcatggctgctcgattcaatcatggaatcatatcattcccacacatagtgccactgctgatggctcgcatgcagctcacccagctagagctgcaagcgcagcagggaagagccggtctttcgatctcgatctcgctactagctactacctaggtagatcgattgataggagtagagatatagctagctgttgctcgca

SEQ ID NO: 2439 - DNA, 1501 bp, Oryza sativa
aatgttttccttggtttccttccacaaaaccggctcctttcctttaccatcatcagtatttacttgctcataattgttaacagaccgtccaattacgaggccctttcttctctgctttgtcttgatctcaaaatactctctttccccatctccgctgacatctccaaataaaatgagttccaactctgagagctcttttttcctaccaacaaaatcagcattacgagggaaagggaattcctccttctccacccttcctctccacctattcacccgatcaaccacacttctcctgcccaattttgtggccaaaacaatgatagtttgaagtatgcaatgtctccaattgccatcatttgcttctaattgcacatctgacacccgagaaagagcatcaactgattccctccattcctgttccattccaccatataacatccaaagctcgccgccatgtctctcccacagttctcctctcttctcaataatatctctggcaaggcaatcagcagcacccaagtcaaagaatatagggatcagatttttcttgccaaagaagttcctcagctcctcgatggtataaggattgccaaatgattttcttgtaaggatgacaactccatatgtggaagcattcataatcctctcaatagtatcatggctgtgagaactccggcatctagacctgtcagaagcaaagcagctgattccatggatctcaagctctgcacgaagccaattagtgaacctcagtagtgaagccttacggccatgaaatcctatgtacacatcaaagctccgaagtctgttgacagaggtagctgatgtcgtaggttgagaggatgaagatttccgatataatccccactgtctcttatgcttctccttctgagttgaacggacaccagtgctagttgctgatgaactgccttgacatgggtcactgaaggtggaaatgaagctaggattgttatagacaattgctggagtgtcaaaattgcttgaagtgcaaatactaggaggaggagaagcatccgatggcaataaccccacagtggctgatggtaattgctcccgctttaacagagtgtcgctggaaagaatatcactgattttcagcacagtaccactcaaggaactattgttctcaggatgtgcgtgatctgagacacgggcagatagacatcgtggcgtgaagaaaggggattggttagcagaaacaaatgctgatgaagaggatgataggttccttgatggcgccgagaacaaagtccccgcatccgagctttcctgctgaagctccatttggtccccttttcagcagtatccagctcccacaagttagaccgtagcttaatgcatccccgtgaaaatcagtatctgcagaagaaacaaaagattccctccataatttgaacttctagaataaattttcataaactcaaactagaactttgagaatagcaacactttttactgatcaacacgacgcatgagcatt

SEQ ID NO: 2440 - DNA, 1501 bp, Oryza sativa; identical to SEQ ID NO: 2435

SEQ ID NO: 2441 - DNA, 1501 bp, Oryza sativa; identical to SEQ ID NO: 2436

SEQ ID NO: 2442 - DNA, 1501 bp, Oryza sativa; identical to SEQ ID NO: 2437

SEQ ID NO: 2443 - DNA, 1501 bp, Oryza sativa
tggtaaattgctcctgatgtggatgaagaaaggtatgcatgacatgttgaaactctataatcccgaggtaatatggtaagataatgaaggagtcatgtggtcagaacctttcatagctgctgaataagccatagcctgaaacttctgcagagaggaagcaaatcgtctattagacatggctgaaatccaaattctttaacccaattcagaaatttagcttttatccatactctcagaatgcaggtctacaatagaacatattgtgtcgtactagaataacttttagtttcagatgcccaaatctcaactaccctatagctgtgtacaaatattcaccccatgaaaccaagtttttttacacaggaaatcagaattatgcggtcatatttccaagggcatcactgcttacttatgcagtcacgctactaaccagctagcgacaagttatcacacacccaaacatgacatattgacatgctaccatattacctcgaaaccggacaggtcatcacggatgggctgcttcgagttcttccggaactcccgcgtcctctgatcaatttcatccagagaataagctacacaagacaaaaacacgagcacgaatcatacgcacagcaccaaaccgaacccctcccactttaaaattgagaatggtagtagaaacactgcaatgcgaagtagcagggccgagaggcatctaggagttttagggatcagagatcgcaccatagctgacgtagcctgtggcgccgaacgcggcggcgacaaccgcgaggacgccgcccttgagcaggcccagcggcttgcgggccggcgggggcggcgcggacgagggatcgcccgcggaggacgagtagtccgtggcggcggccgcgtcggaggcggcgacggccgccgcagccgccgctggctctgacgcgggggaggcggcggagaaggagcgggcggagatcctggggaggagcgggacgaggaggcgcgacctcgcgacgccgtccatggcgtggtggcccagcgagaggagggggagaggacctcggtgggtgggctcgggttttggttttgcttggagaagacgaatagagggtttaagcagggagagaggcggccgagcgcgagatggcgaggagccgaggaagggggaggggggagacggcggataggcgaaagcggaaggaggtggagccgtggaggcctggaggggagtcaagagtgttccgatgtggcccacttgtcagagagtggccactttttaacgagtgggcatatacgcctacacgatactcttctgtttcaggtgggccacagcccattagaagtgagccataaacgctggccattatgggccgagacaaagatttgagggcttctttggttggcttgggttggttggttgcctaagccaaccctaccaaattttgtatttctaaatggaataagtccattttgcctctctcatgtcttgcgcttgtgtgaataacatccctcaaccggaaaa

SEQ ID NO: 2444 - DNA, 1501 bp, Oryza sativa
gcaagctgatcctattcaccgtgcccatcataaatggaaatagttaaacagcttagaaaataaatgcctgtgtaatagctaacaatgaccaatacatgtcaagctcaaggaaggaaaccttatactgcaaatttccaaaagtttaaaagcattaaaggccattgaagaaattgtagatacagggtgatccagactttggacttacactgttaactttaagtaacagtcatgagcaatagaacatgcaatgatatttaccccagccaaataatgctaccagctactagttcacaccttatgtaaagtatttgttgcaagaaaagtctaagatgacagcaacctgctgagaagaacaactgacgatgtcataaggagagggagcttttcgataggtgccgtgcagttcaaagagttagttagcagtaggatgaagatttttgcacatggcaatgagaagttaattatggtgtaggcaacccaaatgaaacaccaaaatatgcacaagacagtttgttgtattctgtagtacagaataaactaaagtaatgaaagaagatggtgttagaaaatgaaacaatattatgagtaatgtgtgagcattatgggaccacgaaataaaaaaagaacatttttatgagcagtgtgttctcaatgagccttgaatgttatcacccaggataagaaacccttaagcaatgaaacatgcaagcgtttaatgtgcaaagttggcattctccacgacataatgcaaaagaagatataatctatgacatagcaagtcatgcatcatttcatgcctctgtcaacctattcatttctagtcatctaggtaagtatcttaagctaaagtgttagaacttcccatacataagtcataactgatgacaattgggtgtaacacatgacaaaccagagagtcaagcaagataaagcaaaaggatgtgtacataaaactacagagctatatgtcatgttgcgaaaagaggagagcttataagacaagccatgactcaaaaaaaattcacatgcctactgtggcccatatatcatgcaacaatccaaaaactcacaggtctcggtgttgatcgtgtcaacatgtgaccaccctaaaaactcttcactaaatattaaagtattgctagaacagagcttcaagatataagtcatgatcaccaacaaccatgttcaaaaagaaatagaaagctatggcacagcaacaaaaagcaaaagcatgcatggatataatctttaacatcatccatgtcatattgcaaaagaaagaaagagagaacaatacaaatgatgtgtcaattacacatccatcattatccatccaccttccgtgtaccacacttcatatatcatgagtcacttcatgtctggacattaacaaactctatcttaacattcaaatgcatgagactttatctcactataaatgcacaatgatttagcattgtttctcacaaaaccattcaagttcattagtactacaacaaca

SEQ ID NO: 2445 - DNA, 1501 bp, Oryza sativa; identical to SEQ ID NO: 2438

SEQ ID NO: 2446 - DNA, 1501 bp, Oryza sativa
tggctgcaacaggccacgccgcattatagccgtgtagcatggttatcttcaatgcattcagttggttagttgttgcaggacggctacaaatagcactgccaaacaaccctaatggtcttagggcttgtttggcacggctctagcttcagctccacctctcttgaaactggagcccagccaaatagtttcagctccacctaaattgggagcaggtttgggtgaagctctatcacaaaataaactagataggtgagctaggtttacgcagctccacaaccccactctagacttaactcctggagctaaatttaggagttggagctctaccaaacatgcccttagttctatgttagagacccaacaattttttaaaaagtatatgtcacccttgtactattaagtcaaaagctattgtcaacgtgtaatagcagatagaacaagatttgacaaacacgaacgaattatacaggtttgggcctccggagaacaataaatctactcccgtagtcccgttctcttgattaatatgtggaagttcggctaaatctggggcacctagagcttttgtgtattatcgtgtatctaactgtgttcaaccttcttcttggcaatcccttgtcaatttatacacctttcaaggtctacctaactcgggggaagggggggtgcgttgctaaggtactgtagatatacatcatgatctacactgtacctgctgtcataccgtctatcccttgttcattcttccatgtcatgctacgcagccccgcctcaaacatgctattgaccgtgcctctctcttaacataatggatcggtcaaagaaaagatggtttggggaggtgcgattcactgaatcacccatatttaatgtcctcaaccgactttgagtgcacttattaatatggaatgatgggacatgcgagccttggtgtcaggatataggtatgtgtggttcccctattggggttctcgtgcatgagcctacgccctagtgcaagggcacaccatgtgtgagtgtcaagaataccgacacaacgtacctgctggctcgggcatcaccatgcgtcgcttcttgggataatctctttacgagtgctcccgagttgccctgagcattcgccacgtgttgtccctaggacaatttcctcgtgggcgcctttgggctatctcaatcactgccacatgtcatctctcaaatagtcttctcgcaggtacttttggacttccctaagcacactgtgtcaccttgcagaatgtcttcgtgcaaatggttccacccgagtacccgactatgtgtaggtcctagacaacctcgagtgaggggtacaaccacgtatgtagttttagatagtacaggccatcaccaatcttcactagctttctatataggtcttggctacacgtatcctattgggcgagaggaatgggccaacgtcatgcctcccagcatagcggtgaggattttaaaaaacatcttactaatgatgatgatatgcatg

SEQ ID NO: 2447 - DNA, 1501 bp, Oryza sativa
gccccattgtaaatgaatggataagcttaaaaaaactcgtgccttagaaatacacgagtcaacgcccttggccgtcaactcaaaaccttggttgaattatgcctcttcttagttgccactttaccaatcacctcacttgtttgttggattatcaaacgtaaacggaattttaaattctaaaacttaattttaagtatactggggattttgtttattgcagtctactttcaatcttagtgtttaaactgctaataaaagtttcacttataaactattttggttgttttgttattttttaagctcatcaactgtaggtgtctttactgtgaaactttatgtgttccgtatcatacatctattccaaaatacctttttcatatgcgatatctgaatatacatcacatagtgctatcctagaaactaccagtagcattttttgaaaagcaaaatatgtgtcccatggctcaaaatatgcaagccttagcccatccaaagaaaagcctgcgaacctaatacggcgttaacctcgacggaatcaacaagtgggcctcaaatgggccttactgaaactgacagaactgcaagtcacatctttcaaacccgccacaagagattcagcataacgcacggtgtacatccctttcatctatttacaccaatgacaggtgggtacatcacccgcgcctggtcccacccgtcatggagaataacaaacccaccagcactttccagagaaacaaactccacgtgtgacaggacggatcacatcaacgacgccgacgccgcaagaaggcccgatctccggcccacccacgtcaccccacccactggctgcgcggccccaccgaaagctccagcgcccgtgaccccacgcgtcagccgcggtggactcggcgagcgacgcgtaacgcgcccacctcatcgcgaagggcggaagcattcagccacccccccaccccgtcgaatcgaacggcgagcggcccaacaacctaacgtctatgaattcgagccgcaggatgtggcccggccgcgctccgccgtccgatccccgcacgcccccaggatccggccgtagaatatgaatttgatttcgaaagcgaagagtgggaggagaaagaaagggggtggagaaagaaagagagagaagagggggaggaggagagaagctgcagcaagagggaaaatccactaatccccaactcggagactcctcctctctgaaatccgccattccctacccctccgccgcaaacacgcgcgcgtggggagctcgcggcgaatccagcctcgccagccccggccgcgcggggacgccttgcccccgatctggcgacggcggccgcgatctcgccgcgcgcctcggcggctgcggcgaattgggggtgggggtggggtggagtggagtttcgataggtgtggcggggagggagggagggagaaggggcggcgtgttgatctggtagcttcgtgggggttgggtggattagatagatggcgggga

SEQ ID NO: 2448 - DNA, 1501 bp, Oryza sativa
tcaccctgccgccgccgccgctccagattccgcactgaatctggaggaagagaaatatacagagaagggagagagagagagggggggaaggaggatagatagaggatgacatgtgggcctcgcattttttttcatgtgaatgacgaatggagcccatataattttttattttagtgccatataagtgccacatcaacaacacagatcaggtcaacatcgccacgtcaacgccacgtcagcaaaaccgccatccagaaccactgagggagtcaaattgcactagtttgaatagttcggggagtcatcctatccggttttacagttgaggatcacggattagattcgagttatttttaagagagtcaaagtggacttattctttttttattctgatcaggacgactcctacaggctacagatagcaggggccaatggtttttaagtagacatggatggtttttaagtagacatggacgggcccacgtctagcatttttaccgatggttttgtcagctacagtatcatacatgtttgcaaaagtttaatgggacgccagtgctgcagtttaaagttaagtctcacaaaaatgtgactaccatgtcacagtcgataggtgccgtacatgtaaaatatatttattatgagataaatttgtgacaagtcaacaaccatgcatagaaataatatattaggttagaagaaaccaaaaccaaaagcatatactccctccatcccaaaatgtttgacgccgttgacttttttaaaaatgtttgaccgttcgtcttattcaaaaaatttaagtaattattaattcttttcatatcatttgatttattgttaaatatactttcatgtatacatatagttttacacatttcataaaagttttttgaataagacgaacggttaaacatgtttaaaaaagtcaacggtgtcaaacatttatagaaggagggagtatatattttcataaacaaacaacaatgtgtttgtcatgtagcaatacaagaggtaatatgacgtggctatgatttatccaccttccgtgaccacatagcaggcacaactgattgttttacatcacataatgagattacgacttatttatctttcgtaactccaaaacatactaataaatccaaccgattattttaaatcatatgctcaaccaaaacatttcatcacaaaattaaagcaatacacaacatgcggtccagattaaaaacaatcttttaattgtagaacatgacaagaaggatccctataaaataaaaggaaaagaaaagaaaattgaaaataacaatgtgccgctcatgcatgtttgtgagtccacactcatctatccaccttccgtgtaccttactatctaatgagtcattccacatctggacattaacaaactttatcttaacttttgaacgaagatacttcacatcagtataaaaagaccaaaatatattaccgtttcacacaaagcattgagtttagtccacaagaaaaa

SEQ ID NO: 2449 - DNA, 1501 bp, Oryza sativa
ctctcttggatttccacggtgagaactctgccattgactagtactttgacttagaaattgggctaatgagccatgacacaagaggaacaagcaaatggcagagaaaactactgggaatttgatggttgctatttttcttgtggactaaactcaatgctttgtgtgaaacggtaatatattttggtctttttatactgatgtgaagtatcttcgttcaaaagttaagataaagtttgttaatgtccagatgtggaatgactcattagatagtaaggtacacggaaggtggatagatgagtgtggactcacaaacatgcatgagcggcacattgttattttcaattttcttttcttttccttttattttatagggatccttcttgtcatgttctacaattaaaagattgtttttaatctggaccgcatgttgtgtattgctttaattttgtgatgaaatgttttggttgagcatatgatttaaaataatcggttggatttattagtatgttttggagttacgaaagataaataagtcgtaatctcattatgtgatgtaaaacaatcagttgtgcctgctatgtggtcacggaaggtggataaatcatagccacgtcatattacctcttgtattgctacatgacaaacacattgttgtttgtttatgaaaatatatactccctccttctataaatgtttgacaccgttgacttttttaaacatgtttaaccgttcgtcttattcaaaaaacttttatgaaatgtgtaaaactatatgtatacatgaaagtatatttaacaataaatcaaatgatatgaaaagaattaataattacttaaattttttgaataagacgaacggtcaaacatttttaaaaaagtcaacggcgtcaaacattttgggatggagggagtatatgcttttggttttggtttcttctaacctaatatattatttctatgcatggttgttgacttgtcacaaatttatctcataataaatatattttacatgtacggcacctatcgactgtgacatggtagtcacatttttgtgagacttaactttaaactgcagcactggcgtcccattaaacttttgcaaacatgtatgatactgtagctgacaaaaccatcggtaaaaatgctagacgtgggcccgtccatgtctacttaaaaaccatccatgtctacttaaaaaccattggcccctgctatctgtagcctgtaggagtcgtcctgatcagaataaaaaaagaataagtccactttgactctcttaaaaataactcgaatctaatccgtgatcctcaactgtaaaaccggataggatgactccccgaactattcaaactagtgcaatttgactccctcagtggttctggatggcggttttgctgacgtggcgttgacgtggcgatgttgacctgatctgtgttgttgatgtggcacttatatggcactaaaataaaaaattatatgggctccattcgtcattcacatga

SEQ ID NO: 2450 - DNA, 1501 bp, Oryza sativa
tatttatttatttttggttatgactaggtgaaaggaatatagtaacatggagttgagatatcttctatatttagcgcagctgctcctacaagtggaattgtggattgatcggtctaactagaccaatatattagcaattgtttgccatggaactgagtaaatgatggcttggttaggcaaatttgaccaacattctgctatttttatactggagccctggaggcgggaaattcttatagagttgttagttgttatctaattttgtcatttgatatgtgctcctacattatctagtactaggttgagtttttgtgggataagggagtagagaacaacttaggtgtgacgtatgttgttccgaatgagtattagaaactttcagattcagtcccatgaattctaatcttggaacacagggggtgtttagatccatgggtgtaaagttttggcgtgtcacatcggatatacagacacacatttgaagtattaaacgtagtctaataacaaaacaaattacagattccgcttgtaaactgcgagacgaatttattaagcttaagtaatccgtcattagcaaatgtttactgtagcaccacattgtcaaatcatggagcaattaggcttaaaagattcgtctcgcaatttacacgcaatctgtgtaattagttatttttttcgtttatatttaatactccatgcatgtgtccaaacattcaatgtgacagggtaaaaaattttgccaggggatctaaacaggcccacaatgcaatagcatggaaattgacacaaaataaaaggcgatgatttttcttcttttggacaaaaaggaatctttccttttcctttgtccaaaaaagaaatctttcattggccgtattcatagcctggatgtgcacgtacaattgttcttagatatataatgaagaaacagaaaccagtgagagcagctcaataattttctagttcatcttatattctccatgtagcatccaacctgaaaaccatacgattactgcagcacttgtttccagcaatagaccatattcgtgagcagatgatgacatctttgcgctgtaagctatttttgtaggagtatttgtcttaaaaagttatatttggtaatgtgtctgaatctatccatttttaaccttgagttcaggtttctgcagtacacgatcccttaaaacaaaattaaatggttaacaatttaattactggtattcagaggactctgtgacttttgtacttatcactgatggtaaattgagaacacttaccttttcctggatagaatctctgctttgaccagataactttcttataacatgttaaggcatggtatcacatatacacattgaaaaatattcctgagataaccaaacatggttactaatgaaaagtttgggaattagttgaatttatagtcttattgtgttgacctttttaatatgtttgtatttgcattctgcacatgagcttggtcctgtatttatttgtcttg

SEQ ID NO: 2451 - DNA, 1501 bp, Oryza sativa
gcagggaagcaggcagcgagtgcaacgggacacgtgaggtgcgggctagcacgtcggggggaggctgattgattcgttgcgtggagccgagccggccgggcgctgtcggtggcgaccggattggttggggtccccgcgggggttggtctcgttactgctctgccaccacgttgccccgcccccttgctgctgctcaccaccattgctcatcctaccacaggctaccacttcatcatcaagattttagcacagctactgctactcatttgatttactagtttagtactgtagtttgttttcgttgatccaaatcaactctgtttctttcagcaatgcaaatcagtgttcagtgaatggattggatgatcaccgaattttacagcgcatcatcggtcataattgatgcaagcagagtgattctaacagatagagagcaaaattgcaggcaaattaaagccagtgaaccagtgacttctgagaatgttcttcaggttttttttttttctgttgcaaaccggacagtggttaatactgtagtatgttctcccctacataacgatactaacaaacgttaaaaaaaatgttggaaaaaagaaccaacttgggaaatctgacgtgcccaccacacacactgctccaaccgtttactagccagcacttataccgacaccaaaacacgtagtaggaggcacagtacaagtggattattactcgcatcatcagtggtgcgtgcagcaatgtgacgtttttagaatgtgatttcttccagctgccatctgtctgaatctatagggttgtactactcagtacataagcattttctctgttctaaaacgaaacgacctaatattataaatccgaatacaatatagcagtttagtattgtattagaaacaacgtagcactacgaatctggacataatatagcaacgtaccatattagacaccccataatactatgatatatgtccagattcaaagtactacgttgtgttctagtacaatgaatatagacacaatatagctagctagtactcgattagacataatatgtccaaattcgtagtaggctacatctaattcattattaagttgctatattttaaaacggatagagtatgtttcaaggccccagaaataattggcataataattaatgaggtagagatagaaggtaacaaaataaggaaaggaaatgccaaacttacataaaaatatcatgaaatgaaatgccaagcttttgacaggaaaggcaaaaaaataataataaatgtataaatatatgtaatgtagaataactcaggaaaggaaatgccaagcttttgataggaaaggcaaaacaattaataaatgtaaaaatatatgtaaggtaaaattttcagaaaaggaaatgcctaactttttacagaaaggcaaacaaaacaggacagaaagctgaagctggtaagacaacagaaaactccccaaattaacttttcataatatatatatagacagagat

SEQ ID NO: 2452 - DNA, 1501 bp, Oryza sativa
ttaaaaaatcatattaatctatttttgaagtttaaaataattaatactcaattaatcatgtgcgaatggcttacctcgttttgcgtatcttctcaatctcctcaatcctctccttctcaaacacaccctaagggtctgtttgggggagtttctaactactgcaacttcttccaaaatcagaagctcttccgaacagtttagttttctggattctacaagtacagttatttagattctaagaaactgtacttgtagaatccagaaaatgaattagaagctagaagctgtgaaatccaactttttcagattctcagaaactggctactgaccaattgttttttagaattttaagctcccctaatacgtccaaggtattgttggaaattttaggactctatcagtaaattttcctgtctgtaatgttgtccaaaatagtttattttctctgtaaaacgcaggatcgacgatactcacgaatgtgtactggtagtggtaggcccgcctacatttctttttcgggctgtttccttttcaattatgaaaattttatggttcttaaaaaagtatcttgagatatctaaattttacataaattttttacattgaggtacttatctagaggtaccaaatttcacaatagaaagtgtaataacttttagtaacttttcaagaatggtaaaattacccaatgaattatggtccacgtactcttagccagtgaaaaaaaattatgtatatataacttttatacttacaaacttggcacgaattaaaacaattataaaagataaggcaaaatatacatacaactatacaagctgttttaaaaaacagcctaccaaaggggaccgaatttagaccgtgtaaactgaactgttttggtctgctgaaaaaggaaaaacgagatgatcatgaacccatgtaggaattcaaagaataaaaatgtaaaagccgaagactaccgggattatggccgtgtttagttccaaaataattcttcaaacttccaactttttcatcacaacaaaactttcctacacatataaacttccaactttttaaacacatcgtttcaattttaatcaaatttaattacaattttagtatgacctaaacacaccctaagaaggaatgagtttgatctaatcgcacgaatcaatcatccactagccttgtctacctcctccttggcctgcgcactagcttcttattctgtactctctcttaagaccaagtacacctataaatacatatggaggagtgagaaataaatacatgtggagtgagaaaagaagatagaacaaaaacgagcagtacggaattcaaatatattacgtttgtatgagaggtgggttaagtattaattgtgcgatatatatttaataaaataattatatgggtagactattagagtggatgtaaatgatgcgtcaattttttaaagctggcatttgactatattatgaaacttgttccctcacctcctctcgatgacaacagc

SEQ ID NO: 2453 - DNA, 1501 bp, Oryza sativa
ctcgcgccgttgcctccctcagctccgcaaggacgaggaggaccttggccgccgcccctcttcgccggaaacccaccggaacggggtatctctcggtcgccggtgagccccaccattcctctcctctctggcgtggtattctcgccgctccggtcgcctatttctctccctaaccgctccaatattttccctaggtcttgccggccctcggccgcggctccgccatggtcgggcgtcgtcggaccgccgttcccgtcgcctcccgtgtcggccgccaccatctctttccgccgccagccgcctccctgtggtcgtctcgccgtcgccgtcctcggtgagaatccccaccgtcccttctccttttttttcctcctccgccgctccccgtgcccgctgccgcgatgcgccgctgtcgccggcggtcgtctggccgtacgccgccgcgcgctatcgctcggccgagccggtttcatgccgcgcccgtgccccagccgcgccgcctcgtggccgtccgatcggctttgggccgatccgggccgtcggttcccgtggactgaatggtgggccgcctcggtggtctcggtccacggtggaccgatacccttgacccgctgacgtgtggggccccgccctgtcggcagccggccctctttgatgacgtcagcgcttaagctttttcctttgaaaaattaaataataattgcgcaataaatcggtaataattgtagaaatccattaaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagaatccgtcatttcggaagtccgcggtcgcgaggaaaagagttcggaagattgtttgaagaagcaaggcaagtcacacattccccttgagcatgttgatcccaatttataaatgttttaccgtttgcaaataaacatgcatgtcttgctaattacatgggatccgggtattacctatttgctttcttgtgccatgtttacttgctatctgtcctttgtcagcattgggtaataaatcgactagctcatgttacttatgtgacctagctagaactgtatgcttagccatgcttaattaccactagctcagttgatgggataattgcagtattagacctcctagtatcatgacatgacgagctgcgtgctcgagacatccgaccatgtgtcatggtcgtaattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtga

SEQ ID NO: 2454 - DNA, 1501 bp, Oryza sativa
gcgtggtgatgggcaatgggctggaggaggcgcggtgctggcacctgcgggcggtggtgttggcggtggagggtgccaccgggcggcggctacacgccgcagaggccgagctggggctcgccgccgatgaggggatcgacgaggcggaactacggcttgtagaagatcgggtcatagacaatgacccaaccgtggccggagccaaggcagttgctcctttcagggaggagcatggccaacctctcgtggagcgcggtggagatcctcggggacagcaaccatgcgttgtggcgattccgccagccgcccgcggctgcctggcgctggatctaaaatcgatgaaaaaaacaacaaacaatatttcttacatgatagaaaagggagatcttagatctaaatcaataaaaaaagcaacaaccagtaattcttacatgatggaaaatggatatcttagatctaaaccgatgaaaaaactacaaccagtgatacttacatgatggaaaagggagatcttagatctaaatcaatgaataaacaacaaccagtaattcttacatgatgagaaaaggagatcttagatctaaatcaatgaaaaaacaacaactaataattcttacacgagcaaaataggatgatcctccctcttcgagaggcagggcagatcgagatcctagttctaaataaatgaagaaacaacgactaataattcttacaccagcaaagagagaggttggcgaggggctcgttgccgccttatccctccatctcccctcttattcttcttccatcttcctctactccatgggatagggggcttaggccccaagtactcgcgttggatccgccactgtatagaggggatgggaagagagagataattagggaagaaagtatgagtataatgaggggagatatagctaaccggtgctagagaaggataatcatatatatacctcacccttttatagagaaagaattaaactccattctaaaactagaatataattagacagagcgaccatagacacatattataattataataagagcggttagatatccttacagattaatatagtactatcatcgctagtattagctttgtgcttactcgccctcggaagtttatatgaacaaaacatttggaaaataattagaatagttgtttgacatgacataagaaaaacacaaggaacaattataattttccccctcaaaatccttttgcaatatttcatactaccttatgggatattgttattgtgctgtaatcctttccactcgttcccattcctatttcaaaagtgcattaaagccagaggctatgagacatgttaaatactccatacgcaagtttttttataggctctacacgcattttgaatatggacagtgtcgtttttttccccttagaggcttagatatcgaatttcctttgcaaatggaaggtatcagaatttttcaccaaagcagggttctcgaagcaactttgctatcctta

SEQ ID NO: 2455 - DNA, 1501 bp, Oryza sativa
acgtttggctcttcgcgatcacagaaaggggatagataggccgacacgcgcggtacaagctggattagtacattattgtctccacatgtatatatgataatatgattattgctgtagcccgtaggtctatccagccgtacaagtaccactatgtatatatacgtacgtaccctgtggatcaaccacaaattatttttgtgacgtgctaattttataaagaggttttggaaggatttgctaattatattctaacgagcttatatggaagatgagtcgacaaatgcagccaacacgttcacatgattaattacgtccagcccggcagtctatatttcgacgtgaagttaattagctagcagaagatcctatttgtgggtcgtgtgtgattagtaaactgtctgtgtgtgtgtgtgtgtgtgtgtgtgtgtgtgtgtatgtatgtatatgtatatgtaatactgaacacattttaaatggatttttagttagagccgtgttagattttaaatggatattttggaacactagcccgtcgtcagtcatcactttactaatttgaactgatgtcgatcgtgaaaaattttaaaccgatgaaagggtagaattcctagcataaagaaacttttcaaacttacattacattactttaacttgcaaataaaaaattctacaatgctaaaatgtcaaatattcttgtggaaattctcttgtccgtcaatgccccgcttgttccatgcatgcatctccagctgccggctcacttgtattaaggaagaaaaatcccatttctcctttcagtccctgtccacttaccatttccttaataccctcacactagcacataattctctctgatgatctggtcaggtgtggcgctgcacactactgtgtcgacacatacccaagcagcaacaaaacaccccctctcctggatttccattttcttttcgtccaaccttgataatacatttttataaacctattcatgtcgtatattacttattaatttctccatcagatgagaaattgccgttgattaatccggagacgaacaactacacaacccgaccggtcgggtaattaaaaccaatttagctctcgttcgtcagcgccgatggctaagctcgctgccggggcgcgccggccgcgcgtcccgtcgcggggcccgggcgtccgacgtggccgaccaggcgggcccacgtgccccctcctcgctcgggcagtgacgcccgtgtgggccacgccctgcctccccagtccccaccctcaccggcccgcctcgctcgcccgcgcgcgcgcgcgcgacgtgcatggcgcgcggcctcctccccccctcccgccgctatatatacccctcccttgcaaccgcctcctctcatcgcacactccaagctaagcctaagcgagcgagaaaaaatagcaaaagctagccggcaagcaacgccaactaattaggggagagagatattcatggctccggcggcggtggctgcggcggagg

SEQ ID NO: 2456 - DNA, 1501 bp, Oryza sativa
ggagtagaggaagatggaagaagaataagaggggagatggagggataaggcggcaacgagcccctcgccaacctctctctttgctggtgtaagaattattagtcgttgtttcttcatttatttagaactaggatctcgatctgccctgcctctcgaagagggaggatcatcctattttgctcgtgtaagaattattagttgttgttttttcattgatttagatctaagatctccttttctcatcatgtaagaattactggttgttgtttattcattgatttagatctaagatctcccttttccatcatgtaagtatcactggttgtagttttttcatcggtttagatctaagatatccattttccatcatgtaagaattactggttgttgctttttttattgatttagatctaagatctcccttttctatcatgtaagaaatattgtttgttgtttttttcatcgattttagatccagcgccaggcagccgcgggcggctggcggaatcgccacaacgcatggttgctgtccccgaggatctccaccgcgctccacgagaggttggccatgctcctccctgaaaggagcaactgccttggctccggccacggttgggtcattgtctatgacccgatcttctacaagccgtagttccgcctcgtcgatcccctcatcggcggcgagccccagctcggcctctgcggcgtgtagccgccgcccggtggcaccctccaccgccaacaccaccgcccgcaggtgccagcaccgcgcctcctccagcccattgcccatcaccacgccgccgcccacctccccgcccctgtgcgctgctcggtaagagagaagagagaggagagggaggaagaggagtatgataagtgggacccacattttttgtaataaataatttgctgactggattgccacgcgtacgccacgtaggacaaaaccgctccggattgggctgtgggggataatttgtccggtattttaagtttagggtgagtaatatctggtttttgggtttagggcggtaattcggttgaccgcgatagttcagggggtaattcgtactttttcctaagtattttttttacccaaactaacgtaagcgcaaattttatcttaccagttcaccataaatccattataatcatgtaccccgtcccataatataagggattttagaggtatgtaacatattctaagactatgaatctggtcgcatccctctagattctaaggtagtcctactttctctattttataatgtaagactttttagatttattacattatgaaatggatatggcgtggagtgtttcattgctagtaggagtaacagattcctagtatctgtccgtttgccattacaccacacaggcacacatgccacacaccaaaccacaggccacacacgcctgaactgacggggtgtcatcaaacggactacggagttgacactgtagactcctctcccccgcgtcgccccgatcatgg

SEQ ID NO: 2457 - DNA, 1501 bp, Oryza sativa
tcgggataaaaaacgttctcgaaccacaaaaccagatatgtggggtcccttaactatataaaaccggtcacctgagattcttcagtggttttgaccccggttttgatctaggtggcagctgagtaagcatgggacccacatgtcaggtgacacgtcgtcacctctcttttccccctttctctctcttcctcctctctctatcttctctgtgctggcgaggcggggcgcgtcgactaccaagctccaccgccgcacccgacgacgacgacgatgacacacaagcgcgaggctgggcggagaaggggcggtgggcaccagccgcaacgtcagcctctgcctccacctacgtcgccgcacccgacaacaatacacgcgtgcaaggccgggtggaaaaggggcggcggccggcggagtggcggcgggcaccagccgcagcgtcagccaccgaggccttcgtgaggagggcaacgacagtggaggacgacgccactgctgccgacaaggccgagaggcgcggagacgggggcaggagcggcgtgcggccggcgggggtagatatcccctccatcgtcacgtcgtgcggagaggccgagggagtgcaggaactcgacgcgcttgagggaatgtaggaactcgacgcgctcgcgcatgacatcgatggtggcgtggagctcgaggccagcgagctcacccgggtcgatgccgagagaggcgaggaacgcgtcgacgtcggcgcggcgggctgcacggccacgctccatgtcgaggaggctggggcgcgcgtagagggaggaggaggaggagggggaggggcgggggctgggccggggcctggcatgggtgggttcccgggagcggccggcgcggggtggggaggaggcggatgtggaggcggtgagacggaggagcttgcagagatgggaggatggggggagaggtggcggcttggggtgggcggagaagaggacgaagagaggtgatgagacgatgggaactcggccgctcggggcctcggggtagagaggcgcaggtgaccggccgagacatcgatgaaggggatatcttcctctgaatatggatcgtcggcttccccatcttcaccgagaccaattgcacgtcggcgctgacatggccctagcactcctcggtgggttcccttttattgctgcaccgacgccgctacaagatcatggttgggccctcggtgacgacggcgagagctcccctgctcccgcgtcgtcgtcgtcgtcgccgtcgccgccaccgccgccacgtcgccggccgccagacctcctctcccgcgtcgcccagtctgtctcctcgccatcagtcggccggcggcgccggcctgccaagagcaccaaacgagaagagagagagagataggagaaaaagagatgagggaaagggtgattgtcgacgtttgatgtcgcgattccggtatttgcatagtatggggatcgtcggtactagggtatacgcgagactgaggtaaaagaga

SEQ ID NO: 2458 - DNA, 1501 bp, Oryza sativa
gtggagcatatatatatatgcgctaggtgtttaagcctactattatggtatggtgactgatcagaagcaacctggctgggactgggaggaaagggaagggatatagcaagtttaatagtacagcccactattagctccaaatcatttatagccaatgtaatagccaattcatacaatagttgcttactatactattaatatttggtcccacctgttatacacacattacgtcttggagttcgtgctgcagctagctacagatctgtagcccgctgctcttctctctctttctttatctttttaaaatatgtttatagctggcttataacctactattgtatctgctctaaaggagaaaagagaggccatgattaaagatgaaaggtgcttactagctctgtgtggagtacagtaattaatctccgttcaattttcttcttttctactaggatccagacccgacagacatgatcgacgatcgtaggagcggtttctgttccaaacatgttctcagatttgatcagtggtaatttctcatgtaatctcatttttcgttccaagtcttatctcatgccatagggctgatatcttgtttgggcttagcagcaataggaatataatttaccgataaaacatttatatatacgaacgatttagaagacaaatacttaaaaaaaaactatgatgaataaaaacctaaatgcacctttaaaatttgttggtggcttatatgctgtgtggaaaatggtgagaggctaaaaacgaaaaggataacactccaacatcacaaacaagaaataaaataaaatgagaacttcacatatgcacccactgcattatttactgtaaactttgcttgttcaagcagcagagtccagggccctatgagcaagtttaataatatagcctactactaactccaaatcatttataaccaatgtaatagtcaatttatagaatatttgcataatatactattctcatctgtcatacacacatcacatcttgaagtccgtgctgcagatctgctcttttctcttcgtttaactctttaaaatatatttatagttgacttatagcctgctattgtatctgctctaataagtgtaactagtcctagctagcccacccaccctggattagtttttaacaacatggtttaccctgccaattgtcccaatgtcccattgaccctcctctgatcaccaaaatgaaccaacaacaattcaacaacacacggggagacactccctctcaccaaggaataaacgaggtctctcaccaaccaaaccccctcctactcctcctcccgtttattaccgcggcttctcttggcctcttgcggtttctccccgaccgagctagcgtccgcttcactcacctcgtcgtcttcacttcacttcacgcacgctcagatccagcctcgcttcgctgccccccacctccatggcggccgtgtcggcggcggccgcccgcctgcaccacctcatgagcctctgcg

SEQ ID NO: 2459 - DNA, 1501 bp, Oryza sativa
gggcggcgacggcggcgagtacacggcgagcgacggcaacggtcggggcggcgccggctagctacggggaggctactcgtgctactacccgagtctaaggggaggagatggaacgaggagggagaacggggagatgcactaccgtgagggcgggcgcaacgacgagaggccgacggcgcgggagtaatctctccggcctcgggccggggaagaggaaggagagggcgcgcctggagtccccttccgcgtccttgctcgtgccggctcctccgacacgcgcaacgacgaacggcgacggcgaacagagcacgggaggcggtggcaatgtcgtggaggcgaagagggggagggcgcccggggctttaagggcggcaatgtcggtttggaaccgacttgggcggtcaaggcgcgagctggcgctcggcgctcgcgtccaaacggcgacagggcagagggaggatgacgccggcgggagaaaaaaggggaaaaggagggagagaaagggggctcgcccctttcttctttgggaaaaggaggaggggagcgggggcgtcgcggcagagggaggagggctctgcctccgtcccttggcggcttgcgcgcggagtggcgggggccgggctatgacgtcggcgatgacggcggggtggtttggagcggcgcgacgacacgggcggcaggcgcgggcaggcgcggcagaggctgacggcggcggcgaccaggcggtcggccaccacggcacgcgcgcgcgggaagcaacgggcgacgcggtggttcgagcggcgcggctcgggcacgcgcgctggctcgcggggccgagcggctgcgcggctgcaggcgcggcagggcagcggggccgggcggcgaccacgcggctctcgcgcacgcgcgggcagagcgagggaggggcgctcggcgcggcgctcgcgcacgcgcgcgcggcgcgcgggcagagcggaagagggagggggagagagagagagcgcccgggagggaggaggagatgggccgagagagattcggcccatcgaacccgggggaggcaaaatagacttttgcggaggaatttgatttggaaggatttggattcggaattgatctcgacgatagatcgaggatttgagatcttgagatggcacggacgctagacaacaagcaaagaaacaaatttcgcaattagggtttttaagagataattttcccgctaggcgccacgacggaacgggcgctacagtcttcctccagccgccgcccgttcctctcccggccgaagaaactagcgccgccgtcatgtcgatacccctccacaagcgttttctcctccaattgaatgcgaaaatcggttttcctcttccccctctttatcttccctatgttttccccttcaatagagctcttaatcgccgtttatgccgcccgtttctcatccgccattgatggccgaagccccaccctcttcggcgtcgttcttctttgccggcgccgttcctcctccctgcat

SEQ ID NO: 2460 - DNA, 1501 bp, Oryza sativa
ctaattaatcatatgttgtgcagagctttttcttttcttttcttaagcaagtggctggaagctcttccctgtattatactaagaagagagaaggtgaaacacattgttcatggattacataacataaactgcaacccgagcaactaacacaagattatgaaaagatgtgttgtgccgagtgcagtgcacgctattttaccatcgatcaaaatattcagtttgtgactgtgttctcgtttctttacctgattcaccggtccaaactccaacgttgctcatcatctgcacgtgcacaggacctcatcgctggcggcacggagagctcatcggccactgtggattgggccatcgcggagcttctcaggaagccggaggtgttcgccaaggtcaccgaggagctggaccgtgtcgtcggccgcggccgctgggtcacggagaaggacatcccgagcctcccctacatcgacgccatcatgaaggagacgatgcgaatgcacccggttgcgcccatgcttgcgcctcgcctgtcccgcgaagacacgtccgtcgacggctatgacatccccgctggcacgcgggtgctcgtcggcgtctggtccatcggccgcgaccccaagctgtgggacgcgccggaggagttcatgccggagaggttcatcggcagcaagatcgacgtgaaggggcaggatttcgagctgctgccgttcgggtcgggccggcggatgtgccccggctacagccttgggctgagggtgatccaggtgagcctcgccaacctgctgcacggcttcgcgtggaggctgcccgacggcatgacgaaggagcagctgagcatggaggagatcttcggtttgtcgacgccgcgcaagttcccgctcgaggttgtcgtcgagcccaagctcccggctgacctctatgtgtctgcttgctgatgtatatctgtgtgttgcatgtctgttgattacagttgttactgcatctgtcgtcgctgcagtccggtaagcctgcagtattagtactggtgttgttgcttatgcattattttctgtctttgtaagagtggaataatagggcaagagtgagtcaataatatgcttgataataaggttttcttcgttcttggactctgatatttgtgcacaagacagattcatgggtactgctagtagatattctctatgttgaactacctggaatgttgagtcgtattgtaacaatataggatactatgccggctgtgatttaggatgcagttaattgttaatttgttagataatcacggctggtatggtgtgctatatatacatgtaatctcgcaccgattcgtgtgctatcaatcaacacgtaaccgcctggacctgagaaggccggcgttcaatccacagattcccaaacttcttcatggtatcagagcgattggaagaagaaatcgattctgcatctgaatctgaagagattgcatccgagtcatctgaagaagaggttgcatctgaaaagagca

SEQ ID NO: 2461 - DNA, 1501 bp, Oryza sativa
cacatagttaaccagatcgagcctatttccataagaaagataaatggaacaggagacgagccttcttttaattctctatactattgggaagaaatcatgtatgagtggtttggtgagacttaaaggtaatccaaggtaactgaaaggaaaggatcgttgcgtcattgcagagtatttgtgggaatcttcatcttttcttctgacacattaattggcaccatgaatgatttgttgaagtttattcttagactagtcgagtccacaaaatgtatgtaaaaagctttgagtcaaaacaattgtctagagcatacatatattactaggagcgtgtcatccgcatattgtattactagtaagtcaagacacgtacaagttgaaattgtcagtgaagattgcaaggtccctctgttcataggtcatagctttattgtgaatagattgtaggaggtctgttgctagttaaaaaaggagagttgaatgagactccttgtctcactccccttctggattgagatttttttccctggggcactccattcaataaaatggaaaaagttgtagatttttagatttttttttctacccaatcaatccacagttgccaatccctttacatatcagaatctctaggattacactctattcagttttaccaaaatgccttctcaaaatcaagcttgagtgcaatcacttatttcttggattttatagtaacatatgcattcaaaaggccatgctaggcaaaataaacataatttatcctctgttaaaaaatatagctacatttctagtagaaatttgagctttttgattggttgtttatgacggtgggagtaattgaggacttttatgagaataaattctttaaatggttttaagagttgagaatgtttctttatacaatattaaagttaaagttaaagggtgtgtttggagtttggacttggggtggacaaaaaacttaaagctcgtagcgagcttggctcggattgagtcgaatttgtagtcttaataagtcgagccaaagtagacttttagctcatgaagctcgcgaactgctcgtttagctcgttaatacaagaaatcaacatatcttcatgtacttcgtgattttaactagtattcagtcatttaaatacaaccgaactatttatatttagtgaattatttattagttagtgtttattttcatgtttatatatgataaaatggtaaatgtgaaattatgaaggtagaataaatacgttaacaagcctaactaactagcttaataagtcaacttatgagactagccaagccgagctaagcttctggatcgttaacaggctcgttaagataacgagctcaaacgagccgagccagctcgtaaaaaataactagttgaggtgggcaatatggacttatcctacttcctacatatctgcgacagtggttttttttcatagggaatatctactgccagtatgatgaatctattttgtgcacgacactccaatatcgc

SEQ ID NO: 2462 - DNA, 1501 bp, Oryza sativa
tctcctcctccctcccgggcgctctctctctctccccctccctcttccgctctgcccgcgcgccgcgcgcgcgtgcgcgagcgccgcgccgagcgcccctccctcgctctgcccgcgcgtgcgcgagagccgcgtggtcgccgcccggccccgctgccctgccgcgcctgcagccgcgcagccgctcggccccgcgagccagcgcgcgtgcccgagccgcgccgctcgaaccaccgcgtcgcccgttgcttcccgcgcgcgcgtgccgtggtggccgaccgcctggtcgccgccgccgtcagcctctgccgcgcctgcccgcgcctgccgcccgtgtcgtcgcgccgctccaaaccaccccgccgtcatcgccgacgtcatagcccggcccccgccactccgcgcgcaagccgccaagggacggaggcagagccctcctccctctgccgcgacgcccccgctcccctcctccttttcccaaagaagaaaggggcgagccccctttctctccctccttttccccttttttctcccgccggcgtcatcctccctctgccctgtcgccgtttggacgcgagcgccgagcgccagctcgcgccttgaccgcccaagtcggttccaaaccgacattgccgcccttaaagccccgggcgccctccccctcttcgcctccacgacattgccaccgcctcccgtgctctgttcgccgtcgccgttcgtcgttgcgcgtgtcggaggagccggcacgagcaaggacgcggaaggggactccaggcgcgccctctccttcctcttccccggcccgaggccggagagattactcccgcgccgtcggcctctcgtcgttgcgcccgccctcacggtagtgcatctccccgttctccctcctcgttccatctcctccccttagactcgggtagtagcacgagtagcctccccgtagctagccggcgccgccccgaccgttgccgtcgctcgccgtgtactcgccgccgtcgccgcccgagctccgtagcacccgctcgtcaccggcctcgctcggcgtagctccgcccaatccgacgctagcaacggattcccgtagccgcgtagatgctctcaccaccgggaattggcctctcgtgacctcgtcgccgtttcccccttctcccgccgccggttgccgccgccgcgattcgccgccgtcaagctccctccggcgaatccgagccgttggctcgtctcccctcgtctcgtgcaaccacccggtgtgctcgctttcgcctgtatcgccgtggttcgctccgccgctcgccgctgtcgtccgccatccgttccggccggtgtcgtcgtctacctcccgccggcccgcgtggcagccacgtaggcgccacgtcggcgccagctcggccaagaccgggtcgagccgaccccggtcagcccctccccgtgcgcgcgttccaccgtgagccgtgaggctgcgcgtgggcccgccgcatccgcgtccaccgcgaaccgcgcg

SEQ ID NO: 2463 - DNA, 1501 bp, Oryza sativa
tccatcatctaatcttggacaccaaatgttgatcacgagcagggttcttctggcactgggataccttgtagctttcaactgaaccattgattggtgactttaattgatcttatctctgacactgaccatccgctgccaggacggaagagaggtggaagagaggggttgctaaagataaggtactaaaccacttgcctactgatctgttgtgagtacacttttattgttcaagttgcttaagcaaacaacctagtatggtcgcatccccaccaatgatgcaaaccatacccctgcacacaagcaaacaacacacgatctagaagctaacgaaactactcttcagggaaggattgggtttaggtcatctccgggaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagactgggaggagaattttgaaaaactgtttgacaaagaattgccgaagggcgagaggagacaatttgcaaatagggttttcagaaaacttgtccttagggtttgaccatttggctcaacctacagtcgagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaactccatcttcagctcagaagcactacacttctgaaaaaggggaatgatagcaaggctgagtacaaccaccgtactcagcaagccacaccaacgatgcagacgtgcaaggggatacaaggacggtttgtggctatttgcataaaggcggttgtaaaacattttattgagcaaaacagcaaaactgttgagtaattaaagtaatattgaatctccactgatcaacgctacaccacgttgaacaggcccaaccaacccacctgtactacagtgcattgggtcgatttattaaggtgggactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataacccttccctaaccatccacaccacgctaaggtttcacccccacccctcaaaaggcagtgggcggtcccctcttgcgccgcggtgaatccggcagc

SEQ ID NO: 2464 - DNA, 1109 bp, Oryza sativa
ccgtgattggatcgactcctcactaacgagcgaacacagctcggcacccactcgtcttattaaaaattttttgaaattattatttattttatatgtgacttactttattatctacagtactttaagtacaacttttcgttttttatatttacaaaaaaaaattgaataagacgagtggtcaaacgttgcaagcaaaaactcaaaatcccttatattatgggacggagggagtagtactccatggtcccagtgagggctttttctctgttttttgaaaatttttttgctccttgaaatagttgccacgttgtctttattggtatagagctcctcgattggaccagagaaactggcagcaagctgtatcaacggtcatatcactgtttccctaagacccggtttagattatggattaattaggctgtagcgcatgttgattcgagagactgtaataaaggtacatggtttagaaaggtaccatccttgttctattgctcatgccggcggacgtggctgcagaacgcggtgtggagttggctgtacgggccgctttgaaatggaggattagcaaagaaattttagaggatttattttcctaagaattttttctatagagccctttaattcataggaagatgataggaaaacttccataggattgcattcatatgatcaattccatagaaaaataaacaagaggttagacctcttgtgaaactttcttttgttgagggtattctgtggtataatcaaagggctcttctctttatttcgggtgttttcaatttctgtaggtatattcagagtttcagacacaagcgctagctgcagttgttctatcttaattacagcaaggataataatacagcaagctgcttactcgtagtctatctatcagcttactcatataatagttaacttttcactataaatatatggtccacctgtttgtctcatagattttcttgattcttgtgcctaagccagctgtaaacttacagcccgcttctcatctctctcctctcctctctcatccacatcggcattcagacttcttatagccctccattcttaggctgctgccgctgcttatatagactaaccaaagt

SEQ ID NO: 2465 - DNA, 1501 bp, Oryza sativa
gtgtccccatgtcttcgaagatgctcataggggtagggtgagtatacatgcgttgtgagtgtatacgtggtattgtgtagttctaaaaaaacttgcaacacgtgatttttttccctttttgcacaaatatcgatgtgttctaatggtacagaaatcaaaattacgatgtagacaataagggcatgtttagatcccctgtcaaaatttttcaccctgtcacatcgaatgtttggacacatgcatgtagtattaaatataggctaaaaaataatcaattgcacagattgcaactaatttgcgagacgaatcttttaagcctaattgctccacgatctgacaatgtggtgctacggtaaatatttgttaatgacggattgattaggcttaataaattcgtctcgcagtttacaggtggaatctgtaatttgttttgttattagtctatatttaatacttcaaatgtgagtccgtatatccggtgtgacacgccaaaatttttcaccgttggatctaaacacaacctaagtttgcaatgtaactagatgaaccctgcatgttgctgcaggagttttgtacgataatagtagaaataacacgttggatagctagatgacataattttatatattttatataattttcatatttgatcaaaattttttaaaaaatataatggtttataacaatttaaatcatatatagattgaccatttaaattaatgtgaaactaatgtgatgtggcagaaggaaaataaagaagataatatagattattcatccaaagtaatatgaattcataagagaagaaaaggagaaaaataattcgaaccatagatcaatcatctaacggctaaaaaaattaaggtgatatgtcttaatgagattagagaaatagtattaaccacacttagtgagcatgattttatagatacacaggattacccacatttgaaatttcttttttttataaaaataaaacccgagacaaatttttaatagtctcgtttattatgtgctactaccgtgtgtaaatagggagtataaggaaagtaacatctgtcataaattagtaacagcagcgggcatttggtctagtggtatgattctcgcttagggtgcgagaggtcccgagttcaattctcggaatgccccattttttttccagttctttttttttcttaacctgcacactcccgctaacagcaacgcgacacgcaaactcgccgcgctgctgccaccgcggcgcgcgcatcgaaacggacgaccgcgacgcccccacccccagtctgccacgccgcagatcgccggggcccccgcacctgctgcactgcacgtcgtcgtcctcctcctctttgtcctgtcgccgaatatatcctcaccgtgcccatgcccatcacgcattcacgcctcacggagtcaatagcgtgaacaatggtgtccatggcgccttcctcctccgccgccgccacccgccgccttccccttcttcttctcctcgccg

SEQ ID NO: 2466 - DNA, 1501 bp, Oryza sativa
aaaaatattttgctgactaggatgccacgtcagcgaaaacacccatatatactgccatagaaccttgagtgcacgatttgtgtgaatttaggggtacatagaaatttctggttttgtggttaaggaacctcaaaaaaaatctcgctgttaagttgagggacctccggtaaacttattccacgtgaaaatgccggtatggtaatattgataattgagcccacaatattctgttttttttaaaacaatcttttagacgcgcgcacatcacacttaattacacacacctaggtttacaaatacgaccataactgctcgggtttagaaactatcgataaattggccaagttcaaaaaagaattcaaaatttagtaaattttgttcaagtttcactgtttttgtccccccaaaaaaaacactagggagcggttttcgttgacgaattgcccttgtatgaaccgttctcactcaagcacgctggtttttgctttgcggcgagccgccggtggtgttgctcctagctaggccctagctagttaatcttcttctccagcggattgtgtcgatcgaattcaattcgaatctcatctcacccctacatagtggatcatgtacgtatcacgtactcatctcctacacatcatctccaattaatctaattcagattttctcagaaagctcagccattacatcatccaattgcatatttgcattctcatctccatgaaaagatcgaatccggttccttcggccaactcatgtcccttcttctccacgtcgtggccgacgccgcaaaagctactccctccatcctatataaaatatttgacgccgttgattttttttaaaatatttgaccgtttattttatttataaaatttaagtaattattaattcttttcctatcctttgatgtattgttaaatatacttttatgtatacatatagttttacacatttcacaaaaatttttaaataagacgaacggtcaaacatgtttaaaaaaatctaacagcatcgaacatttaagtaaataagggagtaattttcagctgtttgatctcgattgccgattaattagttgacctcttcgcttatcctctacacccgtctcgatctttcgctcaattccgctttaatttggtgacttggcgatcgatcgagcgagcgcgccgccggttcgccgccacgtcgccgcggaactagaaacgccggcgccgggagggaatccggtaaagccgtaaattaaaggtgagtgcatgcatggaatcttggaaaattggaatcaaagctaagctagctaagctaggagagattgtgcgaatcatctagctcaaaattaatctctctctctctatatatatagcttcatggctgggcgatcgagctgcaacgacacctgcaggctagctagctaacaaccagctgagaggttaattaattatgatttgtatgagagatcgatcgagaagaggagtagcgagggagaggatggcggcggtga

SEQ ID NO: 2467 - DNA, 1462 bp, Oryza sativa
tcccttatattatgggacggagggagtacttctttagggaaacagtgatatgaccgttgatatactagcttgctgccagtttcttgtccaatcgaggagctctgtaccaataaagacaacgtggcagctattccgaggagaaaaaaatttcagaaaacagagaaaaaggtaatggtaggagggttattgattaatgatatagcaaagaatcatagtagtacttaccagtacaccggtttgattaatattccttgctccagtccaaagagaacggtctccaagcatctaattaactttggttagtctatataagcagcggcagcagcctgattaagatagaacaactgcagctagcgcttctatctgaaactctgaatatacacggatatttagggagtagaggagtgcagcaagcgcgcacgggcagaccatggatcagccgcatgaaccagccggcagcgagcctagcgaaaatgttcaggttctgtttgcaatctagtagtatcattttttctgcttgattggtctaaatgttaagaagattccctcaaaaaaaatgttgacaagaatttttttttgtttcgagaatgtgcggaagttttagtctttgtcagcagtgatagtttaaaaattatgatgtcgtcaccaatggtcgatatagatggcttgtttttgttggtagtgccctcttttaaactcaattacctgtatataattagaaattgtgatatcttcctacctacagctcttcaagggctgccgtgagaaaaaaaaaacttgtttgagattgtgttcagtttgaagtagtataaaaatgaattaaagaataaatttcactaaactagtactttgataaaattaacacaaaactacatatttaaaccatagtatcatacaactacagatatagaaataattttatcataaagctttacatttaaatcattgtatctcaaagcatagatttagtatcgtctttttcaaaacaaattttagatgtgctatccctacacctcttaccattgtaaaattttaaaatgtgtagttttgcgtaaaaaaaaaaacgatgatccatctgtagttttgtgaaggaaaaaacatgacactcaatttctaaagtatgttattttctaattaagatgctgattttacctcggttttcgttagcacgtttttcaaattgctaaacgatatacttcgtgcgaaactttctatataaaagttgctttaaaatattaaatatatttgttttttaaatttataataattaaaactcgattaatcaagcgttaaatgctttctcgattggcgtaccctaactttatcttcatcttaatctatctcaaatactaaatttgtagtcttgtgatactatgacttaaataattaagtactatatataccaaatttcatgtttttttaaatataattctctcaaacattccttggtttggtgcgaaga

SEQ ID NO: 2468 - DNA, 1501 bp, Oryza sativa
gtacggttggtactcacccttgctatttatatatcttttaggagagtgttgaagagaagcccttgtcggtatgcttgcgtatccaacaagatgatcggagtgcggtcttgttctaggtctcgttccctagtcgactgcctgtggcaagttaaccgggcctttatattattttgtcttccgctgttgttctctgatagttgttggcctacctggacctaatgtaagtatttaactcttttagcctgaattctttcgtgatatgttgtgatccaactatgtatgtgtgtaccaactactgatttagggattgatacggataaagacagaagatttccgatttctaaaatcgggggtctacatttgcttacttccattctagagggctgttttatgcaactgttgtatggacggtttacatgaagagaagtgctacaactatgctgctgcagcgctgctgttgttttaagctgacagtggttcattgcccatttattcttgataaataccagtctaccgaacaagacatggtcatgcttctgaaatatgttttttttttttgcgtgtgtttgtgcagctagtatgctgccatgctatcatatagaaagaaactaaaagacacaacaagggttgagcagagttctgtcgataccacaatcctattgttgacagttgtaagatcaaagtgtgttttgattcttattctgtgatgaacaattggcatctgtaattattggttttgatatttggagattactgtcgaagtagttttggagataattgattttcaggtgatgaacagggtttgctgttttgtcgggatcggtcagaccgggcggtggttgccggtcagaccggcttgtgttgagcggtcagaccggccggcccgcggtctgaccggccgacgctgtgtcggtttcggtttcgggttgttttctttggatatccgtgattgtttcatggttatggcttctagataaatactatacgtatgtaatactgttgtttgctactaatgagttaagttggggatagcttggtctcggaatatggtttctttgtttgtttcatgtgtaggtgactcgatgcctcgggagagtatttgcggtgatggaccgggagtcggcttggtggtaagacgatgtccgtggtggtcagatatcatgcggaatactaaggctagagttgatgcacgtggttgatggagattctatatggcatacgatggaggtattgtgtgcgtatgggatgcggagtcgaatttggaaggagtccaaatttagtacgattggttatgtaaagtttctttattgtactagtgggtttcctaaggtgtttaggactcctagtatgagtttggttcgtggctttaggctgcctacctcatatataaataaagggggagcgtgaggcttcccggtatcgcttttgtatcgcttttgagagtaattgagttgctagtttagttagggtttcgagtttagttgagatttttgtaaggagt

SEQ ID NO: 2469 - DNA, 1501 bp, Oryza sativa
aagtttgccattcgtataagggttaaagtagatataaaaggacttctttttttataactatatgtctacaaaaccattgaaaataaataacatactaagcgcatgcagtgtactaataattactaaggcttatgcttagttcaatagtgattttggcggtaggcttttagttgcattcattaacatgtgattaatcaaatattaatcactataaataaaaatgagtttattttatttttaaaaagcttttgtaaaaacttcttgttcaaaataaatcgtttagaagtttgctcctagctatcaagagagttaaaaagataaacgagttttcgaaccgagcttaatagcctgtttggcagaacttatgattctgaaaaacggtttgttggtagccatcttctgagatatagaaaagttgagttttctaacttccaaattttagtttattttgtaaattcgataacctcatcttctcataaactaaatgaaaagcgggactattataggtctaattcttatgtcattctatccaccagtgaattatggaactgggggatgtcaacgtcaagtatgccctcatctatctttagcaccagtgcaccagaacacttttcaaccgcatccacaatctcaatgcagtcaaatatagaatattctatgaagtaaaaggaacatactagttcagtataagacggttttatgaagctgtattgcatggttttctatttacaccctatgtaaactatagctactttaattatacttctgaagattaaagcagcatgtcttaaagttagcaaaatcatcacatatgacctgtttgttgataggtacatcacctaccactgatagaacaattggtcgtaaataggagcatctgcgacaagtttatgatttaaatgtttcatcgtaagaaacctaaccaactaatctacactcagcattgtctattctgttatttgaaaaaaaaatataatgaatttcaaatattatgaaagtgtgatacatgtagctaaagtagtggacatgcctcacatttttttttcagaaatatacatacagaggtaaaaaaaaaaactatgctaaatgaaattgtgtaacttcctgctgcctattccatacaaatttcgtaggttcatttccaacctcaacaagaaaaaatataaacacaaacagaaccgaatttccatatgtttgtaggcccagtaattaattgggccaaaatccctactacatgcaccattactgggctgaataatgggccaaaattagtgaagccaaaagtccaataggcatcgccaaatctgacgctccaaatcgaacccaacccatttaccccgaatctcaccctccacccccaactccggcgaccacctcgccgccatggccgcccgccggagccccgccgcggcccaccaccgcctcttcctcctcctcctcctcttctcggccctcctcgcccccctcgcgtccgcctaccgccccggcgacatcgtcccca

SEQ ID NO: 2470 - DNA, 1501 bp, Oryza sativa
aggcggtcccctccacatccgtgatgacctaagcgcacccgtcggccacctccacctctctccaagccatctctggtctgtccgcgagcgtcggctcccccactgccatgggcacctcccagcaagcgccaacctcaggtgcagcaagtctcagcggcgatgacgaagatgacgagctgctagggcttagctttgggctggggccggtgaggtggcgagcgatgggtagagatcgacagcgaccgagatgagtcaaggaagaggagaccaagagaggaagaagcataactgccatgtgtgtgtcacgtaggaccaaaaccgctctagagcgagtcaagggggcaattcgttcggtatgaaaagttgagggtgaaggttgtttgattttgtggtttatgggagtaattcgtactcatacaatagtacataggggtaattcagactttttcctatagcattggatagtgctctttaaggctttttccgtccaagccacatatagtctcgtaaacgaatttgagttccattttttaacagaaaagaacctggacacaaaactcatgtttgaccatcaaacctaacaaaaagtgagaatcgcttgatttcttttcaactaaagaaatagttttcttccatcaactttgtttcaaagaatattttgccacaccccttcctcatttattaacctgaataaccatttgcggagcaaacatctagtttgctcattcaagtttagaatacccaatcattataatcaggtttttttaaaaaaaaattccccaaaggatcgtaaaaaggttaacataaatattggtacgctcctcaacattgaattaacaagagttggattactacctgcagataataatttgcttttccaacaacttagcttttttttttctaaaacctgtcctctacttctttccaatctttatttaggttgatcctctaagacataggttttaatgctttaaacccatttggcacatttagagtttggatcgattgtattgatcaaatccgtggatgatctcgtgagtggaaagggtgcgaaagtaagaatgtaccatgaatttaaaaagaaaagaggagttggacaggataggaccgtcgcttctctcatgatcgattgtagtgatcaaatccgtggatgatctcgtgagtggaaagggtgtgaaaataagaatgtaccatgttttttttaaaaaaaatgaggagttggacaggatagggttgtggcttctctcgtgagtagaaagggagtgacctagacgtttttgttaggcggcgcaagggccgacccgaacacaacgctagagtactcacaaactagttgcaacctaaccacaattgggtagggcttggatgaacatccacaatcctcctgggccaaagtcggatatagaacaagcatccggcacgagacccgggggagaaatatctcctatatacctcgatcccccaacaacggccaaacctgccaactcccgccccctgcagc

SEQ ID NO: 2471 - DNA, 1501 bp, Oryza sativa
tgcatttgttttttaggcaattggagctgaatatggggaaggttttgagacatttaggatggatggaccactcaaggtcgatgtggtgagtatacgtcatttaacttacatggcaattttttctatatctagcatcctgtattacttccttaagttacattttgtataagtttcctttcattgtttcaggattatctgaacgaaaaattgcaagaatgcttccttcaaaggataagacatgctatgaagccagatgaagcatgtgggcttattttctcatgggacaacgtaattgtgagtttttttttttgttcttgtgctagtttgtaatagtgcaatgtctactagcctactagtgatatttatttcttctaagtggcacattaggccttctcgtctgcagttactcgttgtgaagatcattcaaacaaactctaccttacgtgttaataatttaaaatttgtttctgtttcaacttcattacgggatgctttgtttttttggtttgaactacactggttgattggtagagaagaacaagagtcagcttccttaagtccattcttctcagtagtttatagagctgttacaatggggaaacacttttaatcacctaggtggacatccacccatttgttgcatgtcaactaaatgggtatgaaaagaaaatcaaaaaaaaattgacaagatatattcatatgtaatatatcaccccacaaacatgcaagttcaaattcgacttctacaagttgtaataaaaataacaaatcaaactctgagtagtatacgcatattcacagttaaatttgttatttttgtttcaacttataaaagttgaattttaagttgcatgtttgtgtagtgatatattttatatcaatctatcttgtaaatttttttgaaattttttcatgatcatttagttgacatgcactaaatgagtggacgtccactcgagtgattagaatccacctccattacaatgcccattgttgcatctataattgactcagatttgtcatcctcttctgttctcttaggctgatacagactcactaaagttggatgcctggagacagcttgctttggaagaaggtatacctttaaaataaaaatattcagtgtaaagttttatgaaacatactattcctataatgttattgtatgggtccttttcttttttccgacaatgcaaactgtagaaatcattttcttactcgtttaagttcatattttgtcttcacattcagattctcagtggtatattgtctgcaaggtctgaggagcacatacattaacttactataaatataagattcttattgtgcaaccttttatgacttctcattcaattttgactgaataaaatcggtctaaactacttatttgtcattgaggtttgtgtttacctcactgccagggatgctaccttgatattgctaataaatttatttcatgcagggaaggatatcccaaatgctggtcatgtccaaaagagta

SEQ ID NO: 2472 - DNA, 1501 bp, Oryza sativa
tttcttgggcttcttgcctctccgatgatcgaaatgggatctcttcccgcgtgcaggtgcatccggcggcgtggctggggcgccctcgatcgggaagctttgatcttcgtaccctttttgcggtgggcgggcggcgggcggcggaggaggagaagatgggtgtcggcggggagaagttccagctggggacggtgggggcgctgagcctctccgtggtgtcatccgtctccattgtcatctgcaacaaggcgctcatgagctccctcggcttcaactttggtgggtgttgggagatctgggctcttttttttcctttgcttccccccaagcttcttgattggtcgcttgtgattcgcgtagatctgtgatgctctgcgaatttcgtaggggttgttttcagcgaggattgcttattgatttatgtgcttagatcaattgttagatttttttttgtagtgtttgatttttgtgaatttggccgtggtatttaatttagagatggggagagcatcattgtagagatagtggtaggataaaatgtttctcgaactcatgcagttctggtgaagcttttgaacaaaaaaaatttgctaagaggagtagtgaatatgaaactttgatggttttgatggtgtggattagattcacttgtttatactagtgcagtgaacaagctttagtagcacatctaccaggttgcttgacgcaggggagtaatatccttgtttgatctggtgctgcaatttgaattatgaactcatgcactgtatgtggaacttattgtcaagcttgacttgtgccttttttgtgcggaacataggttgacttgtgttgattgtagcctcctttttcacctaccattttctgttacttcttttctcaaatgcattgcaatgtattagtgtttgtagaatttacatgaatataaatgacaccaactgtttttccatacatggaattgtattttgcagccactaccttgacgagttggcatcttcttgtcacattttgctccctccatgtagcattatggatgaagttcttcgagcacaagcctttcgactcgagaactgtcatgggatttggagtgctcaatggcatctccattggcctcctcaacttgagtcttggttttaattctgttggattttaccaggtacaaggtttgcgatcttctttacgttgattcttgtaccggccagaatttcctagttaattcactgcagtcctgtgcttattgggtgtctggtacagtagtaaactagtagtgatacttatttttgacccttggtacaatgatagctagaggtacaggtaaagtaaatatcttcttgttgatgtgttgcagttttatctattgctgtttgtacaataaacttattacagaaggcttttattacagcacaacattttattgcaagcatttatttcaattgatgtgccctttcttccacactaatcaatccacctaacttatgccgaaatgtcctttatgtctaga

SEQ ID NO: 2473 - DNA, 1501 bp, Oryza sativa
tctaggtgtaagcactgatcaatgcatgtgttgtggatccccggccttcaataatatagaactggccggtcctgtttatcacttctttggtggatagacatcgacaagaacatttttttggttgcaagcttgtgacatcttgcttgaagcacagagttttgatcgatgtggggcagaatttgtgttgcccattcttcttgtctggagggagttatcctgttgcctgacctacatatcagcaacaggcctgtagttgctgtgtcttttgcagttggacgtgtgatatgtgatagataaccaagtgccagccaattttattgtgcaaataagtttttgacgattttgtagttgcaagatttgaccaactttgactcctccagtttttggagtatgcaaatacaaaccttatattttcttatctatattgacttgagaagactgggttatagaagcacatgatttgtttgttacggatgctgtgttatttttacactccttatgtaaaatgtatttttttttcagaaaatagtcgtacagtacactggcaatttactttactataaatctattattggtcagtttgaaagacgtttcttatatattattcaatttctaatatagtgatattctcgaagtagtatgttctttctatttctaaaagaagaaacatcactatcgttcgctagtacatgttattatgggctttccgacagtgaaactgataagatcatggatgatatgatacttttgcctcctccatagctgtcaatggtctggtccctgcgtttctgcatctgatttgtctaattttgcatattggacatcttcattagtaagttatatgttggccttctttgatagaatttagcattctattttacaaagtgtgcaagacctactcttctgttgtcttagaccattggataattttgttttcccctttgtatgagcaagtcgcttaatgggagctgaatataagaacattgttttattagcagtttacatttctggctttcaagtttcaagatcatttactactgactattgccctttctgtactctctttgttttttaatatatgacaccgtttattttttttagatacgtttgttcattcgtcttatttaaataatttatttaattatcatttattttaatgtgacttgatttatcatcaaatgttatttaagtatgactcaaatatttttatatttgcacaacacttttgaataacacgaatagtcaaatgtttgtcaaaaaaatcaacgacgtcatatattaaaaaaggaggtagtactagattacattttccatgaatgttgagatgaatcaatgattaacttgaaattttgggtcactgaagtctgctttaagtttgtactacagataatgttcctgctgtttctttcttattctcaagtgtattactagtgtatgtgcatttttctcattttctcacttgttcttggaaatgcagtcaggtcttcacccttgagggaat

SEQ ID NO: 2474 - DNA, 1501 bp, Oryza sativa
ttcttttatctgtgtctccatcactgttcatttaaaagaataattatgttcagggaataaataactagcatactagttaaattggagactaatattgaaaccatcatgaccaagatcttacaaatctcatggctagcaaacgaagtatgttcttattccagcatgtaagacaagaaaaagattatggtctcattccttaccttctaagttatcggagagccacttagaactttttggactaatatggctatcccaccaccatgagctggatttccttgattgcgtcttttgcattttctccattttgataagataatgaaaacaattccctcaagggtgaagacctgactgcatttccaagaacaagtgagaaaatgagaaaaatgcacatacactagtaatacacttgagaataagaaagaaacagcaggaacattatctgtagtacaaacttaaagcagacttcagtgacccaaaatttcaagttaatcattgattcatctcaacattcatggaaaatgtaatctagtactacctccttttttaatatatgacgtcgttgatttttttgacaaacatttgactattcgtgttattcaaaagtgttgtgcaaatataaaaatatttgagtcatacttaaataacatttgatgataaatcaagtcacattaaaataaatgataattaaataaattatttaaataagacgaatgaacaaacgtatctaaaaaaaataaacggtgtcatatattaaaaaacaaagagagtacagaaagggcaatagtcagtagtaaatgatcttgaaacttgaaagccagaaatgtaaactgctaataaaacaatgttcttatattcagctcccattaagcgacttgctcatacaaaggggaaaacaaaattatccaatggtctaagacaacagaagagtaggtcttgcacactttgtaaaatagaatgctaaattctatcaaagaaggccaacatataacttactaatgaagatgtccaatatgcaaaattagacaaatcagatgcagaaacgcagggaccagaccattgacagctatggaggaggcaaaagtatcatatcatccatgatcttatcagtttcactgtcggaaagcccataataacatgtactagcgaacgatagtgatgtttcttcttttagaaatagaaagaacatactacttcgagaatatcactatattagaaattgaataatatataagaaacgtctttcaaactgaccaataatagatttatagtaaagtaaattgccagtgtactgtacgactattttctgaaaaaaaaatacattttacataaggagtgtaaaaataacacagcatccgtaacaaacaaatcatgtgcttctataacccagtcttctcaagtcaatatagataagaaaatataaggtttgtatttgcatactccaaaaactggaggagtcaaagttggtcaaatcttgcaactacaaaatcgtcaaaaacttatt

SEQ ID NO: 2475 - DNA, 1501 bp, Oryza sativa
agtaattacgccccccttttgaatgggcaatttgtgaacttcatgaaaaaaggcgggtaccttaggagcataagtactgaattttatattctaattgatcaaatgaatatcccctcgtttattacttgacattcaaatgattataaaaaaaataatatgatagattaatctatatatgatatatcatttcacaaacatgtaactaaataacaaattaaactaactattatgcatactcatatttatatttgttttttttataatttatagaagttaaatttggtgttgaatgttaatttctagagtgatatatcatataataatctatttcattaattttatttattttttctaattatttgaatgacatgtaaaaaataaaagaacattccctcaagggattagatagtttgctggttcaatgatgcatttttatttgactagtatatatattattccctccgtttcataatgtaagactttctagcattgctcatatttatatagatgttaatgaatctagatgcacatatatgtctagatttattaatatctgtatgaatatgggtaatatgctaaaaaagacttgcattatgaaacggaggaagtatgtcgccaggctcacttaacatgtaggtctagatcggtttaaaatgctgcatttaagtcggaatcagatcatgtatacatgtaacacaatactggtaagtagtaagaaatgccgatctagggatgaaaaagaataactgagataataacttaccatgcaattttattattgcacaaatttaattaactgtttagtttgatacttggcctcatatatagtacgtagtaattaattaaaccatctcactaggctccaactagaaatcagatccacgtctactagtacagatatgtgatgagcagatataagtgcatctgccacacatcactgaaccagcacatggatcacattaagcacgtcaatgtatgctaattaattgattaactataccatgcctaattgcttaattagcagccaacggattcgattgatcccattcgccaaaaccggccggagtcgctctcatgaaaacagcctcagatgaccttgaagtatggacagaatacaatagcaaaccgatcgaataattctatctctgcttacataaaagcaaaagcaaaagtaaacacacacacacaaagcaaaaacaataaatcagtattctaaaaataaatcagtaacatcaccacaccgctctccaagtgtcaaaaagaattaaaggacaacagctactggcactctccatgaactctcctggtcatcatttcacacccatatactgtgtccaaagtccaaaagctctaacgtctctagttttggaccatgcagactgatgaacatctgatgagatagccatacacgagatgcaccctataaataccccagctccccttcactccaaccacactacccagctcactgaagtagcaacgcagctcatcagtgtcaaga

SEQ ID NO: 2476 - DNA, 1501 bp, Oryza sativa
accggcgcctttgtgccgctgaccggtggggcccgcttgccggcgccgcccctcccctttgatgacgtcagcacagccttttcctttgagaaaataaataataattgcgcaataattcgtgaataattctagaaattcattaaaatggctcaaaaccttctaaaattcatatctaattcattcgaactccaaattgagccgttcaacttgcaaaattcatctaaaattgagctctacatgtttgtttactttttatgtactgtttccttggtttttattagagtttttcctcgttttgcgtgccagcgtgtagtttccgtcgtttcggaagtccgcggtcgtgaggaaaagagttcggaagattgttttgaagaagcaaggcaagtcacacattccccttgagcatgttgatcccaatttacaaatgttttactgtttgcaaacaaatatgcatgttttgctaattacatggggtcagggttttacctatctgctcgcttgtgccatgtttacttgatatatgttctttgtcaaccttgggtaatgaatcgactagctcatgttacttatgtgacctagctagaactatatgcttagccatgcttaattaccactagctcagttgatgggataattacaatattagacctttttagtatcagagtgagctgcgtgctcgagacatctggccatgcttcatggtcgtaattatccaactaaaatgcaactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggcggcatgtcggcgcacggaaacgtgtcgtggggctgtgtcttgtgggtacagttgtacacctctggccagagtaaaactattcgaatagccgtgcccgcggttatgggcggtcgaccagattcaccgtgattagtctcacacttaataaatcgacccaatacactgtagtccaggtgggttggttgggcctgttcaacgtggtgtagcgttgatcagtggagattaatgttactctaattactcaacagttttattgttttggcaaataaaatgttttacaaccgcctttatgcaaatagccacaaaccgtccttgtgttccccttgcacgtccgcatcgttggtgtggcttgctgagtacggtggttgtactcagccttgctattatttcccccttttcagaagtgtagtgcttctgagctgaa

SEQ ID NO: 2477 - DNA, 1501 bp, Oryza sativa
ccccctttgactcgctgacgtgtggggcccgcctgtcggcgccggccctttgctgacgtcagcggcagtccttttcctttgtaaaaataaataataattgcgcaataattcgtaaataattatagaaattcatttaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattccccttgagcatgttgatcccaatttataaatgttttaccgtttacaaataaatatgcatgttttgctaattacatgggatccgggtattacctatctgctcgcttgtgccatgtttacttgatatctattctttgtcaaccttgggtaatgaatcgactagcttgtgttacttatgtgacctagctagaactatatgcttagccatgcttaattaccactagctcagttgatgggataattacagttttagacctttctagtatcttgttgagccgcgtgctcgagacatctggccatgtttcatggtcgtaattatccaactaaaatgcgactgaatggtgggctgtgggtgcatggttttgcgagtcgcacccatggcaattaaggaccggttcacgggaaaccctggaagacttacagtgcttaccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttagggaagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtcccaccttaataaatcgacccaatgcactgtagtacaggtgggttggttgggcctgttcaacgtggtgtagcgttgatcagtggagattcaatattactttaattactcaacagttttgctgttttgctcaataaaatgttttacaaccgcctttatgcaaatagccacaaaccgtccttgtatccccttgcacgtctgcatcgttggtgtggcttgctgagtacggtggttgtactcagccttgctatcattcccctttttcagaagtgtagtgcttctgagctgaagat

SEQ ID NO: 2478 - DNA, 1501 bp, Oryza sativa
tgatctgaaagctgttgacaccttctaagttctaacttgaggtttgcccctttcctactctcaagctcaggcacgtatgtgttaattagccccaaactcaagttctgcccttggccccgccaccatgttcgacctcaagcacaatctttatttattaacctgagcttaaccttgagtagatttggaggggagtaaaataaaagaagtatattagtcatgcgacctaacttgagtgatatgattgactcatagatatactcctactcaagcaagtcagcaacgcctattagagcaggtacaataacagactataagccagctgcaaatatattttaaggagataaatcaggagagagaagagcagcgggctacagatttgtaaccagctgtagcacggacttcaagacgcagtgtgtctatgacaggtgggactaggtattaatagtatagtatgtaactattgtataaataagctattagattagctatagattaattggagctagtagttggctatactattgaacttgctcttagtgcatagctcaaggcatcataaatatgttaccactatcagtgctaaaatgtggtggtggtgggtgtatagctcaacttacgacatcataaatacgtggggaggcaaccgatgaggagtgagaactgagaacattaatacttattactcacctgatggcatcttttcctccatgaagaggaaagaatgtaagcacagagaagagccgtagaaaagcaggatgggatcaatattatgattgaaattgaaccttttatgaaattaactaatctaaaataaaaatattctataagaataagtagcctaaaataaatttactaaaaataaaacgttccatcatattattttgtttcaaaacagacaactcttttgtcttgcttgaaaaggctcaagatgatggcctcatgttgatgaaaaaaatacacacactgatctaagagatttgcttagcttcagtgcaggtccaaggaccaaatttcactgttaacaccccatccattttttcaatgccaaccaaaaatgatttactcctaccttaatgcgtttagtctgagttaaaaccttcgatgaatttcagaatttgaataagtactcttctaaagtgtacaactcagaatttagaattcttttaatgcaatgccaaaacacgccatctattttagaaaaaaattaatttttaataatgaatttggatgagcacttatccggattcctcctcaatatttgtaatttccctttttttcttaatggagtactcctgcagagatcccggtataggtgtacaactccatacataaatgccacgtcgcattcagtatgtggggcccacaacgccatagccgccgggcccattccctgccactctgccagtgcccaccacgaaaaaagaattgaaaaaaaacactgtaaaaaaagaagcctttttcccctcataaaacaagtttttttccctctctctttagtctc

SEQ ID NO: 2479 - DNA, 1501 bp, Oryza sativa
gccacaatataagacatttctaataactaggaaggtggcccgcgcgtatgcacgggcacttatattattgaaaggtattgctagttaattatcatatagtccatctatatatataccgtgtagtatggccacaaatgaaaaatgcgagtgcaagatactcaaaattcttttgattaaatcgtctcatgaagacgtatgatataggaataaagggagggaagcatatgcatggtaaaaaaaaaagaaggagaaaaaatgaaaaaagggaggggaaacgtacgtacccatgtaagtaggtgcgtacgtatgccgcgggaggagaggtgggacctcgtagtatttagtttgttctaggatcaatttaatgtaatggtttataatattagacctaacgatttaagtgaaaatcaagaaatagatactttgatttttttttccttagaatttctaatatttgccctaatttattagagcaccacgtcgcagcttgagagcattttcatgaattttaaatgacttaacacatgtaattagaatattaactgtgcaatatatatgtatgggacatatggtaatatttgttccaacttcgtccatctttatatacatgtagagtgaaattaattttgtggcttgcaagccattagatgtctaattaatagcaattaattttgacacctatttacaattgttcagagtaactcttacatattaattttacgactttaatgatttatcaccatgactcgcatgaaaaaaaatatgtagtacttaaggttcaggatagctgaaattaatgaattatataatttatgtgatagctatttaagggtataacaaatgaattgacttctaaaaagttagaatattgtttaaagaagacactatttagaaacttggaaagtgtgcaaacaaaaatccaaaatatggaatcgggaaaaaaataaagggccttaaactccctttatcacccttatcatagtaagagttctattaatattcgtcaatattacgctcacatttataacataatgatccctttcacctttacgaacaaatagtacaaaatccaaatacgacataacacaaatacattataattattatataatcaactctcggtttcaacttaaacagagctaattagtgtggagaaaaacataacccatggtgcttaattattctctcgctgcatcacacctttaattttcttttcatgttattaacaaaattaatcatctccatatatgatttgatatatggcaaagcggtagctctacggtggttgtgatcaccttatatgtctcaaacactacaccttgtcacccatgcgaaaggcaaaggtgcaaatgtgcattgtgcagcgggcaaaaaaaaaagaatttcggacgctttatttattagcaaacaatagatacgatgattataataataagtccaccagttctagtgtaagtgtacattagttaatatatattttaaattgttaatttaatgggta

SEQ ID NO: 2480 - DNA, 1501 bp, Oryza sativa
ttctgcaaactaggggatcactctggagtctggtctctggtgcagtgaaggtactattggaaggtcaaatatgcaaactaattcttgtaactaatgaaactgaagttcagttccatcttagatgtatttcagttgattcaaggtttattccttttctggtttttgcgttatcctgtccatataaacttgcaaaacccaatggtttttttaattaactgtaatgagcaaaagtccaggtaaaaccaatggtgctatcaacttctcaggtgtcaaggtactgcataaacttcgctgtcacttacctagcacagatgttgaagacttggagacaataaaacttgagttgatgcctgtattcttgctgtaaaaaactggggcagaaactccaggttatttcacttctgtcagaaaaatactaccggtaaaaagacgaagaaaaaaaagaggctctactcccttttttgtgccatccccagaaaaaagaggcactgcaataagtgctggttaaaatctcatcatcagactaattctgaaacctgcttccaaagttcagaacaaaagaacatgggcagccacaaaccatgaaaccacactcacgccatcccttgttactctcaaatgttaaaccctttcctcctttaacgcctaagggctcgttcggatcataggatagggaaagaaaatataggataggaaaagtataggaataggaaaagaatcaaagcgtgaaaaagaggaatgaaatgaaaaacaaaggaatacaaaagttgagagcattcggatcataggaagtcaattgcctaggatttgcacgcaggaagcaaagaaagagcttgaggtggattagaggtggccaaatgggccgggccaaacgggcggcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcgggccggcacggcacggcacgccggcggcccgtcaggcgcggacagggctggcggcggtcgaatgggaaggcgccacgtggcattaacggctatttgaccgttcaaatttgaaaataaccgttgggaggctaaaaaattcataaaaatttcgaaaaaattccaaaaaatctcaaatttcgccctataaatagggcatgaaccccagccatttctcctcatcccacactcctcatcttgtgctctcaagtgttttaagtgctctatttgttcttaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtattgtgtttgtgaattcaataaatattcgaaaatttgtttatgtcggtttaaattttcagaa

SEQ ID NO: 2481 - DNA, 1501 bp, Oryza sativa
ccgacgaggcgttcgccatcttcgtcgaccgcctcgccgccatgaactgatcggtcgatcgagcgagcgagctcgccccagctagggcttgatcttgaatcttgatcgatgtcgacgatgagatggtcagttaagttgcgaggattaagatcaagcttaattagttatcgtcgtcgtctttggttgcttcatcaagttcggttctagatatcgatctggggtgcatgcatggtaatgtgctttggttaatattagtccaaaactctatataattttggatcgactcttaaaatttcgatgttgtgttgtgagactttaatttgtgagtttgtggctggttggatatcaatatggatcataattaagtatatatgtgttgtgattttctggcttgcgattaattaattaggtgaatgaaaatacgcgcggctgggtaatctgctacttaattttaatttgtttttgtattttaattgcatctagttcttctagctcactacaacaaaaacctcgtatagaggcacttttgtagagacgttttgcaaattgcttctaaaatcagaagttttatagtgtagagacactttatagaggcactttaaaaattgcctagaaaacttttactctagagacatttttagatcagtttgttagattttatctcgtagaggcattctttcggcactataaaatgcgtctaatatataaaggcatttcgttgagacattttaaactatgtagagacactttttagaatgataatatgtactaaaggactaaatataaataactagaggaccaagcatacaagtaatgacatggagttgagttggttagtgtattgaagattaaaatgattgaatcaagagatcatgagttcaacacttgtcaaaaccaaggaaactattttattatcttttttggattggttttatatgtttgcggtacaatttaatgtctctagaaaatgcctctaccatcttatagacattttataaaatgtcttttcgtttgtagagacaattcaccataagacacttattagacattttttaaaatgcctctacattgttgtaaagtcatttgataagtacctctatagtactagaaaaatgtctctacaaagcatttttattgtagtgtaggagcttgatttgggagagtagatggttgggcgatatggctgtgcgtcgtgtaaaaacttaatttccttaatttacttcttctaatagaatgacgtgtaatttcttttctttttttttgcgttcgtgaaataatttataggattactttgaatgtattcaggccctgtttctttcagcttgggattattataatctagattattgagtcagattactataaactagattgttataatctgtagtagcataagcggttagttgtttctttcctaaattattagagcctagattattgggtttgtaagtctaaagagggagtggggtggcatggtgggtaattttttacccaataatct

SEQ ID NO: 2482 - DNA, 1501 bp, Oryza sativa
ttattgggtagctaacaactaacaaacagataataatctagagaaataaactagtagcttattatatgtcggtttattataatccagcttatagtaatctagttatataatctagattataataatcttaaactgaaacaaacagggccttagagagctttgacttaaaagacaactaaaacacttcgatgatcgaaaccttgaattaaatatatatgttctaaacagacatatattagaaggtatataatgcacattaataaataaataaaacttgaataacccatatatatatttttaaaaaattaacatattactgtcaactgatgacttggctgtattagaaggtatgagttgggaaccataccctgatattcaaaatgataggatgaatcagcgtataattaattaaatattatattaaaaaactctaaaaatgatcatatagatttttaaagtaatttatctataaaatattttaaaacacaccgaaatgtaggcacgaaaaaacagaaatgagttggaaacatgagaacacacccgagtggactctgaccagcaatatccactcccataaaaaacgaaaagaaaaaaaaataatgacaggaagaggtggcccaattgcaatgggcttccatgggctcctcaagcccaacacgcaatcaccaccatcggtcacgcgtgacgcaaaccccacagcccccctcccctctatataagcctctgcgccgcgctcctccgaaccctagccgcacatccccgcctcttcccgccgccgtccgccgcgcgcacgccgccgccgccatggggaggagtaagtctaaccatttcctgctctaccgctcgttgtcttgctgtttgttccacggttgcgctggatcggtcgccgcggctccctgatttcaggcgcgttttgggcgtttggtttagatccatagtagctgggcgctgctggattgttgctgttcccggtgttgatctgtgttttgctttgatgaatttaggtgtagatagattttgtagttgtttcgttgcatatctcgttagtttgcttactcaacctgaaggagtcatgttggacttaataggatgtgaatattgttgggggaactgtaccgatctttgattttcacagataatggtagtatgatatgattagtggttctctgtgaatctaaatgatttattctgatgtagctagcagatgtagatgcatttatcctagctagaaatggcttgtttgtggtggttttgttgtttgaagcgaatccctgtaatggatttagttacttcatggctatttctatatccactattttcttgttcatcgatcaattatgattatttagattaatgtaatggatttagtttctttcatgactttgtatattcactatttgcgtgttcatcgatcagttatgaatagtattcagattaacagtgatggggctgtaggtgctttagggtgtttctgagtaactaacttgactttgtggcttgc

SEQ ID NO: 2483 - DNA, 1501 bp, Oryza sativa
ttaggacagaagtaacattgtactattctgactaactaattttccatgcattgtcacagtaaaaagaaaaaggcatactacattaatatcagaatctcatgacaatccactgacgttataaattgttgcagggaatgatcatatgcatccatatgatccacaaagcatagctgaacagttatcacatttactcctactccaataatcagagggggcaaaacctaccatcctcatcatgaactacagctttattacatagtaaccgtaaaattcagatcaattacacatttgtaccatcatgtatagctgccatgccgtaccacttacctgaagtcagtaaaagatttcagtaacttagtaaaaaaaaaggagtcactgttcactgttggctagcaaagcaacaaacatggccacagatgaatgcagctgcactcatcagtgaccagtgacctcactatctagtcacatacaccaacccccaccatgactgactctaaactttcacaaggaaaaagcaatgagcatcatgaagactgaagaacccagcaaacctggaaatgcaactgttgcatatcaatcatcaagaatctcttcagaaagaggagatgatacttcagagttcgaagactactcctttaagataactgaagctttttatcccactcagtcaatttcatcaagatgatacaatttaccttaattacactcccgacctctgcataactaggatgaacgcatggagaaaattatactgaagcttcaagtgctgaacatttggtccaaaatttaggaatgccttgcaccttggccacatggagagcacacttggaaagcttcactttagcatcttacgctggacagcatccaccaacatctctctctctttctctctagaaagttactgggtgacaccacacagaaccccactgagagaggccagccaaaggtcaccaatggattctggagagagagaaggagagagaggggacatgaaaaacatatggctagtaaaatgatgtaagcatggagatgtggggtgctcattttgagacaattatgctggtccttgaaacctaaaagctgtgctggttggtgaagatcactgcaattcgcagccatttcccattgctaattgctaccactccaacatcacaacaactttgcattgttagttgttaacttcacctcctactctcctagtttatttttagcctcattttcacctgatacatggactatctttctactactatgtggtaacaatatccatgtatttatagggaggagaagaagaagacaagagcaccaatgtgtggcagatacagacagttttcaggagagagcacaagaagaggcagcagcagaagttgcagcagctagcttgtcattgatcggaaatcggatcccactacaaaattcaggcggctccaaaaacccagatcgatgagctccactctgatggcttcttgctgcttcatcatctcttacaagaggcctcgcc

SEQ ID NO: 2484 - DNA, 1501 bp, Oryza sativa
aggtgtataaactttaggtgtataaatttactaaaataggaaagtaatgcggtgccaaaaaaggaaaccaggtgaagggagagaggggggaggtggggagcgaatctgatcgctaccccatccccacggcgatcgatcgcccattagaggtacccatggacacaatgcatgggatatatatatggaaatgaacatgcatgagataatccaagctctttgcggttgctgatgtggatgatgagcctgaatgttgacacaattaatggcactgtcagcgattattccacagctgaaatatctttaaacagttcaaaatatgatcaactaaggccctgtttctttcagcttgggattattataatccaaattattgggagtaagctgaaagaaacagacaacttattgaagtagcttattataatctggagcctagcttattataatctgataaactcatttaggtgagctttttccagattattgggtaaaaaattacccaccatgccaccccactccctctttagacttacaaacccaataatctaggctctaataatttaggaaagaaacaactaaccgcttatgctactacagattataacaatctagtttatagtaatctgactcaataatctagattataataatcccaagctgaaagaaacagggcctgaatacattcaaagtaatcctataaattatttcacgaacgcaaaaaaaaagaaaagaaattacacgtcattctattagaagaagtaaattaaggaaattaagtttttacacgacgcacagccatatcgcccaaccatctactctcccaaatcaagctcctacactacaataaaaatgctttgtagagacatttttctagtactatagaggtacttatcaaatgactttacaacaatgtagaggcattttaaaaaatgtctaataagtgtcttatggtgaattgtctctacaaacgaaaagacattttataaaatgtctataagatggtagaggcattttctagagacattaaattgtaccgcaaacatataaaaccaatccaaaaaagataataaaatagtttccttggttttgacaagtgttgaactcatgatctcttgattcaatcattttaatcttcaatacactaaccaactcaactccatgtcattacttgtatgcttggtcctctagttatttatatttagtcctttagtacatattatcattctaaaaagtgtctctacatagtttaaaatgtctcaacgaaatgcctttatatattagacgcattttatagtgccgaaagaatgcctctacgagataaaatctaacaaactgatctaaaaatgtctctagagtaaaagttttctaggcaatttttaaagtgcctctataaagtgtctctacactataaaacttctgattttagaagcaatttgcaaaacgtctctacaaaagtgcctctatacgaggtttttgttgtagtgagctagaagaactagatgca

SEQ ID NO: 2485 - DNA, 694 bp, Oryza sativa
gggagaggaggaggtggaggggaaggtggcggacaaaatggatatggagatggctatggatctggggttggatttggtcaatttaacggcggctggccatataataattgatactataaggctggtggtcgagggagtggaggtggtggtgggtacggtggacctaatagatttggacatggatttggttccggcgttggtataggtgaggctggtaatcaatacggtgatgagtatgcgaagagtaaaggtgacggtggaggtgccggtgatagcgctagaggtggatatggtgaaggtttaggtcatggatcgggatatggagacaccggtcctcaacagccatgaaattaacctttgtataatttgaataagatagaataagtgaaagcccaacaccaatataatgtagcacatagttttcatagtcagtatattaaaaggcttcttgtgttttggttatatatactccgtaagttgcaaccttgtacactctaatcgtacatcggatattttcctggtaacagttttaacactgtttgcactagtaacctatcgctcatgaataccacgtccatgtgagtacgctttgaatatgatattaatgattgaggtcaggaatttgttgtcgatcttcattctttagacatgcgttagaggacatatttatagatgtgtgcacgtggtatacgta

SEQ ID NO: 2486 - DNA, 1501 bp, Oryza sativa
tctaataagtggtatcagagcccaacgtttgaaacccagaacaatttttatgggacacttggtgaggaggccggtaacaagtcttcggggtccacatgtcacatggtggggtcacatgggttgatggggagattgttgggtttagtcccacatcggtaattgatgatgggggagcacgacttaaaagttggtgggcggggctgcgcactctaacatgtcacatcatcacacacaagcaattattgtctaaagtattttaaatatcatgtaaatatgacatatcatttacaattttgttgtatttttagaactcattatgcaagcaatgtttaatcattatctcgacaccattttcacattattcaaacatatacatctatcatttatataataacatttatttaaccacgtatcccgcggtaaagtgcgggtatcaactagttaattataagcaacatgtatgtcttccaataacgaaataatatccggaaataaaagacaaacgaagcataaatttaaaaactatgctctaaaactaaaattataaaatttctctgtatccaaatccaaaatatatatttatacttgcagcctatgtttattgcacggattgatgggatgatgactagtgatatgaaatcaggggcgaagccaggatagatggtcaccgaggtcactattaattaacgatcctaacaattggctatagcttctaataattttaagtctattgttgtagtagtggttaccttttacatatcagagggtgtttagatccagaggtgtaaagttttggcgtgtcacatcggatattatataagatgtcacatggggtgatcaggctctaataaaaaaaactaattacataatctatcagtaaacagcgagatggatttattaagcctaattaatccgtcattagaaaaagtttactgcagcacagcattatcaaatcatggagcaattaggcttaaaagattcgtcttgcaaattagtcgcaatatgtgcaattagttatttttagcctatatttaatacttcatgcatgtgttaaacgtgcgatgtgacatggtgtaaaaattttacgtggaaactaaacaaggcctcaattacaaccatatcattattgtactaggttactatatttgggaaaagaatataacaacctcttatatggtgaaaattacctttgttatatttccccaggctcatgcttcatgatcatgtaattgaacttgaaaaatcaaacgttcatatttcagaactctaatttcgtcaaattcaaacttgagagaccaggttcaaccaaattgtgatgataattaggaaataataataggattagttggttatcctaaataagggccactttatgagcgccagtctaaaacatatatgtatatctatctagactgacgtataatcacaattgctaactaattttctatttgctagttgataatagtatcgttccttgccaccaaatgagctttaacgaaac

SEQ ID NO: 2487 - DNA, 1501 bp, Oryza sativa
tcctcgccatgagcgtagcgacacgctaccccgttgtggcacctcccctccctccacttcatgcacagcacactcttgtggttggcaacacccatggcgccggcgaccgcgggcgcgggtgcgggcagcagcggtgggaagttgacggcgtaggagctcggcctctctgccgccgccgagtccatcgcgctaggcaagtcccgcgcgtcgttcaacctgaatacatgcgggcggctgccgcggcttccgccgggttatccggaggcggaggcaggcgcagcgggcaacgagaagaggggcggcggccgccatcggtaggcccatgggggtgggaatggaggacgtccttatctccgccggcgagaggagggattagaggggagagatgaagagaggggagatggggagggagagaggaggaagaagaggaggggattgagaatgacaggtgggccccaccattttttgaaattattgtatgtgtgaagctgacatgtgggtcccagaggttttgttatttttcacggtcgaattgccacgtaagcaccacgtcagataaaaacaccgtccaaaccgctatgggacctatgtcactggttttgacagccgagggacctgttgtatctggtttttcagttgaaggacgaaaatcggattcgttgacaagtcaagggacctcagatgaacttatttctccggccaatgagcgaaggctgtgtttcacaccaaaattggaaagtttggttgaaattagaacaatgtgacggaaaagttgaaaatttatgtgtgtaggaaagttttgatgtgatggaaaagttggaagtttgaagaattattttttaactaaacacggccgaaatgtttcggtcgctgtatagttaatttcatgcgggcttttaatctactgggttcatctcatgctgctgctctgttagatgatagggaaaagtacgtacgaggtccttcatcttgtcatcaaactataaaatcgtctctcaaccagaaaatcaatatatgagatccttaacttacaaaaccggtttagtttaggtccttaggtggtacgtaaaatctaaaccaagaggcttctcgctttagtcgtatcacgcgacacgcctcacagctgttcgatcgtgcttgtcgtcctgacgtacatccgcgtggccgcgctctaatggctcaatgagaaggatcaacgtagtgcctgcctgccttttttttaatagatcatgtatgcctttttcctcttcattcaaataaagttttctctcaaattatttatctgatctataatccgattacaattatgtttattacaattaaatctgtcgacgttcgatgtctcgactacggtatttgcatggcatggggatcatcagtgctaggatatacacgagactgaggtaaaagagatggagacaaggacttttatacaggttcaggcccctgaattgtcaggtaataaccctacatcctgttggccaaagccggtattgctctt

SEQ ID NO: 2488 - DNA, 1501 bp, Oryza sativa
catgcaggcacatgcatgcatacctacggccagttggttaatttcttccattgtactgtatatatgaaaaatccgagcatcgtcatttgctgttattatattctttttcttcatgtcgatcagggcatacccccgatgggggtgcatcgctaactctatcaagaacagctccccacggtgttccacaagtattagagccgtctggcaagatgcatacttttacaggaggtaagaaattaattattagacgatgcaagcattcagagactagcgagctgagtgagtacgttctagctcgttggtacgcctgttatttcttcgtgttcacgtcgatcgatcacacatgcatgcatgtatatatatatgcagtgacacgcgtcacgatattgtacatttttcagaaacgcatgtacatttatgcagatggaaagagtggcagtttttctctacaaacacagcacgtacatatatatatatagagagagagactcctccgaaaagattgtttttcaatcgtgtaaacacaaagcaagggtatacatatatgcctgactaatttctctcttatttttccttgttgcagatgctggcacatcattaggtagtgcacaatctaatcagagaaagcctgttaaaggtaacatccccatcagaaacacttcgaaacagagcacgtatacccctcttgcagatcaaagaaggcctttcgatgttaaaaaaaagagtaaatttcacaaaactacagatatatttaccaattatcacaaaactacagattttaagatgatatatcacaaaactacagatttaaggtggaatatcacaaaactacagatttaataacaaagttatcactggtttagcatcaatttaattataaaacttggatggttataaatcaatcataacattagtgctaagaatttaaaccccaaaacatgtagctttgtgataattttattattaaatccatagttttgtgatacttagtcttaaaccggtagttttgtgataattttattgttaaatctgtagtttagtgatatatcacctcaaattacttgtagttttgtgaaattttctctaaaaaaggaaaacctttctcggtgcgaaataatttataatagtataccttctataattattatggtggacaacgtatcatatgcatataagcttccggtgcacaatcaatatccatacataaactaacaaatgtcatcagaaattttttaaaaaaatggacatgtaatatcgatagtattagacctagcttcgaagtaccatatctaaattcaatatatttcagccagaaaaaaaaagacaaaatcttggcagttttaagaatataaaactgtcaaaattataacacagaacaaaataaatcgcatgtacttgatgtatatacaaaacaattcactgaagtatatataactatcagttatactgatacattatttgaaatcttttgtttgaacaatgccaggtggtcgtgacggcg

SEQ ID NO: 2489 - DNA, 1501 bp, Oryza sativa
cccggtggagccccaccccgagcggctccctcccgctatcctccatcgacaacgacgacaagaccactgccgttcgcgtctccatcaacttcatccaagtattcccctctgtctccgctgaagccgtcgaggaccaggccgcatcggtcgtccactacaaccctgtcgccggccgaatcacgaagccagtcgtcggggagcctgagatcgacagtaccggcgaaggggtgtggttcatcggggccgaggtgagctacactgcctgcgtggactccgtgctcaccaccgacggcaccgtcgagattgagggcgagcgcctccccttctctcctccaaccccctcttcacttcctcctccccttgccccgcctcgacctcaccagccgccgccgttgcccccactgccggcatactccgcccgatgcgctccgctcctcctctagccacctccgctgtcgtggcatcggggcgcatctagttccggtcgagacggcgacgctgctgatcatcaagcaacgtcctcgggactgcctcttagccgtcaggagcggagacgcagggggcaggggaagcgacggcacaaggggcaaaggaagcaacaacgggcgagcgcgtgtgcaccagtgcggtggtggcggcggagctcggccaggctcaccggcttgcctcgccccatttgccgtcggcggcagcctcctggggagaggagctgaagagaagaaaaaaagagagaagagagaagaagagaagtggtccccacattttctatctcatttcacttacatgtggacccacatatttttttatttttattttgctgactcgaatgccatgtcagtgaaaccaggcatctatactgccatgggacctaaattggacggttttgtatagtttaggggtgaagatttctggttttgcgattaagggacgccaaaaaaaatctcgctgttaagttgagggaccttcggtgaacttattccttcttgtaactattcctttccaaagcatgttgcatatacttaacactttcaatgatttcaaatcaaaatgcaatcaactaaaatgttttacatcttagtgtgttctataatttttatataatgaatatctccatccaaggtagtttgaagaattcaaaatttcgtctttcaaaatagatctcaccttataatggatattcagttatgcaaacaatctcaaataaaaatattgtcaattataatgttgtagatatggttgagaccaacgacttcgatatagggcatgtttccattcgaggtcatttgaaaattcaaaattttgttgttaaaaatagatctcagcacttgtattcatattaggggatgtagaagatctctaatgaaaatgttgtcagttatgaagttgtagatatcgtcaagatcaacaacctttatatggcatgcctccatctgagattattcaaaaaattaaaaaaattaaattctaacccatcattgatagttcataactatcacttgta

SEQ ID NO: 2490 - DNA, 1501 bp, Oryza sativa
tacgcgtgtgtatatattttggatgtaaaaaagttcacacacatacttgtataaaatttcacttatatgctcacaaactttatacgtatgcacataaagttatacgtacacgtatacatacaaagattcgtgggctcagaaagcaatcgcgcgcggctaatagctgattagcgattttcggtgcgggggcatgtgtacgtacgagctagctggaattgcgtacgtacgtacgtacttacggcgacaaacggacaaaatgcgtggcgaattgttacagcgcagttaggaccagtcacacaagtagctaagcagagatgtactgcgaagcaaatgcggtagttgaacgcgtacaaactctcaatacatttgcaggctaagtttctgtacatgcgtagctgatcgatctgaccaagtacaaaacactgtgctttttacatgtagtaggagtatcatgcagtaggaataagccaaacgcgtatttgcaaacgagaagtaatttgtgaataaaacttttatatacgtgttcttaacgatctaaaagtaaaggctgaaaaataaacttcgatgaaaaaaatctcaaaatcaactttatatttaaagttaaaaatttaaattttggttgataagtataagcataagaaatagatggggctggtttggacctaatcacacttggattactaacttggaggaataatacaatgatgtgataattaattagtgtctgagacagaatgcatggtagtatgatattttctgctgctcatttacttttttttatttataaacgaaaaaggcactatctcctgatgatactgatcatccacgtgttgctaatgttgttaagtataggtaggactttaggagtaattaatccgaacaaataatgcatgcttagtcagcttggagtacttaactcggttttgtccagcaacaggtgagccactgaacagctgcaaacgcctcctctcctataaactcctcacagtgcacagcccacaacgtcatcgtgttcgtccttagcttagctaggactaggagtagtagctacctagctgaagcttagctgcctagtggggagtagcttagcttagctagctagctagctataggcgagatgctgggctgcttctcccggctgcggcggccggcgtcgggggggcggcgccggcgcccatggcgcagtctgacgacgcgtcgacgtcgacctcggctggcggcggcggcggctgcaccgcggagacctcgccgtgctcctcgtcctcctcgctccggtgcaagaactcgggcggcgtcggcggtgaagacgacgacgatggtgtcggcggcggcggcgccgtcgtcgctgagaacgcctcggcgctgtccgactccgggctgtcgtcggccatcgcgtcgcgccggttcttcctctcctcgcccggcaggtccaactccatcgtcgactcgtcggcgcacggcgccgccgtcggcgtgggcgcggccggggtggcggtgcaga

SEQ ID NO: 2491 - DNA, 1501 bp, Oryza sativa
ggtctccgcggtgcagccgccgccgccgccagccgaggtcgacgtcgacgcgtcgtcagactgcgccatgggcgccggcgccgcccccccgacgccggccgccgcagccgggagaagcagcccagcatctcgcctatagctagctagctagctaagctaagctactccccactaggcagctaagcttcagctaggtagctactactcctagtcctagctaagctaaggacgaacacgatgacgttgtgggctgtgcactgtgaggagtttataggagaggaggcgtttgcagctgttcagtggctcacctgttgctggacaaaaccgagttaagtactccaagctgactaagcatgcattatttgttcggattaattactcctaaagtcctacctatacttaacaacattagcaacacgtggatgatcagtatcatcaggagatagtgcctttttcgtttataaataaaaaaaagtaaatgagcagcagaaaatatcatactaccatgcattctgtctcagacactaattaattatcacatcattgtattattcctccaagttagtaatccaagtgtgattaggtccaaaccagccccatctatttcttatgcttatacttatcaaccaaaatttaaatttttaactttaaatataaagttgattttgagatttttttcatcgaagtttatttttcagcctttacttttagatcgttaagaacacgtatataaaagttttattcacaaattacttctcgtttgcaaatacgcgtttggcttattcctactgcatgatactcctactacatgtaaaaagcacagtgttttgtacttggtcagatcgatcagctacgcatgtacagaaacttagcctgcaaatgtattgagagtttgtacgcgttcaactaccgcatttgcttcgcagtacatctctgcttagctacttgtgtgactggtcctaactgcgctgtaacaattcgccacgcattttgtccgtttgtcgccgtaagtacgtacgtacgtacgcaattccagctagctcgtacgtacacatgcccccgcaccgaaaatcgctaatcagctattagccgcgcgcgattgctttctgagcccacgaatctttgtatgtatacgtgtacgtataactttatgtgcatacgtataaagtttgtgagcatataagtgaaattttatacaagtatgtgtgtgaacttttttacatccaaaatatatacacacgcgtacaaggtttctatataaaatatttatatatgtaccatccacgggtgtgggcgcgcggctgaccgcacgttagtgccccctcctctatatatgtacatatatacatgtattatattgagcatcagggtactttctccgtttttcaaaatgtagattgtttggtcgtgtttttttcctcctaataacaagtcgttaaattttagtaagtttgataaagtttatagaaaaatacagcaacaatctttaaccgcgaggtgt

SEQ ID NO: 2492 - DNA, 1501 bp, Oryza sativa
ctgaatggccgccgcgtcgctgcgttccaccggcgtccctcctgccgccagcgccgccgcctccagcgcctcgccgattgttatcttcgcaggttcctccacccgtaccgcgccgggggcggcgccgacgactcctgcaaccacggcggcgccatcgtcctgctccacgtagtgacccaccgcctgcaaaaaaaaaaaagaaagaaaagggagatcgttcacgctgcacgcacagcggagagacgtcgatcgacgacgaagtgtgtgacctggccggcgacgaactcggtgacgatgcggccgccgccggggacgagggtgtcggagacgttgacgccctgctcggcggcggcgtccgtggcctggtcatgcccgacgacgcccatctcctcgttacgactcgccgcggactccatggcggcggcggggccgcccttgaccgtcttccccagcacgaggttctccgccgactgcatcgtcgccgcgtcccgcggggcgatgggcttggccgcgaggcttccggtcaccgggaacacgtcgccataccggatcccctgctcgccgccgccgccgccggccgccttctccgacggcctcctcggctgctcctggctcatcgtcctagtacactctcgtcgtagctagcactattgtagtgagatcgtgtgtggtctgcgctgtgaatgtgtgagagagatcttcgatttcgaggtcatatatggcgcggctcgccgggtagaacgggggacaggtgtgggagacggcggcgacgtgggcgcgttcgtgtcgcgcgcgaatgggagcggcatgcgtggcgcgtgtgagcggtgctgtttgttcgcttcttcctccgccacctctctggtctttccgggtgtcgacgaccacggtggcggtgcatgcagactaaactcactcccatgaacacgtacgctagctgtcatcggacgccgttggcggttggagactacgtcatcgtcccggcctggcccatattgattgcagtgtacgtgacaacttgcggcccatacttattaggcccgaacaggattgcgtcctctttttattgggctcgagcgagattgcggagtacgggcggtctatacttaggctgtgtccgtttctcccacaagagttggatgaaattttggatactagtggcatgctttttaagttctaaacggtgtgtttcgtgcgaaaactttctatatgaaagttactctaaaataccagattaatatatttttcaagtttgtaataattaaaactcaattaattacatgttattaccatctcgttttgcatgaaacacttaatcttaatcttcatcttcattttcaggagattcaaacaccacctaaggtgtatggagggaaagggagggatcataagtgaacttactgtcgcttttctagtgacgtgtggcccatacttattgggaagaacgtattgtacggactataaattttgggccgtaattgtgttacggtggatgagaggc

SEQ ID NO: 2493 - DNA, 1501 bp, Oryza sativa
ctttgtttaggcttataagccaacttataagtcgaaaagtctaaacctaaacaaacaagcagcttttccgtttggctttttggaagccataagccactctaacactattaagccaaaagctaggttggagaagttttttttggcttatgtaaggtagatgtataactaaaccactaaacttaggacattaaatccaccggcttataaattatataagccaataagctgacttaaaaggatcggtgccgccgctgccgcccgcgcgcacgtacgcctaaaccgaacgcacacgcacgcgcgctggatcgatctgcaagggacgcgcgcgcgcctgaggcctccgcgagcgagagagcgaggaaggcgaggtggccggggacgtccctgtcgcgggctaagctagccgcaggcgggggctcgcgcgggtgccctgcgcgatacgtcgtcgtgaggccggcatgtgtggaagctggctgcctgagcgcgcccagccacacccgcgctttcccgctccattaatgccccgcgtcccgcatcgcgcttcgctggcgcgccccctgcccctccgctgcctcccccccacgtcgccctcgccacaatccacctcacacgcgtgacctccatcgctcgcttgccaaatgccttagctgcgtgtgttgccttcccatcactctgtgtctgtgtatataacggctcgtctcgtgtaaaagctactgctctaaatgtgcttgctaggaacgtgacggtgttagctaggtagtttgttcgtgttcgttcatggagtcgataatggagaagccgatgatggacacgggaggggggatgattgagcggaccaagtcggaccagctggcgccgccgccgccgccgtcgtcggcgcagtcgctgagcaggacggcgtcggcggagacggtgctgagcacggccgacgtgacgacgacgacgagcctgtcgcgcaagtccagcttcgggaagcgctcggcgtccggcggcgccggcgccggtgggaacagccacggctacagcagcagcaacaacaacaacagccacatccgcaagtcccgcagcgcgcagctgaagctcgaaatggaggacctcgtctccagcggcgccgccctcagccgcgcctccagcgccagcctcggcttctccttcaccttcaccggcttcacccctcctccccaggacaccatgtcctccgccgagctccatcccttcagcgacgacgacaacagtatgcatccaatcactcctactgatcctaactgcatgcacatatggttatcgtacctttcgtagttatatttgtcatttttattacaacttataaaaattgaatttaaatttgtattttcgtggagtgatatattttatattaatttatgttactaatttttttaatttttttatagatatttagataatatagacgaaacgagggatatccgatctccttgagagatgaaatcacttccctaatatatatattctcattctctgt

SEQ ID NO: 2494 - DNA, 1501 bp, Oryza sativa
tcctccaagctgaacgcgtttttttttataattttttttgttttgttttgtttttctttcctttttctttttgtgtgtgttgtataggggcttggaaaggggtaggggtttctggagcgggtgcaaatggagacaagcaatcggtggtggggtggagtcattggactcacgcggttgttgttaggcacggtgcttagcagtttactacataggcatgtattgacttttcccctctctaaaacatccatgtattgatttcttccctatctaaaaaattgatgacaagtaaatcgccatctccttgtgcagtatgcactatgagtttattggataaaaaaatcatatattcaagctggttggcttcagttgataaaccgtagagacataaataagataatataaaataatttgagtcagggttttatgtttctactttaagtgataaaccaagattgaaaaaatgataaaaatatatagaataattttaaaacaacttaaacatttcaaaatttatcaagggcattaagccatgcaattaacgtgattataacatgtcaaaccattttacttagccagtaagcaaatacaaaactttttatgaaacacagtacaaaacacagacactcacaacgtacacacactcactattctaaacgcatacacgtagcatatcttgagattcaagaagtcaccactaaaagactaattagcatctcccgaaaactgaaccgacataacttgaatttgacgaagttatcacgaacatttgaatctgagcgagctatttccaccacaagaaatctagctaaccagttgagatacgcttacttgcttcgtagtcttattcttttttaagagcaaatgcaaacctacgaagtgaacagaatgcatatgacaagccattaggccataagccaaataactaaccacccattctccatccacgttaaaaaaaaaagaaaaaaaacccaagaaaaaaaagtttttaatcggtatcactaaaaagggagaaaaaaaatcagggggaaactggagaggagtggaatccaatgcgggtggcgtccagtgagacgtggtccagtggtccgctccatttctcccccctcccctatcctatatgagcccccgaccctcacccaaaaccctcctcttttcccctttcacaccgtactgccggtttgctagccgcctcgctgctccggctccgcctctccacccatcccgccgccaccgccgccgccgccgcctcatcctcctctctacccgcgccgccgcgcctagctatctctaggaagggaggagaaggggccgggtgcgcgcgcgctcgctcgctcgctcgtctcgccggatctacagccgccgccgccgcctccgggtgttctctgcttgggatctatctcgtgagccaaagccatggccgccgtcgcgccgcctcaggtcccggtcgtcgcgccggcgcccgctgctgctgctgctcctcctgccccggctcctgccgccg

SEQ ID NO: 2495 - DNA, 1307 bp, Oryza sativa
tcaaacttatgaaataatctgctagatggttgatggattgttgttattactgtcttcccatcctgcaacatgtcaaaaggttaaagatgaattgaactagttgccagctaatgtgtaatactctcatgtcacctcagctatatcatgtagaagttgaattatcctgagagctgtagttgaatccaatccagatgttggttcatcgagaaagagtaaagatggatttattatgatctcatttccaatgcaaactcttttcctttcaccccctgaaaccccacggacgaaagatccaccaatcatcgtgtcctggcaccttcaaacatcatcagataattaattaagctaatttctaagaataggtgcatgctaccatacaggaagtggagcgtttttcaaactacctttcaaggccaagttcatatatgatgtctattgttcgttcttccttttcttgcctcgtcattgttcttgggagacgaagcagtgctgcataagtcaatgtctcctttacagtaagatgagtaaaaagaacatcatcttgagtcacaaatccaatcctgaaaaacgagtataaaaccaatcattcactatactcttggacaaactttgaattagtttgtccatacaggctcaagctcaactttggtgctctgacgatccaaaccattggtacaagcagatgttttgcatataaaaccttgtagaatgttgagggtagttagtctagtcagacagtgcgaaaattgctaacaataaggaaccaggatatctctcagttcgaattgtttgccgaattggaagcggaaaaaggagaatactacatggtttttaattggcgattctactaaagtggtgttatgtttgagtgtctaaccaacttagtagctaggttacaccaacacaatttaaaggactaagcagaagaacaggtggaggtagaggcagaagcagaggcaatcctggtgacaaagacaagcatccaaaggaattgcgggacagagaccctggtgcagtggtgttcaagacgaagtggacctctaaacaccggagacctgtaagctcagactactgtaggcctcaggtgatgcaagtgttcactgacgtgaaacgtgtgcttactaatactacctccagcatcggtcaggagatacatcgaacagcttatcggcaggaagggcatgactggaacctcacctcaccagagcacgctacgacatggcgcagacatgcgatcgagaacaacgggcaggcgactccctgaacgtcccgaccgtgctccgccgcacaagccgccggagtttcca

SEQ ID NO: 2496 - DNA, 1501 bp, Oryza sativa
tattagcagctgagatgggtgttaggtggtgtttacatccagggacataactttagtccttgtctttagacactaatttagagtattaaatatagactacttacaaaactaattacataaataaaagctaattcacgagacaaattttttaagcctaattaatctataattagagaatgtttactgtagcatcacataggctaatcatggattaattagactcattagattcgtctcgcaaattagtccaagattatggatgggttttattaatagtctacgtttaatatttataattaattttcaaacatccgatgtgatagggacttgaaagttttagtcccatctaaacatggccttactgttaacaagagggccctcactgctgttgagtgttgacaagatgtggagtggctggtgcatgtacgtcttcagagtctctttcgaaaattactgacaaggaaatgtttgtctcagaggagaatggtctctctgtgaaccaaagacgggaagcaccgaccaatcgggaaacggcattagccattgacccccttggtttaacgcactctgctgcaccatgtatgacgagacgtacacgtaagggaacgtgcggtaggtagtagtagcaggcaagaaaatatcaggaaaaattcttccttgtgcagtcttgcatgcttgcagggggggtgtgcccgttccctgaagggagtagcactatcgataaatttttcctcagacgtataaatataatataattacagtgttattaaattatatcataatataatttatattaattttttaaaaatctcatggtacacgctatttttcacgaggtaaagttcacaagacgtaatctcctcccgagcacgtgctatgatttttttctaacaatttaaaattatgtgaaagttgcatacaagtttagttttttttaagtagttatatacaagttatatcataactacatagaagttataatataattacattttaattataatgtatttatattaatcgagaaatacttttatagcaaataaatctttcgtggacatgtggatgcagaatctgctcgctgccgccctgttcgtgccatagcgcaacccagctccgctcttgggccggaacgggattccggcctacgtgatccccgttactgttgggccggaacggcattacggcatccgtgcgggccctgttatggttgggccgtaccggggattccgatctccgtgcggccccgggaggggggcgtggtggaggacgaaggcgacggtggcaaaatcggcgacggcgacggcggcggcggcggcgatggcgaaggggagggacgcgcggtgggagtagatactgtagtcgtgcgtgctccggaccagcagcaggtagcggcgcggggaaggaagctactggtgggggacaacccagatccctcgcccgcgactcttctactcgcgctcgcacgccctcgtcggccgcgccgccgccgcggtgatggagt

SEQ ID NO: 2497 - DNA, 1501 bp, Oryza sativa
tggagaagtcaaccctagcacgaccacgctgagacccccgggcggtagacggccgccgtacagcctcaaagcaacacccagcccaaccaaccctcaagccaaaaccaaatccccaaacccaaaccccaaaaacctagaaataaaataatcaaaagtcacaacccaaaggatacgatccgcgacgggggcagcggtggcggcggcggcaggagccggggcaggaggagcagcagcagcagcgggcgccggcgcgacgaccgggacctgaggcggcgcgacggcggccatggctttggctcacgagatagatcccaagcagagaacacccggaggcggcggcggcggctgtagatccggcgagacgagcgagcgagcgagcgcgcgcgcacccggccccttctcctcccttcctagagatagctaggcgcggcggcgcgggtagagaggaggatgaggcggcggcggcggcggtggcggcgggatgggtggagaggcggagccggagcagcgaggcggctagcaaaccggcagtacggtgtgaaaggggaaaagaggagggttttgggtgagggtcgggggctcatataggataggggaggggggagaaatggagcggaccactggaccacgtctcactggacgccacccgcattggattccactcctctccagtttccccctgattttttttctccctttttagtgataccgattaaaaacttttttttcttgggttttttttcttttttttttaacgtggatggagaatgggtggttagttatttggcttatggcctaatggcttgtcatatgcattctgttcacttcgtaggtttgcatttgctcttaaaaaagaataagactacgaagcaagtaagcgtatctcaactggttagctagatttcttgtggtggaaatagctcgctcagattcaaatgttcgtgataacttcgtcaaattcaagttatgtcggttcagttttcgggagatgctaattagtcttttagtggtgacttcttgaatctcaagatatgctacgtgtatgcgtttagaatagtgagtgtgtgtacgttgtgagtgtctgtgttttgtactgtgtttcataaaaagttttgtatttgcttactggctaagtaaaatggtttgacatgttataatcacgttaattgcatggcttaatgcccttgataaattttgaaatgtttaagttgttttaaaattattctatatatttttatcattttttcaatcttggtttatcacttaaagtagaaacataaaaccctgactcaaattattttatattatcttatttatgtctctacggtttatcaactgaagccaaccagcttgaatatatgatttttttatccaataaactcatagtgcatactgcacaaggagatggcgatttacttgtcatcaattttttagatagggaagaaatcaatacatggatgttttagagaggggaaaagtcaatacatgcctatgtagtaaa

SEQ ID NO: 2498 - DNA, 1501 bp, Oryza sativa
aatcaaggaggccgactagagggggggtgaataggcggttttaaaacttaatggcacttaaacaaaactaacctaagttgctaggcaaggtaaggtgcaaggttaactaagcaactaagttaagttttgcaaacctaggtgtcggtgacatgggaccgggggtatcttgactagaggtttggggcagccgcggtcacccacgtggcctgaccccctcgggggggtcgggcccgagggtgatgtggccgcccctccctttgtctccccgaggggtcgggccgctcccgtttcggctccgagggctagggcgccccgaccccctgtgggtttggcgccacgtgtgtgggttaggtgagcacagcggcgctcacctaaccgcgtttattgcgggttggacgagcgtcccacaccgcatttaatgcagcgcagcacactcgttcggtccgtgacaggtcacagtgtgtgaccggtcacagaccggtcagatcgcgggttaggtggcaacaggcggccttttgcacgcctcgccccgtcccgtcggaatgatgagagcctctaggcactcgtccctagacggagccggcgtgctaactcctggagttagcacgtcagtcccggctagattcataccaggcttcatcgcaaccattacaaggaagtcattttatgaagaagggctgacgcgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcggagggtcattcggacagcagccatggcaaatctccgcccattaatgagggagtagcagggaaatccccggtgtcaggcgagtgatgacgctaggcctcactcaaagacaagctgtgatttagcttccaggcgaaggcgcaagccagttttttttgggagatagggtgagtccccacccaaaagaagagtaggtagaagtggtgtatgtgggatccccttgagatataaaaggaggaccttgcccacttaagaaaaaagggaaaaaaaggaggaaggagggaggagggagctggtaaaaggaagagcggagctcgtagaggagaggaggagtgagagggtctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagggcttagaacctcacctagcgcccccggccgaaccggcaaaggggggcccgcgcggtctcccggtgaggagccccacgctccgtcatctggcgcgccaggtagggggcgcgtgtgtttttctaagctctcgtcctctttcgtgtgcgccaagcttctcccgctcagcccaa

SEQ ID NO: 2499 - DNA, 1501 bp, Oryza sativa
attattgtcgatcggtttcacccttgccgatgcgcgcgatttgcaaccgttgggtttctgcccgcctgtagggaccatccccacctgtcaccaggcctaaggagtggcgtcacgcccgagcactttcctcgaggagggcaatcgccctggcataacgccgggggctactgtcggtgacatgggaccgggggtatcttgactagaggtttggggcagccgcggtcacccacttggcctgaccccctcgggggggtcgggcccgagggtgatgtggccgcccctccctttgtctccccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagcgtcccacgccgcatttaatgcagcgcagcacactcgttcggtccgtgacaggtcacagtgtgtgaccggtcacagaccggtcagatcgcgggttaggtggcaacaggcggccttttgcacgcctcgccccgtcccgtcggaatgatgagagcctctaggcactcgtccctagacggagccggcgtgctaactcctggagttagcacgtcagtcccggctagattcataccaggcttcatcgcaaccattacaaggaagtcattttatgaagaagggctgacgcgtggcatgctaaactgacgcgtggtagacaagaatgaccggtttgtgactggtctgacgccggtcacgtcatcggcagacaaccgtgctcccacgttgcgcctgcttccggcggagtggaggtaggtatggcccatcccatcggagggtcattcggacagcagccatggcaaatctccgcccattaatgagggagtagcagggaaatccccggtgtcaggcgagtgatgacgctaggcctcactcaaagacaagctgtgatttagcttccaggcgaaggcgcaagccagttttttttgggagatagggtgagtccccacccaaaagaagagtaggtagaagtggtgtatgtgggatccccttgagatataaaaggaggaccttgcccacttaagaaaaaaggggaaaaaaaggaggaaggagggaggagggagctggtaaaaggaagagcggagctcgtagaggagaggaggagtgagagggtctctagagtttgaactctcttgctctccagctctttgtaactccttcatacacagatccaccagaacataggagtagggtattacgcttctcagcggcccgaacctgtctacatcgcccgtgtcttgcgcatttgctctctcgcgaaacatttcacagatcgagggcttagaacctcacctagcgcccccggtcgaaccggcaaaggggggcccgcgcggtctcccggtgaggagccccacgctccgtcactaggtgatatgggctcaaatatgtctctatgaatgtaaatagcacaaatgtaaa

SEQ ID NO: 2500 - DNA, 1501 bp, Oryza sativa
cggccaatttgacgaccagtcccatctagctcctcataagacaaaaatcgaagcaatgccttattcaaaactaaaaacattgttcctctatttccctgttaggtcagcagtccaataaagcaaatcctcgatgcatggtatattcagcatcccaatttcaatttcaacaccaaggcacataatcagcagaccaaaaaccctaatcccccttcccgcaacaaagtcgtctccaaagctgtgccctagacatcatcacaagctcgttgcggacttgcaggcgaagaaagaggctcactcaccggagagtgccgtgaggacttggagggacggcccaaccagcgcggccggcgccgccgcatcgccgatcgcagccgccgcggccgcggccgccgccccgctgccggtggtgctcccgaaggggcggccgcgcttcgccggcgtggagccgccgcccccgccggacttgcccgcaggggccgacctcacgtgggacatggtgaggatttcagctgaatcccaaattattttcggaaacaaatcgctgttagttgcaaagagaaattaaaaagcttccagatctaggataagcaagcctaaggttgatgcaaggagagaagtcgtgggtaatggaaagacgagaaggagggtggtgctgcgctcaccggcgaggatgcgtctgaagaagcaggtcgccggcggcggcggcggcgctgctgcgcgggatggaggcggcaggcgaactcacgaggaagagacgggggggacggggagcaaagcagtagccggatacgctgggctggtggtaacatgggcttttctttaggccggcagcagaccaccatgtgaacttctagtccgctttatgtccctcaactctcttcatcgctaagataatagtccactactagctccaattcatctacagcgtatgtaatagccaatttatacaatagttgtttactatgctattaatatatggtcccacctatcatacacacattgtgttttgaagtccgtgatgtagctggctacagatctatagctcgctgctcttctctctcaacatttatttcattaaaatatatttatagatggctaatagtttgctattgtacctgctctaagccacgtactccctccgtcaaaaaaactcaacctaggatgggatgtgtcccctcctaagataatgaatctgaacattaatatttcgacacgagaacaaataggcagtgattaattctaaattttggaacgatatggaaaatctatgatataattcaaacttttcttcgaaatgaatataattcaaacttgaaaccaagtaaagctaaacatatgctaataaaataatttctaattctgacctcaaaccgagtacgtctcagagtctattaatctcgattttcagaattattaaatcatggaaatttgtatcttcaaatcgagtataactcagcacttattaataaatttccaaattaaattacagagattattaaat

SEQ ID NO: 2501 - DNA, 325 bp, Oryza sativa
ccggccggaggcagcggcggctccctcgcgacatggcggccgcggcggcctccggcccctccctccctccctgatctagccggaggggggaggggggagggcggcggcggcacccggcgtggctcccctcccagatccggccaaagggaggccaggggagggtggcggggacaaccacagcgcggggcggcggcggcacccggtgcggctcccctcccctcccagatccggccagagggaggccgggggagggcggcggcggcgaggcgcggggatgaccatggcgcggggcggcggcggcacccggtgcggctcccctcccaga

SEQ ID NO: 2502 - DNA, 1501 bp, Oryza sativa
taacgccttgatcttccttttctgaagtactacacttgcttccagagtttcagagtactatctatgatattttttgttaggcttggaatggctggtatatattgtagcatgttggtgttatgaatgctgctggaattttctgccaaatcgttttgctgtgcctagaatgagcaatagtctggtgtttcagtgaggttgttttgctcggctttctctgcagcccagcccgtggacaacgtctctggcaacaagaagaggccgttccggtacaatggatgttgccatgttggtatggatgccttcattttattttataccagtactactagctgtgaagtgtttgaagaggtcgtgtgtactcgtactctcgagtgccaagttgaaattttttcttttctgccgccaaggccaaaggggcgcaacttgcaaggaatctgggatcgttggttgacatcttaatttaaatatgttactcatgaacttgggaatctgggattaagataagataagcatacacgctccactaaccaattcaacacgctcactcattagccgcttatattgtttgggtcaagctaactgatacatctcctacggaatttcacatccgtgaaacagttgatatctcaacctggtaaaaaaaaactctatatctcagcgacgcattcataatcactacaactaatcacataaaattgaaaaaaataggtaacaccagagctttgtatagggcctgttcggctgcctgtgctacggctgtggcgcagccagcaccaacagtttcgcacacgcacgacacagcctcagctttagcaaccgcagccagcttgccgaccagacccataatttgctctgtttggcttaccttgctttttcttagaacccaaggtgattttgaattttaactttcaagaatgattttggctgagtttttttactcatcttttagcacctgtaaaagggagatctggacaaagtaggtggtgaagaaaacactctaaaattaatataaaatcaaaacttaaaatttaaaatcaactgtgttgcagctctcccatgatcaaccatcaacattgtcaatactaggaaacagcctggattaaaatggtagtctgaataatcataaaaataaatcctcagcgcttgttccaacctcagcacaagttgagcctaaattaaactgctggttttgttgaacgtgaaatttactatccaataattagcaagtgctccggagtgtgactgatcccacgtataccaagtcatgctcatgcttgctgccggtacatacattttttttttcttttggcacacactgtaccaagccgggttattgtcttgtcaggctagaaaagaaaaattaatcaactaagaccgacgactcgaaacatctatatatacacatccagtacaagcatcgtcaacaccgcatgcacaactactacaaccaaacaaattaaaccaagccatatcgatcgaattatcggtcaagagatggcag

SEQ ID NO: 2503 - DNA, 1501 bp, Oryza sativa
tgtactcagaccttgctgatagtcacatcgtttatattccttgtgaaacaatgtactccatctctctaaattatttgcttgaggccaactcttttttgtcgtgctgctagttatgactttgcgaggttattgtaattgagcaatttgaattgggtcatcaatagtgttgaaatcaatatgctagctagatatgtgtctcataatacttgtcgttttgatttttttttaacatttgaccattcgttttattcaaaaattataaaattattatttattttgtttgtgacttattttattatcaaatgtattttaagtatgacttatcttttttatatttggacaaatttttaaataagacgaatggtgaaacgttgcaggcaaaaaaaaaaagtcaaaacatctaatttgggacggatttagtattttttttttctcattgtccaactgaacttggcaactattttaacaatgtctataaaatgtataatatgatcttcctgtggtggttcaatacttattagaaaattatggtcaaacaaaatgtaacatgtaaaattaatgctgccttgcaaaaccgtggacaaatctgatcaaagcagctaacactggtgtttcctaacgatacgagcaacagtgtttctctttttataaattccgtgatagcttttgcatcagttatattgaaccctgaacatgccttgattatctgccctttcggaaattagtcggtaaattaagtagtatatcgagagacctgcacaatattagtgctataatacgttaatttgcatgtcgaccagggcgcggccggagataatgtacttttatcttccttaagtaattaaattaacatgtttgaggaatgagaatctcagaatccactgaattaaacgtagtagcagatggtgaattcggctgtgattggatggaccgagtccatattccaactttccaagcttggtccgaggcgtgaagtctctatatatcttgaacaacaaatgcatatactccctccatcctaaaatgtttgacgccgttgatttttttttaaattattgaccgttcgttttattcaaaaaatttaagtaattattaattcttttattatcatttgatttattgttaaatatacttttacgtatacatatagttttacacatttcagaaaagtttttgaataaaacgaacggtcaaatatgtttaaaaaagttaacggcgtcaaacatttaggaaatgagggaatatatatcttaaagacgaacagccagtgacaggccggcctgtcacactcaagctggtactaggaatatatgatgggtagtgaactggtccatcgtgcttgtagattctgcgtgtagtataaatgtgtaatgaactcctcagaggcatgccaaagccagactaacggggtgtcccaaacaccccctaaactgtgaaactctccgtctggagcgtttctatacacgaagcatataaaagcacaaagcgaaaaatttcaact

SEQ ID NO: 2504 - DNA, 1256 bp, Oryza sativa
tattttataccagtactactagctgtgaagtgtttgaagaggtcatgtgtactcctactctcgagtgccaagttgaaattttttcttttctgccgccaaggccaaaggggcgcaacttgcaaggaatctgggatcgttggttgacatcttaatttaaatatgttactcatgaacttgggaatctgggattaagataagataagcatacacgctccactaaccaattcaacacgctcactcattagccgcttatattgtttgggtcaagctaacagatacatctacggaatttcacatccgtgaaacagtagatatctcaacctggtaaaaaaaaaactctatatctcagcgacgcattcataatcactacaactaatcacataaaattgaaaaaaataggtaacaccagagctttgtatagggcctgttcggctgcctgtgctacggctgtggcacagccagcaccaacagtgttgcacacgcacgacgcagcctcagctttagcaaccgcagccagcttgccgaccagacccataatttgctctgtttggcttaccttgctttttcttagaacccaaggtgattttgaattttaactttcaagaatgattttggctgagtttttttactcatcttttagcacctgtaaaagggagatctggacaaagtaggtggtgaagaaaacaccctaaaattaatataaaatcaaaacttaaaatttaaaatcaactgtgttgcagctctcccatgatcaaccatcaacattgtcaatactaggatacccatagcgcgccgactagcccctatgctcttgagacattacgaaacagcctggattaaaatggtagtctgaataatcataaaaataaatcctcagcgcttgttccaacctcagcacaagttgagcctaaattaaactgctggttttgttgaacgtgaaatttactatccaataattagcaagtgctccggagtgtgactgatcccacgtataccaagtcatgctcatgcttgctgccggtacatacattttttttttcttttggcacacactgtaccaagccgggttattgtcttgtcaggctagaaaagaaaaattaatcaactaagaccgacgactcgaaacatctatatatacacatccagtacaagcatcgtcaacaccgcatgcacaactactacaaccaaacaaattaaaccaagccatatcgatcgaattatcggtcaagagatggcagcttctgtcacctgcaagc

SEQ ID NO: 2505 - DNA, 1501 bp, Oryza sativa
atatatcacagtattcttctccaagtgtttgctggcctgaaccagttgttagcaagtaataaagagactgaccaagcaattttatctgcaaatgttcatgagaaatgtaattttggacaatcaataagaatattagcaccgaaataaatgcagagaacaaaatttatactatttctctatgttacagatctagagaacaatttgatgtagttcatattttaaaaggttgtgcttctgccacacagcacaacacattctatgctactgagaatctgatgactgagatgcaacacaatgcaatccatcttcatttttttatataaataaactaatttcaccaccaagcatggaaatcagatatatataataacataacctgtcagttcatactgactagaacaaattagctatttgaattcaaatgcaaagtagctacatgagttaaaacgccgaagaaatcaaacagccctaaaagtccgttgatagttgaagtttaatccccagtacagtaatgcatacccaacttgtaagccttgaaacttgaaagcatgtaatattataggtgtgcaatcaaatttgaagttgtaaaaagctaatacactaaatgctcattgccaatcataccaaagtcatacgacaatatacaatagttgaaaattttcaactactttacccaaacaccgaaacaattcatctgatttcaggcattcactctcatatcaccagtctatgtagcaaacagtgtataagataagttaaatttccggcagaattcgacaaatatcacataacccgagtagagccacaagccaacacagccaatttaagctctcacctcgttctgataagcaacggcgaccctggtacctgcatcatcaccaaaacccaaaccaccatcaaatcgcgcgacgcggagctaatcttaagctacgagacggggggagaaaaagcaacacaccgaagaggtggcggaaggcgtcgcggcaggcctcggtgacgtgcgcggcgtagccgtcgtccttctccgccgcccgcatgatctccggctgcgccgcctcagggaaccgccgcggacgcgcgggggccccgccggaaccgccgcccctcgagctggtgcccgcatccccgccgccgccgccgcgcatctctctcgccgtcgacctcctcacgcgatagagagttcagagctccaaggagttctcgcctcgtccgcgcttcgtcgtgctccaggctgggctggtggtatatttgcagatacacccctgagtttaataatatttctgtatctattcgtcttcttgtgttcgcgatggagcggagacgcgggcccacatgtcagcgactatttatagtgtggagatagcaatcccgtctcgggctattttagggttcagggttctcctctctgcggcggcggcggcggctattttctctcgcctactccgaagatttggctttggttgagcggagaaggtctagatcttccgtcggggagtcgcca

SEQ ID NO: 2506 - DNA, 1501 bp, Oryza sativa
ggtgagccaaatattaaagggcaactagccaactattacaacatcaaggtagcctatcagtgtaactatgacaaaaggcttcacttggaaaagaatccatagctttccaaagaatgtcatcatttaggcagcctactgatgttgattaatgagaaccatgaaagaagtgtcaagaaaacaggttctactgaacagaacaaagacaacaattggaattatatattctttttagagaacaataggaagtatgaaagaaaaaaaaaagttccaactagtacaaaagactggacatggcatggtgtgcacaaggatctcaacacgccactgataaaattatataaggaaatgaagagtttaaatgccctatcagagtaactatgacaaagaagcttcatttggacaataaatccatagctttcctaagatatcatcatttagggcattcacaaatcacaagcactggcacaaaaatctgcaagctattacagaacatatatctgcaaacaccaacatagttgtgctcaaagataagcaaacctgctgtattcacatatcagatctggttcaaacgaacttccaggtttctaaccaggcttaagatttactaacaggttgagctgaattcttcagccaaaatatttttgatataccaactctactacgacaggaataaacaacatgaaaagcatcaaagatcaatacgacaaaaacaataactcgatatatctccagatgaccataccaaatcaattaccaatacctagtcatatgcttcataacacccctatctcgcaagttgcaacatagagctcttacaacttgcaccacaaatctcagctagggcatgtattaagatgacgaagcgaattggcgataccggaccatacataatcagttaatcacagaatctacacagcgttatcttagaattaacgaggcagctaaaaactttgggttggatgagtgcgcttactttggagcttcttgtccatgtacctgcaacccaccagaacaaaaactcgcatcaaaaatccaaatccaagtagaacaaaccaagcccacaaatcgaactcaagatgaagaaaaaaagcactaagaaattacttcttcagatccggaggctgccccgatcggctcatggcgactccccgacggaagatctagaccttctccgctcaaccaaagccaaatcttcggagtaggcgagagaaaatagccgccgccgccgccgcagagaggagaaccctgaaccctaaaatagcccgagacgggattgctatctccacactataaatagtcgctgacatgtgggcccgcgtctccgctccatcgcgaacacaagaagacgaatagatacagaaatattattaaactcaggggtgtatctgcaaatataccaccagcccagcctggagcacgacgaagcgcggacgaggcgagaactccttggagctctgaactctctatcgcgtgaggaggtcgacggcgagagagatgcgcg

SEQ ID NO: 2507 - DNA, 1501 bp, Oryza sativa; identical to SEQ ID NO: 357

SEQ ID NO: 2508 - DNA, 1501 bp, Oryza sativa
ttacacagaaaccctagaaattgacaaaagaatcttcgcgagcatgggagataactaaatcatcccgctacaaatttcatcaccattaagcccccctttttttctagtgaaaccccaattcctaatttcctaccgagatccgccaatccaatcgcgatcgaggaagctaagagatgaagccacgcacgcgaatcggatcaaaacgcgggccttcccaaccaagcctcgcagacagagatccaccaaccgagacccaaaaacaaaggctaacctaagtactaacacaccagggagcaaaccacgaactgcacaaaatctaggagaggtcgagaggaggtatgtggaggtgcttgcctcggcaggtgggggagtggcggatgaaccaggagtggaggcggacgccgtcggcggcgcggagccagacgtcctcgtagatgaggcggaggcggtcgggggtgatggggtacgcccgcgcgatccccgggagcacgggcacgtagacgaggcgctcctgcagcgccacgagcgccgcgagccccaccaccgccatgccccccgcgccgtagcacagcgccttcagccagcccaccatccccgcccccgccgccgtcgatcccgtcgccggtgagagagagagagagaggcgctcgcttccgtcgggcgtgcggcggcggcggcggcgaggcgagatgcttcgagttccgactcgtcggggccggggtcgggtttgagtttggtccaagatgtggtcaggttcgagcttttttttaaaaaggaaaaactgtccggttcgagttggagttcgtggtcagcttgtacaataaggaaaaactattattattggtgtttgaatcttctgaagatgaagatgaaaattaagtgtttcatgcaaaatgaggctgtaataacatatgattaattgagttttaattattataaacttaaaaaatagattaatttgatattttataacaactttcatatagaaagttttcgcacgaaacacaccgtttaacggtttgaaaagcgtgccacgagtatccaaaagttaatctaacttttgttggagaaaagaacagggccatgcatatcagagccgaatctggattcaagcggtgtgatagttttttttctcctaagttttaatcgatttttactatttttattaaattttaatggctgaaaatcatttaaaaagattttagttggaatatgtttttgtcacacatcgaaatatcgagatttcgtggttttcgatcggtttttattgagaggctaacattgtctctttacaaagtaaattaacttcaattgtatttcgatgtccaagttcatattgtaatttcattgttgattcttaggaagtgattgtcttgtgtcaaaatgttaattttgactgttagtttccatttttatatgttataacaaatcatgattagcgtataattcatgacaaattatattaaagtattataaagtttcaatctataagtacacttgt

SEQ ID NO: 2509 - DNA, 1501 bp, Oryza sativa
cattccgctccggtttccaaaccttacttgcctcagtatatcactcaatcgcttaggctagtgggatataatatcatggtactcaatcgcttacttgcctcagtatataaatactgccttgcatttgtgcatcccctgccaaaaaactgccaatctgtagcaatctggttgtgctgtctatgctgaatttgtttgttcctaatatatgcttttctattttgcagaaataaatgtgtaacatttggtgaagtggagatggtagttggaacctgaataagtatttaggattatgtaaaaatttaatatcccacttgaagatcacttgctaaatatgatcacagtttacttggtttgttagccaatgcaaaaattccacttctctgcagtatgcaaagcttaagcatatgctgatgacacagcaaaatcccacttccttgtaaagttttttgggatccagagtaacccaaatgagaatataccaaatttcggtaatctcctgaacatattgtgatttgtgaaaagatcaatcacaataaatttggaattcgggaatcacttgtacccatgttttaatcacccatgaacaaaaactgtttttgtatgcatacatatatgccatatctgtttgtgcatatggtgattctagaagcttctggaaatttccacagaacagcatgacaattacgaaatctctaaccagtaaccagtccatgggctgaaaccacaggaccatttcattgttgcaaggctgagcctgaaagtactagagcctatattgaattcatcaatccctcatacaaatacggactatttcagtccatttttatttggcacgaccaaggacatgaactcgttttaagttcacacttgtacaaagttgtctgactttataggctgactttgattttgagttgaacgacaaagtgcggtctgaaaaattgctttcaccgtgctcatttgtaaacgaaattttgatgaaagttgtcacgaataagcgtgtcgatttgctgaatttttgagtaatttgggcatagatcctacacaacccatgttcatttgattgcacagtaaacggctttacttgaactgcaggtttctgcagaagattacctaatcgtcaaaaatagctctagtgcattgaccttttgacagatttcagcagtgttaggctcgcacttacataatgcttcttcgcctaatccattataactagcaataggaaacaaaatggcattgaccattgatctcttgccattcttctcatctgaagcattagcgctttgttttagaaaacatttttgccaatctaatttttctccatttaggtcaagaaaagcagttaactatggaccatcacaattcacaagagctaggtaaaaagggttgagaaagtgggacgtgcatgctagactcaaccgttctgcactaacaacctactaactaccccgtttgatcagcctaccttgtccaaattccaccacgaaaattccccaaacaaatc

SEQ ID NO: 2510 - DNA, 1501 bp, Oryza sativa
atattcttaaaaaatataaaatacttcctccatttttatttacgtgacattggttagttcaattttgatttgaccaatgtcaaatagaaaaaacatatgttgtattaaacatccaataagaacttagtgagattagggatttgcaactgctctctatctctttaaacgagtattcagcggtcatacttgttgtgtgtagtggcgtatgtgcgcgtcccttctaaatagaaatagaagtcggtttttcttataggattatttctcatggtaacagtacactactgatccttaccaagaattaccacaaaaatacctgtggttaatttgggcaacatcctgacttaattagacagtagtaaaaggcagcaacagtagtagtaacagcagctgtggtttaattttatttatttattagttacctggtacaaggaccttgcgttgccaaagatgaaatcgatggagccctggatgtcgcagttgtagaggtagtgcctcccgatgttgtcgaacagcgtgtcctgcgtccccagtatcctgcacttgtacagcaccgtcttgtcgccggacagcctcagcgccaccgcctgctgccccaccgcccccggcgccgccgccgccgccgagttctgcaccaccaccacgcttgttacatccaggaacacgtttcgccgccgccggcgagccggccggcgacgacgacgacgacgacgtgcggtgtgtgtatacctcgaaggtgatgtggctggcgcagaagtagtcggcctcgacggcgacggaggcggagtagaaggtgcccacctggtggcccgacgcgccgacgtcggacgcgcgcgagtgccacgtgatcaccgtgtggccggtgcccatgccgatcagcgacacgaacggcttcgtgatcggcaccgtcaccttctccctgcacggcacgccgtcgccggcgaggtcagcgccattgcagcttcaattccagtcttaaaaagcttcgcgagataggacgacattaactcgtccatggcggttacgagagggacaggtagtggggaggcgatcgatcggtcgaacacccacgtacctgtagacgcccggcctgacgacgatcttgaccctcctcgtgttgccggcggggaccatgtcgacggcgccctgcacggtgcgcgagtgccccgtcccgtccggcgacaccacgatcgtcgtccgctgctcgccgccgccgccgccgccgctcctcttgccgccgccaccgccggccgtgtcgtcccacgtgctgctccgcgccgccccggccggcatgctcaggtcctcccacgtgatgaacccgccatcacctcctactccggcgccgccgccgccagccaccgtcacggcgaacacgagcgccacaacgacgacgagcacgcccgtggcggccatgtccaactagtcgagagctaccgatctctagctagagctaattaaccacgcggattaatttggaacacacgagagatcaaccagcttagct

SEQ ID NO: 2511 - DNA, 1501 bp, Oryza sativa
aacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagttttgccacacaccggaggttctcgatctcttcgagccggtgtgtgtcgaaacacttccgctcgcggttccggaaaatccttccgaagctgtcgccgcctgaaccggtacctcctcaacgacagccgtatgaaccggtacctcctccacagatggtggagttggagccgatccggaggtatcgtcaaaccccgacatgtagttggggtcgaaatcacccaaggtgaacgacggcgactggtatggaaagttcggatccattctgaaaatttaaaccgacataaataaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtcagtgcgccgctggcgctttcggcctgacgggccgctggcgaaacgggccgtgccgtgccgtgccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccgtttggccacctctaagagcctgcaatgagatgggctctgtgcaaaagctgagttaggtggccc

SEQ ID NO: 2512 - DNA, 1501 bp, Oryza sativa
ataggatcaattcctttaatttaaagggctatatagaaaaaaaatcctacaggaataaaaccatctaaaatttctatgaattctttttaatcaaagggccctaagttgctggtggttctgttcatggtggctgggttcctccggaagggccgggaaggggcgagggtgcacggacagcgggacaggtggcagaagtgtgggatgcatattgcctggttttttacttttacctggtccgtctactcgacacgcgtacagggatcgagatcggtaggggcggcgctccaaggagcatcacatcggtagagacggtgacgaaggagatcacggcaggctcgtatgttatcatcaatcaaatttgtatgctttacacgtgagatctacgtgttatatatttaaacaaacattattacactataaatgtatgttgtgtgttcttatttatagggatactagcttaattaaagaaaaacagattgagaaaaaaatttataaatgataaaaagaacgttgattggggaccaaatcagagtattccccaagtctatttgaagattactacgtcacttttagttcatagaagataataagatataaggttttaattcggattcagctctcctaacaccatcaatttcaaacggatctagccgctcatatagaaggaatctcgggggtccatgtcacgccccgaactagtcccgaccggaactagcccgtgacgttccaaattaacctgttaatcgataccagtcccaggaaacagtgctggtatcacagggagacagaatatcatagcatcagaggtctctttattatagagtagaggtacagtcatgttgggctgcggacagatcccgagctcacaactgcattacaaaagggaaacggaagccaggacttggaccaatcaacacaggcgcgacttgggaactaggccgaaaccctaaaactcatcgtagccggcttgctcctggaagaactcctcatcagcagcttccgcttcatcttcttcagcaacttggggggggtcatttatatagagcaagggtgagtacgggagtactcagcaagccatgggaaataagtgtttaatgcaggcttcaaggaaaggctgttgtttttgcaattgtttttatttgaactcttttctaaaacaactaggtgagtgcttctcaaacgacacggatgagacagtgcgtctcgtccggtcggagtatgtgcaatgtatcagtctttagaattgaaacaaggttggcacccggccaacagcttttcaaacggccacccgggccaaccacttttcaaacggccacccgggcctagctgatcccatcacctgcagaattttcaaacattgaaccccttttcacaacagtaatttcacaagcagtagtcaaacaaaactacgctaggaatcacctcacatccgcccatgaccgtgggcacggctgttcgaacagtttgttaacctctgcagagggggtacactttactcaca

SEQ ID NO: 2513 - DNA, 1501 bp, Oryza sativa
gatccggtggggaccgaggagaattctcacccgcgggtgagtggggacagggccccgcaaactttcggggataggggcggggattggaattaatccgcgcgtgacttggaggggccaccgatgtgagttacttatctaaaagtagctcattgcaataatgtagagccaataaacccattcaaaattgacatataaaagctcaacaccctagttctcctcaaccataattcctttccttccttcaaccaacccacacaaccgggggctattaaaattttatcgtaatattattaagtgtattgcaatatttttatgaagtattagctccatccggatgatgcaggccccggtcacccgccgggtcccctgtggggggcggggaaaggtgatgtttttcacacgacttcctttgcggggccgggattatgggtctatctaaaaatatgcgggaggacgggattagcgaggcgggcgtcgatgtctcggcgtggggcagcggtggagcttccggcggagggaacagcagcgctcggcagagatcaatagtggtgcgaaggaggatgagaggggatcgcgaggagtggtggcacagagccggtcgtcgaggcaaagatcgtcggggcctcggcggcgcagacggcgcggaggagggcgaggggagtggcagagggttgaagggcgtcgcctccgtagcgcggtggctaagaaggcggaggaggatggaacgctcccggtgattgtggcgctgagagaggagatgcgaggagggcggcgtgaaatatgcgacgaggaaaggagagcggttgcatagggggagggtgcgtgggatcagggcagagtgatgagtagtggcttagtgggtgatgggggaggtaatctcaaccgttcgatcggatgtagacgaatacagagtgttggatttgatggatgaagtatgtaacatgtaagagtgagttggttaattatagggtatagatacggtgaattaagaaagttttatcttaggccatgtttagttctcaaaataaaaatttttacgttgttacatcgaatgtttggatacatgcatcgagtattaaatgtaggaaaaaaccaattacacagattgtatgtaaattgcgagacaaatcttttaagcctaattgcgtcatgatttgacaatatggtgctacaataaatatgtgctaatgatggattaattaggtttaataaattcgtctcgcagtttcctggcggaatctgtaatttattttgttattagaccatatttaatactttaaatgtgtgttcataaatccgacgtgatgttcagggacaattttttttgtcaactaaacaagcccttggtaaaatagaagtgtagaagatcagtgaccgcctggctggctgccacgctatataatgactcatgtgccggccggctcgtctccaccgtctccccggccgtttcgttcgatcagaattcagacatgcagccgaccagcgccgccgcaggccccgt

SEQ ID NO: 2514 - DNA, 1501 bp, Oryza sativa
tctaaatcatctatagccaatgtaataatcaattcatacaatagttgcttactacattattaatacatgccccacatgtcatacacacattacgtcttggagtccgtgctgcagctggctacagatctgtagcccgctgctcttctctctctttctttatctctttaaaatatgtttatagctggcttatagcctgctattgtacctgctcttagtgaaatccggtggttggttggtggcttagtgctggcgtgctgctacttgtgtactccctccgtaaaaaaaatgacaaaccctgagttttcgtgtccaacataaatattaatttttttacgattaatatttttattgttattatatgataaaacataaatagtactttatgtgtgactaactttttttaattttctcataaatttttcaaataagacggacggtcaaacgttggacacggatttctacggctgcacttattttgagatggaggtagtattaaaatcaaaattattatttcttgtgttgtcaactcgtcacccttctccgcgtgcacgctttcaaattgctaaatgatatgttttttcttaaaaaaattatatgaaagttgctttaaaaatcatattgatttaaaaatcatattgatttatttttaaaagctaatacttaactaattgtgtgttaatgaaacaatccgttttttatatggagttctcaccttcacctcccgaatatagcctaatagattgcttttcagtgaaactacgtgcacatatgcatgcataaacgggttaccggcaacccgtaaaaatgattttttttttggaaaaagtataaattaccccccccaactatcgaggtcgactgaattatacccccgaacttgaaaacagacattctacaccccgaactattgaaaccggacaaataacccccgactcaatttggagcggttttggatccacgtggcagtccaatcagcactttttaaataaaaaaaatcagtgggccccttttgtcagttctccaccactctctatctctctctactctatcccagtctctccccctctctctctctcttctcacctgcacggcggcggccgcgcgagggcgggagcaggcggcgctgccggcggcggagggcggctgagacggaggcggagtgggttgccggcagcttcgctgtggtgtgggctagcaaccacctcctcggcgacggccacatcgcggtggtgctcctccagtcgtggtcggagttcgcgcgcacggggacgttcgccggaggcctgaaccttgactggtcggtgctgagccgtccccactccccgccgaggtacagcgccgccgtcgacgggatgttcgtgccgtgggaccacgagcacgagttgaacccgctcacggcgagccgcggaggcgagcttcgtcgagcggctctactacgtcgaggccgctgacatcgccaggctgcgcgaggaggcgcgcgcagcgcgcgacgagcggctct

SEQ ID NO: 2515 - DNA, 1501 bp, Oryza sativa
attagcacatatttattgtagcaccatattgtcaaatcatgacgcaattaggcttaaaagatttgtctcgcaatttacatacaatctgtgtaattggttttttcctacatttaatactcgatgcatgtatccaaacattcgatgtaacaacgtaaaaatttttattttgagaactaaacatggcctaagataaaactttcttaattcaccgtatctataccctataattaaccaactcactcttacatgttacatacttcatccatcaaatccaacactctgtattcgtctacatccgatcgaacggttgagattacctcccccatcacccactaagccactactcatcactctgccctgatcccacgcaccctccccctatgcaaccgctctcctttcctcgtcgcatatttcacgccgccctcctcgcatctcctctctcagcgccacaatcaccgggagcgttccatcctcctccgccttcttagccaccgcgctacggaggcgacgcccttcaaccctctgccactcccctcgccctcctccgcgccgtctgcgccgccgaggccccgacgatctttgcctcgacgaccggctctgtgccaccactcctcgcgatcccctctcatcctccttcgcaccactattgatctctgccgagcgctgctgttccctccgccggaagctccaccgctgccccacgccgagacatcgacgcccgcctcgctaatcccgtcctcccgcatatttttagatagacccataatcccggccccgcaaaggaagtcgtgtgaaaaacatcacctttccccgccccccacaggggacccggcgggtgaccggggcctgcatcatccggatggagctaatacttcataaaaatattgcaatacacttaataatattacgataaaattttaatagcccccggttgtgtgggttggttgaaggaaggaaaggaattatggttgaggagaactagggtgttgagcttttatatgtcaattttgaatgggtttattggctctacattattgcaatgagctacttttagataagtaactcacatcggtggcccctccaagtcacgcgcggattaattccaatccccgcccctatccccgaaagtttgcggggccctgtccccactcacccgcgggtgagaattctcctcggtccccaccggatcccggcctcaacggagaaattaccaaccctaccaaacatcacacaaaattgagcagatcatctcccattcagactcatccacccaaccaaacacaccaagttaggacttcggatcgttttgatgggcctcgatctcggcccatttaggttagccagcctaaccggcccgtatcatgcttcggtttcagcccgtttcgcacggggaactcacgcgacgcaaccgccgccgtcctcctccccgcgccaaagcccaacgccggtgagggttccggttccccaactgcggcggcggcggtccgggcgctcccggagc

SEQ ID NO: 2516 - DNA, 1501 bp, Oryza sativa
tcccctcagaaacctccgagaagacgagaatttcacggaacacacgagatgaacccaaaaaaaaaaacgaggggttggggggaagcgccgcccgggacttcctttttctcgaaatccccgggcagggaggaggggaaaccctagggtttcagggagatttgggcgcggtcctcggcggccaaatcggcttgaaccggaacgggttcaggctgagcaggaagcactccatgaagcagccaccaacggcggcggcgtccgctcaccccggcccgattcacgccaaaccgctctcccccaacacgcgggcggcggcggcggcggaggaggagaccaccagaacgacgggcggacgcggcgagaatctcaggccgtcacctccccgcgcggccaccggcgagaggagatactaaacccccgcacccccgcgcctcctctccccgccccgcccccgggaagaaggcggcggcggcggcggagggggggaggtggacaggtgggaaggcgaggaggaggttggggccttgggggaatctactccgtttcgtttcgtttggtttggtttggttcgctggggttgcggcgggcggggcgggggcgggtttaccggtgaccggtggtagggtgacgaaggaagggttggtgacttccttttgctgctactgctgcccttggatttggaggagggcgtgaaagaaagtcttcttcggcttacgccttcggttttttgttactacttgtaaagatgtactgttaaacggaatgtacaaagtcaaaatcagcagtaaattgataaaattatctcgagtatatattatcaatcaatactattgacctcgttgaatcctaataaaaaatatagtgttttctaccgattgatcgatttgacgaatataatctatggtgaaagataagaatgaaggagtacagacaacctccaagagcctctgtggtagtatttactacgctttacattattataaaatagaaagaaggggtgaggtttctaattcagttcagttctagctagaaaatgcctaaatatttctcaatttagatcaaactagaaaaaaaatacccgtacattacaacaggtgaagaatattttaatttttattattgttatacggtttagtaaggagaaattcaattttaaaatttgcttcgctgcataattttctagaaaatcattagctgcaattactcccttcttccttagatgtttgacaccgttgacttttttaaatatgtttgaccgtttgttttattcaaaaacttttgtgatatgtgtaaaactatatgtatacataaaagtatatttaacaataaatcaaatgatagaaaaaaaattaacaattacttaaattttttgaataagacaaacggtcaaacatttttaaaaaagtcaatggcatcaaacattttgggatggaggtagtataagtctgatcatctcatgttagcatgcgagtttttttaaagagattttttatactactcatcc

SEQ ID NO: 2517 - DNA, 1501 bp, Oryza sativa; identical to SEQ ID NO: 2509

SEQ ID NO: 2518 - DNA, 1501 bp, Oryza sativa
ttgcgatttagcagttttaattagtttaatacagatcatgctaagcccaaggcccaccatcaccaggcctactttcacatgcgttagcggtttagccaagatttacagttgtttggcaacttcgagttaaaaggcttaaagctctcggtagcttaaaattcttattaacaattgcttggcttataagaatttacaaaggttggatttttcagtttttgacttcttgtttattttgtttatttcgtggattatataactatacatatattttttactgagaatctatagagctacatatgttaaaaggaattgtactcctcccgtcttaaaatataacagcttttagcgcttaaggtttgtcccaaaatacaataactttttcatcaacattctcttctaaaccaatcacaaccctccacaattcaatcttctcatctacctttacttctcaaccaatcataatcttatctcatttaattccacataattttttaataccggtgtctaaccataaaaatctttatattttaggacggagggagcagttgctaaaaacttctagtaaagggtcttggtgtcaacagttagtgatgatatactatccatcactgttaactgttcaccattcatactagtttatttaaatataaaattgaaaatgagacatagatgaatctcacgccttgaagtaaggattccacctaggattcccggcaaatttagttggggtgtccaataaaggaggcctaattagttcatcttgtagctcaccaacagcaagaaacactttgttgaaataacgtctaactgtttctccagacctatcaaacttagtgataactaatctatttctaaggctgtcccctactgtatttagaaacatagttacttgtttcttaatagatatgtggatggtatcgttaagcaaaccacgatttctaaagaacttacatagccaaaacaaagagtcttttctaaaaggtggtaataacgtaagtctaagtatgttgatacaagtggtatcgttcctctaaatttttgtgtctagatactcaattctcatcctatctcttttaactattgggccatatttaacacattctctcctagcacttctctttcttttccttgagtgaataatcatagccatcattaacaaaaatagattggcagcaacatcaaaaattaaaatcttggtcctcttatccatatactctctccgtaaaaaaaaaaaggaatctagtacgggatgtgtgacacatcctaaaaatatagacatatgtatttctaaatttattgtattagaatatattatatttaatactggtttaattttttattggacgtagggagtacactacaactatcaaagaaaaataaacacgttgctcaaatcatctcatcaaaaggtagagtaattgcccacatcgcccagtcccagacccagctgctgagctcccactgccaccgccatactcgaggctggccatgaaggctcccg

SEQ ID NO: 2519 - DNA, 1139 bp, Oryza sativa
ccgtgccacgctggatacgtcgcggccgtccgttagccacgttggatggcctacgtggtggggcgggggtgctgacgtggcctgggtttatataggtaaattaaggtcatggagccgtcttggcccggttttgttttggtgtgaggaaggagatggttgtcgtgttttggtgcctgcactgacacacctttccagtcacatctcaatcaaaattaaggaagggaatttatattggtttaatgtgattattctccatggcatttgtttctttttttttcttgtcagaaaaaaaatcttatatgagatgaccttatgttagttagtactcctaccgtgttcaacatttaaccatcgttttattttaaaaaaattaaaaaatcatgtataaaaatactaatcataaagaaatttcaaataaaataaacagtcaaacgttaaatatagaaatccataaccacacttaaaatgggacgaaggggataatgtattatagttttcaatgaacattttgctaaggcaataatagtgtacatttgctatttactcctaatcaaaaaatggtaaacgttccatattgttttcttaatttaattatagatgaaaattcaaaagacttttggacgatttcattctttttctccggttcttctaagtttatcaacttttagataactaccattctcaaactacgatttcttcacaagctttccgcgtcatcattgttttagatttcttgaagttactttaggtctctggcatataatatttgattcatctctacaaacaattatacatgatacgtccaataataacgtgacctaagtccctcctagacaatttcagatgttgaataaatacattatgtcccaaaaaaaccatgtttagtcatcacttatatatttaatagaagtatggaattcttatattaaatctgatcatcgataattttttaaaatatatatgttaaaagcaatggattaagatcctctgcagtcgactgcaccgcgcttttattattgacatgcggtgcagtcgactgcagagcatcctgatccgtaaacagccacatcggtagatataacatcactgggtctagataggagtaaaaaattgtgatgggtgacactaagttaagcaca

SEQ ID NO: 2520 - DNA, 1501 bp, Oryza sativa
aactacagtgtgaactcacagcctatgaatcaacggatagcccgcaaagtggtgggattcagtcatactaatgaacaacaatgccacacccaaatgacagatggacatcctaattatttctcttgtaaaaggcccaactgttttgttgggtcaatgggcattttgttgggccgatgaaattgttgtacacagtatgaataagtccaccttgaatccttcacgtagggtttcaatcgtatttctcaaacgaaaaaccaggtacaatacattgctcatcttctgaaatcagtcaactatagttcaaagacagtattgactaattgagattgttttcgactcatgtgaccccatgttgtgtgttgactcggtcatcgtcctacgtggcactcatatcaaaggaaacaaaaaacagtggagcccgcatggtgcccactcatcacataagaagagacagagagcccaaacaagaggtgagagggaacgaggatggatggctaagggcatcaccaatgtttactgttggaattaatgaatggaccttagcccactcgaagattaattctttggaaaatcacaaaagcccacctcatgggatggcatgcatgtggagtttagtaccaccttacttattctaggagagggggacctccttaaaagggaggatgccctcctagccacttgaagcatgtgtggtggagagaagagggggaacacacgcgcgcgcgtactcgctcgcctggcaggcggcgcacgtgcacgacgtgcacgtggttcgccaaaattggttcctcaccttgcgcagatgcagcctccttttgcaattttgttttgctgcaaattcggattcgtttttgttttggaaacgttccagaaaaatccggtgcatgcaaacggtgtggagtccggataagttacgcgcgacttatccggttcggttacgcgcagtggagatcgtgcgggcgcccttatcaagcgacccttctctatataaaccgagccgccgccttcacgcaacacacgcgaaatcaatctagggtttgcctccgactctgtgctgcgcgtcgctcgtagattactccatcccgctcgccggcgtgcacctgtgatcgggagagcaggtctccggaacctctgccttcgacgttctgcaccgggagaaggcggcaataaggtttttgggaagcgctttgcgcgactgctccctgttcgtccgcgacggctcgtcttcctcttcgcttgcgtgctgcgtgccttcgtagatgcctgcgaaaagtttcgaccgagcagccggtctttccgccacctcggtacgtgttcaatatgttgcgcatatttgatctgtttatgttatactgtgtagtttacatgtgtagatctaatgatgcgttcatgctagttttcatctgtaatgtcatgatttatttatggagtagattaaatcattatatgcctataatctcaacaatccaaaaaccttattataggcattgtgattttacta

SEQ ID NO: 2521 - DNA, 1501 bp, Oryza sativa
ttttttttctatcatttgatttattgttaaatatacttttatgtatacatatagttttacacatatcacaaaagtttttgaataaaacaaacggtcaaacatatttaaaaaagtcaacggtgtcaaacatctaaggaagaagggagtaattgcagctaatgattttctagaaaattatgcagcgaagcaaattttaaaattgaatttctccttactaaaccgtataacaataataaaaattaaaatattcttcacctgttgtaatgtacgggtattttttttctagtttgatctaaattgagaaatatttaggcattttctagctagaactgaactgaattagaaacctcaccccttctttctattttataataatgtaaagcgtagtaaatactaccacagaggctcttggaggttgtctgtactccttcattcttatctttcaccatagattatattcgtcaaatcgatcaatcggtagaaaacactatattttttattaggattcaacgaggtcaatagtattgattgataatatatactcgagataattttatcaatttactgctgattttgactttgtacattccgtttaacagtacatctttacaagtagtaacaaaaaaccgaaggcgtaagccgaagaagactttctttcacgccctcctccaaatccaagggcagcagtagcagcaaaaggaagtcaccaacccttccttcgtcaccctaccaccggtcaccggtaaacccgcccccgccccgcccgccgcaaccccagcgaaccaaaccaaaccaaacgaaacgaaacggagtagattcccccaaggccccaacctcctcctcgccttcccacctgtccacctccccccctccgccgccgccgccgccttcttcccgggggcggggcggggagaggaggcgcgggggtgcgggggtttagtatctcctctcgccggtggccgcgcggggaggtgacggcctgagattctcgccgcgtccgcccgtcgttctggtggtctcctcctccgccgccgccgccgcccgcgtgttgggggagagcggtttggcgtgaatcgggccggggtgagcggacgccgccgccgttggtggctgcttcatggagtgcttcctgctcagcctgaacccgttccggttcaagccgatttggccgccgaggaccgcgcccaaatctccctgaaaccctagggtttcccctcctccctgcccggggatttcgagaaaaaggaagtcccgggcggcgcttccccccaacccctcgtttttttttttgggttcatctcgtgtgttccgtgaaattctcgtcttctcggaggtttctgaggggagggagaggctgggctgaccggctcaaggtgttgtgaaaggacatgagcttgctgcgagaggctccttgtctcgtttagtttgagttcgggctgggcgtcccttcttctataggtgacggtggtggtggtgctgctgctgcgagggatggcgaagg

SEQ ID NO: 2522 - DNA, 1501 bp, Oryza sativa
ggaactcaagttcccaacccctctcactcgtttttcgctcgcacgcttttcaaactgctaaacgatacgttttttataaaaagtttctatacaaaagttgcttagaaaattcaaattaatccatttttttaagaaatagctaatacttaattaatcacgtgctaatggaccgtttggtttttcgtgcatgggagatgggttcccaaccccctccaacgaacacagccttactcattccagcggcatggaaaaagaaggcaaagaagaagatggttctaacgtgtgggtcttgcttgtcattgagggaatagtgaggctatgagcttgagattggtccttctggaccagccttgctgtagcagaaaaagaagagaaatgagaaacaacagaatttacatatatattacgtactttttttattatattagtataatcacataaataaaaaatattcttaattgccaaaaaggtacaaaaattttcagaactcagaaaaacgcagccaaacctcacgaccaaatgtaatcttacatgaatacaaaggatggacatagctatcattatctgctctctacctcactttccgtgaggcaaatacgcatctaatggcatttaattcagctaagcatcatgcttacattaataaatgatgacactaaattccccttggactcccactctttggatgaactagtaaaagctaccaccggtgtcaggtgacaccgacgactttcggcaaaagttatgcttaaaatgcttattcatatattataacattatattctaaatataattagcatactataatatcgatagacgataccaaagatgattcgccaatgtatctagtacaacatatcttgagtatttttttataaaaaaataatgttacggcaccagtgcaccactgataaatctgtttgattattgaagaggttaattaaactaatatttaagtgatcatcatatgaatatccggataaaagaaagtgaaaatgaaatgaggtaattttttaatagaaaatggcagtactccgtccgtaaaaaaaaaatcaacgtaatattagatgagatattttctaatacaacaaataacacatcaaatctattacttaggttgattttttttttatggagtacagcctatctggagtagcaggctgaacggcatcgtaattgaaagcctcgtcagagcaggctggtcctcgaacccttccgaaccatccagaagaggagcctcccgacggctaggatgcatccacatccactcatcaacggctaagacgcgccctcctctctccgaatttttaccaacttttactgctcgcatcaaatggagcgcgggcgaggcgggtaaaaaaggaagcgaagaaatccgtggtatttatattttcgagacccaaaaagaaaaccacgaattcccaataaagaaataggcaaaattccccatctcctcgtctcctcccaactccaaaccctagctcccaccccctctcgccgt

SEQ ID NO: 2523 - DNA, 1501 bp, Oryza sativa
taaaattttgataggatttcttatatatttaccaaagtttggtaattaaatgtagacactttttttttaacaatcttgtcaaaaagaagttatggttaaaaataacatcactctgaacaacccctagtatacatatgttgtgaactatgatgaaaacatcaaaatcaactttaaaattaagattaaattccaattgtgattgatgctgataaattgaagagcaattttaacttcagaaaatattttaaaaataatttaggtttttcacatattttcaaccacttaatttggttaaaatttggccactcaaatcggtttttactttttaaaagtataaagttttattccaaaagtactctcattgcttcggtttaccaccttttcaaccacaaaaggtaaacggtaagaaaacactacaagcttgtttggcacagctccagctttctttttctgagttagagtccaatcaaacagtttcggatccatctaaaatgggaatagagctagatgaaacattatcacaaaataaaagaggtggagttgagtttaaacggctacacaactccactccaaacctaactcctagagctaaaattaagtgtccctttgaatcacacgatttaaaaaacaaaggtatagggaaacataggattcagacaggaatgcaagtctaaaataaaggattgcaaaacataggaaaaacataagaatgatcgtttgattgttggatcacagtaaaaatacatgaattagataaagagagatagtcttaaaagaaattttctaaaaggttagagtttttgctaagttttctccaaaatctatatgcaatgagcaaatttcatatgatttaaaaagtttcaatcctttaaatcaaataaccacgtagaaaaaaagtcatatatgagtatgaaattacagcgtagaatcctttgcttggggccctaagagtgacactctaccaaacaagtcctacttctatgctaagcgaaacgatatatttacgaacacaaaatataatttgtgaataaaacttttatatacgtgtagcgatctaaataaacactgaaaatttaaatttcaataaaaaaccctaaaatcaactttaaatttaacactgaaaatttaaatttgggctaataaacatatgcaaaagttaaagccgtaaattgccatgtctgttcatcttgcttatcagaacggaataatctttacacgcgtggcatatagtatgttcttgcaaatttgaacactcgaggccgcgaaagttccagaagaaacgcgttccactgcaacacgcggacgagcgtgacgacgtcagcgtcctcggaacgcaagggcactccggtaatttctccaccccttctcttggcctataaattgccacctgcgccgcggcgaaagaacgcaatctcatcgcaagaaaagaaaaaaaatcctattcaaatcgaaacccctctctttgatctcgtcgccgaggaattaggaggagagagagcaa

SEQ ID NO: 2524 - DNA, 1501 bp, Oryza sativa
cggaagtttgaagaaaaaagttggaagtttatgggtgtgtttagttcacgccaaaattggaagtttggttgaaattggaacgatgtgacagaaaagttagaagtttatgtgtgtaggaaagttttgatgtgatggaaaagttgaaagtttgaagaattattttggaactaaacacggcgcaagtaaatgaatcaggtaaacattttattgccataagtaaaaagattacagttagtgcaacctaagcacgttcaattcaaccaatcaataactaataataactaatgatctcagctatccatacacttggtcattagtaacatgcagaggccatcagagggcaaaactcctatacatatcttactacttcactactactttggatggggaggaagcgaattgggaaagttcgatgaaataccttctcttactactttactagtactactttggatgttatttggaatagtttcaaatttttcaatctacataagggcagcacattttgcaatcaaggatagaggtgagctgtcataattttctaagcattgaagcaaatgcttggaggtggacagacgctaagacaaaagaactacatccatggtctgctacatcggattggtacaaaatttgtcaagttcagatccaagtcaggctgtgtttagttcatgtcaaacttaaaagtttgattgaaattgaagggccgttttggtttgataccaaaatgttgccataccaatgttttggtagtttaaatagtaaatgtgatgatttggtttaaagccaaatatttggaaatgcctatactcaatttggcacaattctagaatgttcttcaccataatttgaaatttggctctcaattggcatcaatccaaagacactcatttacaattctaccctaccaaaatattggtagtgccaaagcttgcctagagtttggcactaccaatatattggtagggtattaaaccaaacaagcccgaaatgatgtgacggaaaagttaaaagtttgtgtataggaaagttttaatgtgatagaaaaattgaaagtttgaagaaaaagtttgtaactaaactcggcctcagttaatgccttgtttagttggcaaaaattactaaagactttcggcagccatcagtcgagtagtcactgcctcctggctcccctgcaccgcagtcgtcgatacagattcgttgatactgacttttcagatgtcgtttttaagcatttcaaattaagttagattagttcaccggaattcgagaccactgtaaattgattcttttatcaagtgggtagtaagatgggatccacataattaggttttagttgtttctacctctcacaatggctgtgtttagttggtggaaaaattaggaagtttgaagaaagttggaagtttatgtgtgtaggaaagtttttgatgtgatgaaaagttgaaagtttgaagttggtggaggggaactaaacacggccaatgtgtggtatagttggcca

SEQ ID NO: 2525 - DNA, 1501 bp, Oryza sativa; identical to SEQ ID NO: 2522

SEQ ID NO: 2526 - DNA, 1501 bp, Oryza sativa
tctagattaatgattacagtggtactattttgataaattattttgttcccagtttatatgaattttaaaattttagatcacaattttacatataaactacaaatctatggtggatctgagatctgtagttatgccaaagaatacctcatattgctgatcctttctcgtatgctttctaatggagctagtatctgcagctgtattatcagaaatacatttaaatgagatatgttttgtatgacccagttgacggcctcacaaaccctaaacaggagggaaccaagcctgagctctaggcttggctcctaaatcccattcaaatattcttaaaaaaatcacatatttcttttttttaaaaaaaatagtaggatgattaggccgaatatgtcagttgagccttaggcgtggagaattttaatttggctctgtcaccaccatcaggaattgaagcagggaaatgagagctataaccgttgaataacctctcaaaaaatccctgaattttagctgcatgagcagcttaaatgtgggatcaatattcattaagctcaagttactaacttgaaaaatatacagcatgtgtgtgttgttttgaactctaaaaatacctagacggagttatgcattattgaaaacataacatatgaatgcaaacttatactagaaaaacccatgaattctaaccttagtggtttttcaccaatatttctaataaggggtcaacctttggaagatgagaactctaccatttgaacacatgaatagtgaaaaatcaaactattaaagcttgacgggctagggccataactgagcattgccacgtcagattattgtacaattatactactctagcagtacatacactcttggctgtgtactgttgtacgaaacggagagtccaaagtagtagactgtccatatagttcagtttgatggatttcacccggagatacaccgtacgatttaattgtaataatacatagaaccatttgttttttttttgaactgaagaaccatttgtttttcatttacttttactttaaaacatggacaatgaatttgtttttgaacagggcttgaaactcttaactccgagcaaatgaaaattcaaacagcagtggattcaatattcaactcgaaacccctcctttttttcaactaaaaagtccgcaaaacttcccaataattaaaccgtgaaatttcagcgagacctgtatttaaaaatatgggccaaattcaaaatccaaagcaataaacaactgggctacacacaacatgcgacggcccatctcatcaagcaacaaggcccagcccactcgacacccaccgaatccacgccgctcaatcgaaaccgacggtccagatctcgccgcgccaaccccatcacacaaaccctagcaaccccccacctatataacctctctccctcacgccccgcctccattcgcacgcccgcgccaccacaaaaccctagccgccgccgccgccgccgccgccgccg

SEQ ID NO: 2527 - DNA, 1501 bp, Oryza sativa
ttggatattcccagatgtgtgattgtgatgatttttgtgttttgtaaattttttagatgaatgcaactgcaatgagaaatagaatggaatatattttgtttttcttcattggtaatctgcaccattgacaagccgcattgtgctacacatcacaggtgagtcacctgtgatgggttgcaatgccaccagtcaaaggggcattgtgctacccatcacgggtgagtcaccttcacccgtgagagatgagtttagtcatccatactagttacggaccttcacccattagagatgagtttagtcatcactgaccacttatctctgagtccattagaggtgatgatctgagcctgttactgatgacttggtgatggtttgagtctgttactgatgacttaaaccagtgtagtgaaatctatttttcaggtttgcaataattaaatatcaattaatcatatgctaatggttttctcgttttacgtgtgttacttcatattcattttaaaacaccaccaaattgtagctcgatttctctttgatgccggagtgtacgagcatgttgagggtacgagtgtgttggtgtaggtggacaatacaactactagtaatttaattatataaagcctttccaactgtatggatcatccatagcctttggtacaagcaaacctgatcttacaatctttttatactatccctaagaacaaaaaaaaaaaaatctttgagcgtagttgttgctcgtttcaatgctcacagcatggtcggaatgaactcaaaaagcctagcaaattttgggcagttggaagaccaaaaatttattagcatcaaacaaattttcatattgagatccattgtattctaactccaattgctaagttagggactgttaggggtggcaatttctccgacggggctagggccagggagatttctcacccgcgggtaagcggggcggggcccgcaaatttccggggttaggatgggggaactcgtgggtgaccctgcgagttcccggggtatgtgtttctcatgcccattacaataattagagcctagctaacccattccaaattgatatatatataagctctatacctaagttcccctcctccccaattactagatcgattccccagcccttaggttctcatgtcgccactataggtcatgtgcagctctacttcatttttctaaaaaaaacttttaaatactccaggttgttctattgtggacaatgccctctaattttctatccgcgaggatgggccattgttggggcacatgcccctccaattttctatccgcgaggagggggcatatgccccgttagccttccctttgctaacctatggaaatttagcaaattagactcatcatcatatgaatcgtgctcatcctgaacatgcctttgtatggaatttagttagttcacttcttaattgttatttattaaagatcactcgttattaaatcgtttggcttttaaaataagatgtcataattg

SEQ ID NO: 2528 - DNA, 1501 bp, Oryza sativa
cattgccgagcggcaagattattgtgcccccttctgattggagcagtagcttgatggcgccccgtagctttgcggcacacaatgccagtgagttttaagctacttgctgggtcgagctaaggttgtttatatcccctaattgttggctgcatgtgcttgaggcagcacaataaccccgttgtcatcatgtaatctgacttttttttcttatcttaaccttaataaaaacagtcggcgttcttctggcagctggggaaaaaaagaaaaataggggatctatgatctaaaataggggatctatgatcttgttaggcacaactccatatcttagatctatagtaaatttaaagtttgtatgttgaattatagttgtttaaaatttaatccaaaatagaaatagaaatctaaatatatagatttgtggagctaaaaatacttataactataagaaattttgaattgggaactgcacaaaagaagatctatgttaatagctagaattcgattcaaacgaacaaaatccatcttaaatttataataattaaaacttaattaatcatatatattcactttcttattttccgtgtcttaacttcatctccatctttattaaaaagagcatcacttaaattttgctcgtgatcaagtccacgatgagacgagtcaaatgaatccagccaattagggcatgtacttgtcacgcctagaaattcacgaaccagaatttctaagctgaatgtatattaaacctctgtccaggaccagccagggtacacaaacgacaattgttgacatacagatccacgtcttacaaaaatataaaagattacaaatgcagcggaaaagataaaagcgagctaaaccggaaagcttgacttcagcagcaaggcgactccattccacaggcaatccttgacggcagcgacggaaccaacctctctgagacggctccaactgagaagaacttcaactctggtgtgggggaaaagagcaagactgagtactacccactgtactcagcaagtcgtaccggaagaggaggtatgatgcaggatatatccaagggggctaaaggttcttttgcataaagctagcatttaaaagcagaagttgaaagcagtaaaacagtagtagcaattaagcagtattaaccaatcactgtccaacgctacaccacgttgcaacaggcccaaccaaccacctgaactacaccagttcattaagctaaactaggggtgagactaatcacggtgaatctggtcgaccgcccataaccgcgggcacggctattcgaatagttttactctgatcagaggtgtacaactgtacccacaagacacagtcccatgacacgttcccgtgcgccgacatgccaccacgacataccggaaagaggccgtgacaggacccttcgcataaccctctctaaccgatcgcaccacaccttagggttcgcccccgtccccaacaggcaacgggcagcccccctttcgtgccacgg

SEQ ID NO: 2529 - DNA, 1501 bp, Oryza sativa
aagaagcctcgctggattggattgtggcagacaagagaagtataggagatagcactttttttttgtgaataatcagcagttagcagtcagtccgcaagtttattaatttttctgtgaacgcattggttttcacaatttgtcaagagagtttattagtattttattttttattaaatatataggcatatccacatatccatgattcttgaaaaatgccgtatccccgtatcgccgtatcgcgtatccgtatcctcgtattcgggtaacatagtagccaagagcatttgcttaaaccttttgtcttactatgtcatgtactcttgtaatccaaaaaaaaagaaaatataattctcacaaggtcttctattcctgaaaaaaaaatcctaattaacagatagaacatgtaatcttcaaggggatatataaggagatctcgttgcatattgatacgaattcaatagaataagtaccaatagatacattatgaaaactttgttcaccttaagatatgtataattcacaaaattttcatcatcaatactgcatgtaccttgaaccaaaatagatgcaactctcttaatgatgaactggcaccttgaacccaaaatagatgcatctctcttaatgatgaactattatgcttctcgatatatgatttttgccatggtaggcctacacatatatagaatatcaattatgacatcttattttaaaagccaaacgatttaataacgagtgatctttaataaataacaattaagaagtgaactaactaaattccatacaaaggcatgttcaggatgagcacgattcatatgatgatgagtctaatttgctaaatttccataggttagcaaagggaaggctaacggggcatatgccccctcctcgcggatagaaaattggaggggcatgtgccccaacaatggcccatcctcgcggatagaaaattagagggcattgtccacaatagaacaacctggagtatttaaaagttttttttagaaaaatgaagtagagctgcacatgacctatagtggcgacatgagaacctaagggctggggaatcgatctagtaattggggaggaggggaacttaggtatagagcttatatatatatcaatttggaatgggttagctaggctctaattattgtaatgggcatgagaaacacataccccgggaactcgcagggtcacccacgagttcccccatcctaaccccggaaatttgcgggccccgccccgcttacccgcgggtgagaaatctccctggccctagccccgtcggagaaattgccacccctaacagtccctaacttagcaattggagttagaatacaatggatctcaatatgaaaatttgtttgatgctaataaatttttggtcttccaactgcccaaaatttgctaggctttttgagttcattccgaccatgctgtgagcattgaaacgagcaacaactacgctcaaagatttttttttttttgttcttaggga

SEQ ID NO: 2530 - DNA, 1501 bp, Oryza sativa
aatcacatgttctggttgatcgttgagggttgagactcaaaatgtcaattcggtacagctttgtttgtgtcatcattgaacaaccgcctcatattttattcgtgctattagctgttgctacctcttgaaaatgtattcgagaaagtgaactgaactgacccagctgcttcgcttaggatatgcaggaggcagccgcctaactggattccttctgttgtcttcaaccgatatcaacaaggtcgaccaactctgaatatttcgcaacgcactccatgaatccatctgaatgtgcgttgctacagaaataattactcctgccatattcttttcagtttatttaccgaattatttgcaccatgctttaacaaaacaatctcaaaaagatgttttctagcacattattaacttgtctaagctatttattatgtttattttttaataattcgtttaataatctaaatcaaacatgaccgatctcccaaattccaattgtcaatatttgttaatttcaactcgtaccatcgatgatttaatagtaaagataatatctgttattgtaaggcattattccataaactacattgactagaacacaaaacaatatagtaccaacttgactaaactaatatggagcattttcttttataccattggtcaaatttgattattgtaagtcaaaattaatactccttccgtcccataatataagggattttgagtttttgcttgcactgtttgaccactcgtcttattcaaaaaatttgtataaatataaaaaacgaaaagttatgcttaaagtattttggataataaagcaagtcaaaaaaaataaataataattttaaatttttttgaataagacgagcaatcaagaagtacaaataaaaaaaactcaaaatctcttatattatgagacggagggagtacgaatttatggatggagctctcgatcaacataccagatggctgggcccacatgtcattgcaggtcaaagcagagcggagcagtaattaattggctgccccatgtgtcagggagcaagctccagtgaccaatccccactgcccgtaccgtttcaacgattacccgcggccattaacgccccgccacgtcacaagcggagggatctcatcgtgaatctcgcacgctaaattaattattatttctatccactccggtctccggataaacacgagtccgcctcgcgagacccgtatatgtcggaggcatatgctgccgattcacccctatccactgccaggtgggcccgcctcaccaaccgcccctcccccgctgccactgacaggtgggcccagatccccgcggccccaccggccagcctcaccgacgcatgtttcacccacccctccaaaaacaactcgtcgccctggcccgtgtctctctcctccccttccccttccctttctccatttttgcaaggggaaaaaaagagaggagagagagagagagagagagggaggaagcttcgagccctagcaa

SEQ ID NO: 2531 - DNA, 1501 bp, Oryza sativa
ctaatcatcttgcaaaaatctcaaggaaattctaaccgagcatgctttcttttttcatcggaaatggagttggtattcaccagccccgtttttggtatcctcctccccagtcatgaagtagaaagaaggtaagaatctcaatctttttgctaaatatgtactccctccgtcccaaaaaaaccccaacataattggggatgggacattatctagtccaatatgtccagatgcattggactaggtaatgtctgtccagatgcattagactaggtaatgtcccatccccaactatgttggagttttttggacggagggaaatatgtccagatgcattggactaggtaatgtcccatccctaactatgttggggttttttgagatggagggagtagtcgattggtatatactattatcatttatcatttttctatagaaccaacatatctcatgagtcctggttcttcccatctctccccatctcacaaaattaacttgtaatcatctctcagaatcgtgaggaagtttgaacatgtacaactttcgcaattcttcggtagcccaacccccaccaagcaacacacaaggatttgcacgaatccttacggtgtgagtcatacacggtcactaatcacctgtcacgatgccactacccggaaaaaaaaatcaggctcgcacacgcacacactgcacagaaaccgtgtgatccatccatcgcacggtcgccggagctcgccgcgccgccgggacggagcacggccggcggcgaccaaacagtcacacgggccaccggaccagccgtcaccgaatcgccgattgccggcgctgccctgcaccaaatcgagcgggatcggtcgcgttcgaaagctagtttctggctctacagaacgggagtggtctcagccgaaatggtcgatcgtgtcgacgggaatcgcctctcgaagtcgggagagaagcacaccagtaacaatagtttccaaaaacgaaccaaccatcactcatcgagccatttctccctcgactctcaaccaaaccccacaaatttggtctcgttcgaaagctaatttgagcaactaaaattcgtagaaagaccgcgtcgtgaaatatccatcgtggagagagatatttgctcgcaaagtcggggcagaaacacacgagggaacagcggccggcggctgtagccccatcccgtgggcggaatccgtggcgcgggcgcgtcgagcgatccccgccgtcggatgggttccgatccgacggctgcggtggatcgtggcgcgcatccgcgtggctaatccgtgggatcgcgtctcgaccaatcacagcgcgtcagctgcgtcacccgagtcctccactcgtctccgctatttaagccgccgtcttcgcctccggcctcctcacccacatccgccgccgccgccgcagaatcggaagcaatccgccgcgagtcgcgaccatttcttgcgagtagtagtagaggggagagtgagtgaggggcgtgctgcaa

SEQ ID NO: 2532 - DNA, 1501 bp, Oryza sativa
aaggggaaggggaggagagagacacgggccagggcgacgagttgtttttggaggggtgggtgaaacatgcgtcggtgaggctggccggtggggccgcggggatctgggcccacctgtcagtggcagcgggggaggggcggttggtgaggcgggcccacctggcagtggataggggtgaatcggcagcatatgcctccgacatatacgggtctcgcgaggcggactcgtgtttatccggagaccggagtggatagaaataataattaatttagcgtgcgagattcacgatgagatccctccgcttgtgacgtggcggggcgttaatggccgcgggtaatcgttgaaacggtacgggcagtggggattggtcactggagcttgctccctgacacatggggcagccaattaattactgctccgctctgctttgacctgcaatgacatgtgggcccagccatctggtatgttgatcgagagctccatccataaattcgtactccctccgtctcataatataagagattttgagttttttttatttgtacttcttgattgctcgtcttattcaaaaaaatttaaaattattatttattttttttgacttgctttattatccaaaatactttaagcataacttttcgttttttatatttatacaaattttttgaataagacgagtggtcaaacagtgcaagcaaaaactcaaaatcccttatattatgggacggaaggagtattaattttgacttacaataatcaaatttgaccaatggtataaaagaaaatgctccatattagtttagtcaagttggtactatattgttttgtgttctagtcaatgtagtttatggaataatgccttacaataacagatattatctttactattaaatcatcgatggtacgagttgaaattaacaaatattgacaattggaatttgggagatcggtcatgtttgatttagattattaaacgaattattaaaaaataaacataataaatagcttagacaagttaataatgtgctagaaaacatctttttgagattgttttgttaaagcatggtgcaaataattcggtaaataaactgaaaagaatatggcaggagtaattatttctgtagcaacgcacattcagatggattcatggagtgcgttgcgaaatattcagagttggtcgaccttgttgatatcggttgaagacaacagaaggaatccagttaggcggctgcctcctgcatatcctaagcgaagcagctgggtcagttcagttcactttctcgaatacattttcaagaggtagcaacagctaatagcacgaataaaatatgaggcggttgttcaatgatgacacaaacaaagctgtaccgaattgacattttgagtctcaaccctcaacgatcaaccagaacatgtgattgcatcacgacaattattcgatcagaaaggaacataaaagtcatggaggaaaaacagcagagagatcagaaaagcgtatatg

SEQ ID NO: 2533 - DNA, 1465 bp, Oryza sativa
tataccacaagtatactgaaacatggatctgtgttgctgggtgttactatctttcaggtaactaatatagcaagttctcaattactgaccattttgtttttttttccttaggtggtaattttcatggaagtgaatgttccaagggatatgggctgagaagcaggtaaaaacaatcatgaagtaatcaaaggaggaatgatgaagaagaaatggcatctctggaaaatctgtactgaagaagttactttgtttacctctcttgagtaggaggaaacaatccataaacccccaaaagtactctggataatagcatatttcaactaattataaaaaagaaacatttgaagaggaaaaaaaacagaatcaaatcttcatatctgggagcagactagcagtaagtagaatccccctaaatacattattggaccatacaacaatcagtacaataatgctgccattgaagattcaagaactaggtagatgtttcaatcaagaacacaaatttcacccactaaccacaatccatacaaaatccacaaaagtagtttcactcaccatatcagaggcaacatttaaccccaacctagcagattatctatccatactaactaaatcccaactggtgaatcaaaagaaagaactaagcaaactgacaatcaatccttaccctgagagcacatcctctaccaacttccctacaagacaagaaatctaacagaaagatctattgcagaaaaacagactagcagatataggagagacaaaatctgaccaaaaacacccaacatgtagagccatacagaccaagaaacatgaacacaaaaaacatagtaacaaagcaacccacagaacagctttcttcagagcacaacacacatggcacctgctgcattacatcataagctctacactactgaaactgctcaagaaactgaaggtagtaggattcacttacagaaacgccactgcaccatcctgctgctctgttcttggacctccctggagctcaaaaccccaaatgattttaagaacaagaacaagaagaagaagaagtcccaagaacacgagcagtggttagtactagcagtagtagtacctagctagagaaaggcaaggacagtgagatgtgagctgaaagattcttgtgagcctcccactgagagagagaaatacagagaagactctctgtatatggaggcagtggtgagcaagctcaagtaaaggaggtgggggacaaggagcacgagaaattagggcacgcgagggtggtggtggtggaaaagacgggaggaggagaggaaaagggctgggtggaaaggagaggcctctgtatttatagacagagaaagaaacaaagaagcagagaaagaaagagatggagagagctagactagtcactgcagctgcagcagctgcagcaaacagtgcatgcattgcaatgcaatgcaatgcaaagaaagcacca

SEQ ID NO: 2534 - DNA, 1501 bp, Oryza sativa
agcgaccccatcgtgagtcatggcgtggcattgccggatattctgcgaatgtgccatatgtacaatgcgatgaagccatcccattttgttaaaaaaaaagaagctcaaaagttacagaagagtttccatgcgccattccttgtggcttcagatagttcagttaactagaaggaaattaacagagcagaacagtgataatctgtaataacagttttgacaaagactactaatctgcctttctaaaagaacaattctactgtatgagacattaatatatgattaattgagtattaactattttaaattttaaaaatagattaatatgatttttttaaaataactttcttataaattttattttacaaaaatcacacaccgtttaaccgttcgaaaagtatgcacgcgagaaatttcttacaatcctcggctgccgaacacaaccaccacgacatgctcctgaggcctgcatctgtgcagtggtgcggcgtgcgacggcacttcgtggctgttgggccttggtccactcatcgttctgggctagacctaaggggatggatacccaggaataataagattcataataagattcacattgactcccttaactagtggcatatccctgagttctcgaccaatcaactattaaaaccggtgtaaattgactctcttgatggttttagagaacggttttgttgacgtgacgtccacgtgacatctcagtcaacaaataaattaaaaaataaagtaggatccacgtgtcatcctctttctctactactgtcagggttatggataccacatacctaatagtagttgactaaatctcggcaggacccaccacataccatgtcctatatggaaacaacctgcggatatggaggaagttccggataaggaaagacaaccagagttctacatggaaacgacaagaactattcggattatatccatattggtttccctagttctacttgaacaaagggacacctatgggtataaatacaaggccctctaggaggagagggggacggacaacacgaccacctcaattgacacccaccatagactggagggaacaacagaggccacaacatacaagacaacatacaccaagacaagacgccgaatatcgacttcagggatagacacggctagtcccctatggtgtctctggatactgtcagtagagacgaaagcgtttctcatataatcaaggaatggtatatatctaaatccaatctaatttcacctataaaaaaagattactattccttggtaatctataggaagggattgtctttttctctgatatcgccgggcacggattcgaggaggaagactaccctgttgtcgactacgagtcagaccttcagaccgccatgtcgacaacagttagataggctaccccacatattgtactggtgtgattatggtgaataagagcaataccggcttcggccaacaggatatagggttattacctgataattcaggggcccga

SEQ ID NO: 2535 - DNA, 1501 bp, Oryza sativa
ctcctgcctccgtgagtccctacaatagtgtgcatgatgagagggagagggaaaaaaagtggctcatgcagtgtaactagagggtgcggttgcacatgcaaagacagtgatgaggaacgatggtggctcatgaagaaagagcagtagtggcggtgcgtggaataacagttagtggttgctggtagtatgaggagtttgctgttaacacaaatcgctaaccgatcgctaaccgagtttgttaatttttagaatgtgggccactagtcattataaagaaatagctagtcttaaagtagtaaaatattgagataaaagtgagagtactcgtctgaggcttttaaatttttgccacttttaaaatggtactccctccgtcctgtaatataagggattttgagtttttgtttgcactgtttgaccacttgtcttattaaaaaaattttggcattattattcttttttgacttactttattatttaaagtactttaaacacaacttttcgtttttttatatttgcacaaattttttaaataagacgagtgatcaaacaatacaaacaaaaactcaaaatcatttatattataggacggaggtagtaattaagaatttactactcaccgtctataatatgaattgtgtcctacgtgtgtccttattagtatatgacatgtgtgacagtggcaaattcttaattctcagtagttagagtctcgagtgtcttcccttccctttgtgacgtaaaagaaagaaaatctcccgtctcctgccgccaagacgagtcgcggctgaacaggggaggggcggcgatctccatctggcgagcagagcaggggagaggattatggtgagcatccgcatcctcttttctgattcatctctctctcccatcgggtctggaatttgcttgcttgcgttcgttcgttcgttaaccctagcttctcttctagatctggaagaagctcttcccttaatttcagagccttaaccttaatacaactatacaagtaacagtttgtttgttggatccgcccctggtgagagagatgtttgattctgcggtgagattagtatagctagcatatgcatggagatggaggtcagcgagtcaatgtcaaaggtcaaatgcggtatttattgtggtaaagagtactggtttagttggttgaatctgtagggtgcagtatagtacagtagtgtgcaatttgtgaggaagaattgatcaatcttcctccaatttgccatttgccgcgagcattttgcttcgcagctttggtaatttcagcttagtgtcctgggtcctggaatggaaaagcttcagttctctcaagctggtagcatagaaagaacacatgctagcatactagtatactaccgtactgccatacacataaataaaaaaccgtactacaacgagtaaaccaaattcaaactcatctccatacggtgcagctatgtgtgctacaatttgtttttccaaactgatgatcatggccttgtga

SEQ ID NO: 2536 - DNA, 1501 bp, Oryza sativa
tttggttgataagatctgactttgagcaaaatcgactctctgcaaaatctttcttgcagtgagccagctgaggaagccatgcgaaaggcaagcaatgcatgcacgccaccgaccggctatatctctatatatcagcatgtgcatattggttagtgtcatgactcatgagcagttgtcaacatgtcaggcgcttctagtacagcgacctgacgaaacaaaaaaaagttggaaaagcggcaaaaacacacttttgagtcatcaagaattgtctttaaagccatttaatttccaaggagacttttgagccatatcatttttttaaaaaagaaacacgttataaaaacaggtgctcatatacgtgtgtacatacggggtacggcatctacccaaaaaagaatactagatttaaaccactcatgacggaggaagtaactagttgcatagctcaacttcacacttttgagccattttctagaacaacttatttgaaatgaagtttccttttctcttgaaaacgtttgcaaaagcctagagcccaacaattaactgaactaaacatgcagctctcatagaacaaggggtggcgatcgagctcagggttcactatctgggattgccgaatcatttcaggacaccaaaaaatttaaatttcggatgttgaaaaaaaatctgaagtttaaaatggtttactaaatctaaagatgattttttttccatggaaaaacgtcctacatgaacccatcggtacatccaaaattgggaaggactggggaggattatgtttgaatggaaaaacatcctaaaggaatccaccaataaacttgaaatttcaaaaaattaggtcagaaattgtgaatttttacgtgttacccctgtttcaaattataaggcctataattttttacacgatttttaataacatattttgattattaatttatttcgtattatatcatcaacaattataaaactagtatcacatgaaagtattttaaaatacgaatctaataacaataatataacatacataatacttggtgtagatatcattaatgtaattattaataaaaactatcgagtttgatttttttcttaaaaataagaacatcctataatttgagacagggagtactaatcatttttcttggtaaatgtgtcaaattaggcctctaaaatcacaacccttttaattgaattctatgctccgattactgacaactcggacaacatacagctgacctttgaaaaagggtatattgtgatcgagttaggcccgtgccatgatgggtggttatccaatcatccaggttttgattcaggtcgtggcctgcaggacaatactatagttaagagagaattaggccctggtttgacatttctgatagccggcacacattttcttccatcggtttttcttttgccacgcgtacgtgcatgctgccggttaaaggcccgtttgcttctaagtttagggttccttttatttaataattttggtttt

SEQ ID NO: 2537 - DNA, 1501 bp, Oryza sativa
  unsure (1)..(1501): unsure at all n locations
gaaatatccgtcccgttttcacccctatatagacccaacaatcgcattcaaattaacatataaaagctcaacaccctagttcccctcaaccgtaatccctttccttccttgaaccaacccgcaccgccgagggctattgaaattttatcatactattattcagtgtattgcaatatttgtatggagtattaactccatccggctgatgcaggaccccggtcacccgtcgggtcccctgtgggggtggggatgggtgatgtttttcactcgacttcgtttctggggtcggggcggggatacccgcatgagggcaggggacggggcattccaacccaacccggccctgcccgccccgttgccacccctagaccgaatgcgtttgaaaggtgacgagataagctttctatcaagctcaagatcatctaaatcagagtaggcatgagggcgctatgttcgtttgaagtcagtgttatctccggaggctaaattagacttggacgtggaattatcattggaacgtgtgaagttatatgcgtatatgatgaaatgatgtcctcatcaacgaggtttcagctccactccacaagcaaaaactcaactgggggtacaactgtatgagccttggctctttaactccgtcttcaacacaaaatcactatatatgaaactagacctgccttaacttaatgaacaggttaattaattgatctcattttatagttaacctatctcatgcttatagttgcattgcccattcttatctgacattgtgcagctcgatcggtgcaccagcaggtttgttccgtcccctttcacaatgagaagtcattttaatttttggcactttcgacctgtttcgtatggcaatggagcctccaagttgcacctaaaagcctaagctgatagggaaaggtggacaattcactttatacacttcaacactcttcctcacacgagaccccctcaagtctcagcgtggaatattggagtgggctgcaattattttatttnnnnnnnnnnnnnnnnnnnnnnnnnnnnnnnnnnnnnnnnnntgataccatattaagttgcatgcatcagccagttgcacctaaaaacctaagctgatagggaaagacagtcaattcactttatacactccaacattatccaccaccacgccggtagtagaggaggacaaggaggaggcggaggcaacgatgacggggacaaaagaggaacagtagcggcggcggccaatgttggagtgctgctgcacggtggccgccggagctaggcggtggcggtggcggtggcggtggcgcttgtgcttgtgctgtcagccgccgtcctatcttgttgtcgaagaatccatcttttgaacccatctcgtcgaaatcctagagcaccaaaacacccctacctggcgcgccactgtcgacgtttgatgtcgcaattctggtatttgcatagtatggagatcgtcggtgctaggatatacgcgagactgaggtaaaagaga

SEQ ID NO: 2538 - DNA, 555 bp, Oryza sativa
tcatctggactcacctagagtatggatcatctcccctgtccatgcatgcatgcatgctgcaagaaaatgcatatacaaacattcagaaaattatatttgatattgatattcatttgcctcccatctccctctccaacagtgccatctctgatcacacccacactgtgaagtgaagtcagtcatctccaagagaagcaaaagcaaatgcaaagccttcacctctcacctcacatccattgctgcatggaccatggcaccaatgcaccatgcacatctccagcatctccatctccatgagtccatgtgcattcaagcttagcagcagcagcagcagcagctgtatgtgtgggtgtggccatggtgctttctttgcattgcattgcattgcaatgcatgcactgtttgctgcagctgctgcagctgcagtgactagtctagctctctccatctctttctttctctgcttctttgtttctttctctgtctataaatacagaggcctctcctttccacccagcccttttcctctcctcctcccgtcttttccaccaccac

SEQ ID NO: 2539 - DNA, 1501 bp, Oryza sativa
taaaaaaataactttcaaattgaaattttgctagataagctgtcgagcagagttgacgaggttgtcaatggatatatatcatcaattcacagagcgaccacggtgtgcgactcatcagtgatcggtggtgtcattttcagactgccgtacgtgcatgcatttttccaggggaagcaacatggaaatgcatgggtgcgcagggtgaccttttccctgctcatgtgtcaaaagaaggagaatgttgtctgcacgatctaatttagcaacagtggatggttaggagtttttgtcaacttttaggtgcatgtatgtatgttgcacgattgtggcttgatattagaaaagttagctatgtgcatgcggatattccttaatacacgtactctatttctaaccccagatcctagaatctttagcagtataaacactgattagattcgactttcatcatctaagggcggatccaccttctaggcgggatggatggctaggagtttatgccctcaaaccattaaggtcgagcgacaatgacagagttagaaccgaagccctgcaagatggtcaactccctaataacctttaaaatttcatgatttttaattcaaatattaatgatttatagtacctaacgtttaactgtgaaatcatactagaaagttatgcacatactcattactaataggtactctgtttctaactcccgatcctagaatctctaggataacactagtcgaatcgactatcatctactaggaggatccaccttttgggctgaatggatgattgccaatgtttcacgccctatgcaagggagtcaattcctcaataacctttaaaatttcatgaattttgattcaagtatcaatggtatatatataccataactatgtgcaaaaacttgtggaatcagctggcccggcccacaggtggaagaacatgcaatggctattgccgagcgacatcccagctagaaacacaaaataatgaggttataaggttactttgtaacatatatagtcttaacccaaattaactaaagatttgtaacatatatagtcttagttaatttgggttataaggtttgtcatggctttacaaaattcatagctctaccactatcagcccgtcaatccattgattattataggacttggaaagaggatttttgaagtagcacatcctcatagtgccaccaagttattttacttcctctagaatgctacaatcatatacaggttaaactattttctatgaaattactgtaaaatccatattattgaacaggctcggtgaattgcaaaatgattaatgaaaaagatggagccaatgcattgtttaatatatgacatcgttgatttttagatttacatttgactatgcgtcttatataattcttttatgcaaacattttaaagaagttttaaagataaattaagttataaaataaaaaagaatgatgagacatatcttaaaaagttaatgatgttatatattaaaaaac

SEQ ID NO: 2540 - DNA, 1501 bp, Oryza sativa
tcatctccattgtcgacggaaacagaagtagaggcggtatcatcaatctcacaattcttgagcctcttcggaggaggagtagaaggagaaatatcaacttcctcaacaggtcgaacttgccaaaagttggcactcatgtccatctccgagtttccatcccatacaatctgaagatgtgcacaacgagcagagtagaatccatatcaatgcaattattgagtaataatcaatcacgcggtagtgatcaatcttgcatgaacaaaacagtaacactgggcatgcaagaacgaaatcgatgatgatgctgtgctgatgagggacaaaaaacaatcaaacaaacaaaatgaaaattcattggcatggatgtcaggaagctgtcaagaatggattacctcgagatttcgccacagctgtccggtggcaatggcggtgaccttgccccgtggcccgacgatgggcggcgcgccgtcctcgacggcccacacaaactccacctccgccagcgaggtgagtctggcgcggagcccctcctccaccgcctcgcgtggcacgacgaactcgtcgccgtccttccgcgaccggtacgccaccgtgaaccgctcgccggccgccgcgtgacccgccgcggctagtaccgcctcctgcacggccgcctggggcggggtcggaggcctgtaccggcgcatcgtattcctgagtggcctttcgagcgtgcgctggcgccgcaccccgacgtacagctcgccgtcgtcgtcgtcgtcgtcgcggcgacgcatgaagatgacgctgtctccgtcgacgaagtccatgtcgtcccgaaatttcttccagaccttggcgagcgtgactctcttgcccttcctgccgtagtcgaacgtcatcggagatccatggaggtccttgacgaggaggggctggaccgctttggcgtcgaccagcggcgggaagacgcctttggcgtcagccatgggggcggagaagcggatgcggaagtcgaagtcggaaatcatcagcgtcttgacgaagtaacgcaactgctggccaccggcggcggcggcgggtgcgggagcgggagcgggggccaggcgcgggacgtcgtggtcggcgaccgggtcgagggtgatctcggcgtaggcctcattggtgagggcgtcggcgcggaggcggacggcggccaccgtacagaggaagacgcgggggccggggacggcgagctgctccaggagaggggcggggaactggcaaaactgagcggcgtggccgtcgacgaagtagaagaccaccgagccgacggcggggaggcggccggagttcggggcggcgcatgcgagccacatgtcacggtctacgatcccgtcgccgtcgtcggcgagcggcgccgccgccgccgccattgtcgccgggagagaggacgaggggttttgggtggagcgggagatggatttgtcgaattgaggtttgaggcgaggcgaggtgacggttactgtttcctatatcaagt

SEQ ID NO: 2541 - DNA, 1501 bp, Oryza sativa
ggccgtgcctgggccgatgcttctggcgttggtcgggccgtgtgggcccgatagattctggccggagcacggccgtgcctgggccgtgccgcccagatggccatctatacttccggctgcgcatgttgtagcagcgcacggtcatgttcttcccggcgagcacgctctcgtcgtcaatagggtagatgcagtcgccggcgcaccacggcaggatcctcgcgtcgcgcgaagaacgccgtgccggcgctgaggaatagcgcgcggccgccgaagctcctgtcccggcggccggcgccagaaccgcagctcgtggtcccaccggaacgcgcagaggtatctgtcgtcgtcccaggggctcaggcagctctccgtcccgacgaacaccagtcgtcggcggcgagccaccaccgcgatctccacaaggatcagtattccctgtacggcctgtccgcaaacttctccccccgcggcggggacgacgacgcactgttgctgctgttggaattaatgaatgggtcttagcccactcgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacgcgcgtgctcgctcgcctggcctggcctggcctggcagggcaggcggcgcgcgtgcacgacgtacgcgtcgaatggtccgaaaaattggctcttcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcagtatatacgcaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaacaaccttattataggcactgtgattttacta

SEQ ID NO: 2542 - DNA, 1501 bp, Oryza sativa
cgttgaacaagttcaccacaatttaataataaattcaccaatctagtggttgtacaacatcaaaccctcctcccaagagaatacgaaaagcaccgatcctttgcttactacattccatttcatggatgctaatgaatgattttgatggggtcatatattcccctccttttcttggttcctaagaattcaaggatttctttgccaagtctctctagtcttcgtcggcaagttcaacagaaattactacaatggagctgctttttgctaggaggaggggatgaagaggtgtccaatctctttccccatgacgcacccgctagcctccacccctgatacctccacgcaactgctcctcctccctgacgaccacctccatggcactaccgccaccttcgtgacctcgagctgaagatccacaacagttgccgcatcatcatgcttggtgacgccagtgcgctgccgcccgcgtcactcgggagagaggagatgacatgttgctcgcgcggctcccctccatatctgtcacgggatcccaagttccatctacgccaccgtgatctcgtcgaccattaggctgttgtggccactgctcgagagagaggagactgcgaccagcaggacccaaagctcccctgccacccaccactgaggtttgatggggcagcgggaacccaagctcccctgccactgaggtttgagagaggagcctgcgaccagtgggaccccaagctccgccctcttcctggatcccctctgtctctgtagcgagagctcaagctccgtttgcattaacgcaagcttgctagcaccgggctctctatctcgactacctatcgcctctctcttggctcctcttctggatctaaggccgccaccgcccttggtttctccggctaattgactgtatcaacctcccggcctcaccaccgacctttagctccttccctatcatcgttgacttctgcatccctccatcggccaccagctccctttcaccgcgccactcccgacggtgaccccgataggtatggagacagagaaagagaggaaatagggagaggtggaggaaggagaaaatgaatatatcttacatgtgggtccccctatatgttttttcacatttcactgacatctgggggccatatgttgactcagtcggtcaacctgtcacgtcagcaaaaaccacttcttaaatcaccgaaggagtatatttgcatcagtttttgaagttgggagatgcattacagtcggttttatggttgggggatgtgattggatcaaagcataagaggttagggaggccaaaatagactcttttttttgtgaggagataaaatagacttattcttcccactgcaccagcacagttgtcccgtccgggcttccatccttccccctcgtcacgggccactcttttaattcccattcggcccagccaagagggccccagcccagccgagagagcccttgtaaaaccggagatggattctaataactcgag

SEQ ID NO: 2543 - DNA, 1501 bp, Oryza sativa
tatcaaaatgattagatgttggtttaggaaatgcttagccatgcttagcttaactagtacacaaaaagggatcacattattacatagactttgtctattagcatagttttggattggtgccaccgcagtggtgttagttaattaaaatacactgaatggtgggctgtgggtgcatggtttagctggtcgcacccatggcagttaaggaccggttcacgggaaaccctgggagacttaccgtgcttaccacaagcgggagtgggtaactgcttgatctgaagtatagctcaaccctttcctaggcaccggtggcgagggtgggcgtgatggagttgggtcggccggggtgtccggttgtccagttgccggattcaccgcggcgcaagaggggaccgcccactgccttttgaggggtgggggtgaaaccttagcgtggtgtggatggttaggggagagttatgtggaggtcacgatttccccctttgtagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagttcaggcggttggttgggcctgttgcaacgtggtgtagcgttggacagtgtttggttaatattgatttattactacaactgttttactgctttcaactactgtttttaaatgcctgctttgtgcaaaagaacctttagcctccttcggttatatcctgcatcatacctcctcttccggtatgacttgctgagtacagtgggtagtactcagtcttgctctcttttcccccacaccagagctgaagatcttcctagtgggagctgtcttgtcgaagttgatttcgtcactgccgtcaaggattgcctgtggagtggagtcgccccgctgctgaagtcaagcttcccggtttagctcgcttttatcttttccgctgcatttgtaatctttatatttttgtaagacgtggatttgtatgtcaacaattgtcgtttgtgtaccctagctggtcctggacagggatttaatgcacattcagcttagaaattctggttcgtgaatttctgagcgtgacaacagccaagatctcacacaagttgcttgcaccagtcattgacaaaatagatcgaaggctatagcaggatggatcccaggccttctcagttggggtgaaagactcatcatgatcaactcagttatgtcggcaataccaaattatttcatgtcctgcatcaagtggccagacaaaaccatcgaagcagttgatcgcctaaggagggcattcctttggaaaggggataagaaagtaaaaggaggtcaatgtttagtggcctggccaactgtcactctcaacaaggaacaaggaggattgggaatcggtgacttgagagctcacaacc

SEQ ID NO: 2544 - DNA, 1108 bp, Oryza sativa
tcatctggactcacctagagtatggatcatctcccctgtccatgcatgcatgcatgctgcaagaaaatgcatatacaaacattcagaaaattatatttgatattgatattcatttgcctcccatctccctctccaacagtgccatctctgatcacacccacactgtgaagtgaagtcagtcatctccaagagaagcaaaagcaaatgcaaagccttcacctctcacctcacatccattgctgcatggaccatggcaccaatgcaccatgcacatctccagcatctccatctccatgagtccatgtgcattcaagcttagcagcagcagcagcagcagctgtatgtgtgggtgtggccatggtgctttctttgcattgcattgcattgcaatgcatgcactgtttgctgcagctgctgcagctgcagtgactagtctagctctctccatctctttctttctctgcttctttgtttctttctctgtctataaatacagaggcctctcctttccacccagcccttttcctctcctcctcccgtcttttccaccaccaccaccctcgcgtgccctaatttctcgtgctccttgtcccccacctcctttacttgagcttgctcaccactgcctccatatacagagagtcttctctgtatttctctctctcagtgggaggctcacaagaatctttcagctcacatctcactgtccttgcctttctctagctaggtactactactgctagtactaaccactgctcgtgttcttgggacttcttcttcttcttgttcttgttcttaaaatcatttggggttttgagctccagggaggtccaagaacagagcagcaggatggtgcagtggcgtttctgtaagtgaatcctactaccttcagtttcttgagcagtttcagtagtgtagagcttatgatgtaatgcagcaggtgccatgtgtgttgtgctctgaagaaagctgttctgtgggttgctttgttactatgttttttgtgttcatgtttcttggtctgtatggctctacatgttgggtgtttttggtcagattttgtctctcctatatctgctagtctgtttttctgcaatagatctttctg

SEQ ID NO: 2545 - DNA, 1501 bp, Oryza sativa
taaaatatcattatgttgtaaaataagctatgtttttctgtaacgaaagtagtagatttattcaatactatcttacgggttaagtgctcaactaaaatagttgtatacgttacataacaggttaagcacttcactaaaatagttctttgtaaatggattgcaaaagttattttcaaagatgacccatgagtctgaggcaaaaggctcgccacatagcaagctacacatttgagccacatgtgaaaagaatgctcacaaacaatcatttgtgcagtagtgtgattaaaataattatttatacaattaaaatgtttaaattcactatgtaaattaatggtacttgtgcccatattattgtttgccaacaatcgatagaacttgatagttcttttcggtatatagcaaaattagctagatattttacaactaattattgtatttcgttgctgagatgcacatgctattttttttctttatgttgcagtttcttattgttgatgaactgatgcctgggtgcatttgacactatacatattccaaataaaaaagtctagcggaatctaaattgatttcggattgtttcttgcatagtgcatgagacttcacataccccacgaatataatttcataactaaaaataactcggcaagcgtgattattattgtagtttggacttttcatgattgccgtcatgatttaaatatttttactctaaaatttataattaaacattaggaatttatatgctccaaacaatcactctttgtaactttcttttagctaacgtgcattaggaatttagtattacaattatgggtaaagtgttacccttaaattcattatattttagccacaacaaaaaggttaaaaatcctgacggccttaagagtataaatgtattagaattttgttttttcttcctcccaatatgtaatgaatttgaatataagaccttacatatagatataatactactaaaagtacaaacaaaaaaaattccataatttttgggatatataactaaaacattatatgttctcaaataactgatagtaaaaaaattgttgttagacttgatactgagatttgtgacaaatgaagtgattattaagaatatggttacatgtggcagttttttttgtaattaatatataggtaatatcgatgctatatatattatttatagaatagatacatcatatgttttataaagttttaaatagtgaataactgaagaaaataaggggggtaaggatagatcgctttgtaggtgattttttttctttggcaaatagtgggtaggtaattttccttacgtacatatataactgctggatatatgccgatggggataggaaagggaggtggaaaaaacaattctaatagtaatgaaaatagtgggtccagctgtttattaaagtgcaacgtgatggtttagcggtgtttgtaggactctcatatgacgacttaatagcgtttataggaagtttcatgaattttc

SEQ ID NO: 2546 - DNA, 1501 bp, Oryza sativa
tctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggtacacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacataagcatgtgacccattctccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcgacatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagctattttgtagtcatgaaactgctccatgatatacagatcattgctagcatcagtagcactgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagt

SEQ ID NO: 2547 - DNA, 1501 bp, Oryza sativa
agatgagacggtgagctggagaggacagtggcagagaaaaggttgctccaagcagtgagcaagcctccggctgaaccaagggagggttgaaaggagaaattacgaagattgcgtggtaagaaggaagcagcgaggagagggcagatagtatcaagcttggtttcttggaaacaaactatatctggtttattctcagctagggattggaagataagagctttctttttatcgcagccaaggccgcgcacattccaggtggcaatcttcatagaaaaaacagagaagcaacttggtggaggaatcccacccaaaaccaaggcaaaatcgcatgtttaaaagtctgccgcggaaaaaaggaagaacagataagcaagaaagctgaaacggtaaaaggagttttgcaagctgaagcaagagtctgctcattgtgcatactgcagattggatggacagaaagttcaaagatgaacaagtacgccaacttctggcaagttcgatcagtttgttacgatcttgcttctgctgctcctccccctcctctttctccaaagaggctgaagatttgtaaggttgctacggcatctacttcttcatctgtctgcaatgaagatgagcaagttcagacgatgcgggagcgagtagaggcgctacttcctgataacatcaaagctatcatcgatcaaaaaggaaatccaaagggaaaggacacctgacgttgtcggcaatgatcacactcaagattgggtctgtttgtcatgtggggattgcaatacaaacgtcgcagcaacaggcgggcgacggtaaggcgtgacgaggaatagtttttacttctattttgattcggttcggagtttgttagatagtttgttagtttcttattccgtaagctgttaggagtctatcctttagaattgctatgtaatctgtaagacagtttggttttggaatcaatcaattacgtgagattaatctgcagacctattcctgcctcgccggtgcggtgccgaacacggctcctccgcgccaacgaggtccaggaccacgtcctgttacagccttcaaatactccctccgtcgtaatcctccttccaatctcctcgcccgtgacaacttggtatcagattcttctggttccgtgtccatgggttccactcagacgcaactcgacgagatcgcgaagaacctcacttccatggctgcgcagatttctgatttagccaggaagatgagcaccctggaaccattggtgcccatcgcaccaaaacttagcgacctgccggaacgcgtcacccaggtgcaagcctctgcgttcgagtactccgagcaggtgcgctccctcaacctggcgatccagcgcgtggaggcgtcctagcgcgcgtcggccacggcggcatctggcgcctcctctcagccgccgccaggcgaccctcccccatccggcgacaacgacagaaccctgcgccgcgatcgccgtggcgacgactcgacggtcgacaacagc

SEQ ID NO: 2548 - DNA, 1501 bp, Oryza sativa
aatgatctttacagtgatcgatctgcctttcttgctggtgcaacctatgatcctctacctactcactacaagtagttcctttcaatattttttggagtataataatctaagagcctcgatgtttgccaatcatccaccaccaaaaatttattttggagttaattttaagttatttttaacgtagttacttttttagcgttagttttaagttgctaaaaatctggtttttaaatcttcggctatagtagcggttatctccagctatagctatttgagaagggtctaactgtttggtctcatgcacaatttacctactatagtttcatttagtccgctataactgtttgagaaagccaatcaaaacactgctacaaacatatatatgcataaattttactcagaaattattttttattgctaataagctgttttggcatataatcagcttttggccgattgatggggctgtaactatgatgcattgatctaatgtatgaaacgcattatacttcacagtaagttaaacaaaccaatattgttgagtttattcatcgacattttttttaataatgtattttataaaacctagcctctacaccaatccaacatgagtgtatacagccacttgtgcatagacattactattaattagttagttcatatccagaaaccagtcaatcaagcagaagcagatcatttcagataagggcttattttaccagggcatgacgccaatgacggcaggatcacactaaaagttctgaatttcttaagacagattagcaaaccagttgtcgacaacgtctttactcagaacctgacaaggcaaaccatgtgtagagaactagagatgacacctctatcaaaccagagttaaattaattaccataaagttaaactatagttatggatgcgtcacgcatgctcaaactaaaatatcctatgtgaaattgccaaaaaaaagtatattaaattaattataaatattattgctacacgaatggatgtgataacatctctatataaataacaatcaattaattaccattatcaatggacgtacttgtgtaagacaaactccccaaatatatgatttggtgtaaattattaacaagatgagatcgtcatagaatatgccaaacttgtactacattaattaattaaactgtctacaaattaatggtgacacattggtccacaagaattgaactagatagtcaacttaatcgcgcgcaattcctttccatggacaggaaattggaataggtatagtactataattttaagttacaaattaagatgagtactgaataatatttgcaaggcacgaatggaaagcgacacatatacatgcaaaactgattttggaattatcttttcggaggatttggatacgctaattatattagggagttacctttcgtgttatcgggtaattaagttccatgaagtacctaacatatattttaacatgatgcggaggccagcttggcgcgtgagg

SEQ ID NO: 2549 - DNA, 1501 bp, Oryza sativa
aaataccgatactattcacgatatcggctatgtgccactaaaatttgggaaaattagaaccacgccactgccgtccaattatctctcaacctatgtctaagccccctgttaaatgtcacttttgccccttccccttccatctctcttcttcctcaatcccggtggagagacgagatgggcgttgggcgtcggcagcattggtgatgaagctcaaggccgacgcggcggagctcgaggaccgacgcttcctccatcagcagtgcggagctgttcttccatcctcctctatcgccatagacaacgccggcggccctcctcgcctgatctgggcggaggcggtgcggctcgctgatgaccacgacgaggacagcgacggcggcggctactcctgagctctcccccgtagatgaggttgacgacggtgacatcggtggctcccgagcctcccgccgcagatggggtcgaagacgacggcgtcgacggcagtggctcctgaggcctcccaccgtggaggtggtcaacgacggcggctgcaacggtggtggagagagaggaagtcccgaggcctcccactgcggagggggttgatgacggcgactgcatcttgtcctcctcgtagttgtcatcggagtccgaagcagctgtcacgggagcccgaggcggctgccgggatgccgcccccgtcgtcagagcactcgatcttgtcctcctccgttagctcgagaccaccgtctacggtggtggagagagaggaaggggaaagaaaagagaggaactggcagctaggtcccacttgcaattgaggctaacaaattttttgacggataacatgatggagtggcacggttctagttttcccaatttccagtggcacgtaacagatgtgttgaatatatagtagtggcatttttctgaattgatatatttttggcatggatccaattaactataaaagcaaaaggccggcacatgaagggagaaaaagataaatttcctcttcccattaatttcctccccgagcgagcttggctctgtcggtgcctccaacacatctacaacagatcaagttgaaataaataacaatgcttctagtgatgtaaaactaaggagaagggcctctagtcaacggcgggcgtggcggggaagaatctctggtcgacggcggggagctgtggctacgggcagagctcaagctttcctagggaagggcgttggaggcagggttggcgacagagttgcagccttgcaggattcgctcaggaagatgatgcaaacggcggctggtgggagggtgatgcaaaaggcgagggctcgaggaggggggaggggggaggggggaggggcgcagcgacgctcgttggccaggagctcaccgccgcctccgcacaagctcctcttttggtcgccgcctcttcacaaccttgagctctgtcacctggaaccatggaggtagcatgcactctgcgaggaccatgtgccagtgctcagctcgtcggtgccg

SEQ ID NO: 2550 - DNA, 1501 bp, Oryza sativa
atcttcaacacaaaataaatatatttaatgttaaatgtagcaaaactaatttggtattgtggatgttactaaattttttacacacttagttaaacctaaataaatttgactaaaaaaagccaaacgatttatggatgatgtgtattgtctcaaagcctcgtggaggctcaaagtattgtgcatgcctttatcaaggcgatatatatttagaaatttttttcgtcaaattttgtttaaattccactgggttcgtctatgactgctcgattatatattacagttatctagaaaaccgtcagggccggagaggttttcgataacaaattacattcttaaaccataaacaaattcaccttaattcgtttgaacctaaggataaattggaacggttttagaaatggaagggtggataatgtccagtagaacagttgagggattctttttctacaagcgtgcggatagtttaggcataatatggatctgttcatttaattttctaattggactatgtttggcagcggcacaaggaaaaaaactcactcgttttcttcaatatgtatttttgcaaaatcttcggtgacatgaggaagggggagaataggggaaagagagaggaggctgacgtggccacgctgacatatggggttcacgtgggtcccacgctgacttagccaccacgtaggataaaatcggggtcaaaaccactgaataggggtgaaaacggtacggaaactttccggattgcatacttattttcgaaaacggaatctgtcggtcggaattttttcggaatttttcggaaacggaaacaaattcggaaatattttctcggaaacagaatcggaaatgataagggcggtttccgtcggaactcggaatcggtcggaaactttccgaaaattttctcgaaattttcaaatattttctcggaattaccagaaattttgtgactaaaataccctggattctttttttaagcactaaatagtgaataccatggtgtttggctggtattttttaaaaaaatatttgttatgcaaatctaaaattacataagaatattttttcctacattgggattattcaacaacattactcttttaaacatagataatttattcaattggatttatcagtttgaggggttttttattccgataaattttcgttaccgtattcgcgccggtttgttttcgctccgttttcggtttcgataatattcgattctgttttcgtatccggggtttccgattccgattcccaaaaaaatatgaaaacgaaaacgataaagatggtttccgtccgttttcgtaccgttttcacccctaccactgaaggacctattgtgaccggttttgattagttaagggacgtcagatatctggttttgtgattgggggacgattttgtaacttgatgacaagttgagggaccttcggtgtactttttccctaataggttgacaaatttctttcccctttgttcctgtcccaaatataga

SEQ ID NO: 2551 - DNA, 1501 bp, Oryza sativa
aatcctttcatggttcgaatacatgcagctgtggattttttttttagaaaaaataaactaaacagtccaacggtagaaaaattgggcgacaaactatatgtgtcgcgcacaactagatcctcgtcaaacatatagtaaagcaaaataacccttaaatgtagcctgtagaaggcccaaaaataacctaacccagcaaaatattgagatatataaaaaaaaccctagctctagccttatcctctccagtctccttgtctcccctcccgttcgccccatgcaaccagccacagagagaggcggtgcatgtcaccaaggcgcaccggcaccgtgcactcctctagatctcgtcgtcgtcagtcgccatctctcctcccctcctctcccctctggcctcatgtcctctccagtgtcccctcaccctccggtctcccgacaacgcacgggcggcgtgcggggaggcgcatagtcacggcgcagagcaacggcacggccgcgcggcaagggcgcggcgaccggcgaggatatgtgatgtgttgaaccttgaactcatgtctgtgtcatgtgtttgcttggctggctgagtgtgagtggctggcagcttgctagactatcatggtgaatggtgaagtgttgtttgtgtattgaatgtcaaagtatttgtggactttgtggaattgtggtcatgcatgcatttagttaatggatggaatgatggatcaatatgtgtttttgctgagttttttatgatactatttaaatattcatgctatttttgatagtgtgtcaattatatatgtacaatatttgtcctgtgttgattggatggagatgctacccctgcatctccagttggggttggggtcgggggcagggctgttttcgtccaatccggccctgccccgctccgttgccatccctagtgcttgaacatctagagccatcagaatacccgggagcatgattggcagcacatatatgggtagcaggaaagacgccatgtcccaagcacatcctcaacacaatctgttcgtgaatccggtttccactgaagcctcctaagccaaaagtattactgatcctgctaaagttaggaaatgaaatttatatataattggaaatgtcatgcatataaaaaaaatatcttcatttggaagtcatacctgttaaagtttgatgtagtaccctcttttttttattcatgtcctacgaagtatgaacaatacaatagagaacaagtgaacaaccatgcaatcagctactccaccatatgttccattcctttcgtatattacttttattgtgtgcaatatatggaaagggatcctctaacgtaaagttacctctgacgtcccgagagcagtggggcccacatgtcagtcaccacgttcctctgactttacgtcggaggatctcaatccgccatatatacagcctctagtgcaagaatatatttgatggcacctcaaccagagcaagcaaaagcaaagtagctatgctaaca

SEQ ID NO: 2552 - DNA, 1501 bp, Oryza sativa
atatttaaccatctaatcgtattcataataggctatgtggagcctcgcacacactctaaatgaaatgttcacagatggattatctctcaaactatgcaatcatattacaaactcatgaatttagtgtagcctcatgtgctaccccatacatctgtcaataaacaatgggcgatctagctaacatcagtaatccaattaaaaaacaaaaaagcacattgcttttactttacatttaatttggtaggcatgtttaatttctaaacaaaataagtctaccttctatttagatgatgaagaagattataaataattgcttatagaaattatttgaatatgatatggtataaatgtaactaataggttaaaattatataagcaatactaacgaaaaaaattgtgaatatatatcgtacttttaaattgtggcagattttctccggtaatattatatccttataagcttctcaaacctaacctatgatgcatgcccgcacattcgcgtggtcttatataaaacaaaacagaaaatagaaaaaaaaatgccaatatgaactacatttgaactaattgctgaaaatcttgtaacttattttgcttcattcttttgtcttagatattaatgatttttcttgcatcgcatcaattttttaattaagtggttagattaatgatttttttctctatcgtgcgccactgtattatgaatttctccgcatattattgcaaatataagcaacacactaaggttacagtacatagtcggtttagaagttatatttcttactactaaatttattttttaagggtcaagttgattaggtttttctttttaaaaaatacaatagatcacatatatcacagagaaacgagacctaggatgcatgcatatcatctctatcttattcatttgtaactaataattaaattgcatcaatataaaccaaataaaagaagcgctagctagatggtacaaatagaacacttttgatagcaactaatgtatttttaagatttgatagaaaaaagttagcccctaaagaaacacctagcttttaaattagatttaatttgtagatatgttttctaaatatactaaatatgtcttattttagatgatgaagaagattatagaaaattgcttaaaggacgattaaatattatatggcataaagctaacaaaaatatgttaaacatttatctaagcaacgcatcctatgatgcatgcccgcgcgaatgcgcgactaccttcctagttatatactaaaagtccattaaacttgcaaaaaaggccctcaagccaccacgtggtactctataaacattcctataccgccacgtggcactgtctaatctcaccgttgattttcatttaattggtggacctatcattttaaaccattagattatatctatatctatatctatagttgatttttatttaaattggtggacctattacgaatcattaggtgtatatataataccttccctatataaaagg

SEQ ID NO: 2553 - DNA, 904 bp, Oryza sativa
gcgcctccggaggcggcgcctccccctcctcctcctccgctcggtcgccggccatggcgagcgcgaggcgaagcagcgggaagaagaagaggaggaggagacctcggctagtggcagaatggtaaatagtggggaaatggaggggcggagtgttattttggtgatggatcgctgatcaggtcagcgtcttgggtacgttgggttgaatgggtcttcgttttttttttttttttttttttttgcctgtcttccacggcagatttccgtctacattcttcggtgtagctgcaccaccggctacctaccaaccgggattattaccgtgtcatgtggtgtggagaattaggttaaatcatactccctcccaccatattttaatggatgacgttgttgactttttatcaacgtttgaccattcgttttatttaaaaattttgtgtaaatataaaaatatttatgtcatgcttgaagaacatttgatgacgaatcaactcataataaaataaatgataattacataaattttttaaataagacgaatgatcaaacgttggataaaaagtcaacggcgtcatacattaaaatacggaggtagtaattgttattgtagagtttttttctctctataggagtggttgatagtgatggtaatgtgtatcaattacgtgtggtttgaaacaataaattaatggtttatgtagggctggatggaatataggtgatgcgtagtgattgttttgtggtttttttttgagaggctgtttagtttgttgtgtgttcaaaacacattattggtattatctagttggtaaatagtgagaatttgtgcgtgcacgtgaattcaaacatagcgtgtccatgtctcgcgtgtccatgtctcggattggacagatccacctgaagc

SEQ ID NO: 2554 - DNA, 1501 bp, Oryza sativa
atttgaatttaaggaggttaccgcggtatttatattactgtaccccgcggtaagcatggtaagcatggtaaccgcacggttgccggcagtaacgtaaaccctgcacggttgccggcagtaacgtaaaccctgctcagatataggaatttatgtgtagccactgcacaaataccacttaatttgaaacttaattggcaatagtttcagcaagtgattgaatttagctcatgggagatggcatgtctaaggtttcgttaagtatcaataactgatagatcaatgagattaggtgccatgattgaatttcagtaaatcgccaggaaagatgcacgcatgaacagaccatcgttcacttggttatgttgcaactagacaatagagcaaaacacaccggggtggggggttaagaacattacgttcacaacttcacatattgaagcttcatttcacggatgataaattacctttctcaactatttaaattgatgggatgaatcgacaaatgggatatatactaatactttgttctccctgtgattattcactggataaataatttagttggcttttaggaaaatttgtagaaccgcactagtcaatgctagctaaactatgatcttaagaacctttacatttttctaccgattcataagtgggcaccacaacaccagaattacatttatctaaaaacaactatatatactattccccgtgcaaaaaaataaaaaactatactatttatcacagcatcactgcagcacatgatgtggtaggcccaggactaccctagaatttggcctagagaagaccaggtattcatttttcttggcccatgaaaaaagcctggtccaacaaataaaaaaaaccgtaattctctctctcccgtgcactctcccctcccagcctccactccctcccaacagacaagcaacggcgacggcgctcccacgacctgcatggctggcgcgactccggcgctcccgccgtcctgcgaggcccctatgcgcgccgccactcctcccgtccgtccggctcccactaggcgctcgcgcccagccgtggcgcccggcggcgccgctaccttcgcgtgccacactggcgccggcgcggccgcgccctctccacgactccgcgtctccggctcttcgcccctggccagctggccacaccctctctgtcccgcgttcagccgtcacccactcgcccggcctcctgggctcccggctgaccagctcctggcctcccggctcccgcggtctcggtgtccggcccgacaacgctagtgcccagccacccaagccggcaggccccagccgccgtccgcccgtccggccagtgctagtgcactagtgcgccactccctctccggactccggtgaccaattcctcagtccctcactccctctcggcctctcccccttctagaatctagagttctagtagtagtagaccagttgatgacaattttgcatggtttgatggttgtcaggagattgaggca

SEQ ID NO: 2555 - DNA, 1501 bp, Oryza sativa
atatcaagccgctccctctccctctccctccctcttagcaacagccggcagtgggaggggaagggaagcggcggggcggcgggggcggcctcccctccgccggtcctggaggggaggcggcggggcgagccgagcggccgggaaagtggcgaggggtggcggcctcccctctgccaaatctgggaggggaggcggccggggaagcggcggggcgacggcctcccctccgccagatctgggagggggaggcggcagggcgagctagccggcggggtggcggcggtggcactagggcggtgcgagggtggcggcggactctcctccaccggatccgggaggggaggtggtcgggtggtggttgtggtcctgtggagcttttttttattttgtgaattgatgtgtagatttttttgttgatttggggatgatttgtggattgtggatgggcatgtgttgtgtatgatttgtaaatgatttttgtggatgatttaggtgtgttgtgcgtgatttgtaaatgatttatgcatgtgatttttgtgcgattgtgctcgagatggaaatagaaaaacagcagtggaagcaaaaaaaacaaaaaagaaaaaaaatcccttactcccggttggtaacattaatccgggctaaagacgattttatctttagtcctggttgaccaggactaaaaatcgatctttagtcccgggtatttgaatcgggactaaagatagtggtctttagtcccggattcatagtcctagttgaaaaaccggggttacagagggttaccaatcgggagcacaaatcatttctccaccagtgacatgtcagactgattcatcatcttcctcacctctcttcccctgccagcagccactgagttggtcagctcaaggcatcaagtgctgatgccgatgaacgcggcagacaacgcaaagaggggagacacgccgcctggagctccacggcgcctgttgacggctgttaagtgccaaaataacgtcgtcaatacctgtataaaaccacaaatgtgaaacttccaacatagtggtaggatttatttctaacaatttccacgagtggtggtgtatatttgtatgcaggtgatcaaccaccaaagttgggagagaatgagcataaagaatggaaacatattttgctctcatgaactcacatggttttaagctacaacatataaaatgtgcaattatttggaccaaaacatggagcatcatgaagtggggcccacatgtcagcatcctgaagaaagatgtgggccaggggagccaatcagggttcggccgaacccctggatcggcggaacccgcagctggcccaatccagcccatattcggtatgacgattgtactcctcatcccaatgacggttgtgtccttttctaccggtggaaaccgtcatagagaggacacttgtcaagaggagatgaagctagaaggaatatgctcataggatgcttggagcatctccactctcccaaggcaactct

SEQ ID NO: 2556 - DNA, 1501 bp, Oryza sativa
ccgagccgcaataaatgcggttaggtgagccctgctgggctcacctaacccatgcacgcggagtagaacccgcgaggggtcggggcgcctcggccctcgggggcgaggcaggagtggtccgacccccccccctcggggagaccaagaggtgggcgcacacatcaccctcgggcccgacgtcccccgagggtgccaggccacgtgggcgattgtgtctgcctcaagcctctagtcatgatactcccggtcccatgtcaccgacacaatggctaaaaataattgagatgatgcggcttcaagagagaagagagaaataacattaactacacttagtggggatgaactttatagatatactaggtgattccctgcgctttactgcaagaattactaagtaatttctaacatatatatctttcaacaatcgagcaagaagtaagtatgatgttaattattaacaacaaataaaactgattttttttcaagccatatttgaagagaaataaatttaatagactttgtagaggattatagatgaaatttatgttgttggccaaaatttgtatcgcaagaagcggaagacaggggaaaaagaaatgaaaagttaggatttattagtagtaaacatgaaacaaactaaataatatcttcgctttgatacagaatatatggatgtatgtatgttaagtattataaaaaatgatggatatatttgttgaaatattatggaaatgatgagagaggtgatgattggatctatttgcattctgatttgtagaattaaataaagtatggatgatattgcatgtttgtatgaactatttgataattagttgttgctagtgaatgataaggtagcatgtttgcatgttgagctttatacttagtgggctttaactttataaaaagcatagatgagagacgattgttgaagattgcataagtgtcttaccccctcttgtgtggattagtcctggattatggttctgtgattgcttggtttgatgggtcggaatccaagaggattcggatcgttctcaccctcaccacttggtcgcatccaacccttgcaggtataaagctagttatcctcttgtgcacggtttacaccggtgctctttggttcaaaacctactaccgtgaagatcgagcctccccttgcgggtgtgtttgtatcagttacctagttctacttggataagaggatactcaatgatataaatacaagactccctagaaggaaagagacacgaggacaaatttagacaaacccaatgtggacatgagggatctagagatatattcaatttcgtcgagttcatgtttgaggaataagactgcacaagtcgtcgatcacatgtgagagctccatgctgctagatcgatagggactagattaggtcaactcaaatgttgtactcgtgtgagactaatatataaaggcaacaatgactccggtcaacaggagaagagctattacctgtcagttaaggggtccgaa

SEQ ID NO: 2557 - DNA, 1501 bp, Oryza sativa
ttcccctgtcttccgcttcttgcgatacaaattttggccaacaacataaatttcatctataatcctctacaaagtctattaaatttatttctcttcaaatatggcttgaaaaaaaatcagttttatttgttgttaataattaacatcatacttacttcttgctcgattgttgaaagatatatatgttagaaattacttagtaattcttgcagtaaagcgcagggaatcacctagtatatctataaagttcatccccactaagtgtagttaatgttatttctctcttctctcttgaagccgcatcatctcaattatttttagccattgtgtcggtgacatgggaccgggagtatcatgactagaggcttgaggcagacacaatcgcccacgtggcctggcaccctcgggggacgtcgggcccgagggtgatgtgtgcgcccacctcttggtctccccgaggggggggggtcggaccactcctgcctcgcccccgagggccgaggcgccccgacccctcgcgggttctactccgcgtgcatgggttaggtgagcccagcagggctcacctaaccgcatttattgcggctcggctaaacgtgtcacgccgcacgaaatacagtgcactccactcgtttatccggtctgtgaccagtcacagaccggtcaaatcgcgggttaggtggcgacaggcggtctgacgcacgcttcgccccatcccgtcaagacgagagcttctaggcactcgtccccagctggagttagcgtgttacatcccagagatggcacgttagccccggtcgatatatgccaggcttcatcctaaccattacaggcaagatgttgtgtgaagaagggcaaacatgcacgttgctaagctgacgcgtggtggacaagaatgaccgatttgtgatcggtctgacactgctcatgtcgtcagcacacagccacgttcccacgacgcgcctgcctccggcagaagtggaggtaggtgtgtgccgtcccgtcagaaggatgttcggaggacaaccgtgcaaatctccgtccatttatgaagagaagaaaagtccagtttagaaagagaggggtgcatgtggtatccccttgaagtataaaaggaggaccttgcccatagggaagggggatgactttttccagattcagtagctagaagaaaagggagaggttggctcacactttgtagctccttgatacacagatccaccaaaacataggagtagggtgttacgcttctcagcggcccgaacctgtatacatcgcttgtgcttcatgctctttcgataggtcgcgatctttccacatacacagagagcttgggatctcaccctgagcccccggccgaaccggcaaaggggggcccgtgcggtctcccggtgaggagccccgcgctccgtcatctggcgcgccaggtagggggctcagcgtgtgtcttctgagctcttgcgctctttcgtgtgcaccaagcctttcctgttcagcctca

SEQ ID NO: 2558 - DNA, 1501 bp, Oryza sativa
cggcatcaaggacctcctgggcggcgtcgagctttttctttagctccgcctcccagctcccgtgttgaaggcggagggagtcctgcgcctcgttcatcacagtggtggcgatgagggcagccccccgctcctcctccacctctcgggcgatctccgccagcgccgtcttacgggcttcaagatctgagacgtgccggcggtgtgctttgcggcctgcttccaccatggcctccaccgagcgccgcccctcctcgacacgcgcccatgcggcgtcgagctccgcacgctccgcctgcagggcctccacctgggcgcttaatccatccaacaccgcggtgttggcggcggctaaggcctgcagaaggggctctgcgctcagcggggcgacggaaggcgtggggaagagctgccttggagaagatgccgcgcggctcggcccgccaatggacgtgccggcctcggggatgtcccccggacctgtttggtcctgggcgtcgcccgaaggagtgggcccaagcgatgcgcccgcggcctcgtcgcgagccatcctagaagctgtcgcctgggcatcgcccgaggaggtgggcccaagcgacgcgcccgcggcctcatcgcgagctgcctcggaagtcgccatcgcctcagcctggcgagcccgggcggcctcctcccgagcggcttcttcggcttggcgagcccgggcggcctcctcccgagcggcttgcggttgtggcagccgagatagatcgtatcgtgcgcgcgttaattacgctcgccgaccgaagcgacgttaccatatctccaggcgaagcaaatcggctcgcccagatttgggcgctgctcaggtgaggtgacagtcttgaagagaccgcccattattgacagccaagttaccattaccgatgcgcatggtttgagaccgttgggtttctgcccaaccatggagaccggtcccacctgtcaccaggctttaggagtggcgtcacgcccgaccgcttcccttgagaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcgcccacctcttggtctccccgagggggggggtcggaccactcctgcctcgcccccgagggccgaggcgccccgacccctcgcgggttctactccgcgtgcatgggttaggtgagcacagcagggctcacctaaccgcatttattgcggctcggctaaacgtgtcacgccgcacgaaatacagtgcactccactcgtttatccggtctgtgaccagtcacagaccggtcaaatcgcgggttaggtggcgacaggcggtctgacgcacgcttcgccccatcccgtcaagacgagagcttctaggcactcgtccccagctggagttagcgtgttacatcccagagatggcacgt

SEQ ID NO: 2559 - DNA, 1501 bp, Oryza sativa
cgaaggtgtggtttcggaggcactgctccttccaatctctcgtgcgcgcaagagataagaagcgaggaagcgagagcaacttaggcgcggagaaggagaaactaacaccgggaaagaagcgatgaaaccggatcggactcgcggcctccttatctatcaggagaaagaacgtggacgcgctgttgtggagggaatcgtgggaacgtgggttagtggctgcaaaaggatagtgacgtgacgcacgccgccagccacgcccacgccctcggcccggcgcgcgcgcgtgtgtggcattccgacccccacctcaactggtcaacagggagcctccaataactccctatttaggttgagatattcctcgcttaaatcctgaggtggtattattatcctcaatacttattatgggcctttgagatttaatattataagttgggcctagcccaattattctatcacgatcatcatctcatcagactatcagagatggaataatcttgatcaagctgtacagtacggcgtgccagggaaatgtacgacacagggatcaccgaatgtgtccttgtttaagatggaggccggatcgatctcggccttagcaccgatcgatatgggcagagaacagttccatgtccgatcgtgcccatgcatgccttggcaacgcagctgtgcctgcaatttttaaagagagcgcaacgattgagcaacacagttgcagcactgattagttcgatcagtgctgaatatgcattgctagcttagctggatattccctcttgaattgggataaagtttcagctcgatcattaattgctctagctagctatacgaatgcccaggactatatataaatgaacatagttacctctcattaatatctgtatttcactttgtatcattgtatgtgtgagatactgattattgcatatatttttgcatgcagatgtagaggaagattcgaagtggtagtagaggtaatcatcgatgatctagcggcgacagggacggctgatctgtgtgctggaggctggagcatatgatctggacaggatggccgcgcgcgaaagggacaatgctgtagtccgcgcggtgtgcattgcgttggttacacctacctgaatcgatcgcacgcacctcattttctggtaaccttgcgagcgtcagagaaaagaagacacgatccagcatatgcagaaacctctgaaaatgcaccgcgccaaaaaggtgtacagtacactgacagaaaacgttcgtagctagcgtttcggtagattgatgcatgtggatgatgcatagctagctaatcgtgctcgacgactagctgctgctcgtggtatgtcgtccaaaactatatcatgcatgcaccacctaagaattgaattttttttaagataataaaaatgatttatatctccgcgtctttgcataagacactacacaaatccagtaagtttagtatctaaaaataaagccatgaggtaatgggataaacccctagctt

SEQ ID NO: 2560 - DNA, 1501 bp, Oryza sativa
  unsure (1)..(1501): unsure at all n locations
aaatgcagagaacaattttagatcgataatgttctgctcttccttaacgacgcaagaaatatcctgctttctcgctttggataaacaaacacaagtttcaaatttcatatttacaacaaactcgggaggcttcgttcaatttttggatctactgtagaagataaacgaccttctgttgaccaccgagaaaaataaaaacgggcgggagtattcgattcattagacccggtaacagtcattggcattagtagcgatcgaattgagggcgcatagggagggagtagctactccaggtagtagcatattattttcatatatatatatatatatatatatatatatatatatatatatatatataattctttatatgcatgaacctttaatgtattaaaaatatacacatgtatatanaatgtatataaaagttgtgtgcatatgaataaagagctaaaaaatacacgtatacaaactttgtatacgtgtatataaaattgatatacgtatgtaaaaaaagcccaaaaaatacacgtatacaaactttatatatgtgtatacaaaatttgtatacgtgtatacaaaattggtatgcgcaggtataaaacccagaaaatacacgtatacaaagtttgtatacgtatatacaaagtttgtatatgtacatattaaaaaaccgaaaaaactaaaaaaatatggaaagaaataaaaacagaaaaagaaacgtgcgtaacaaaaaaaaccgcacggcaaagatacagaaagaaaaaaaaacagaaaaaacaaaaagaaagaaaaccgtccaaaaaaaaaagaaagaaaaatcgttcggaaaaaataaaaaccgcaccgcccgcgccacctccgcgacacgcgtccagttgcgcgggggagggggcgcgcgactggtcgccgattagcgttctcggctaccatgacaggacaaacagactcctgcaactttagaacgtgttaattagctgactttcccatattcttctcccaaattttcacactcaccttcactgaactgataaacgatgtgttttctattttttaaaaaaaatctagagaaaagttgcgtttagaataaattatattaatccatttctcatgtttttagctgatacttaattaatcatatgcttgagctatctcgttttctacatggggacaagttcgcaacttctcctcccaaacatagccttaagccattctcaataaatgaaatgccatgtaagcaaatatagtgacatggcaatataattataaagaaagggagggaaaagtttcatctagatgaaactgggtgtacacaatttacagaactatgaaattggttaaaactagcattgggggctagaatatttcatttcatccaaccatatctaatcccatgcatcgctattaggggaatgttcttttcttcaactccaacctacaacttattcattgtccgttaacacgctttcaaaatgttaaatgatgcgtgtttttaaatctt

SEQ ID NO: 2561 - DNA, 1501 bp, Oryza sativa
aatacagatattaatgagaggtaactatgttcatttatatatagtcctgggcattcgtatagctagctagagcaattaatgatcgagctgaaactttatcccaattcaagagggaatatccagctaagctagcaatgcatattcagcactgatcgaactaatcagtgctgcaactgtgttgctcaatcgttgcgctctctttaaaaattgcaggcacagctgcgttgccaaggcatgcatgggcacgatcggacatggaactgttctctgcccatatcgatcggtgctaaggccgagatcgatccggcctccatcttaaacaaggacacattcggtgatccctgtgtcgtacatttccctggcacgccgtactgtacagcttgatcaagattattccatctctgatagtctgatgagatgatgatcgtgatagaataattgggctaggcccaacttataatattaaatctcaaaggcccataataagtattgaggataataataccacctcaggatttaagcgaggaatatctcaacctaaatagggagttattggaggctccctgttgaccagttgaggtgggggtcggaatgccacacacgcgcgcgcgccgggccgagggcgtgggcgtggctggcggcgtgcgtcacgtcactatccttttgcagccactaacccacgttcccacgattccctccacaacagcgcgtccacgttctttctcctgatagataaggaggccgcgagtccgatccggtttcatcgcttctttcccggtgttagtttctccttctccgcgcctaagttgctctcgcttcctcgcttcttatctcttgcgcgcacgagagattggaaggagcagtgcctccgaaaccacaccttcgcctgagatctgcaccgggtaggcgggtgatcaggtttttggggagtgcctcccgcacgactgctcatcaccatgtctggagttgccgccgccgctgctggaggagatggcggaggtggtgcgccgccgacaggagccggagctggtgcgccaggaggtgccgtgaacgacaacaacaacggaggcaattctgcctcaccatccagcggagagccattctcggggtataatcttctcctcctgttcctgttgttagcgctatttctgttcccattgttagcgctatcgctatactatgtgcgctatgttcttgttcctgttcttcatgatgcctctagcatgttattgcgttactgttatgttcctgttcctgacattcatgatgcgcatagtatgctactggttatgttaagatcaccctacactgcttatgccatgattattgctttaacatttttggattaaaatatgccgattaattactatatttccaacattccaaaaacctgataggacattttcggtagttggctttgctgctgcactgaaaccacatgcttttgatggttcaaactataagagatggaaagcacgtgcactattgtggttgacagcga

SEQ ID NO: 2562 - DNA, 1501 bp, Oryza sativa
  unsure (1)..(1501): unsure at all n locations
gagaagttgcgaacttgtccccatgtagaaaacgagatagctcaagcatatgattaattaagtatcagctaaaaacatgagaaatggattaatataatttattctaaacgcaacttttctctagattttttttaaaaaatagaaaacacatcgtttatcagttcagtgaaggtgagtgtgaaaatttgggagaagaatatgggaaagtcagctaattaacacgttctaaagttgcaggagtctgtttgtcctgtcatggtagccgagaacgctaatcggcgaccagtcgcgcgccccctcccccgcgcaactggacgcgtgtcgcggaggtggcgcgggcggtgcggtttttattttttccgaacgatttttctttcttttttttttggacggttttctttctttttgttttttctgtttttttttctttctgtatctttgccgtgcggttttttttgttacgcacgtttctttttctgtttttatttctttccatatttttttagttttttcggttttttaatatgtacatatacaaactttgtatatacgtatacaaactttgtatacgtgtattttctgggttttatacctgcgcataccaattttgtatacacgtatacaaattttgtatacacatatataaagtttgtatacgtgtattttttgggctttttttacatacgtatatcaattttatatacacgtatacaaagtttgtatacgtgtattttttagctctttattcatatgcacacaacttttatatacattntatatacatgtgtatatttttaatacattaaaggttcatgcatataaagaattatatatatatatatatatatatatatatatatatatatatatatatatgaaaataatatgctactacctggagtagctactccctccctatgcgccctcaattcgatcgctactaatgccaatgactgttaccgggtctaatgaatcgaatactcccgcccgtttttatttttctcggtggtcaacagaaggtcgtttatcttctacagtagatccaaaaattgaacgaagcctcccgagtttgttgtaaatatgaaatttgaaacttgtgtttgtttatccaaagcgagaaagcaggatatttcttgcgtcgttaaggaagagcagaacattatcgatctaaaattgttctctgcatttggagggttcataacccaactgaagtcagatttgtagcctcgccggcggctgtgttacagataacggtgaaagccctggcatggaggattccagttccaaggtttgctatcatattcatctgttattttttcatcttttggattcttttcctgatctcgattcctttcttgatcgtttctgctcctaattcgctttctttatgttttgcatttgcagcaactttgtagtcctgcagcaggtgcaaatgtatcaggtggtggtggctctagttctgttttcatcagaaactatcatgctggtgtaaatgtaatta

SEQ ID NO: 2563 - DNA, 1501 bp, Oryza sativa
ggtcgtaagattgagggcttggccgcttgggagttagggacgttgccgaaggaatcctgttggtcgagacgtcagagttgcggtggccagccgcccggtaggccgtctccggactggagtagtatttctgaagtttacggggcggctgatgcttctactccatattaactattccatcggaaccgtgcgattattacgtgcggtttttaaaaaccatgataaaccgtgcgattattacgtgcttagcagcaaagatgttagagatgtgtgcagcaacgaagatgctatcttcaagttttgcctttgctagaatcatcctcttcatcgttatctctattttctttcacgttattaggccaaacatgaaatggatggggatgcagtgacattctcatatcggagagacgtgatcgttaacacgtgaaccctatcatccacataaccacatgtctatgatcacattagaggatctacttctccaaaaggagataaatattgttacagtgactcaatccatataaaccaaaatctagtaccaccaccaatttctctcccttcctctttcctttttcactaacgtgcaagagacctgcaaacacaaaaaggtttcttactgtcacaacccgcacacaacttcctgtttgacagtccacacgggcgcgcacgtgagccccaccacgcatccgagatgagatgtgtcagagaactctgcatcgatggatcgatcgaccgctgtttaatggaggcagcagtaacgtctgtgagcagccgctgcgccgctcataaataaaccccccccccccccccccccaattgggctcctccgcctcttcctgccattaagcaccagatcctaatccgcctttaatgcccttaactccaagctcgatatcagaggaggaagaagaggcgtaggagtagtacggctccgccgcctccctcccctgccattataagctcacgcgcggcgctcgcccgggcggctctgccacctgtgaccttgctgttgctgtcaccggagaggcggaggggatgctcacgtgcatcgcgtgctcgaagcagcccggcggcggcggcggggagccgctgcacgagccgccggaggacgaggacgccgtcgatggcggcggcggcggcggcggggcgacgcccagcacgcggctggccatcaaggcgctcactgcgcaggtggggttctcggtacttcactctcgagagtcgagactgtcactgtgtgtgcttgaagctcttcttttcttatcctgttgattaattcaatgaaaaagaaaagaaaagagaagatgatggttttggttctgaagggttcctgcttttctgttcagattttgcttcgttttgatcgtggtatataatttttttttgggatgttcaagctctttgaatgtttgaatctttggttcgggtaggtcgtaatcaaccagatcgggcttgattttgacgggaggtttttgttttggggtttcgtttcagatcaaggaca

SEQ ID NO: 2564 - DNA, 1501 bp, Oryza sativa
cttaggtactccttgagaatttttgttctttttttggtttaaatatgcaggctaagattcaatttttcacagttctaaaaaagcatctcaatttataaacaagcctttgcttatgtactcattgagaaattctcaaaattcctgtgtgtacacccgaaagctatcaaagtcaatggtaagcttttcaatttgctatgtgctgtttagttttttcaaagaagcttcatgaaactttcgatcaaatctatccaagtgtggagcgctttaagaaagcaattttgaaattgtggtccgtatcttgtcaagaagacgtagaagcaaagttgatttgaactgaaagcaaccattctttttgtttgcatgtgtttgaattcaaccatgacaagtacatatttaaattcgaaccaaccaggggagagcaagaaactcaaacttctgagcgaatcaatcaatgtttgatttttgtaatctgatagaaacaaggcttttgtcatgagcccatcgaaattattgtttcttcttacgttttctgcaagatcatgcctaactttgacaaaatctgtccaaaaccttttgaatttcttatgcacggccatacgataagctgatttaaattgaaagccaccgtcttttgatttgtgtagggaatgattccgtgaaaaacaagttactacgtttttaaccaaactatgtttaatatttttatataagcaaggctcttatcacaacaattcaaatgttgtctctggaaagtacgctcaactttggacaaaatccatccgaactttgacatttgcattttggttttggtccataaccatatcacacaagaaaacacggggacaatgctgtccgaattgacaaaatctatatttatgtttgtgtggttccttagttaaatcatcaaaactttggacaaattctgacctctcttggaattttttaacaaaactgagaaagctctggaagttagaacagaaatggccttctttttgtttcgataatcttctattttgaattaaatcatgcagacaacagcatgattcttgcttgccctgtaaggacaagggaggtacaacacaaataattccattgaagtcttagtgcccaaaaaaaagaaatattgaaactaaaataatatcacagtctgaaactaaaatagaggataaaacaaattcaaatagtccatgggtacctgaattctttgtggttgccacgaattcggtacggtaggttaataattgttagtagacgtaccgtctgagaatattgaacatgttatacattggagtatattattccaccaagactcattttactattttcgcacaatcatcaatttaagacctcaagtttacagaaaacgactgatttaatgacacttgaaaaattccaaccatttctataggatcatggtatgctttcagcaattgctgacttttgccctaccttatcacttgagcccctataaatagaggcattatattgaacaaatgcattg

SEQ ID NO: 2565 - DNA, 1501 bp, Oryza sativa
caaacttctagtactagaagaaaagctaaacattataggcaaaataaaatatgacttagcaattagtaatcctcaagcaaatagaataatagataacatgtctaacacaaactatttacatatattcatttagacagcaacctgatcacgccaaaccacacatttccagaaggttgcttacccataccacacatttttagcgaggatgaaatatccaggaaactatcagaaatgtgaccaaatactgcgtcataaaaaagaatctgcaggcagataaatggaaacgaaaaaaaacttccatcagctcaattgtaaaaagaacttattccagacagtggtgtcagtgttcccctaaaataacctaatcatgttggaactaggatcaatgctacaaggccggcccactgccgacgcctttgtaaatgcagacatgctaacacttaacacctttcccgtgtggaacaggcaacaacttaaaaaaaaaaagaaaggtctttttcacgtcgcaaccatggcttcaaattttgctccctagaaaacgatttgtgtacagtgcatgacagggacagccaagatatgagcattaaaatgtggaatcgactggctcacaaatcgtgtttatgctctgaaactgtcaataaaatcacgaaaattttcaggctaataatgtaacgtcagtgcttaggagaaaaaactactgtacttttcgggtcagattctttcgctgacggaatcgccattattatttcccccaagccaaccaacgctgcccccaccgcctctgactgacaacctggccccacgaccccagtcaccccatccgatcccaggtcccccctgtcccctgcaccgagtctttctgcaccgccccctcactttccacctccgggcccacacgacagtaacccaggggacccacgtgcaccgggttcacgggccccggtcgagacccccggtgcgccggtggcattcgaggaggctagcctctctctcctccccgacctcacaagcgcgaaccccgcggagccgccacctctctcgcctccccgcctccgccgcgccgcctagggtttccaccgcccccgggatgcgcgcgccccctcgccggtagcctcccccccggttcccgccgcctccgccgccgccatgtcgctgctgcggcgccggaagcagccgcagccgccgccggagcagccgaacgaggacagcagcaacggctccgacctcgacgagaaggggaagaagaagccgggatcgtcgtcctcctcggcggcgcctcctccggaggcggcggcggcggcggcgaaggaggcgacgaagcggacgagggccaggtggtcgtgcgtggacagctgctgctggctggtggggtgcgtgtgctcggcgtggtggctgctgctcttcctgtacaacgcgatgccggcgtcgttcccgcagtacgtcacggaggcgatcacggggccgctcccggaccctcccggggtcaagctgcagaaggagg

SEQ ID NO: 2566 - DNA, 1501 bp, Oryza sativa
aataagggtcgggccatgctgggccggcccgaaggcacatgcagcccatcatgttttctttgaaataagtctatttcccctccatactctttgggttgtgacatataaaaaactaaataagtctattttacgtccctactctctagtcgtgccatataatacgtctatacgtctatatggttgaaaataagtctatttcacctcgctaaagttcgtgccgtgccgggccggcccaccgtgccgaggcataggtccaggcacagcccaacacccgaaccgtgccggcatgggcccgacaacgatcaggccgtgccgtgcctgggccaggccaaaatcccctgccttgggccgggccgttgggcctcgggcgttatggccaactatacttcacggtgaaacaacagtagtaggagtacgaagcaaaatgccaagatccaacttttttatggatcttcgattttttttccccctaaagaccactagggttgactagttggcgtagggttacagctaatggcttcacggtacgactcatttatcttttattttaacgattgaagtacaacgttttagactctgcaccaaataaaaacacacacatttatatttataaacagaaaatttttccgtttgaaccatcctttacctaacatttttcactttggactaggtaaacatatcttttatcttttgtgtcactttgaaccaccccagttttctaatccattcacatacaactcatcgtatattgaaaatgttatttatatataacttcgagagttcattgatgtactagagcggtgtcatatttgaggcaactgcgagttgtcattccccactttcttaagcaaatgtttgagagaagctgattgagaagatacacaaaataaggtgaaccattagcatacgattaattgagtattaattattttaaatttaaaaaatagagtaatatgatttttaaagaaactttcatatataattttttttaaaaacacacaattaaaccattcgggaagtatgcaaaaactggggtacctttcctctcgaccagcttatgccgaacacagactgtgttcgttccgagaaagggaagaaaacttccttgttttccgcgcacatgtttctcgaactgctaaacgatatgtttcttttaaaaaaaattttctttagagaagttcctttagaaaactatattaatttattttttaattttaaataattaataattaattaatcattggtgaatgactaattttcttaatcatacgctaataattaactttttttccaacaaaggcatagaatacatgacgttgacttttaagctgttataagaactacaactagtatgcttgtgaagtgaagaaccattcaggaaagttcagaggtttctgccgaacaactggcctcactcaggctgtgtttagttggatccaaagtttagattttggttggaattggagatgatgtgactgaaaagttgtgtgtgtatgacagg

SEQ ID NO: 2567 - DNA, 1501 bp, Oryza sativa
aaatttattttaaaaatacaccgtctaataatttaggaaacatactcatagtaaacgaacgagttgcaaaagctaaactcactttcaaattggcaacagccaataagatgaccttttgttggctctaaagaataatcacctaaatttgaaagccatatacatatacaacaatatttctcaatgctttctttaaaaattattttatcttttaccgagtctcaaatctttctcttttactttggactagctcatgcacaacagctagtacttggtggctatgcgctcacactcaacgaacatatgattacttctttctcattcatgtaggatgtaggttgatatggcttgagtgataacgtttgcatgtaaactaaggttattatacttgccgtacatatatgatactaggatgaagtagatatacatttatgatagatgctcacaatttttctttgtggaatcacacttttttggatggcaattgttgattaagtatgcaaccataaggggtgtaaggaaagtcaatcattgtgcagctatggtttattgggcatttggatggagaggcatcttttttctcttctaatgaagtgaacattgaagaaaagtatgttattcttcgctccaagtatcaatgcatatacttgtaaaataagcatcacatcacatgtatatacatgtaccatgccaagaaggtaagcatcaccgtttagcgatgattcgaggaccagcatagtgtagaagagcggtgtacatcttaccttaatttatagaagaatggtatctcccgatgaataaaaccatatagaacacggctatatcaaaaactcataccatattaaccttattgatttcaaccagagagaaacgggactaggaaaaacaatctaaaacgactaataacatgttgtacatggtagaggcgagatcaatcaaggagtcgatagtggtgtatgaagcacgtatacattcatttctgtttgaaacaagggtgcgtacaccctgtgatcacaaatatttgtgctctatgataaatctggttattttttattgcttggcctatcaataatcgggataacttttagtttgaaaacataaaacaatataaatagatttatctcgaaaaagtacttttattgaaaaaattcaaacatcttagtactaaattcaatcgagcaaacttatgacaacaaatcattgaccatatgctagaggttgtaacaatatgaacaatcccactaaacgaggactcttcgacattgcatagaaattattaattttatgttcagctaaccttaaaaagactactcctaatataattttcataaacgaacgaggtatatagcgactcgaaatgaggacaaatcaggtccattttttcacccccatgcaggaggaaaatgagaggcaggggtattttcggcacttcacaactcgagaataaacaaatcttgaaaaatgtgacaagatggccgctgctctgctctgctcctgctcatca

SEQ ID NO: 2568 - DNA, 674 bp, Oryza sativa
tcttcatctgggctcagctagtagcatgtctttttcttccccaatctatcaaaaaaaatacgactcgggccaatacaacagtagagtaaaagtctgaaaccaacatcacaaccaaaccaaattgcccctctcaacccacaaaaaaggaactaatcttttcctgcaatttggaccaaacgcgagtaggtaaaaacaaggggattaattcgagaggtgaccaaccgacgacgcgacgatgcggccggcggcggagacgcgccccctggccgccctcccgccccacgcggcgctcagcgcgacgcggccgcgggaccccggggaggcggcggcggcgaaggagacggccgccgggcgccgggacaccgcgggggaggtcgcggcgaggagggtcggggcggggcgggaggtcctcgcgagcacggccatggcgtccatcccggtagctgcttctcctccaacgtccgcgcgagcgagcgagcgaccaaagcagccgcctttttttggattagggagagcggagaagaagaagatgatgagcaggagcagagcagagcagcggccatcttgtcacatttttcaagatttgtttattctcgagttgtgaagtgccgaaaatacccctgcctctcattttcctcctgcatgggggtgaaaaaatggacctgatttgtcct

SEQ ID NO: 2569 - DNA, 1501 bp, Oryza sativa
tctatactattttaaaatatagtagtgatggactggtggtagcagtgagtctgctactatcacctctatcgctaacatattaggcctccttatcggtgaaactcacgtgctcactggattcaaacgtaaaaaaaaaagtatgtctaagcaaaataatgtcaatatttttttaaggtccggtaagtacgtactcccttcagtttcattttaattgacgttttggacaatgatacggtctacaaaatatatctttgaccttatttttctattataatatatataataaataattgcatatttacttttattgtagtgctttgaaagacaaatctatatatgttgttctagttcttttaaattaaatatttttaaagttattaattgtcaaagttataaaagttcgatctcaacctcatctaaaatgccaattaatatgaaaccggagggagtagggaattaatccatatagttaaaaggattagaaagagccagtttgcagaatcttcaaaaagataagtgtgcacaacgtgactttgttttttgccattgcaacatacaggcagtcttgtcccaaaatgaaactatttttttcactcttcacccaaaatgaagctattttttcactcttcccctcctctcaacaaatcataaccattctccatttaattatctcgtctactgtctgttctcagctaatcacaaccttactttaattatttctaccgattttttaaatacccatgctcactaaaaaaacctacattttgaatagaggtaatacaaagtactctctctgtttcgtattacatgtcgttttgacatttttagttaaactttttaaagtttgtccaagtttatagaaaaacatagtagcatttttaacacaaaacaaacatatatctactattataaaaatcaaagatgttttttgtcgaaattttgatacgtcatccgtttttgagttgttatatatcgtccgtatccaatttgatgtgagtatagaataactattatacatcctatcctagcccaacccctcccctccaagcccaacctaactggcccacactatcccgccgtcctatcgtgcgtttaataaaatatattcaatgctagatttaataaaaactaattcggtgttttagatattactaaatttttctttaaatttggtcaaatttaacaaagtttaactaggaaaaaaatgtcaaagtgacctataatataaaactgagagagtagaaatatagcattgcacacgtcttccgtacaaagatatactaaagtggtgtttggatccagggacttaactttagtctctgtatttagagtattaaatatagactacttacaaatctaattacataaacgaaagctaatttgcgagacaaattttttaagcctaatcaatccataattaaagaatgtttactgtagcattacataggctaattatggattaattaggctcaatagattcgtctcgtgaattagtctaaga

SEQ ID NO: 2570 - DNA, 1501 bp, Oryza sativa
aggggactccgggcacccttctccttccccttccccggcccgaggccggagagctcaccccgcgccgtcggccgcccatcactgcgcccggctcggtagtgcctcctccgttctccctccccgctctctctcgtgcccttagcttttgagctagcacccgtagcactaccgaacgcgcgtggacaccgccccgagccccactgccgccccgcatggcctcgctgccattgccgtccgctcccggaggccgccgctcgtcgccggccctcctcggtgctcctccgtcccatccggcgccggaaacgcattccttgaacgctggaggtgctccccccgccgagaatcgatccctctcccctcccggcgagtttccctcttcctctcaccggcggtgacctccgccgcgattcatcgtcgtcggcccttcctcttctaatctgtcccgttggctcgctcctcctcgctccgctcgtcgctccggtggtcccccttcctttcgccgcgcctcgccgccgttctgccgatgcgcgtcgccgtccgctgtccatctcggcatcccctcttcttcctcctcccgccggcccgcgtggctgccaggaaggcgccacgtcggcgccagctcggccggaccgggtcaagctgaccccggtcagccgctccctccgtctcccgctcgcgcgcgtggtccaccgcgagccgtgaggctgcgcgtgggcccgacgcgtctcggtccatccggcgcaccgctcgtgcaccatccccaccgaaccctagcgccgccctcgcgtgcgcccatcccaccgtgggccgtgtcaccgacaagcgggccccacccgggacccgtgaggtgctcccggtccaccggaccgctccctctctcttccgcgcaccgtaatgggccgccttccccgcgcccgcgccggcccaaatggctcggtcgagcctccttcaaacctcgggccacgcccttgccgcccgagaaagtctaatatacatccctcgtccatttccttttccataaatcaattccttattattccaaaattgcataaatcaattcctttggtcccgcacgtaagtgactgtcaataatattctggagaatattatttctataaattccataaaccatttctcctattccagaaattccatttaagcttccgaaattcatatcttctcaaccgttcgtccgatcgcccccgttcaacctccagtgatttcgtaaaattgagatctatctaatggcactattaattagtctaattaggatctttcttttagtcttttgtttaggtttttgattgtttgcgtatagttgcggttaccggatttttcgtcgatcgtggttttctcgaagattcgtgaagctccctgaagaccttgagcaaggcaagtcaccctttgatcaattgctcctataattggaaaatcattattattttgtttgtaacttgcattattagaatcacacacttaatttgcttggcctcggtttgcg

SEQ ID NO: 2571 - DNA, 1501 bp, Oryza sativa
cttacgccgaccctgcacaattttcatttctgataccacccgatccaagttatgtatatgtatcactggtgcagaaagcttttttactcccggttggtaacccccatatagtcacggttttccaaccgggagtacgaatccagaactaaatatcgctatttttagtcccggttgataacaccaaccaggactaaagagagtagcgcttttttttttcttttgccagatttaatttctatattttctcccgaatttagtgccatgtatatccctaaatcaatccctaaatccccaattcaaagtaacatccaaaatattaagttacttataaacataaatcaaatacatcacaaatcctaaaaaaaacactcaaatcaaatacatcacaaatcctaaaaaatacatacaaatcaaatacatcacagattatacatctcatatccatgcaatgaatcacaaaatttcacatctcaatcaaacacaaattgtaaaaaaaaaagaaaagaaaagagaccggccggcagttgagagggcacggccgccgccgcgtgcggcacctccggccgcccgccggaagcgccgccgccgcggccccgccggccgccgggccaccgccgccggccaccggatcggatgggaagtgaggaggggaggagaaggggcggatgggaagtgaggaggggaggaggaatgggagaaggggaggaggagttagatctgtgaagaggaaggggacggatctgtgaagtgtaggagaggataagggatagggattatatactacgtattaaattttagtctcggttggtaatactaaccgggactaaagatcaaaatagactaaagatcaaaataatttttagtcccggttagtattatcaaccgggactataaagatgatctttagtccggttggtgtcaccaaccgggactaaagatccttggccctctgacaggctactaacacgggatgaaccaggagtaaagatgatttttagtcccggttggtgttaccaaccgggactaaagatcataaactagctgtggtgtttttaactgggactaaagattatttttagtcccagtttttattgcaaccgggactattatggattttggccgaccgaccaaagatggtttttccaccagtgtatgcaaatataatcagcacatcctgaggtatgcactccctcaattttcagtaactcacaaatctatacaagtgtgctagagtactgtactccctcagtttttttttttcaaaacgcaccgaatttcatggcatgagaatgtttaattatgcttttggtctcactcatttcacccaagaaaataaattttgttggggtgtccctatgcatgcatatatatatatatacctgtgtcgagactaaattttcaaagcatttatatattcacaaaaataaaatcaaggattaaattgaagaataaaatttaaatatatacttttatttttaatgttttgtttttatatacatgc

SEQ ID NO: 2572 - DNA, 707 bp, Oryza sativa
ccagtatgggggcgggggaaggggggagggctcgagcccccgctacccagctggactccatggaaatttgagggaggagagggggaaaagagggagaggaagaagaaaatggggggagagagtgggctggaggaggaagaagaaggctgaggcccccctctcctccaaacttagctccgccactgtttgccgcctattagtagtcgtgcctcgagcttgagaggttgagggagaggtggtgaagagaacaatctgggagagaggtaggtgggagaggtgagtaaaaaaaaagaggtaggacttggagcgcggtgagaaaaaaatatcgctgcatcacacgtctcgcacgattattcttcgttggtggatcttttgacagtccgccagtgaagatgtatcattctctagcggtgacttaaccgggccaccagcgaagatccattttcgctggtggtccttagcccccagccctcgttacgtacttgctggcggctttccatttggctgctagcgaaaatcatagggcaacgccataaaaaatattttttctagtagtgaatgagccaattggagtatatatttgtgttcatcatattaacccaaagcagccctattttttttagataacagatcattaagatccgaccttatatgaaagccaacagttcacaatgcaacacttgaaattatcttaattttacaagcca

SEQ ID NO: 2573 - DNA, 837 bp, Oryza sativa
aattcattttattagtcataacacattttcggatagtcaatgatttcaaatcgaaatatggtcaacaacaaaattgtagaggttatcaagatctacaacttttattttggtcatttgtctatataactttgtttccaacagcttgaaattgattttgacaatatgacaaatgtaaacagcatttgtaaatattacatgactttaaatgggaaagccataaacagctaacttgtacagctaatcaagatctacaacttttattttggtcacttcttcatccgacaaagtgatagtaccaatgtttacaaaattgacatatctgtgttgatatttataaaccagatgagagaaatgtgatttttgtgaataatataactatcactttgtcggatgaagaagtaaccaaaataaaagttgtagatcttgatgagaggacaactttattgttgaccatatttccatttgaaatcatttagtatttacaaatgttgattatatttgtcatattgtcaaaatcaatttcaagctattagaaacaaagttatatagataaatgaccaaaataaaagttgtagatcttgatgagagaatcatttttgttgttgaccatatttcgatttgaaatcatttactatccaaaaatgtgttatgactaataaaatgaattattatacagcagctatatattttgtactcacaaatataaagacttatctgggaaatggaaaaatagtcatcggtgatgggccttagttcaagcccgatagagattaatctatctctatcaggcattatcttagggctcgtcacagatgagtcatccgtgacgggcctgaa

SEQ ID NO: 2574 - DNA, 1501 bp, Oryza sativa
aatcaaacttcttaaagttttcctcgcaaaaaaaacttcttaatgtttaaccaaatttgtaacaaaattttagtaacattttccaatacaagataaactttgtatcaaatactattcaatgttaaatttaataagactagtttggtgccacaggtattgctaattttatctataaatttagtcaaacatatataattttgactaagaaaaaataaataatttataatcaaaatataaacgatttgtatcaaaactatttataattgaaaaaagaaggtaggtgtaaatgaaaagacaccacaaatcaccagctcatcctttcaagacttgggtatggatcttggctgtgttcggaccttccagtttacgacccatctcggtcgttttccatgcgcaagctttttaaactaataaacggtgtattttttttacaaaaagtttctatacgaaagttgcttaaaaaaattaaattaatctatttttgaaatttttttattaatacttaattaatcacgtgttaatgaaccgctccgtttttcgtgtagaggagatgttgttttttcgaaaagagaagggcaaataacacttttacgttgtgttttgatgttgaaattgagaactaattcttacacatgtaaaacaaattgattcattagcacataattaattaaatattagcttttaaaaaaaatagattaatatgattttttaaaagaaatttttgtatggatttttttaaaaatgaacaccgtttaatactttatcccaaggaaagaactcttgctgccaaacaaagagccgtactctatcccataaaacaaagtgaacaacacgtttatttttcacagacaaactaatttagtaaatttcatggcaaattgctactatccgagacctttttttcttttttgcctcttcaaagccattttttaaaaaatgaaaatttaaaaccttttttcttcaatgataaatctgtacatccaccgtccaaaatagatactactattagcagtaaatttgaatacagttttgttttgttgtctagattcagggattgaagcgggccgacctgcaagttcacttatagatcaaatagataataacttatgaattttcacgtcgtggtccggcttgccatattcagagatgcaagtgtggatccataaacttatttatagattaaattaatatattacccactaattttacctataagcaggttcacggacaaacccgcttacactcctatctggatttgatttttttaaacaaagagagtatgcaagagaaaagtctatatctaccaaccttaccaaattttagtaaaattacaaaaaaagtggctacatttagtttagcatagtggctaccaatttttttttttcatcaaagtgaacaggccctttgttactcgagacagtgcacaagcacaaccctctcgctatttaaaccctccaatctccccttcccacgcccgcaccctcctgcctccccccaacat

SEQ ID NO: 2575 - DNA, 1501 bp, Oryza sativa
atgtatgttcgagattcggctgcggaagctaactttgtgggacgatttctgatgggtccttgtatggtctgtggctgtgtgatgtgtagaattgtggattttgttttaggcctttggaagaggatgccacgatctgttttgtttagtttttcggtccgattggactggatttcctgaatcattctgtgctgatctcatccctttgatgaaacatagtgatgtacgtcagtatttgcaacggtgtggtcgttcagatgagcctgatcttgcagttagatttgaatatctagtaagcgtgacatgaacgtcttaataaacgtcacatgagcgtcacctactgttttctagcggcatagacgcctagtggagacggaagatctttctttattggttatcttgttgttttgcacaaattacttggtagtgatgttgctgtctgtgtacttatagacaatagaaagttgctttcaaatgtaatacttcacaatgttgagcagtaaacgcaccagagcgtaaaggttcttgtgttgtttatacttcatgaatagcaaactaccatctaggtgcttatagccaccttttatgcttgacgtgtaagttggaaattgatggttcatacaacattttctcttaacacgagaaaagttatttctcttaacaatagaaagttagtacacaaggtaagtttagctgctgcatgcttgctgtgttctattagtaagaactaatctctttatagcttgctacggaacatatacagattcacagaacatttttaacaagttaagaagcatatacacttgcgtgcttgaagcattgtcctttttgtgttgataatttctgctatgaattaagtattcatcatctttatagctgttttttttttaattttctcactaggtaaattcaaacttaaccaaggaaaatagcttggtgatttttttattggtttattctaataatttggtcaatcgtactgttgtttttgttagagttctgctctatgctatcttgcatgattagaaatctcactgcacactggagctcccaatgatttgagcacatgctactatatgttgctgggcagaaaatggttgaacattagaacaagagttagaatggaaagcaacaggaattagtcttgtactctggttaccatcctcttgtttcagtccaataaaaatgtaaagtagtgaaagaatttatctttcttggatggagaatgtgccacatcatcaaaatactaatagccatcgggtgcagcttgaaaacgaaactaccgtttgatatagaaccagtacatcctagtttggctgaaaaactttttatttcttcagaagcataagttcatcaaagtatcaaaaactttatgatcattatcatgtttcataagttgaactcaggtcaactttgttttgtctttccttgcagtactgaaaatttgagttttaatatttttgccttaaatttctgctcagcttcacttcatcaacaatcaaga

SEQ ID NO: 2576 - DNA, 1113 bp, Oryza sativa
gagggggttggcaaggcagcagagtctggtgaggctgcccatggctgcagctgtggctccagctgcaaatgcaatccctgcaactgctaaaggagatggtgatctgcatcagcatgctgatgatatgtacaagtaaataaagaagccatttgatgcaatggctcctgtgtgtgtgtgtgtgcgacagtgtgagtcagcttgtgttcttcatcctgatgtactaatgtggcctgtgaatattgtgaggtgtctcctgctttactctcttgtcagaatgtaattagaggctatatatcatggccttgtgattggagcacctgaagtttttacagacaacattatgtttgtgtaatataatatggtttacttgtgcatgtatatggcatgttctttcagttccatttactgatgcagtcaaccatattgtctcaccgttcctgcttataacccgaaaattgactaacggtgcacttaccaaaaagtagtatacaagtttaagtaggcaaaatgaatgacaagattatgcgcagaataaaatctgattgaacatttggactgtttgaaactcataaagataaagataaaaatggagaatgtaaaatgaggtagatattagcacatgattaattaaattttaattattacaaacttgacaaatagatatatttgatattttaaagcaacatatatataaaaagttttcgcacgaaacacaccgtttagtagtttgaaaaacgtgctaatgaaaatcaaggtaaaatcttaatcttcatgagaaaagagcactagtgtatacacgtcactgctctcatgctagaatagataaatttcagaggaattcaaagatttgaatttttttttttttggaaaagagaaaagagttgaaaatttaagcgatgttccaagtaaccataaatagccaatgaaagctgctgaggtaacctgaagcggctgagccggccggagctggagaagcagaggttcatgccggcgatgctccggcacggcgaggagcgccgccgccgtgaaaaactgaaagcccaatattagctgggcccaaacgtgatcccccacgaacatatcggcccacaacttattgagccgcgaacggga

SEQ ID NO: 2577 - DNA, 1501 bp, Oryza sativa
gtgcgggcgtgggaaggggagattggagggtttaaatagcgagagggttgtgcttgtgcactgtctcgagtaacaaagggcctgttcactttgatgaaaaaaaaaaattggtagccactatgctaaactaaatgtagccactttttttgtaattttactaaaatttggtaaggttggtagatatagacttttctcttgcatactctctttgtttaaaaaaatcaaatccagataggagtgtaagcgggtttgtccgtgaacctgcttataggtaaaattagtgggtaatatattaatttaatctataaataagtttatggatccacacttgcatctctgaatatggcaagccggaccacgacgtgaaaattcataagttattatctatttgatctataagtgaacttgcaggtcggcccgcttcaatccctgaatctagacaacaaaacaaaactgtattcaaatttactgctaatagtagtatctattttggacggtggatgtacagatttatcattgaagaaaaaaggttttaaattttcattttttaaaaaatggctttgaagaggcaaaaaagaaaaaaaggtctcggatagtagcaatttgccatgaaatttactaaattagtttgtctgtgaaaaataaacgtgttgttcactttgttttatgggatagagtacggctctttgtttggcagcaagagttctttccttgggataaagtattaaacggtgttcatttttaaaaaaatccatacaaaaatttcttttaaaaaatcatattaatctattttttttaaaagctaatatttaattaattatgtgctaatgaatcaatttgttttacatgtgtaagaattagttctcaatttcaacatcaaaacacaacgtaaaagtgttatttgcccttctcttttcgaaaaaacaacatctcctctacacgaaaaacggagcggttcattaacacgtgattaattaagtattaataaaaaaatttcaaaaatagattaatttaatttttttaagcaactttcgtatagaaactttttgtaaaaaaaatacaccgtttattagtttaaaaagcttgcgcatggaaaacgaccgagatgggtcgtaaactggaaggtccgaacacagccaagatccatacccaagtcttgaaaggatgagctggtgatttgtggtgtcttttcatttacacctaccttcttttttcaattataaatagttttgatacaaatcgtttatattttgattataaattatttattttttcttagtcaaaattatatatgtttgactaaatttatagataaaattagcaatacctgtggcaccaaactagtcttattaaatttaacattgaatagtatttgatacaaagtttatcttgtattggaaaatgttactaaaattttgttacaaatttggttaaacattaagaagttttttttgcgaggaaaactttaagaagtttgattaagagtaaagacaatcgactt

SEQ ID NO: 2578 - DNA, 1501 bp, Oryza sativa
caaaaggaagagagatggtttacaaggacaatcaagtgtccaaatcatacctcatgcataacttcgatttgcagcataaagatcagcatgtgaaattagcaatattcaggactaaaggctaaaatgatcaagaattactcaattgtccattctggatgtggaaactagccaattcattcaatagtattataaaaaagatgcccagcaattaaagaactgagcttactgaaagtatatattgataataacaaaaccaatttgaaagttgatgtataatatttttttcaaatatattgccaacaagaagttacttccagaaaaatatctaatggtaccacatttgtgacactaaacttgcatattgtttgactaactgttggccagaacttacaagttctgaatcctgaaatgccttgacccattacaaataaactgtaattctgatgtggataaaaggaaagaaccgtaccgtaagaaagtttccagtgttctggccatcagctctatggtagttgttattgctccggctgccctgaatcccagctggaatctgcttggtggcatcagcctttgcaggtgatggtttctcagcaggagcagccacagccgcagctggtgctggtgctggcgctggtgcaggtgcagctgcaggtgctggtttagcagctggcttaggggcctcattgcctccaaaaaggtaacccagagaactttggccaccaccggcactcccaccacgactcatcttgattgttgatgaagtgaagctgagcagaaatttaaggcaaaaatattaaaactcaaattttcagtactgcaaggaaagacaaaacaaagttgacctgagttcaacttatgaaacatgataatgatcataaagtttttgatactttgatgaacttatgcttctgaagaaataaaaagtttttcagccaaactaggatgtactggttctatatcaaacggtagtttcgttttcaagctgcacccgatggctattagtattttgatgatgtggcacattctccatccaagaaagataaattctttcactactttacatttttattggactgaaacaagaggatggtaaccagagtacaagactaattcctgttgctttccattctaactcttgttctaatgttcaaccattttctgcccagcaacatatagtagcatgtgctcaaatcattgggagctccagtgtgcagtgagatttctaatcatgcaagatagcatagagcagaactctaacaaaaacaacagtacgattgaccaaattattagaataaaccaataaaaaaatcaccaagctattttccttggttaagtttgaatttacctagtgagaaaattaaaaaaaaaacagctataaagatgatgaatacttaattcatagcagaaattatcaacacaaaaaggacaatgcttcaagcacgcaagtgtatatgcttcttaacttgttaaaaatgttctgtgaatctgtatatgttccgta

SEQ ID NO: 2579 - DNA, 1501 bp, Oryza sativa
aatataaattatttaacagacgtggatgagatgtattatccattcttccttagtgtgatgctattaagattcatttgtttgctcgcattattgatagcaaacaagcgtacttcgccggatttgagttttgtttatgctaggtcaacatgatatggcgttgatattttgcatgcatcattgcagcgacttgtatctagtttatactaccccattatatctacttacctagtgctctttttgttgtggggatagagactaagtcaactcagaaagtaaggtttattattaactggaatctggattaggcatgatgcaactataagtgtccaatgatattttgccatttggccagcaactgatggagagttgagggtaccagtctggtgaaactggtggaccgaattaatatctatcgcccatgtatttactatttagcctatggtttgacttatccatttgctcatatgaaatacggagtattttacaaggatatgaaaagattgcaacttagaaaaggtataggtaacatttttacaacttgtaaaggtattgtgaaaaatcacagaaaacgccttttggtgcaagcaaaaccggctgcacggaatctcagccgttggatagtcacgtggacggaagcagattggcctttcgggaaggaataagtcgactctaactccctcaatataggtccgatttaatttgtatcctcgactgcaatactagatatgttgatccccaactacttaaaaactggtgtagtttggctttctggactgttttgacagtggttttcattggtcgattggcgtggctagttaacttggtcaaaatagtcgagtcaccatgtggggcccacatgtcaatgtttcctcctctcttaatatggttttaacagttggagtcattatatttgattttgccgttgagggatagatccgatgtatatttaagggactcaatgcagacttattcctttcgggagtactagtacatgcgcttgggcctgggctaagtgcttttcaattgggtattggaccatatttctggcccaataggaataactgccatctcaggctctcggctgcacggcccattgattggggaaatatgggcttcggccatcttttttcgaacacacaaaaatttatcatgtcatactagtaggaaaaggagtacatctgacattcgtcggaaatgggacaaatccaaaaatgtaaaggaaagctagcagcgaaaaaggactagacggcgaacagtactcataataggcttcgtccatcacttttgcaattttgaggtaaatttctcaatccttttgaaacgcaaaataacatgatttaaacgtattgaaatcaaaatattgtatggttgtgtcgtatcgcatgtgcatccgaacgccagactcgttagttctccagaaattcttacaaacaaaagtattgactccagacctcacccttcatatgccgtaaaaatggttttgtttgtaaaaatggcagca

SEQ ID NO: 2580 - DNA, 1501 bp, Oryza sativa
ggccttgccgcggcggcggcggacacgaggagcaggaggaggaaggaggagatcccgatcgttggcttcttgaactccatttgatcaagcttcgttttaattagtgtcttgttactgttgttctgtgacctatgctctcgatctgatggtgatggttttacgggttttagaaaaaagctgtatttatagcgatgcacatttgcaaatgctgattaagtagttatacttaacccgtgatttactgagtgtggttagcagcttggccttgtggagttgctcacttgctcgagcgagtgatttaagtttaaccaagagagtggtttagttgcggtcgcacgcgcgcggcagtgtccgttcgttttggcgcgagttggcactaggccgaaactgctccatttcagctttctgcggcccagttccctgtcgtgctggaggcccaagggatcagacaggccggcctgccgcagatgaagcagatcggataaagatcaagatattttaactttttaattatttaatatttataaaagtatatttttgttttagagttttacatatcaatacccataacactcttcggagatttcttttgaggacaaaaaaaaatggaagggtgttttttatggcgtgtcaaatggcgttgcctcacgctaacgctaacgggtgcgattgcatttgggtgtaaaataactttttttttaaaaaaaatgacaacaatacatcattacaagatgaaaaggatcctctaacatgaacttctcctgacgtggtcactgacaggtgggctcgtgagtggtaaaactcacatgtaagtcaccacgttcctctgactttacattagaggatctcaatccatacaaatatacaagtaaaaatctgttttctaaaacttgagaatatataacaaatatatgactgttaataatgagtttgttttaaaaaaataatggtaaatcactgttgaccttatctcgatcggccggccgccgcggagctgacgtgactgaaccggacacgacgtcagtggaacggcaggcgcacagcaccggaaggatccatcttggatacatagccgccgtctggaacaggtaataactcgttacagaaccatctctgcaagtgagataacgtggcatcacaaatgccatgggattaattccacggtcgtcgaaattaagttgagaaggcaaaaggaaagcagttacaaaatcacccgttaaaaacggcgcacatacgcagccttctcgctactacttggctagctgttatagggctcttagccgccggcgatcttacgtcggcgaccgtcgccgtcgccaccgcttatagtacatgtttatcaccacttatgtttcggtcaaactcacaccgctcaccgcgcacgaaccgtaaccgtcgcctcctctacttaatgcccctcgtctcttctcccgcgtgcacctcactatacgtacgttggcacgtaccacgtacgcacatccgatccacatgcctcctcttc

SEQ ID NO: 2581 - DNA, 1501 bp, Oryza sativa
ttgcggagccgtttcttctttcgctccccctcgggctgcggcgtcggcacggcaccctccgggcgcctgctgctggcacgcaccgccccgccccctcggggaggagatgggggaggggtaccctcctgcttcctcttcccccgggcgtcggcagggcggctcccccccgggtccccgtcgcggggcccagaagcacgacccccccccggggtagattgttctcccctgcggctcccgcccgcgccaacgtggcctcggggggcccgctcccccgacgccccgacctcctgcatgatggtcaggatgttggcgcgctctggatcgcagcagagggggaggaccccttgggggatgagggatgcctccacggagctgagattcagcacccgttggaccaccatcctgaagtcctcagggtcccagtcccatttgcgcccctggtgggtcctcatgtagtcctcgggcccagtgtactcccaggcgccccgggcacgccgctggagcggcgcgatccggcggcgaaggtagtcaccgaacaccatggcccccgtgagcccctgggatcgcagacccaccaggcggtcaagaacggcgtcgtagccgtctcccagatctaccgccgcctgccagctggaggcctgcgccggaggctggctcggaagtcggaggcgcgcttcgtcgacgaggggggtgtagaaccaatcactcttccagtcgtcccactttttgcggaggacgcagggaatgtagcggttcaacacctgcccccgcggctggaagtagcagccaccgactaccgtcggcggcgacaccggctgtacggtgaagaaccaccggaacaaccggagagatgggctcaccccgataaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgtggcgccgggcgtccctcgcccagcgtgaccacctcccggccggtggcagattccggcatgaatcggcgcggcagcccggcctgcctctcgctcacgatgcgggaaggcggcagcacgctaccgtcgagcggtgcggagccccgtgccatgacgccggtggaggaggagcttgagagcgagcgagtatggcaagggtagggcacaggaaacgaagagttagagcgcaagtggcgaaggcaaggggaagaatggcgagaggaaggaaacgaatcccttcctcggcgtctttattcccttgccaacgctatgcccggctcctcgcttcccgcgcccactaccttgccccctcgtttctcgctcccacgcctccactaaccccacccgcccgtttgcggcgcacgcagcagatgtgcggccgtggcggttgagatggggcagatcgtgcgcgcattaaccgcgctcg

SEQ ID NO: 2582 - DNA, 452 bp, Oryza sativa
cctaggtcacgcggctcacgccacagccgcaccgcacgggatgagtggatgacgggaggggaggggaatggatgtggggaggagagagactgagggatgtgctgctagggttaaggatttttttagtgggctgggctttttgggctttctttgatctatattttgaggtctatatgtactccccgggggcccgcgggtcacccgcgggtgaaatcagtcccccgtcccctccccgcccaaatgcggggccccgtccccgacgcacccgcgggtcgaaaatcggccccgcccccgcccccgtaggggcgggtccccgcaggggacccggccccgcgggggaaattgccatccctaattatgtctaattctgcccaacggtgatgtaggctaatgcatattattttaatgttaatttttgttctcaccgtacgtgattatttcaggtggctact

SEQ ID NO: 2583 - DNA, 1501 bp, Oryza sativa
attacagcgattagctacaagagagaataagaacccatatatcatgatttgccaatttaaaattcagtaatatttttaatatatggatgattgaacagtttgtttcattaattggagtcttgcaatcacttctaaaatgattgataaatcatttagctaagtcatttcataagtcctatatatatatagctaggcagttgtcctgtcctatatagttagtctcatctgcaactaatgatataattaatagctagattataagtgctaatcatccttgggagaagagaggggaggggaggtcacatagaggttaggggggtgttggccctccctggcccctacgatggcttcgccactgcgtgtccgacacggagtccgaatcaaaagcgaagtcgaatcggagaagggcgcgaacgcgtgagtgcatgacacggtttccaatccgaatacttgtcgctgttggatttatattaatcttgccgctaatcagaatcttgctacaaatctttccaaggcgcctacaaatcgagcgttgtttcaccaagtaaaatgaacgtgtctcactaagtagatcgaaaatgtttcaatcttgtaaaaagctggaacacaaccaaatcacctcatgaaacattttgctacaacatatgatataacggcttccaaaaaatcgggcgttgtctcaccctatataaaacaatgttttatcaaatagtgaaagaatgtttcaattcttaaaaaaagtgaaacacagtaagattactagatgaaataatttggttcaacgtatacaacaaacgatttaaagctattgcaacgcttaaaccccgtgtacatcaacaaaccacgtgtccattaagatgaaattatgtaacagtattaaaatctactgcaatatttcatccatacatagtgaaacattgttggtgaaaaaaaaataaaacaaatccccctaatagagcgtttccgttatatctgatagttgttgcaacggagcacgagtggtgaggacacgtggtactggtagagccggcgcgtgtgcgtgagaggcgaggcggaggcgcacgtggggggcaccccatttttttgcgccgcatcgggcgctccattttgatcatttgtgaaatctttcgtgctttgaggaattctttcccctctccaaacagccaagattttttttttaatcatatccttgtctccatccttggaaagttcacaacttcacatacgcatacggtgttttttttaccagtaaaacttgaataaaacaattgcacctttccagatgctaataagtatgaaaaagaaattttataatctaaataggcataaggcgcatgatacgtagagagacgtaaaacaaaataaactgtcaaaggtacagtaaaggcaaagtaaagtggcaatttcatatgttgtaaaatgttcactgattgacaaaaaaaaaacaactagcgaatagctaaatgatagcatcaacattcattttgaaagcttaaagaag

SEQ ID NO: 2584 - DNA, 243 bp, Oryza sativa
attcctgcagccctccaattactaacgccgattcaagtggccaccgtaccgagcaagcaaccgccgcctgccactctaatatctatatataggcttgctccaattcagtgatgaacatatcagaattttgagaagaacattgtaaagttcagtaaagtttcttagcttttttcttagtgaaagtgagtagaaaagacagaaggagatcagggagaagagcggcgaaagggaagtaaaagatca

SEQ ID NO: 2585 - DNA, 1501 bp, Oryza sativa
tttaattattacgaacacaacggtgtaatcggatcgtaaatcgaatgagtagtttaagagaaaattgtatttgaagtataggtggatggtacctcttatagatggagtggtagctggtttagacaaactagctaacactagttgtctagttacgtccaaccaattaacctatgatcgatgtgtgtcttcattattcaccggaggtccctcaatttaatagtgagattttttaatcccttaaccacaaaattagaaatatatgcccctagtcagcaaaaaaaatttaaaaagtacgtggagcccacatgtcagttacacaacttttttttcttttcttttcttctccttctcttctctttctcttcttcagtgagtgaggccggcggcggagagggcggagcggcgatgggcgggcggcgggtccgcgcggcggcgggcggcggcaggcgagcacggcctgtggacagaacggaggcgggcggagcggcgccgggatgcaggcagagcagcgatgggcggcggcaggcaaccggatgagcacggcgggcggaggagggggtcgcaacggcggaggtggccgaaaccacgtcagtgaaaccacttttttaaattttttttgctgactaagatgctacgtcagtgaaaccacccacatatactgccatgggacctcctttgaacggtttgtgtgagtttaggggtaacatttctggttttatggttaaggggcctcaaaaaatctcgctgttaagctgagggaccttcggtgaacttattccaattgtgagcaactcgcttgttcttttgaggggctgtgcgcatcaggggcaggcccaggaaccaagccggatgggctgatgcaatctgggcccaaaattcccccagaagaaacgggtattttgaagcccagcccaaaaaatatgaatggatcagcccaaggcttggcctgatagcaattatctgttctgaattatgacggtcttcacgtatgccaaaagaacccagattggaaatgtgtgcatacaaaatatctaatgatcattgaaaagtgaggagtttaattatttattactttagaaaatagccactcttcaaatgttttttatggacacaactacaccaagagagtgctagctggatagtgttaaagagagacatcatttttttcaaaaaaaagctactattacactcaatatctatgtattttttttcttcttagagaagtttctcttaaattactcatccgatttataatccgattacaccgttgtgtttgtaacaattaaatctttacaacaagatctcacatgattatattttgatgaaaaatcacaagttacttttatgatatgtctaaattacttctagatttcactaagttacttcttagacatataaaagtaaattcagtaaaacttaaaagtaatttacatatattataaaagtaacttataacaaaaaagaaagtaactttaatttagaactatacctagattcatta

SEQ ID NO: 2586 - DNA, 1224 bp, Oryza sativa
agtctttttcttcgttttgcgtgttagtttgtcgtttccgtcgttgcgaaggttcgtgagtgcgccggaagtattcaataagattaattgaagaccgattattgcaaggcaagtcacacagaccctaaacacaatcctttgagcatgttgatcctatatttaaattctctatttatttcaactgtgcatttattttcgaatgtcaccgggtggtgtgaacctattcctttgttatggccaatttgcattgattactttattccttgataccttgggttattataacttgactagttgagctttatatattggttcagctagatattagatatgattgcttagccatgcttagaaacattagcacactattgggataacttatgactcattgtttaatgatggtttaatcgtagctcacgatggttaatcgtgttatgataattaattgataactaaaacttgacaatggtgggttgtgagcacatggttttgaaggtcgtgctcatgacaattaaggaccggttcacgagctactgttgtgaaacattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagttgtgttgtgcaaagggtattgtcacagcctctattcgggtactttccagtatcgcgacgcatggtagacatgatgaggaggctgtgtcttgtgggtacagtggtacacctctggccagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaa

SEQ ID NO: 2587 - DNA, 1501 bp, Oryza sativa
tccacggtttgaatagaaaatcgccgagaggagcactgtagcggcggctagggtttgggaatcagggaggagaagaagtgaggagagagagaacaggctcgggctcccccgggtatttatacccccgacccccggaagttctggactgggatgaccggaacttccggcctgacagaacagagggcagtcaggcccaagttcaaaggaatagatgagaattcaatgatttagaaataaaaacctatgaatatatagagacttatgatgcatatgaccagccaacaatcaacattacataagaatggtcaatatacatcacaagaagggataaaaaccaaattttctcaataaaaacacacacaaaaaattttgcaaaatttcacaaaagggtttttggataatagagggaatgtttgagctttattcctagtatcaagaccatcttctacacaagaagtgatctcaagacacaaaagctcttttttttttaatttacattttagtgacacatgtttggctatgaattagccaaccacccatcagctaatgttacgagagtctaagatattgagctcacccctaagctcgcaaaatcttttctcatctaaaggcttggtgaaaatgtcggctaattgggtcttggttctcacatggtaagacatatgtctcatttagtctcgtgatctctcaaaaagtggtggcgaatatctatgtgcttgtttcttgagcgttgggcgggattattggctattttgatggcactctcattgtcacataggagtgggatcttggtaaagttgtagccaaagtattttagggtttgtttcatccaaaggagttgggcacaacaagaatcggcggcgatatatttggcttcggcggtggataaagcaatggaattttgcttcttggagaaccaagaaacaagggaccgcccaagaaattgacaagtcccgattgtactttttctatgaaccttacacccggcataatccgaatcggaatagcccaaaagctcaaagtcacaacccttaggataccacaagcaagattaggagtgtgaactaaatatcttagaattctcttgacggcaatcaaatggcactctttaggctccgcttgaaaacgggcacacatacacacactaagcatgatgtcgggatgtcacgtcctgataaattcatcccgaaataaaaatcattttctaaaaggaataatagaattaattaaaatttgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaatgagtttataaaaagaaaaaccctaaaaagtcttttccccccccttcccctcttgggccggctcggcccacctccctccctctctctcctctcccccgcggcccaatc

SEQ ID NO: 2588 - DNA, 1501 bp, Oryza sativa
gcgaggatggcgtggaacacaccgctgcgatgccgacgacggaggcggcgccgcgagacggcgagccggcgaggatgaacggtgaagacgacgacggacaccggcggtgttcggtcggaggggaggcgaggccgaggacgacgtcgcggctgcgatgccgaagatggtagaggtgcagcaagccgacgagccggggaggtggaaggggcggccgaaaggacactggcgatgaagaggatggagaggccggcgctgcgacggcgttccggcgaaaccgaggagcagccggggtggagggcgatgcggcgacgccgagggaggggacggcagcgccggctgatgcacgggcgcggtggaaggggctgccggaggagacgtcgacgaggaggaaggagaggccggcgcgggcgatctcggctccatcaatgacgccggcgaagtttgcgggaggatttccaaacgaatccgagagagagagcgagagggaaaagtgggggggaaagagggagggaatcacggggagtgatttctgtcacatcctgatttttgtttcaggatttataaattatttaataaattattattagaatttatattaaatgttcattaatttacaagtgaagttaaatgtgggaaataaaatttcctaaatataaagcatggatggatttaattttgattaaattctccatgattaattacactctctgaaattttctcagatgtttcggagctcaattcttaatttttaatcatacaaagagcatttcagtaattacccacatattaaattaatcattaaatggtctttttttaatattgttaaatactttgggtgtccaagtatgttcaagatttttcttggaattatttgagcataggaagtatttttaacaatttaaagatcatttcattgattaatttaattggaaaagtaataataatcctcttcctagtcttgggccctttccagcccatctccctcttttgtctgcacggccgtgcagcccaagtcggcccagccgagcttcccccttctctttctttctttgctttgttttcagccagcccaagacgaaaagtctaatttgcctccctcgacactgtttatcttctacctctagcagccgaactgagaccgatttggctcggtttttctcctccaaatctgacctttccccttgtgtttttctaaaattagttgaggggaaatattcctcttatcctcctctatctttacccccaaaaatcggagctaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgccccctctcccgtggtctcccgtgcctcgtagcgccgccgccacgtgctccaccccgccgtcgtcgccggccgagctccatccgcgtcgcgc

SEQ ID NO: 2589 - DNA, 1501 bp, Oryza sativa
tctcgtcgtcctctacgtgttcttgtcctccaaagtcgcagccgaccatccaatctccggcgaggtcgccatcttggttcggccattgatgaggtcatcatcatgacgtcatcatcgttttttttctttttcctgtttttctaatagattaaatcttcggaaattcataactaaatcatcgtaactcggttttgagtggttcaagttgctaaattcatctaaaatcaggatctacatgtttgtttactttatatgtactgtttatttggtttttattagtctttttcttcgttttgcgtgttagtttgtcgtttccgtcgttgcgaaggttcgtgagtgcgccggaagtattcaataagattaattgaagaccgattattgcaaggcaagtcacacagaccctaaacacaatcctttgagcatgttgatcctatatttaaattctctatttatttcaactgtgcatttattttcgaatgtcaccgggtggtgtgaacctattcctttgttatggccaatttgcattgattactttattccttgataccttgggttattataacttgactagttgagctttatatattggttcagctagatattagatatgattgcttagccatgcttagaaacattagcacactattgggataacttatgactcattgtttaatgatggtttaatcgtagctcacgatggttaatcgtgttatgataattaattgataactaaaacttgacaatggtgggttgtgagcacatggttttgaaggtcgtgctcatgacaattaaggaccggttcacgagctactgttgtgaaacattaaccgtaccaaccacaagccagcatgggcaacggctttaccttctgtatagcatgattcattgcggggcaccagactgagaagcggcgagaagtccgtgggggtcgctggggagtccatgcctctggttatatttatagagggggtgattatgatccaggaatggtgcactgtggtgagttgtgttgtgcaaagggtattgtcacagcctctattcgggtactttccagtatcgcgacgcatggtagacatgatgaggaggctgtgtcttgtgggtacagtggtacacctctggccagagtaaaactattcgaatagccgtgcccgcggttatgggcgggttgagcaatgtttttcgtgattagtctcacacctctcacaataattatggatgttatatctggtaataatttgcttagctcctggtttggagttagatctgtacagccgggtatggttgttcaggatggttgggcctgtgcagcatgggtgtgctgttcagtgttgattaaaatttctgattaattactccactgttttactcctcttaaatgttttgctaaatgctgcttttgcaaatgagcctatattatgccatcctttggtatccttgtgcacttgcatatttgctgtgtggcttgttgagtatgtcatatgctcattcttgcaataatcaa

SEQ ID NO: 2590 - DNA, 1501 bp, Oryza sativa
cccttccaaaccccaggatcaacggtggagatcagggttctgggctggcccatctggccctcaattttggcctgtggactcctcctgttctgccttatccattactgcgagttttgggctgattctctggtattttagtgaagtctaaagcccctcccttgtatggatatgttccttcttcactttagtctgattttcctcccaacttcggtggtttaggacctgcatcaattaaacacgaacactcgtggaatatgttagaattaacacctaccactatattggatgttttattatctgagttttatgcaaatgctggcggtataaaaatgtgtatttaatagccgccaacaatagggatttctcgagtcctagttgatttctaagcctaattggacgtgggaaagaccatgggaagtaagtccacccctaatataaatataagggggacaagttcgattgaaacaataaccactcaatcgtcaaaatcaatttagttatccaaaccctctatattctacatctccctccttgcttccaatcccaagtaaattctccccaaatcccctaattgctcgccgcctctcgtctctacggtgttaaaggacatcctagctggcctgccgagtctagcacaaactagagcgcattcaccctaacggggtccctcctgggtgtgtgttcggcagcctctacccacaccctacagcggcgcgtctccgggtgattccgtgggttgcacataacatgctcaagttgtggcggcgcgattctacatcaacaacatgcacatgcgtgatctacctgtacaggtacacatcaaccagtgactgttctagccagaatccacaaagcatagatgttaacaacaaaatttggtaagatacgtggacataaggatggatccgaagcggatttgaaggagttagtttggtttccaaaatgaaacaatgcatctgctggagtctgtatcagtcgatatagagttggatttgattagtcgatacatatgatttcgagttcatgatgagttcggattgaggattcagaattattgccatacaaggatagagtctaaagaagcaattgcatctattaattaggataagagtaagctttcctttttgtgttttagaaatctatattagcatccacaatgggctggtgtgtttattttgtgaagtttgaatcgtgtccgatatgaacaagttttgtactacgagtataaatatatgcccagggtcttgtatgaagaacaacaacagttcaatatactctcagcgcatcgccaaactttttgttttcaattttctcaatgagttcttgtttcgagttggggcatcttcttcgatcttccgatgagaggtatgacttgtcacagtagtttgcatcggtggattagtataacgttttaaatgttctaatctatctattgtagctgctggttatcagttatcttagtgttaacaatggaattttgcatcagattcaaaaaggaaga

SEQ ID NO: 2591 - DNA, 1501 bp, Oryza sativa
cggcgctgccgacgtcagttcgtcacctcgcgcgctcgcgtgcggcacgccgtcgtccgtcctccgccgcccgccctcgcgtgcgccacgcagtcatccgtccgcccggcgccgccctcatcgtcatctaccatcagcttggccgtcgtcgtcgcccaccatcagccgccccgtcgtcgtcctcaccaacagctcgtcgacgttgtcgtatgtggcggcctctgcctgctcgccagctccgccacaaagccgtttaagcagattctctttccttactcaatattcaggaaacattcgttcttatgaatcaaagacaacaatcttttctctctttttttggtatttcgagaggagaaaccatgcaaacatagcagcaagacgaacttgagaatgatgggtgggtgaaacgtgtgagctcaaaacaaaatggcaccatccagaatcttagactgaaaacattcacaaatcgctatatttttttcccagaacgaagcatcaaccttaaaatgcaaaatatcacgcataagcaagcaggagactccttgttgcttgcttgcttggtcttttcagcttccttttcttctacttgttccccacacagccactcctttttttccccggtgattaaaaccgaggtgttctcacggtcgcggcatgaggcctcgacggcgatggcctctacggccttggtggtcgcatcgtcgtgtcgacgtccagggcatcgacgacaccaatccaggcaacgaggagcccgcgtcatatcgtcgccatcttgacgcagctccgggctcagccctggagcatcgccgcgccccacatgcggagctccgccccaaacacgcgcggtggccgcgcttgcttgccctgaagctgcggaggacgacgacgatggcggcggcgaacggacaacggcgcggctgacgcgggtacaggcggtggcggactgacgacggcggcgccgggcggacggacgactgcgtggcgcacatgagagcgggcggcggcggacggacgacggcgtgacgcccgcgagcgcgggaggtggcgaactgacgtcggcggcgccgggagatggacgatgacggtgtgattgacgttgggggtacggaatggcaccgaacgaagaaaattcgcactccgatagcgtattctgaaagtagcacaaattaaatggtaaatcctaaaagcattgcgtattcgatggcatattctgaaaattctcgcccgcctatccgccatcccgaaacgccgccgcctcccctcctcatcgctccgcctcctattgctgccggccgccgctgcatccttctcctgatctccttcccatgccaggcaccacggcaaccttctcctccccatcaccgcctcctatccatccccttcagacgtcaccgctgcaccatccaagccacgccaccagtccctcatcggacgagctcaagggcgccagatccgggcagaacgagcgccgacgctgcctcctgcccatccctattctggg

SEQ ID NO: 2592 - DNA, 1501 bp, Oryza sativa
gatcgcgttgttctcctctacgcgtaggtaccctccaaaagtccggccgagtcttctagcgccggcgaggtcgtcgctgatgtcgagtcgacattgatgatgtcagcgatgacgtcattaatcccttttcttagttttctctattagatgaaaatcgattaaacttcggaaattaataactaaatcatcgtacctcggattcgagtggttcaagttgctaaatttttctaaaatcaagatctacatgttaaaaatatccacatgtactggttatgcttgtttttgtactattttgttgattttgttctttcgttttagtttccgacgttccggaggagagcgttttcgttgaggaaggttcggaagtgtttgcggaagctcaaggcaagtcacaaagatcccaaacaaccctttgagcatgttgaacccgtttaaagctattgtttgatttcaacttatgcattattttcgaatgtcatcgggtggtgagcctttcacaattaattaatggccgaagatggctttattttcctatgggttataatttgattagctagaaccttatatattggtttgggttcagctaaatgctatatatatataattgcttagccatgcttagaaacattagcacatgattgggataactaatgttacactatcacttatggttatatttaatggtagctcacgatggtcaatcgtgattggttaattaattattgccaattaaaatttgtcaatggtgggttgtgagcacatggttgtgaaggtcgtgctcatggcaattaaggaccgattcgcgagctactgttgtaaaacattaaccgtgccaaccacaagccagcataggcaacggctttaccttttgtatagcatgattcattgcggggcaccagactgagaagcggcgagaagtccgtgggggtcgctggggagtccatgcctctggttgtatttatagagggggtgattatgatccaggtatggtgcactgtggtgagttgtgttgtgcagagggtattgtcatagcctctattcgggtactttccagtatcgcgacgcatggtagacatgatgttgaggctgtgtcttgtaggtacagtggtacacctctggccagagtaaaactattcgaatagccgtgcccgcggttatgggcgagttgagcaatgtttttcgtgattagtctcacacatctcacaataattattgatgctataattggtaataatttgcttagctcctggtttggagttagatttgtacagccggggttggttgttcaggtttggttgggcctgtacagcattggggtgctgttcagtgttgattaaaattgatgattaattactctattgttttactactcttaaatctttgctaaatgctgcttttacaaatgagcctatattatgccatcctttggtatccttgtgcacttgcatatttgctgtgtggcttgttgagtatgtcatatgcttattcttgcaataatcaa

SEQ ID NO: 2593 - DNA, 1501 bp, Oryza sativa
ggggctgcagcagctcgcttgacgaaccactggcggcaaacgcaattggcttgacggagggacgaatgccacgacgaccgggaacgacgggaggacgacgaccggaaccggcgaggaggcgatgagggcagccggcagcagctacacggatgcgaggacggcgcggaacacgccgctgtgatgacgatgatggtggcggcgcagcaagacgatgagctgggtgaccgacgggacgtcgacgacgaggatgaacggagacgacgacgatggaccgcggaggggtttggatggaggggaggcgatgccaaggaagatgtcgccggctcgccgctgtgattccggaggtggtggtggcgcggccgacggtgcacgtgtggaggaagggccgaccggggaaattccggcgaggcggatggagaggccggcgtggcacggcggtgttccggcgaaattcgggcgacgtcgtggcctagccgaggaagaggacggagttccggtgccgggagaggtggtggcgacaacggccgacgcacaggagacgcggcagaggcggaacagtggcagcaacgccactgttgccggcgaggatgcacttccggaggtctccgcgggaaacggagagcatgccggggaaggggaggcgactgcgacgccgggggaggcgatggcacggccggccggctagctgacgcggcggcaggggcggttggagtcggccggtgctagggagtgagaaggaggcggcgtggaggtggctaaagactcggaagggaccaaaatgtaacgaggggaggatgaggacttcgttttatagggcaaggagggagtgccagtcacgggagaggtcaaagaagggggattaaatcccggcgattggggatgggattaaatggggaaagttaggggaactagagaggaagggatgtggattccatttctctaaccaatttgaattaatccggcatgaatggagcggattcgggggaggaattggtgcaagggttaatgggagagaggagagagaggagccggctgggaggtagaagacgaccgggtgggtggacccattggtccggcgcgaggcgcgcacgtgcgccgcacgtgcagaggggcgcgagggagaggagggaggtggcctggggcggcaggtcggctgggccgggatagggtaggggcggcccaagcggaagaggagggaagaggtgggccgggaggaggaggggaggcctgggatagatagtgtggagattatgggtaccccatacccacacggcatggttatccgactagttataggggataacttatatatatggaacatgtaacagatcatgacttgggtgttacgtttccttgtatattacggaacggcccaaagtcctggtttgataatattgtaaagtagatttaggaaaccgataccgtattggttaaggtttctatcttgtaatcctgccccttatcctatataaggtgggcaggaggccctctagggggcata

SEQ ID NO: 2594 - DNA, 1501 bp, Oryza sativa
aaaaaagggaaattaaaaggcatccttttgctgctgtgttgtgaccctcaactacaagaagtaaagttttgcacttgtcgctgaccggtgtaccaaaatatatgagattctcaccaaataattagtgttgcttgttctctttatgaactcatctactatatacttatgctaaaaaaatgtttttccttcctaatcattgatttcataaatttaactttgccatttgaaatttcacttgcagcgcttgtttcgttggtaatatgcgaagaacaaataccatgggtttgatcaagaggtgatgttttcatcgttggcaaaagacgattccatgtgtaacatataatgttcatttattatttttcctgtgttgctacaattgatcgatctgagcttctctgccttaatataaatttttgcacattgtgggtgcggtattgatgctttttgatgttgtcatcttatggatcaaccatatgagtgttaagaaacttaatcgatttaaactcaaattgctacatcaaccattaatttgaagaagacaaacgctgagatgagtagattattggattgttttacaaacattaaagataggtaatttttgcttgttcttattctcttagtttatcctttctggtgatcaagtaaaacataacatgtttacataacgtgcaacttttcaccggagtaaaacattgtaagatccacccacaaaaactaaataggtggcagacacattgtcacgtcgggaaaaatgctaccattttcccaaacgctcattgtattaatgtaacgccccgatttttgttcgggattaaaaatcattcaataattcattttctagaaattaaataaaagttaaatcaatttaatcaagtaaattatagagggaattaaaattttcctttaaaaatcattggccggaaatattttgtaatattctctgtgccctaatgaacactctgaaattttccgcgaattttcggagctcaatatctaattttaaagtcacaaagatcatttaaccaattaaataaaaagaaaaacaaattaactttccctttctttgtaattgggccgccccggcccaattccccttcccctcccacggcccgcgccctctctttccctctctccggccagcttctctctccctcggccgcccttgcaaaagtccatctttcctccccgttccaactctccctccctctctccccgacaggtgggacccgtggaccccacctgtcacctcctacctctggcctccccatccaaatcaccatggccggccgaaccaccccgcccacgtcgccgcaaaatccgccactcccgcctcccgcgctcgcaactgtcggcgcgggcacgaccccctccacgtcctccaccacttccccctcacgccccgcgaaaatcggcgacgagccacctccaccccaccccacgatgccgcctccactccgacgccggttgccgcccatcccggcccgagccactccctcccggg

SEQ ID NO: 2595 - DNA, 1501 bp, Oryza sativa
ataattatgaccgaagatgactttatttttctatggataataaattgattagctcgaaccttatatattggtttggttcagctaaatgctatatatataattgcttagccatgcttagctacattagctcattaatgggatgaatcatactacattattatttatgattatattaaatggtagctcatgatggttaatcatgttatgataattaattgataattaaaacttgataatggtgggttgtgagcacatggttttgaaggtcgtgatcatgacaattaaggatcggttcacgagctactgttgtgagacattaatcgtgccaaccacaagccagcgtgggcaacagctttaccttttgtatagtatggctcattgcggggcaccagactgtgaagtggtgagaagtccgtgggggtcgctggggagtccatgcctctgtggtggattgtgttgtgcgaggggtactgtcacaatcccgtttcgaggtatcgtggtggtactaagggcatggtaacatgttttgaggctctgtgtcttgtgggtatagtggtacacctctggccagagtaaaactatttgaatagccgtgcccgcggtcatgggcgggttgagcaatgtttttcgtgattagtctcacacctctcacaataattattgatgctataactggtaataatttgcttagcttctggtttggagttagatctgtacagccgggtatggttgttcaggatggttgggcctgagcagcatgggtgtgctgttcagtgttgattaacattgattaattactctactattttacattctcaaatatttgctaaatgctgcttttgcaaatgagcctatattatgccatcctttggtacccttgtgtgtttgcatatttgttgtgtggcttgcggagtattccatgtactcactttgcaataatcaatcaaacctcagttgaagaaaaaggatctagaaggaaaagaagtttggtttaaaccctagttgagctgcatgtgtgagtggagctgaaaccatcgctagtccgttattccgctgctgtttttcttttcttttgtaagtatgtaactgattgatttgtatattaaattttcagtttgtgtacctcggctgattcctggacgaggattttatgcacaaataagttcggaaattactagtgaattttcgggcgtgacaatagatatatgagggcccacacgttatagacacatgagagcccacatgtcatagacacatgagtggcaaatccttaattgccatattttaaaagtggcaaatagttaaatgacccgtgatccggaggagttacgtgatggtggtgcgaaggagattgcgtgtggagaaggagtatgatgggatcgttctgcagcgtccgattttctgatccactgttaattgatcacgtgtctatattggcttcaccatcactagactgagacgaggtaggaacatgtaacactcgaacatcacaaagggcgac

SEQ ID NO: 2596 - DNA, 1501 bp, Oryza sativa
aaacaacaccacaacagcaaagagtactaaaatataagctcaacaaaattggtttcacaattttaacttttaccaataatttcttacgaatttcttaagagctagaccacacaagggatacatatagctatttatatttttactgggaaaaccagtacaaaagttggtcattcttatttttcaacactgaagatcatgtttttcttaatcgacaaaaatttggttcactgaatttgcagttcatatgaattagttatgaatttttaaagcgcaaacctctttcagctcaaaagctatctcaaaaatcgatttctattttcactcccccttttctccaacttccaccggacttcgctcacatggcagcaacctggtcgtagggtcgtgcgaggctaaggcctcgggctgatggcaagagatggagcaaggcctcgggctgacggtaagagacgttgcctagggctgtttcaaccgaaatcaaaagagattaacaccggatgagctacagccacctcctagctgcaataatgtagatggatgacctgttgaatgttgctgtagatgttcaacatgaagggaactaaaaaaaggcaccatggatggcatggaagctcaccaaatggtgggaaacaaagtcatgttgctgctgcaaccatgcaggctgaaaccaccactctcttctcctatttcgatctctctcaactctccatgcatgtgcaagatgttgggatggatggaaagcttggatgatggggattgttgtggtctaacttgcagggattgatcttgggctattggatgggatttggggaggagaagtgagatgagagctcagcttgaggaagaaaagaaagaacaagcagtgaagatgaaaggggaggaagaagaaggggttttctctgccccccttaagtcctgaggtgggagcacgcccatgggtgtgttgtggggctaaagaggcacccaaggttagtgacaagtgggcccaagtcatggctgtctatgagggtgagagaggtgggtgaaaaactgagtacagattcgtttatgcaatttccaggatttattttctttccctctcttggtaaattcaatttgactaggtaaaactagttcaaaaattaagggatttggtgtggtgataggtgttgttttcttggttccatttttcaaagtttcactcaaaaattcgaaatattttaattctggtgaaaagatgaaattggttaggctgaaagttggtttgaatttttaggaggcctaaacagagagtaaaaaatccacaaaatttatatttgttggtgataaataaactagtatttgaataaattattacacatgtacacttatgttcaagttattattcaaatagaagtggtttcaattttaccgattagagttaattttgttatcgcctatgatcaaattgcaatatagtaaatatgaaatctaaaggacaacaaatgcacttctaaatacctggttatgaatgtagggctgt

SEQ ID NO: 2597 - DNA, 1501 bp, Oryza sativa
atggtattgtaatgttatctgaaccttcgctatctctgatgtggatcattattcgcaaaagcgctactgtggcgaaacataattgatggactagtgacgtcattttggtaatgacggcgcgggtcgtcacaatattcttactctataggaccgaaatcttttgaaaaatattatttctgtaaaaatgtatttaaagccactcataagtcatcacggaagagagagcgggtggataaataaggaacgagagggagagagaggggagtatgataagtgggctctattttatttattttattttattagaaaaaatgctcgtgcattgcaacgggaaaggctattttaatcttatttttgttatatggtttagttaagatgaaattcactgtgttaaattcgtttggatatatatattgttagaaaatcatgatctgcaactaggagtctgatcttctcaaattagcatgcgaatttttttaaagagatttcttatacgatttcttctgtatttccaaaagcgaatgaacttaaaaaccaactcaaatatggatttgtatttccaaaaacgaacgaatttaaaaaccgacccatacacaaatggcgtaccaaagtaccgataaaaacatcttcaatttataatagtagagaagagatataagtagtagatagatagagaataacaaattaaaaccgactcaaacacggatgacgaaccgtaggagcatcttcaatttttataatagtagagatttgataaatgggatgccacgtgtacaccacgtcaacagatactatagtcaatattgctctggaattcaaattataccgtttttaatagtttaagatcatgatatcgggtattacgtactctctctgtcccaaaatataacaacttttagccatcaggatttatcccaaaatataacaatttctccagcaacattctctttccaaccaatcataacccaataagagcaaaatggaaaacttgtcgtgaaaaattttctccaaaaatttgaaatttttgagtatgttacaagcatttagctgttctcttcccaaccaaatacaaccctccaccattcacttttcccatatacctccactactcatcgaatcacaaccctccaccattcacttataccctattttcttaataaccgtatcccacttaaaaactttttatattctgcgacggagggagtattatagttgacaaaggtatattcagggagtcaaagtggacttatcactgcggctttgataaatccgaagtggactggaaaccgacaccgtgtgatccgtgggcgggcctggacttgttctccttgtcggattccagcccatataccacatcacaggcgcaggggcacagagcagggcgacccgtcgtataaaaccctaacgccgcctccaccagctctctcaccccagaattcccaaatccgcaacgcacgcacgacagccagagagagagagagagtcagaccgccgacacccg

SEQ ID NO: 2598 - DNA, 1355 bp, Oryza sativa
accaaccgggactaaagatccgggggggcctgacaggtcctgacagcattcgaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtggaacttatttatatgctactatattcaatatctatgttgatataatgctaataaaaaatgtcaaatttgtcaatatttactctctaaattccagttttacaacgtaatatttcgagtactcattgcatacaggagaaatgtcactaaaatggtcgatcgcccgctttccttaaaaggaaaatcgagtgcttgcttttattttactccctccatccacaaatataatattaagattctaaggtttgaattttttttcataagaaacacaaaacaaacgcaaacactcataaacgtacgcacatacacaccccttacgaatacacacacgctaccgccaaattttgcccacacgtataagagattctaggtagtacaccacatattaactcatggatatcaataattgcacgggtaaccttctttaatcatgtttcttgcactaatcaaaacctatccactgtcttttgaggggtacaaaattgtgttcctatctggcttaaattgtttaacgatctcagaatcccttatatttataacgaagaggagagtaacacacaagtaaaaatggaaacctacataaatcaagagggatgagatgagggagataccatcagacttgcaccagatggtgggaaaaaaaacaattgaaatcaggtaaaaagaatatgttgacacttattttttgtagcaaaaccgaattataagccaagtctacccagcgtgcatagcttatgaaagtttaagctaaaccctttaatttgtacatcccttgttactgtttttaatctactgtcaatttgtcatgggatttttttttttgtaatttcaccaatatgatggagattggccaacgaaattataatctcagaaatataatggtatatatatatatatatatatgtttaaaatttcatgtttttactctttttatatatcataagctttgattcataaggctaaacaagtacaccgaacagttttcttggccatgtggtgctctttatttctcgacaagggctaatgtgcggcacagctcacttcagtctcacttttcctgaatatatatagccgtggtagtgccttggatcagctacgtgcaattgcataataatacaggcagttccc

SEQ ID NO: 2599 - DNA, 1501 bp, Oryza sativa
acggggtggcgcggctgagcacgggcacagcttaggccggcccggccgagcaacggctcacggcggcgcggcctcctgcggcgacggccgacgcacgcgggaaagcggcggcgcggcgcggcaaggggatccgggcggcctaggcgagcggggcggcgacaagccggccggccgacctaacggcggcgacgcacggcccggtggtcgccggcggcggccaccggcgcggcagcacgcacgggagacagaggagggaggcaaggagggagaggaggagctcaccaaggacgcgacgacgaggggcggggaaaagcgggggagctcggcgtcggcgctcctcgggacgaaggcggaacggcggcccggcggcgtagggtggaggtggcttgggatgcactgtggaagggtggttgcggcgattaaatagggaaacggagcggaggccggggtgcggcgaggcacggagaagccggcggcgcaaacggcgcggcgcggcagtggctagggcggcggctagaggtggccggagcacgccggggaccgatggagagagggagcacggtggagaggtggttcgcgtggtggaaggggaggaagaaacggcggctgagcgtgcccttgaggtggcaaagccagcgctggcggcggagcagtgcggcggcgaccctagcgacgggaaacggcggccggagttcgccggagtgtggcggcgcgcgggagcggcgtggggagagcgagggagagagtgccgggcccgggaaacaaggggaaatggacgaggggagcacgggggtgctttttgtgggctcaggaaggcgggatcgaggccggacgtggcggaatcggccggcgaagtggggcgccgacgtggagtggtggaggggttaaccggcgccgattttcgcggggagagtggggggaaaggtggaggaggtggaggggatcgatttcacgcgctcgtggggcggggtggagcgcgggagccgcggcgtcgtggggtgaaaccggcggccatggcggcagttggggcgacgggaggttggggaagaagatgacaggtggggcctcgggtcccacctgttggggagagagagatgggaaaacgggtgagggaggtaaagcagacttcagggagagagagccgagcgggccgagggaggaggccggcccgagagggagagaaaaggggcgcgcgggccgcgggagagaaggaagagttgggccgaaaatggcccaaagagaggaagggggattttaattgtttttctttttatttagttggttaaaatgaacttggtgcttttaaaattatttcttgagctccgaaaactcacggaaaattctagagagtacattagggcacaaagaatattacagaatattcccggccaatgatttttaaaggaaattttaattccctccataattccacttgattaaattggtttaacttttatttaatttctagaaaatgcattattaaatgattttttaaacccga

SEQ ID NO: 2600 - DNA, 1501 bp, Oryza sativa
attagttttggccttccaaacagcagtagtctatttctttgaaatatacccaatattgtgaaactagtgagagttgaatgaaaacaggctcatgtaattctctactaaatctgtttttgctttcaatgtttcacttgaagggcatctttgtttgttttcaacgaattgtttatttctcgtcattcagttagttagaagatgctaacagttctacgcttgtggaattgtgctttctgtatagccgcttattaatacgagttgtttcttttcaattagtaataaagcataatagctcttctagctagcagcctagcaccataacaattgtacggtactacagaatttgcatttcatataattgcattttacactgcgggcaacaccaacaaagtttccacaacaaggtccacatgtgcaaggaattataattgtcaaaaagtaatgttatataaatatatgtagtacttcctcaaatattctacaggaaactgccacatcaaagtagtcgaacgcggtatacattcactactacagaacttgacatcgtgaacagtctatccgtgtcagggccttacgaaccgtcacatccctatctgaccagattaaacaacgacacataaacacccttgcagacaatttccataggcctttaggctgggcccatcactaatgacactcataagtgacggggagaggttatcgcccaacaaagataatcattgacgggccacaacctaacgccatcaccgatgagtgtcatcgttggcgagcccaacaataggcccgacaaagatatatgttaaactctgtcaccgatgagtacggttttttgcgatccctagttattgactgttatcgatattacacactataaataccccaaccaattcgtggaatggttatcccaaccaaacgtactggtcacatttgtggtgagacgtgtaggtgggcaaattttgccttttttaaaaaaaaagaaaaacagaaaatatagaaaaagtctactaatgtatggaaaaaataaatcatccctacaaattttgtaatacatgtcatttaaaaatcatatctaatatttgttcacttttgtagccatggaccgatattagatgtacgaaattgatcgacatagcaaagagtatagaagtggcattgcaaattttataaacgtggcggagaagaggaaaagaaggaacaatgatgacatgacttgtgatgacacgacttgtccatgtccagattgcaaaaatgagaagatgttgatagcagagtagatatatactgtcatatgatacgtcaaggattcgtgaagggctacacatgttggacgaagcatgcagagcaagaatcaatcaatattgcagatgcagcgagtagtggtcaaaatcagaaagaagatgaagctgacatgtttgttccttctctgttgggcggtgaaatggttgatgtcaatcacgatcttctacaagcaatattgcatgatgttgaggagtcagctcga

SEQ ID NO: 2601 - DNA, 1501 bp, Oryza sativa
tcctacacacataaacttccaacttttctgtcacattgttccaatttcttcaaacttcctattttggcgtaaaactaaacacacctgaaatggagtagtatttcgtagtcctgtcttggtccacaaatgcatatactgtatgctctctttcgttccataatgtcatctagtgtccatagcattaaatacattgtcacataagtaaaaaattctactccctccttcccaaattgatcattatgtaatagaattcaaaatttctaaattaatcatcatacaactgcatggatacggatttcatcagaatataattaatgtagtatagtatgtgaaaatgtatgtatgctagggtgtaattggtatgggattttaattgatgcatgcattgtgggagaaatgtgtgcatggtgtctttattgatgcgatttaaattgtccttggtcttggtgcataaacttatatttgggaaggaggaagtatgtggcaagagagttaacgaggagatatgtaaaaagatgaagaaatcatttctcatgcaagaaactatctctacacaagaaccaataatgaaaataataaggggatagatagataaaaggagagagaagagaggtgattggatgagaatttaattgaacacaccatccattgaatacatagtttctacacagtgtctatatgatatggcaagtatagaaactacttcatagtttttggattatggatagcccaatgtacgagaccgttaattttttatcccaaaatatataaaatttagtataaatatataaaactaaaagttaagattatattttctttgatgataaaacaagtcagaaccaaataaatagtatttatatatttattttgaataaaacaaatgatcaaatattataaaacaattcaacacatcatacattttgagacggagggagtatgtacccaaactttaacaacacattatatgattgaaatatgttaaaagcttagtataactattttttttcaaaatatgataattgaagagttaattctagtgaaaattgaatcctatagaatacctcattctatggaagtcccaaccttatagaaagtttgatttgagtctttatcctttctaaaattgttgtgtttttttctacggtacaattaaacggttattctgtaatttttttcttttttaataatcttttttagtacttgcattcttataaaaattctgtgttttctttagttctctgttttaatcctatatctatacttcctataaagttataacccactaattctaaaacttaacatgcaaccatgccacatcatcatccactagcaataattatatattcaacctcatacaagcaatatcatctacaatctatttaattctacaaatcaacatgcgtccaaacatattcaatcatcatctctcacatcatttccataatatttttataaatatatgtatcatttttcggtagcgctattccgagcgctagagcgc

SEQ ID NO: 2602 - DNA, 1501 bp, Oryza sativa
ggtcgagcttgagtagctgcgtgaggtcgccaatcggccaatggcggatggaaccacgacggagctcaacatcacgtcggcgaacatgttgccgttgaggaatatctcagccaaggtgttgcagttggtcaggttgtccaagaactcccaggcgccgccatcatcggtcggcgtacggctccgacgagatggacgccccgctcctgtgaagcctcccctccctggggcgggggctcctctcatcgtctcccacgcccgcgcggatgctctccgcggcaacgtccgacgccctcgtcaagatcaagccaggcgagataagcatggtctccggcatccccaaggagcacctccgccgcaaagtgcttctttggacttactctgatttatgtagtgtcgatagattcgctagccctcgcagatccgtgtgggaatcgctcgagatgtcttggtttggtgggttcctttggttgttactcgggttagggatagagcctggaggtgtcgagtcgtgaacttgttggaattaatagatgggctaaggctcattcgaagattaattctttggaaaatcacaaaagcccacctcatgggatggcatgcatgtggagtttagtaccaccttgcttattctaggagagggggacctccttaaaagggaggatgccctcctagccacttaaagcatgtgtggtggagagaagaggggaaacacacgcgcgcgctcgctggcctggcctggcagggcaggcggcgcacgtgcacgacgtacgcgtcgaatggtccgcaaaattggctcctcacccttgtgcagatgcagcctccttttgcagttttgttttgctgcgggattcggatttgttttgttttggaaacattccaaaaaatccggtgtgtgaaaacggcatggaatccggataggttacgcgtgacttatccggttcggtttacgcggacgccctgatcaggcgatctatctctatataaaccgagccgctgccttcacgcaacacacgcgaaatcaatctagggtttgcctcctactctgtactgcgccgtcgctcgtagactactccatcccgctcgccggcgtgcaccggcaatcgggagagcaggtctccggaacctctgccttcgatgtcctgcaccgggagaaggtagcaataaggtttttgggaagcgcttcgcgcgactgctccctgttcgttcgcgacggctcgtcttcctcttcgctcgcgtgcttcgcgccttcgtagacgctcgcaactgcgagtagttcctgccgagcaaccggtctttccgccacctcggtatgtgttcaacatgttgcgcatatttgatctgttcaggttttactgcttagtttacatgtgtagatctaatgatgcgttcaatctagtttacatctgcaatgtcatgatttatttatggaataaattaaatcattatgtgcttataatttcaacaatccaaaaaccttattataggcgctgtgattttacta

SEQ ID NO: 2603 - DNA, 1501 bp, Oryza sativa
gagtttaaaattctgagaaacaggtggttggtagccagcttttaagaatctgaaaaagctgggttttcgagcttatggcttctagttcattttctgtactctacaactgcagcagctagaagctcccctaaacatgcccataatgcaggtagtaagattttatgaagtgctacggatgtccaaaagtataataaggagttttagaattgaacacgtatgagtattaagaaaattggtggaattaaataggagaagattgtgattggttgagaagagcaggtaggtaaggaatttgaatagcttaatgttgtgattggttgataagagaatgtagatggagaggttgttatatttgtttgaatatgtgccgaatatactagtcctatttagttacagttggacttgaagttgtaataggtggtagggggtggagttagagtcggactctgtaacccaaatctctcttaaatggagggggggcaccataatctaaccatggcgactacaatgtagcgtagacacgtagggagatgatgacggcgaggccatggactcgtagcagctaggagctatgttggttgggaggagcggccataatcagagccccggggatgtaggcttcggctgaacctcgttaacaaatatcgtgtgttcttatgtcgtcatctggatgccttgggtgatcatatgactgaaacgatcgggatggttagtcgttgttccgctatatcgactaacttttataacaatagtttggaacaaatattaagactaaaaattattatattttagaacaggggagtaaaagacactcctacgttagggaatgtgaaatagcacggtcggttgttggctacaagcttatgtgcactgtaaattggcggcccgggtactaaatccataacgaaaagatatcgtcaaacaaaggagtaaattttaatttgtattgtgtatatagactaacgttacgtacaaatagacctaggctttaggctgtgttgttttgaggttaggaacacgtaaaatggagcgatgaattggagcataattaattaaggattagttaaagaatttaaaataaattaatacgatatttaaaatcaactttttatataacttttttttaaaaaaatataatttagcagttaaaaagtatgcacgtgaaatataaggaagtaaaagttaggagtatgtagtataaaacgcaccattaagccacttttcaacttaatgtcacgtattttataattttagaagtatccactcctgtttatgcatcttctatccatccatattagaagaattatccataagtacaatgtactcgttaaaataaaatagtgcatgactaatgactactggggttatatagtagtagtagaacacaatatatgtatagatggttgaccgaggaagcttaccaaccgtcaatgattataatttgttcaaacttagaatgggctatgggcatttgaggtggcttgacaatgttttctttacg

SEQ ID NO: 2604 - DNA, 1501 bp, Oryza sativa
gtcgccgccgtcgccctggggtgagccgtggaccgtcgcctcctttcccccttccctcccctctctcggccgccgctccaccgcgccggtggtcaccggcggcgaccatcggggcgcgggcgcgccgcctcccgctgaccgcgccagcgtggtcgccctcgggcgcgccgagtggttgccgcgtggggcccggccgtcagccgctcgtgccctcaggtgtggctgacgtgtggggcccacggcgccggccggtgtgagcccgggtgcaaccggtccaccgtggaccgtgaggctgccgcgtgggccccacccccgtggacccggtccgcgcgccccctccccctcggctgacgcaataaaccccttttttaaattaaaatttaaatgaagaaattcgcaaatattcatttaaagagcatataaacttcaaatggccataacttggccatttgaactcggaattggaccgttcaagtctcttttttttcgttaagaagtcaagaacccattttggtgctttgttcctgcttgttatatggagtttattagagtaaaagcccttttattttctgttggtcgtgtagacgttgcagcttcggaagatccgctcttcgtggaggttgaagccgacatttgggaaagtgagcaaggcaagtcacatcatccttgaacatattgaatcccagtttataaaattattttgatttaaattattgcattatcgctttatttaaattcccgcgttatcactgttttaaattattgcactttgcggataaatgcccaaagccgaggcgccagcaaggccaagcgcctccccgccccaacaacagtggtaaggatgtcattcggggtcatgtgaaccacgtgactgccgaggatgtgctgacaactccagacgtcatcgtgggtacgttcctcattcattccatccctggtaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgttcctatagaaatccagggaattccttttccttcggatctgattcttctagacaccaagaacttgcatgtgatccttgggatgaattggttggctcaattccaaggagtagtggattgcgcaagacgcactgtcactctgtaccgagggccggaacaaccggttgttttctttgcacccccaacctctgtcggtagtttagaacttcatcagataggactgtcagaaatccccatagtcagtgagttcggagatgtgtttccggaagaactacccggtatgctgcccaagcgagagattgagttccggatagatcttgctgtaggaaccactcctctgtacaaccgaccctaccgtatggtagcaaatgaactggccgaagtcaagaaactgttggaagagttaaaagaaaagg

SEQ ID NO: 2605 - DNA, 1501 bp, Oryza sativa
aagtattccacgaacactttgttcattaagttcatgaagaaggcaggagcattggtcagcccgaacgacatcaccgtgaattcatacagtccataacacgtggtgaatgcggtcttcgggatatcttcttcacggatacgcaattggtgatatccggagagaagatcaatcttggagaataccgtggcacctttaagctgatcgaacagatcatcaatccggggaagagggtacttgtttttgatagtaacttcattgagagctctgtaatcaacgcacatcctctttgtcttgtctttcttctccacaaaaatcacaggagcaccccagggggaagtgctcggccgtatgtaccccttttcttttaactcttccaacagtttcttgacttcggccagttcatttgctaccatacggtagggtcggttgtacagaggagtggttcctacagcaagatctatccggaactcaatctctcgcttgggcagcataccgggtagttcttccggaaacacatctccgaactcactgactatggggatttctgacagtcctatctgatgaagttctaaactaccgacagaggttgggggtgcaaagaaaacaaccggttgttccggccctcggtacagagtgacagtgcgtcttgcgcaatccactactccttggaattgagccaaccaattcatcccaaggatcacatgcaagttcttggtgtctagaagaatcagatccgaaggaaaaggaattccctggatttctataggaacggcagggctataatactttgctgtcataacccctccaggggtggtgatgagcagagggttcctaagcctttctacccccaactgatttctccccacgaatggcacagatataaacgagtgggaagctccagagtcgaacaaaatggtaccagggatggaatgaatgaggaacgtacccacgatgacgtctggagttgtcagcacatcctcggcagtcacgtggttcacatgaccccgaatgacatccttaccactgttgttggggcggggaggcgcttggccttgctggcgcctcggctttgggcatttatccgcaaagtgcaataatttaaaacagtgataacgcgggaatttaaataaagcgataatgcaataatttaaatcaaaataattttataaactgggattcaatatgttcaaggatgatgtgacttgccttgctcactttcccaaatgtcggcttcaacctccacgaagagcggatcttccgaagctgcaacgtctacacgaccaacagaaaataaaagggcttttactctaataaactccatataacaagcaggaacaaagcaccaaaatgggttcttgacttcttaacgaaaaaaaagagacttgaacggtccaattccgagttcaaatggccaagttatggccatttgaagtttatatgctctttaaatgaatatttgcgaatttcttcatttaaattttaatttaaaaaaggggtttat

SEQ ID NO: 2606 - DNA, 1501 bp, Oryza sativa
tgctctccccacggcaggttgacctcgacgacgtggtgtggtgtggacggcggaccgcttacctcacgaacggatctggtatcgctgaagctaggaccgcaggatctggagcacccaaactcgggatggttggatccgcgacctgtgagttcagggtgtccggatctggagcccccgagttcatggttgctgggaccgtcagggggaggctgggggatgtagaagctcgtcgtcgaccggagataagcgacgatggacggaggggcttgtcgatggcgttgggcagccgcgtggtgccccattggccgatggtcctggcaccggcgttgtcttcgtctttggctcgatatgacctggatctggcgtggtggaggcgggaaggaggcggcgaccgtgggtggtgggcgaaggaggcagcgacccggaggcggtaggcgaaggagccgatgacggggtggcggagagacggcggcggcgaccatggggcggagggcgaaggaggcggcgacctttggaggtgggcgaaggaggccggcggtcggtgggaagaagagaagagagactgagaggaggaggagagagactgagcaggtggcggtgggccccatgggtggggggtgggggttccttttttatatgtcaaaattgatcacctttgacgggtgcaaacttaaaatcaatgacgggccagaagtcatatccgtcacaggtgacggcccatcacctgtgacgggttgtaactccctggcccatcacaaatgaggtcataccagtgacgggttggaagtcaaacttgtcactgtcttacctgtgacggcttaaaattctggcccgtcacaggtgaggtgatacctgtgacgggccacggctagatgcctcaccaatgacggtaaacctaacgacccgtcaaaggtgacggtcatctgtgaccaatttataaacccgtcactaatgtgccgtcatagatgtagggttctggcgtagtgcttaatcttcgctctcagctgtgatcaatgacaggaacacacacacatcatcagcccctaaaaccagcaaccatgcatgcctactctacactcaacaaataaatatacaaatcatgcatgcatgttcttcatatcggttatctggtcaatcacacaatcaccatcaaacaatgtgtgagattctcttgttacttaggtaccaagaagttatgcaagaacaagctagatcacacacataattaattatgtagctagctagccgccatgcgagcgttcaaagctatatccacgtactggatcatccacagcgcgaattcagaaatcgcaataatttaaaatattctcacgcaaaatcgtctataaattcgcatcaaaatctgaacccaaaacattccatcatcgcatgctttgcattgctctcccttctaaaaaacaatcagaagtcgcagacaagaaagagacgaaaatgtctaacacctacgtgtcccatgtcgctgtcgttgtaatcctggcaa

SEQ ID NO: 2607 - DNA, 1501 bp, Oryza sativa
tcgtgtgtcgcagaaacagatgagatcattgtcaatatggccgctggccgacgatgttgcccggcgggtagtagtcgcagacggcgacggtgtcgacgccgttgcggcaggtgcggcgcgcgcagccgagctgcgtcgtggcgcgccacaccacctgcgtgtacgcgccgcaggtccggccgggcggcgccgcgcaccggccggcgtcgcggtcgtaccaccgccggccgtccgcccagaacgccgccacctccgcgccggtgtggcgccggccgtacgccttgaacaggttccggccgtagacggcggcgccgtcgccggtgccccgcgccgcggtgggcggcggcggccgcaggctgcattccgtccggagctcgccggcgtaccgcgccgcatccagctgcagcgtcccgttccacgacagcggcggcacgcccaccgccgcgcgtgcctcgttgtgcacccgcaggaactgcaccggcgtcggctcgacgggggtctgcacggcggagacggagatggatgccgccgccaccggcgatgcggaggcccgcgggaggcacaggacggcgacgagacagcagtagagtggagacatggtggtttcggggtgaagttgtggtgaactcgcgattgtatatatatagcgggggttcttattaattaatggctgccgttttgtgagtcctttggcttttaatttgtacttttaactcatggttttttactaggggagttatgctacaccgactgtgaaagtgtgaatagctttcatatgcaatggttgacggtcttgcagttattatattttgaatgttgcatctctctggaacatcttatgaagcaaattgaaacaattttttataagtgataaagcatcaattaattattttcattaaaatatagttatgttagatcttgttgtaaagatttaattaaaaaaatacaactatgcaatcatattgcattatttgtatatgggattaataatttaagagaaaaaataatttaaacatgttaagaaaagctagatatgcatcgataggggaaagtgagggtagtattggatattgcatgtagctgagatgtaggcataggaagcaagtagctggcatgcagcattcatgcaatgaatgtgtagaggggagcgcacaggagggggacccgatttttctctcaaaaatccgacgcccgattcgtagttgcctcgcaaagatatagtaataaaagaggagaaaataaaattaatgtcgggacctagggatggaattccggaatatccgaagagtttaggcacgatgattcgctagtacacgtatcacaaccttattatcacatccacacaacatacacatacgtagaagcaataagattttcataacttattaagcacatgtggccgaccgaccaaataaaagatataaaatgcagtgaaatattttttttcctttaattgatttcctccgtaatttcctaattcctcccatgcatttaatataaa

SEQ ID NO: 2608 - DNA, 1501 bp, Oryza sativa
tgcacaagggaaacaatgccatggtcgctggaacggcgtgccaccggttccccttgcccaactccaaaaaaactatatgacaaccaatccgagaagccaaaataaattcatgtaactgtgaaaagagtgagggtaggggagttatgagctgttgatattatttcctttcaggtctcaaagttgtatgaagttgtgcctccaatcctccatgagataggcaaggtaaatgttctaccaggtttataatgatatatcctctaatttcatgtttgtggttgttatggtcatcatgttctggctttgtatcttcaggtcaaaaatccatggcccaatgatgatgctcacaaacaaccttacccacatgctgacataacataagcaatcacagactaatagacaccaatacaaaataatacaaaataaaaaactcattctatttatgaatctccattcgaatacacgtaacatcttgtatttgtccttggcatctctttgagttttgtgtcgtggcctcgtggggcaacgctaggtctgtgcataccccaggttgcgtcgaggcacagccatgtctgacaccaccgctctcgctggtgcaaacaaatatgctagtctgtctgattgcctctaatttacttcatcctgtcgtgtaaacgtatcgttttgaacatttacaaagccttcagtatagcaataatatccatagatatacattcttcacaaaacctgatgataaaattatactgtttcatgcctattctaaacataaattgtcatgtatatatctagtctaaagtatttaaaatatatattgatattctatgctttgaatattgtttggttcgttgtttttcagaaaaatgaatacgagagcataatcttcacaatttagctcaagacattacagatcaaattgtactaattcaaaattaaattatatttgaagaaaatatatataatgcacaagcattagagcacaacggcttattgggcagaatagtaattcactcgcatgcacaacgacctacactctctgtcccataaaaaaaataacttgtaaagatgaacacatacatatattggttcaaatttgtccgtataaattgattttttttaggacggagtgagtatgtgattattctccggggcacggcactatatgtataacacgatcagtatggtcggccggtgccgtagttccccggcgggaagtagtcgcagacgagcagcgagtcgccggagtcgcacacgatgcggccgcacccgacctgcgtcgtgttccgccacaccacctgcgtgtaccgcgtgcacggcgacgacgacccggacgacgcggccgccgccgcgccggcgcacgtgttgctgccgtagtcgtaccgccgccggccctcgtccacccacgccgccgccagcgccggcgcgttccaccgccgccccttcccgacgaacgcgttctcgccgaagttgaacagcggcgagcgccgcggcgcgcagtcgccgcgcc

SEQ ID NO: 2609 - DNA, 1501 bp, Oryza sativa
aatttggtcccgtatagcattgtagcttgtagtcatgagttgatattggcattttaacaaatcccttttgcggagtggcatttcggtgaaacctagttttggcaatggcagaatgtccaatttctataatatgacatgctgagatagctaaaacgcatgtcattgaggccttatcttttcgctcatgcttatcagcggaaactaaaatttgattgattttaggtttttttatcatcgtttattttcccgtttttttgcttttaaatcattaagaatacgtatataaaagttttattttaaattattttttatttataaatatgtcgcttgacttagttcctgaaataagacaaacgatcgggctgtgaagttgtatgtaatgaaagcaaatcaagtagggctatcactacagtagtaccaaaagtaaaggagaaaccgtacataatttgaaagaaagagaaagtcagaaaaccacataattatgcatggctctcgctgcaacttggtccgtgacccacacgagtcctattaaaaaaaaatcaaaacagcagtagttgagcttatttaaaaggggagattttcttttccttttcatttcgagtccacatacgtttggaggcacagaaaaaggaaaaaaaagaaaagaaaaacaaaaagtcagaacatctgcacttgatttcttattcacgcaactccattaaagtctaaccattgacttttttcccctgcccgctcttacacggcacgtctcattcaaatatgaactctcgcacagtgaggaatcccaaattgagaaggaaaaaaaatgaaaacaaatttctttttcctctgacttgtagctctacaactacgcgtcgttttctttattatttattcgtgtataaaaacttttcctttcttaattcttgccaaaaaaaaaaaactggtcacgaataatcgtctcctaaaaaaaaaaagtctctagtctcagcgcgataattctcccgcgaactgcgcactgaccccgcgtgaccaattgacatgtcggccacccaacaagtgggcccacctgtcagtgactgtgggatcagggagcgtctggttcgctcggtacgcgtagcgcgatgcggtcgcttgtctcgtagttggaaccaactagcccccgtgaccccacaacgcgtcggattctgattgggcgagacccacctcgtggccactgttgcatggtcaactttcccacccatccgagccgtccatcccatccaacggcgcgtacggatccaccgcctgacgccggtggcgccggtcgacgatccatcccgaccgtccgatcgggctcgcgcgttgactataaccggtccacgccgtgaccgccaccggctgctcccggtgaccgcgtcgcgtcgttttataaccccgactacgttagcctcctcccacttcttcttcttcttcttccccccatttctcacttactccggcgatcaccgtggttgagcgtcggcggcggaggaggaggcga

SEQ ID NO: 2610 - DNA, 1501 bp, Oryza sativa
aataaaaaactgaaggaagaattcccgtggggacgagtcgagcggctgcggcgtacctggtcctcgaggtccatctgggtgggcttgcccttggcggccgggtcagagtcgacgtccatcggcagacggcggcggccacgcggcaagctggtggaggacaaccacgatgacggcagcgggcaggaagaagcgggaggaggaagaggaggagaggactgcaaggtggcctgccgcacgctgctctcctcccaccgccgccggtggatccgtgcgaggtcaggcgagggacgcccgccgccactggatccgggcggaggacgaccgtcgtcaccggattcgagcgggggacagccccgccgagcccgtcgctcgccattgccgcagtgcgtcgccgtcgcccgtcgccgcatccatccccgagcacaagccacagccgcaggggagagggtgggcgccttctctgcttcgtcgccgtcacctcccaagtctggtatcccctcccacacggcggcggcggcaggcggacggggaggcggtggtggcggcgatggaaacgaggcggagcggcttggctaactgcggtgtacgggagggctagatccgaaaataatggagagcgcggggaagaagcaggggcggtttctggggtggggccacagttgacgattactatacgaggaggggggggggggggttgctgcggggggtgtgttttaacgcctacacctcatatgtagtatagtatctatataatataagactattatatttatgactttattataccaggtattttttatgaaaaagtttaattttatataatgacataaaactaatatttatttacttattaaaacagtatatgtagcttttttttatgatagttcaacatattttctccagttgtatatattatataggaatgttttccaaaactatatttatcattttaaaaagtgctacacatactttttaatatatattattttttatgtacaacaaacttatgcatatgataatcacacaacaaattttatacttccaacaatacagtttacaaatttctacttatttctcacatattgaagggtaaaactaacttttctatacctattaaacggtcaactaatggtcaattgatggcaagggtacgaaagggatccaaatcaaaattcagaggtatataaaggagtgaagaaaattcaggggcatagaaggaatcggctaaaatttcaaggatatagatttgaaatgagtggacgaaaataggagtattgcaattgatgctagctttgagcaggaaatgcaaaagtgtttggatcttgattttgcttcgcagttaccatccactgaatttttggggccgttgttcaggtgctgtccaaatggaaggaagggagtaatacaagcaaagggacatcacaggagaaatgaagtcaacactatgcccatatcctaaatgcaattgtgatgctttgctgaaaatatgctcacggatatt

SEQ ID NO: 2611 - DNA, 548 bp, Oryza sativa
  unsure (1)..(548): unsure at all n locations
ccctccnccaccccccacccccccacccccgcatcaccccacccacatccatcctgcacaaactccctcatccctctctctccgacaaattctgtcgttcagtaaatcaattactatcagttgtttttgttcgataagtaaacaagttactatcaaaatattccccgcaccttttttttccttcctcccgcaccttttttggtgattggcccattagtaacaatattattgtgtctttcggtctaagagtaaatgagttactaacacttccgcacttccaaattgatttcttctcttagtaaatgaattactcctaggttattttcagcccttcccaatttggttactcctttaagtaaataaattactctcagatcgttctcagctcttcattagtactcccaattggtttgcaaatcttctcttagtaaataaattaatatttgcacgtcattggacttctcttagtaaaataagttagtcctgatacaggagtaaatatattgcagattgcacaaggccgctggagtatttagtgacaaaacaaa

SEQ ID NO: 2612 - DNA, 1501 bp, Oryza sativa
aaatattagatgtgaaatggatgaaaacatatggcaggttcttccactcatgcgctacctgtacatacattgctgttaattttactataagggcaggaggtcacagtgaacacacatggtgaacacatgataaaaattgcatagccgtgtatggttgtattctacatttaaccttactaacaaatttaaataggcaccaatgtatttgacaaaattatataatttgtgcagatggctatatggatgctacttcatactccctctatccaaaattcttaagcatattttattttttggttttttttccaattgagatggtcagatttgtagttttcatgtgcatagttaaattgttgactagaacccaagcaactatctgcaaatacttcattagtttgttacgtggaggatgagttaattcctccatgattttggtgacaaaagaaatatgacttttgggtggatggagtatttattagaatgtttatgaaattttgcattgtgctgaaatgataaatatttttttcaagtcttagctatttacatgcaaataaatttattaatgcaaaaaaaatagaaaccaggctaggataaattcataaaaggaagccattaatactcacatcgtccaaccatatcataattagacaataggctatattagattcttataaggaagcaattaatactcacatcggccaaccatatcataattagaaaataggctaggataaattcatataaggaagcaattaatactcacatcggccaaccatatcataattagaaaatagactaggataaattcatataaggaagcaattaatactcacatcgtccaactatatcataattagaaaataggctaggataaattcatataaggaaacaattaattctcacatcgtccaaccatttcacatttgtgaaccatgaatgaaaaatctttaaaaatagaggcaattaatgcatagcaaaaacagaggcaattaatgtagagccaactagtcccagtgaagaataaataaatgcaaaattttgtcacttacccccttcttttatattaaaattgaagataaaacctattggcttatatgtcagtgaccttatatgactcatatatcgatgatataggagggtatgtccaagaattataaattaagggagggtgtatgaccaaatctttcataataaattagatgtatccgaggcatgttgaacatgtttgcctttcttgaaagcataaaaccaccccccctcccctttcccacctcacatgtcccacctcttccccaccccatccccttctcctctcacttcagatcgacaaagagttctatatagtagagagagatagagagaaagctagggatattgagagtctgacatctgaaaattagctatttgaaatctagagagttgagaagttcaggagagtagagggggagagaaccgcgtaatcagatggcttcgtcatcaaatccatcaaatcttccctgct

SEQ ID NO: 2613 - DNA, 1501 bp, Oryza sativa
ccggccgtccgcccagaacgccgccacctccgcgccggtgtggcgccggccgtacgccttgaacaggttccggccgtagacggcggcgccgtcgccggtgccccgcgccgcggtgggcggcggcggccgcaggctgcattccgtccggagctcgccggcgtaccgcgccgcatccagctgcagcgtcccgttccacgacagcggcggcacgcccaccgccgcgcgtgcctcgttgtgcacccgcaggaactgcaccggcgtcggctcgacgggggtctgcacggcggagacggagatggatgccgccgccaccggcgatgcggaggcccgcgggaggcacaggacggcgacgagacagcagtagagtggagacatggtggtttcggggtgaagttgtggtgaactcgcgattgtatatatatagcgggggttcttattaattaatggctgccgttttgtgagtcctttggcttttaatttgtacttttaactcatggttttttactaggggagttatgctacaccgactgtgaaagtgtgaatagctttcatatgcaatggttgacggtcttgcagttattatattttgaatgttgcatctctctggaacatcttatgaagcaaattgaaacaattttttataagtgataaagcatcaattaattattttcattaaaatatagttatgttagatcttgttgtaaagatttaattaaaaaaatacaactatgcaatcatattgcattatttgtatatgggattaataatttaagagaaaaaataatttaaacatgttaagaaaagctagatatgcatcgataggggaaagtgagggtagtattggatattgcatgtagctgagatgtaggcataggaagcaagtagctggcatgcagcattcatgcaatgaatgtgtagaggggagcgcacaggagggggacccgatttttctctcaaaaatccgacgcccgattcgtagttgcctcgcaaagatatagtaataaaagaggagaaaataaaattaatgtcgggacctagggatggaattccggaatatccgaagagtttaggcacgatgattcgctagtacacgtatcacaaccttattatcacatccacacaacatacacatacgtagaagcaataagattttcataacttattaagcacatgtggccgaccgaccaaataaaagatataaaatgcagtgaaatattttttttcctttaattgatttcctccgtaatttcctaattcctcccatgcatttaatataaacaagcatatagaagcaagaaactgaatcgatgtattgcagcactaggcagcgagcaaaaaggtaacaaagcaatgtactatcatcatacaagcaagcttgatactctgataaaagcagaatcaggatggatcaggaaaagccagggccggccctggggctatgtagccgaggcgatcgctgggggcccatgatggtggggggccaacacctaatactagtagt

SEQ ID NO: 2614 - DNA, 1501 bp, Oryza sativa; identical to SEQ ID NO: 2606

SEQ ID NO: 2615 - DNA, 1501 bp, Oryza sativa
tgtcaaggattttggccaccatccaaaaacgacgtggccctgtgctgtcgtcgtcgacatcaggtgtttccgcaggcagcgacacaaactccaccgctaggacacccggtgacgcagagattgatggcactggtgttcccatgtgagccggcgacgacatggagtcggagtggcgggacggcacgtccaccgccactacctcgtagcgcacggtgaaggtttcctgaggagacgttcccccgtcctcctccccgggtgacgcccatggccatgatgccgcctcatcgaacacggcgtcacggctcacgacgatgcgcttggccaccgggtcgtatatacgatatgcctttgaacccggctcgtagccgagaaagaccatcaccttgctccgatcatcaagttcttgatgtgtggtttcacctccttgacgtagacgacgcagccaaatgtgtgaaagtagtgcacaacaggtgtttgaccgtgccatgactcgaacggtgtcttgtcgcggacgctctttgtcggcgcccggttgaggatgtagacggcagtggtgaccgcctcgccctagaactcccccggcatgttcttggccttcatcatgcatctggccatggccacaaccgtttggttgcggtgctcgatgacgctgttttgctgtggagagtatggcgtcgttagctgcctggcgacgccttcgttcgtgcagtatagcccgaactcgacagaggtgaattcccctcctcgatcagtgtggagaacgcgcagcttgcagccggtctccacctccactcctgccttgaaccgcttgatggtagcgggagcctcgctttttgatgttaacagaaacaaccacatgtagcgagttagatcatcaatcagaagtaggaagtattttttactgccatgtgtcgacgatgtgatgggtccacagatgtccccgtgcaccagatcaagatggatagtggcgcgatgcaatgccgccgttgggaacggcgctcgtcgctgcttgcttattaggcagccgtcgcagaccttggtaacccgctccagagtgggaatgccgcgcaccatgccgcggctcgccagtgagcggagagcgtcgaagttgaggtgcccgtatgtcacaccctgaagttctcctcctaagcctaaattgaatttataaatggtcccaagaaaatatcggtgtaaaagcaagagtaaaccctaataaaccaatgcaaataataatcggaattggcattagaatttttcttgagttctacatgtcgaaatttgctaacaagatttttagtggaattttgagagccctagaaataattttaaccaattaaaattgagcacatgcaattttaaatccaggaaaaatcctttcttccttttctttttcttttccctcctttttcctcttcttgggccgtcggcccagtccgcccgccgccgcgcgcgcccttttcctccttgtgggccggcccaagccgcccctccctctctctcc

SEQ ID NO: 2616 - DNA, 1501 bp, Oryza sativa
gtggcagctgagtcagcgtgggacccacgtgagccccacatgttaggattcagcaccctctcttttccccctccccttccttcctcctctctctctctctaactttttctcttctccgggcaatccggctggcgggtggggagaaggtcactggagcgaggtgggaggaggtccggcggccggtggcgacacggacgcggttacatagtatttccctccggaataacgcggcggcggcaccacggactcatgcgatccacagtaggagctcatgcgggaaagcttcctgctcaattcctaagcttggggcgccgtggcgaattcgtttgatgagatggagggtgagttcttggagtacctgaacgtggtgcttcggccatggccgcgtgtggccgcctataggcggtcggcccccggcgacggcgtcggagatcgacaatcgcttcgttcagagatgttataaaaatcgatgcacaacggagacacaaattttacgtggaaaacccttacgggaaaaaaccacgggcgccgactggcaatcatcattatagaggagttgattacaaacgtaggggaataacaatgggaacgtcaccccttcctgtacggcttacaagagtatatataggggataaaagaaagacacctaataggatagacataaagtgctactaggaaactaatccgaatatattgtgggcccaaaattcggatcacatatttaacaagaaatcaaaagaacatcgacaccgtactgcgcccatcgattccgtcaagggcgccgttaccaagttcggatgaactgttgattggagagaagtaaattacatcgatctccattgctactgatcttgtcttgtggttaagcttagacagtgattagcattttgattttcttgtgatttgcccgtttctagtgtcgactgctgcgtgcagaggcacaaacaagtgcagggtgagcttgacctggtgcaggatgaggccaccgagtgccacaagagatcagaagaagcggaggccggcaaggcacatgcggtgaaggacctaggcggcaccaatgcgccttcttgatgagctaagacgaagcttggagaaggcgcaagccgagaaggcacgagcacggcaagacatggagctcgccgagctgcgtctccgagagacgcagcgagcgtcagcgagagccctgcggcgaagtcggaattcgtcgtcgccagggacctccatgccaccgccgaaatgagcatgcggccgctaccactgaggtggacgtccccgcttccaccgcccacctgtgcgctgcccctctcccaccgcccgcccacagctcctcccctcaccaccgctgcatcgcccgtggccggccgccgatgccctcgtcctctcaccggctgagtcaaagaagggagagagagatgaggaagggagagaagaggggaagagagagagagaggaggctgaggtggtagccagacatatgggtcccatgttggtcccacgctga

SEQ ID NO: 2617 - DNA, 1501 bp, Oryza sativa
gtcgaggaagttcaggatgccggtgctgccgccgaggatgccggtggcagtgtacctgcagccgttcgcggcttccaccatgaagtactacggcgacagcatgacctccgttgggtcggaggttgttggttactcgtcgaccagccttgcgacggcgacgctgtcgtccagctctagcttgccatcggccatggctaacaatgacagcttgagcccaagagaatgagggttttggttatattagaagttggtcagttggtactgccgtactggtagatggcacatggtagataaaggatatactcccatgttgcaataactcattccaatctgcttgtaatatttgaatgaactggtgtccttctgctccactagtggtgaaatacccaaggcaaaatttgctacaagacacctaaagtttgtggcatttgctgtgagacatccaaagaacgtgtattttctcgtggacaccgtaaaaatgtggtaattagctgctggatatctgcctcattattttattatcccttttattattttcggtggaaatggagagagaaagagcattgaaagtaccaaaacacccctgacactgtttttcttccagcttctgttcttctttcttctcctctcacactgccatgccacagcagaccaacggctccatctggcaagggcaagcacgatggcatccaggtacatgctagccccgtgtagcagatgtccccgttggcctcgttctggaacgtatgtattgacacctgcagcagcagcaatgccaagccgagccgtgtgcaaactggaaaacggcgttgattcgataccccttagcgagtgcgagcagcaccagcaggagcaggaagggccccaaggggagtaggtatgcagtatgcccctgatttcgctcgcactactgctccttgcgaggtcaaggacggagaggaagaacagaagaggggatctcaaaagggaaaaaaaatgaaaaaatgagccatccctgtcgatccacccgtggcggaaatggcggacggggcatgcgtcccgcgcaaggatttggccgacggcggcggtgcccacttcgccgctaccccatccgaagcggagccctggggaggactcctagcagcggcgcgccgccccgtgctccagcccagccagtcccgcaccgccccgtgctccagcccagccagctccgcgccgccctgtgctctagttgctgctgcagcggcggcgcccacttcgccgttgccccatccgaagccgcaggaggaagaagatgaacagagaaagagggattgacaagtgggctcatggacaaatctgtctttaaccaatgtctctctccgtttctatcgaaaataataaaataatgagacgagtgtctagcagctaattaccacatttttacagtgtccacgagagaatacacgttctttgggtgtcttacagcaaacgccacaaactttgagtgtcctgtagcaaattttgccaatacccaatgtta

SEQ ID NO: 2618 - DNA, 1501 bp, Oryza sativa; identical to SEQ ID NO: 2617

SEQ ID NO: 2619 - DNA, 1501 bp, Oryza sativa
gaggccgtgaggacagtggccgggagtccggtggcgccctcctctctgctaccgatttttttttaatctgtgattcattggatttgatctgtgatgtatgtgatattggatctgatctgggagttgtgatgtatttcttttaggatttgtgatgtattttttgtttgagattttgtgatgtgatgtattgtgatctgtgatgcatttctttccaatatgtgatgtatttctttccagatctgtgatgctactttgattgatatggggatgatttgggaatatgatcgggaatatttagggagcagatcgatttgagaaaaaagaattaaccgagactgctcctaccatctttagtcccggttagtgaaacaattaaccaggactgctcctatcatctatagtcccggttggtaactaaaaatggatttttagtcccggtatccatctttagtcccagattcgtagtcccggttatataaccgggactatagggggttcccaaccgggagtaaagcccctttctctaccagtgagatagtcgaaattgacgttatgtagcaacaactagaaattatatttgcgagctgtgtcatgcaaatttcgataagaacaaaaagggcggctgcagacaacgtcctgaatacacacaatcgtttcatgacaaagaacatcctaattgttatcgaatggacaaccgcgtcatattgaaagacgtggttctctcaacagtagtgttgaaagtaaagacaattatattgcttagtaaaaattttttgatcccccattacatggccctaggaggctatttatagtcctattacagacttcccctttaggatttagattttacaggggaatttacatggttactcttatgataaggaccacactagaggtacaaagtgtcctttacatgtacgggcccttactgggctaggatggcacggcccaacagtttatcgaaactccccaaaggcgcaacggcccgctaggccttcttccggtggggttcgatatacgacgaagcccatgtcttcacgcctaggctttcgcccgtacggccctccgacgaagttcatgcttggtggagcccgcgtgttttttaagccatggctttcgccatgtagtttttgcccatatggctaccctctcgatcttcgctgctcgcctccggctcgagtctgttgcccaggttcttggtttcggtaggctcggccgaaggctctcatagtgtacctccaacactaataaacaaaaaatcattctacaataatacaatggatttgctaaatggtatttgatagaaaattaggatatattttctacaaaatccttcactaccaaaatcacgttaagatttgagctcgaactcttcctccagctttgaagaactcttcttctctagtgtcagcaacaccccaactccgatagagaaccaggtgttatcatatcaagatgaatctcaaatcgatctagaccgtccaaaagcctattgttagta

SEQ ID NO: 2620 - DNA, 484 bp, Oryza sativa
tatgggcccttttagaacgttgaaatcaaatccctactgtgcgttacttatttgggtgacaggcattagcggtttaattatgaactaggcaattataagtgtatgcttagggatgcaagtgggcaatccctctactcatataaaaacccgcttaatagttcattttcttgcttctagtacaaaatttggaagaaaaaattaactagaattgtgataagggcacacttgcatccctatgtatgctggagcatccataatccagttagtttttgtatatagaaagaaataaaatttgctgacactaaagtaattttgactcgcactcttttttgtgttgattaactaacatgtactggtgttgattaactaacatgtactgaattttgttatcatgcttgtatttttgtggtgattggttgctgttgtactctctatttctacttggagatttactgattgctttattaactttcttgacaactta

SEQ ID NO: 2621 - DNA, 1501 bp, Oryza sativa
  unsure (1)..(1501): unsure at all n locations
tgaactcttttggcttacatatggttgtagcttttcatttacatatccttgtacttgttgtatagcagtaccttacaggaatcaaacaactttgaccgcttgttcttggaacgaaagatctcgactagtcagctggatggcttcttccatcatcagtgcagcaggggggctcaaccagccggttaggctcataggtatgagggttttgctatttcctgagacctctcattattatcacattttctctagcataaaatggacgaatgaaaaaataacgtataatctctggtattgtggtatgtatatcaagggaaaatacatgcatggtggcatgtatatataggaaatggcagtgctgtagttagacctaaagcttcgatatttatatctatacttatactaatcgaacactttctatgagctcccacgttaatccgaaagatctggctagaagaacaacataaccttaatttctcgcttcctcttctactcgatcagacaaatttccagtattggaaatagaccagctaagaaagttcaccaggagatgggaggcatcagaatcaaaagtacagcattacagaaatggggcacaattcttctaactacagtaatgagacacaaaagtattcacattactagtagctttgtggagcgttgcacatcccctttgttatgctgtcaagagtatggcagtgttgcagacacgctaatcggcgggatgtatcataggcgccagaagatgaatcaggcgtctacaagtggtgaagataaagttgtgtaagagtttgtttggctaaagataaatcaggcttgagataatttggagtttgttagaggtaagttattgtcagagtaatcttggtcgtgacaagttaactgcatgtttaaattagtctttgcactattttttgtaatagcatattagctttggattcctagttgcatgcgctggctgaatgtagtttttcagtcagagtttgttattcagtttctctgttttttcggagtagatgagatcgagctgggatcggatcgtgggatggcacggtcagtcgttgatccggcaaggtcgcacatgtaacagactccatcgtggaggtgaatacaaggaaaaaaacccagaaaagctgcagtcagttcgcaccaccaaaaactctgtttttcgtttcagttcttcagttactgttcacgtctggaaaatattcagagattgtaggttagccattgatcgagagctgagctaggggtttttgctgacatttggtatcagagcggtaccgtcacgatccggcgacgatgtcatacacaccgcctggacgccgtggtggcggtggcagcggtggaagtggcagcggccgcggcggcgcaagtggcagcagtggggggnnnnnnnnnnnnnnnnnnnnnnnnnnncttgtgcctcaggggagagatgcagggcacaccacccgcctcccagtgctgtcaaggacgaactatccggattgggcgctcctga

SEQ ID NO: 2622 - DNA, 1501 bp, Oryza sativa
atacagctaataccctctatccgatgccctccttgtacttcgagaagccacccctgactgccgagttccttacaacagcccgtcataaccatacaaccggggctcaatacggaggaataacctccccagggaattaactttgaattatataccggcgcggaggaatacccgtactaagctgtcaccgtcagcggcccacctcttatccgcagtatataaccccaaataatgatatcccgtaatctaggcaccacgtctaaaatatcagatactactctaatatcatcgtcatgacagagagtaattgcatatgcaaacattatacccgcaccaaagcatctcgcagataccctagccgtatattcagtataacatgaacataatgtaaagtacgtacttatatactcggaaagtatttcaataccataaatgtatatagaagagtattctaataaaagtacaaagctttcaaaagaggaaaggaaagctactagagtcatacccgaactcttccgaaggcttctggactcctgatttctactctattcctattccaccaactagatactactaaactaaacttgagagaaatgagagagctcttgcttgaggtgtgtgttgaagtgaagagagtgaactccttaaataggcaggtaatgacggttatggtggttggaaaggtcggtaataccctccaaccgccatagggagtgaatctccactgttccctcaaaaccctgcatccatcggcgctggcattggttcggccgaacccctggtttagccgaaccctgggctggcccaaccagcccacaagttggctggtggcctcctccggtgttcctcttcgtagacttgtgaaatttggcccagtgtgtcgtgtcaatcctgagttcttggcccattcatacataagtctggttctcgactgtcacaccccgaagttctcctcccaagccaaaaatttaatttataagcgaccctacgaaaataccagtgcaaagcaagagtaaacccttttaaatcaatgcgaataataatcggaactggcatgtggaatttttcttgagttctacatgtcgaaattcactaacaggatttttagtggaattttcagagccctagaaataattttaaccagttaaaattgagcaagcaatattttaattccaggaaatccttttctcctttttctttttctttttccctccctttttcgaatgggccgctggcccattctctccttttctctccctcctccctgctgggccggccgcaggccgaggcccagccaagccgcccctccctctctccccgggacgccgacaggtgggccccacctatcagacccgtccccttcctccagccggcgccgccgcgcccgcaaccaccgccgcgtccacgcctccgccttctccgggccacgtcagccacgtccgcgcgtgcaccgcatctcccgcgcccactcccctctctctcccgcccacgcccgcgcccgaga

SEQ ID NO: 2623 - DNA, 1501 bp, Oryza sativa
cgctgagccgacgccaccctcctacccttcatggagctgctgcttcccctctgccaagttgtcgccgcctcttccaccaccgccagcggtcctcctcgtcggcgacacaatgttgcctctctgccatcgctcctaccctccgcgaagcagccgagggccctccgcagctgttgccatgcggccgccaccactcctcctgcccatcgcgctttggacagagagaggagagagagcgggataaagaatgagcaaatgagtggttgaggataaggttgatgtattcggtgtcattttagtcatttgggcttgtaaatacatgtttttctttttttttctaaatgaaaaactcacgatgtagtgaaagtatggtcagacgacaacttctattttgaaaaacatggacaaatgagcaaactttttttaaaaaaggatcaaattgatagttaagctttagaaaagggttaaatgagcaaatgtcccttataaattgtcctttatctgtattatgtgtctaatagtacacatgttcatcatatctttgatattcgatatgatgcacaaataccttgttagcaattgtagctcgatgaacttttggtatataatttttaaattttaaagatagaacgtttaaagagcgttgaaagaatattttgtatttattttgtagaaaatatattttaattgtgtatgtttgcgcaaaaatatagagtgatattttaaatagtataatataaaatcctatttttaataccatcgttttctttcaatggcaccatgtacgtatttttttctattttaccgcttttatcgtaattaagttcgtacgcgagtttcttttttctatgtgaaaagtaggtaaacttcattgtttattaagtgtataccacagttatacaaagttatatgtatctacgtacgttcttttttttttttggcccacagcataggaaggtatttttattaaatagtagatctaatctaatggtccaaaataccaggtccaccaatttaactgaaaatcgactgtgagattagatagtgccatgtggcggtctaggagtgtttgtaggagtgacacgtggcgtcttaggagtatttatagaaagtttcatggacttttagtatataatagatagatgtagaattgagaggcaaggagtatatagagcgagcattcccttaaggtgtaaaaactagctctttctattattcataaaagataaagccaacattgtttatttaactaaacaatcttggcaaatgctaggatgcaactgatgctagtgtggtgcgtgcgtgccttctcacttgtactcacagaaaatggaaaaactgaaccgtctacacatggttgaatttcgtccaacgatgatattatagtaataatttgtatgcgtctaagttaatcagtcttatgtgcaaccctacattgaacataactaactgaatttcatgcacaaagggtacataaaatgtattccaaagaataattatattt

SEQ ID NO: 2624 - DNA, 1501 bp, Oryza sativa
tttggtaacagcggttgttagaagacaaataaaataaattattttgtaaaggaaaaaaatacattaccacaaatgtcactgcgactaagaagaaaataatggagagggagcgtgatgctggatccattactccttctcgcacaacagcagattattcttggagataactttgttggtggccgacgaatatatatagtatattacaattaattttgcatttatagacgaaatagatgtgagatatctttggatcatatcgaaacgcccacgcattaattagatagattgtgaacggaattatctgggagattttatcataattgtacattgattgtaacttaatatacaaatctggctggagtaaaatcaacgattgccagacatgttgatatttttacgaaggcaaattttgctacggaacacttcgacttcgtggttttagctgtacaacaccacccgaactcaattttggaggaaaacactccataaacgtggtaatttaccgatggacatcgcgccgattagaatgataatttccggtttaagaggagagaaaaatcgtgtgaaatgtcaaaaatgcctttaggcccacacgtcaactctcctatctctcttctcttctctctctatcttcattccataacgccgctatgctgcccgtcgtcttcatcattgtccagccctctctcggcgggagtggagggggcagggaggtggaaggcggtggcaggtgtgtcgacggaggaggctgcgacgaggaagcgctgggcaagcggtggcgaagccggggtggttatggtggcgaagcggcacggggttcgagctcatcgcggcggaggagatggtgaggacggcgggagcggccgccgcgggagtggccgccgcgggagcggcggaggacggagaggacgtagcagccggagccctcgcgtgcgacggcggcggcgaagtcagtcccctcctcgagggggacgcagcgcacacggcaggggcccacccgattggaacaaaagtgagttcggatggtgtcccacggctaaaaccacgaagtcaaagtgtcctgtagcaaaatttgccttttacaaacgtaagcgctcacactcaagactcaacccaatgaacacgtatccctatgagcgtaccccaaatactggattttttgaatagacgaagtcatcacaagtgtctcgctgttaagtgtcaatgggtacgtcacctagctgtaaatacaagcaccattgaagtctataacttaaacccggatggacaagtttcaccaaaaagaacctaaccaattgagctactatcacttcgcacccatgtcgaaaaattgaccctagctactccattcatctataaaagactaaaatactgatttttagcttaagaatttgtcacgcgaatactgtattgtagggtggggttcactggacgttggaaaaagtacgaattacccccactgaactatcatggtcgaatgaattactccattgaacccgaa

SEQ ID NO: 2625 - DNA, 1501 bp, Oryza sativa
tcgattgtaaactcatggttgacacatatatgtacagttcagatttataagttgcagctatgcctttaatggatgaaagtgggcatatatgtaattttgagatggttttaaagtgagtgatttattttcttgtgcttggtacaaactaacaatatgcatgtaagaaaggtttaggatagggtagatttactccaaagctgcttgcagcagataagtttacactacaatatttagccgacaggttcatgggcaagtgtttgtgagttttttggtccaatttttctaaaataataggccaagtcttttattcttagatgaaaaacaggctttccctattgtcttctgaggtttagcttaaaaaagcccacgagttcatgaaaaggtagttgtcagaactgagaggtatatagccttccttggcttgctagccttcaacctatcgttaggcagtaaaatggaacgatggccagttctatatattatggctctgctgtgcttataccatttgttattggagcatttcatccctaggtctatagcagcgctcctcttcatatcctcattcccatgtgctcatgaggtatgtgcgtcgatttgcatccaaataatatcaatgatggacgtttggtaactaaatgttaattcttaattaccacaactaaaatatatgccgtttaattgcaatcaggttgtccaataaacttgaagaagatataggtaaatggaagcctgatgatatcatgcaggtaaataaaggcctgataagatcaaatcaagtaggaatttgtattttttttaccaaagattaaatcaagtgggaatctcgttttttttcccttaaagtgcttatatgctaatagggtagatttaagaggacgtcacgggcccaatcaggcatgcgaaaaatcacgcgtgagggtgttgcgggcccaatcgcagaggagcacagaggcgtatgtggaaaatgaactcaggcgcaggtctgcaagcggcaaggggcacgtaaaaaggtgcatgcctaattacttcgtacgcgtatgatttaatagaaacataaaattaaaacctattccaatacagatgatgtaccaaaattctaacgaaaacatcttcaatttttataatagtagagaagggatttgcatcatcaaatatcgccgtagcgttagcacgggcattttactatttataaaaaatgtgacacacgattatagcccccgtgattcaatagcggcagcaaagatccctgcaacgctcaggcagcaaaagcatacactaagtcaccgacgcatgggcccgtgcgagagggcgctgacgtgtgggccccacataaaattcttccgtctcggcttccccctctttttacttctctctctcctcccctaatatcccgagagagagaaagagagatcccccaacgcttcgcgaatcgcaaatccctctcgcttctctctctctctctctcctcgcgccgccgccgccaccgccggcgccgcggcca

SEQ ID NO: 2626 - DNA, 1501 bp, Oryza sativa
tagaattttggtacatcatctgtattggaataggttttaattttatgtttctattaaatcatacgcgtacgaagtaattaggcatgcacctttttacgtgccccttgccgcttgcagacctgcgcctgagttcattttccacatacgcctctgtgctcctctgcgattgggcccgcaacaccctcacgcgtgatttttcgcatgcctgattgggcccgtgacgtcctcttaaatctaccctattagcatataagcactttaagggaaaaaaaacgagattcccacttgatttaatctttggtaaaaaaaatacaaattcctacttgatttgatcttatcaggcctttatttacctgcatgatatcatcaggcttccatttacctatatcttcttcaagtttattggacaacctgattgcaattaaacggcatatattttagttgtggtaattaagaattaacatttagttaccaaacgtccatcattgatattatttggatgcaaatcgacgcacatacctcatgagcacatgggaatgaggatatgaagaggagcgctgctatagacctagggatgaaatgctccaataacaaatggtataagcacagcagagccataatatatagaactggccatcgttccattttactgcctaacgataggttgaaggctagcaagccaaggaaggctatatacctctcagttctgacaactaccttttcatgaactcgtgggcttttttaagctaaacctcagaagacaatagggaaagcctgtttttcatctaagaataaaagacttggcctattattttagaaaaattggaccaaaaaactcacaaacacttgcccatgaacctgtcggctaaatattgtagtgtaaacttatctgctgcaagcagctttggagtaaatctaccctatcctaaacctttcttacatgcatattgttagtttgtaccaagcacaagaaaataaatcactcactttaaaaccatctcaaaattacatatatgcccactttcatccattaaaggcatagctgcaacttataaatctgaactgtacatatatgtgtcaaccatgagtttacaatcgaaaggggaaagaatggaaaaacagttagaagagattatgccccagccttgcttccattggctctgcactgatcgaataatcgcatcctaccttgccattctgcactgatttctcttgacaactgcacttcatttagcaaaaccatgaaatggagcatgttcctgtcagcctgctaaatagaaacaaccagcttcttttgttaatgagtggcttccaagcttaacttgttttgctaaacttttgaagcaaatcatgctagcttatggtacaccacaaattgatataccagatcagtgatgatcaataatgctatttgctttttaaacagataaatatgaccataagtaacagagaaatgcagttgttttatatttcttttttccccacaaatttgttgcttggt

SEQ ID NO: 2627 - DNA, 1501 bp, Oryza sativa
ctattacgcttcacagtgagtggacaaattgtacgacccaaaaaatagatgtagaattacataatgaaaattttctttccaaattgtaaactatgcgcaataagtttttttacgaaacatatggtattatcgatggcaagccaatataaacaacaagagagaattacaaatatgccactgctttcatctcctaatttggaatagccattataaatacacaaattgcatatttgccaccaaagttggtgtgtgtggcttccgtttgccattgcagtctgaactggtataattaaaaggtcaaaagtttttttcacaaaactaatgtagaaaacaaggaacatggtatgaccgttttgctcttggctaaaacagatccctcactggcttctctctccaagagccctaaatcctcaaatccccttatctcttcctccaaatcgagaacaaaactattcaaaattggttccaataggagatcgagggcaagggaggaatggaggaatggtgacttgggcggtaacagcaagcgcagcggcggggagctgcttcggcggcaacagcttgatgtagctgttgctagtgaaccatgtacatgtctctccaaccttaaactagtgaaccatgtacatgtctctcaaaggcaaagtgaattcccttgttatttttatcttttcaggataataaattacaaaatacttcgtaccatagtctagcccatcagaaaaacacaaccatcatcgtctcattgttataatggcttgcactggttttcctctctaaattaaaatacaaaataattgatttataataaatagtctatgcagttgtatagatatgttatatcactgctagagaaagcatttgtagtcccagtttgtaaacccctttagtcccggatagcaaaccagggctacaagaacaggactaaagatcgtcccggttcagatacccgggactaaaagttttttttctacttaaatattgattttaaactgtcctcaaaatcatcctcattcacaaaataatccacaaattcaataacaaaatcatccacattcacaaatgcaacaacaaaatcatccacatttacaaaaacatcagaaaatcttccacaaatttacaccacaaaatcagtcaaaaaaaacatctaaaaataatcccctattcttctattttttttctactccacgacggccgttccgggcgccgcccttcgctccagcgctgggcgccgccgccctccgcaacggccgcgccgccaatgtctttggctgccgcccgctgacgtgagggtaaagggagaagggaagccagcaaggggaggaggggaggaaaagatagaggatgtgagggagagaaagagataaggatgagaggaggagggaatctctgaaatttttctctccctcacatgcgcgcctttttgctttctctatctcacgagcgatttttttagtctaaacaacagggactaaagatattagggggcctaccacgtcct

SEQ ID NO: 2628 - DNA, 1501 bp, Oryza sativa
ctttacctttattttactttggaccaccccataaactttttaggaatacataaatgacttttccaactttaaacacatcagcagcccgtaacccggtaatattttccaacttacacaggcaattgtttacaatattatagagtagatgcagctaaagaaaatgacttgggcggtccaaagtgcaccaaagataatcttacctagtctaaagtaaaaatatgagctagaggatagcctaaagtgaaactttggcaataaaaggtggaccagagtgcaattaactcttgtttttttcctacatttaatacttcatatatatgtccaaacattcgatgtgacagcgtgaacaattttgttttgtgactaagggtgtgttcggacccaagggttcccaacacctctccatcgttttccgcgtgcacgcttttcaaactgctaaacggtgtgttttttgtaaaaagtttctatacaaaaattgctttaaaaaatcatattgattcatttttgaaaaaaaaagctaatttctaattaatcacgcgttaatggaccgctccgttttccgtgcgaagaagatttgttcccaacctccccaagcaaacacagcctaaacagggcctaaacctcgatgcgtttttatcatttctgaataaggtaactaatagatcgtcatagtcttcgtcagacttctatctcgatcgctttcaacggggcacatcagcctaggcggctttgggtcatggacatgtacaggtaggtgcaactaatcatacattttgcaagttttcatggactagtaaaatagaaaaggtaaaaatgaattagtcttgtgttggtactaactaacacagcatttgcaaacctgtaagctaccgtagcatatataaataattgtttaagatttatccatgccactaaatagtttattccaaaaaaaaaagttacttatggttaatcttgtggcaaaaaaaattactcatgataacaagaacaaatctcagatgctcatttgtttatcccatgatatttcaggtttatattgcaaatgaactttgtaccgcatattgatctcttactaacttacccatgcaggggcggagctagtatatattagggggtgctcaggaacccgataaagaaaattttttaaactataccttatctattttcaccgtatatgtacccccttaatacaaacttagacatttgtattaggttaaactttaatctaaagtaaagtaaattaagagagtaacaccacattctgtttcgctctagctctatccctgcccatgcttcacctagaaaaatgttaccttcatcgtcacttgtgttgtttaagtcttgcagcacgaaacctcaaggaggagatccattcttttcctatatatagctacccacagagaaaaacctcattgtcctcctctccactacactacactgtgcacttctgcaggttgcaatggccaccatcccggaggtgccggcgagcgagcttatccag

SEQ ID NO: 2629 - DNA, 1501 bp, Oryza sativa
cactttataccaccatttaacacattttttcactttgggctaggttactttacctttattttactttggaccaccccataaactttttaggaatacataaatgacttttccaactttaaacacatcagcagcccgtaacccggtaatattttccaacttacacaggcaattgtttacaatattatagagtagatgcagctaaagaaaatgacttgggcggtccaaagtgcaccaaagataatcttacctagtctaaagtaaaaatatgagctagaggatagcctaaagtgaaactttggcaataaaaggtggaccagagtgcaattaactcttgtttttttcctacatttaatacttcatatatatgtccaaacattcgatgtgacagcgtgaacaattttgttttgtgactaagggtgtgttcggacccaagggttcccaacacctctccatcgttttccgcgtgcacgcttttcaaactgctaaacggtgtgttttttgtaaaaagtttctatacaaaaattgctttaaaaaatcatattgattcatttttgaaaaaaaaagctaatttctaattaatcacgcgttaatggaccgctccgttttccgtgcgaagaagatttgttcccaacctccccaagcaaacacagcctaaacagggcctaaacctcgatgcgtttttatcatttctgaataaggtaactaatagatcgtcatagtcttcgtcagacttctatctcgatcgctttcaacggggcacatcagcctaggcggctttgggtcatggacatgtacaggtaggtgcaactaatcatacattttgcaagttttcatggactagtaaaatagaaaaggtaaaaatgaattagtcttgtgttggtactaactaacacagcatttgcaaacctgtaagctaccgtagcatatataaataattgtttaagatttatccatgccactaaatagtttattccaaaaaaaaaagttacttatggttaatcttgtggcaaaaaaaattactcatgataacaagaacaaatctcagatgctcatttgtttatcccatgatatttcaggtttatattgcaaatgaactttgtaccgcatattgatctcttactaacttacccatgcaggggcggagctagtatatattagggggtgctcaggaacccgataaagaaaattttttaaactataccttatctattttcaccgtatatgtacccccttaatacaaacttagacatttgtattaggttaaactttaatctaaagtaaagtaaattaagagagtaacaccacattctgtttcgctctagctctatccctgcccatgcttcacctagaaaaatgttaccttcatcgtcacttgtgttgtttaagtcttgcagcacgaaacctcaaggaggagatccattcttttcctatatatagctacccacagagaaaaacctcattgtcctcctctccactacactacactgtgcacttctgcagg

SEQ ID NO: 2630 - DNA, 1501 bp, Oryza sativa
cgaacacacccttagtcacaaaacaaaattgttcacgctgtcacatcgaatgtttggacatatatatgaagtattaaatgtaggaaaaaaacaagagttaattgcactctggtccaccttttattgccaaagtttcactttaggctatcctctagctcatatttttactttagactaggtaagattatctttggtgcactttggaccgcccaagtcattttctttagctgcatctactctataatattgtaaacaattgcctgtgtaagttggaaaatattaccgggttacgggctgctgatgtgtttaaagttggaaaagtcatttatgtattcctaaaaagtttatggggtggtccaaagtaaaataaaggtaaagtaacctagcccaaagtgaaaaaatgtgttaaatggtggtataaagtgaagctttggtaataaacggtggccctaaacgcaatttactaaaaaaaacaattacacagattgtgtgtaaattgcaagacaaatcttttaagcctaattagccatgatttaacaatgtgatgctacagtaaatatttgctaatgatggattaattagacttaataaattcacctcgcagtttcctgacggaatctgtaatttgttttgttattagactatgtttaatacttcaaatgtgtgttcatatatccaatataaaaaccaaacccaaaaaatttttccaactaaataaggccataatctgaaaacgtgtaaaatgttgtgatattaactagagaacgaaatagagtgaaatctataaccgtagttctagagtgagtactacatgttattaacaatgtaaatatattaaacgacagagtattgtaaaagtaaaatttataaatagctgaaatttgaattgtggaacgaagaatagatgtaaacacagtatgagattaattgaaattagaaatggaagataaagtaaaattagcaattgaaattcaatacgagttaccaaacttgagtccctacaatactaaattaaactttggattaaaatgaaataataaaataattccgagtcaatataaaacaatacacaatattattttaaaattcaaaacaaaaattaaaacaaaactactcctccaaaacatggaaaatggttaattcaaccagtacaatgtacggaattggacttggtgattcttcactctctagtatgtcttgttatcattgtccatgtaatctctataatgattgattatagccttttaaagaaaagatgggaataaattctatgattaaaaaatatgtctctccctaattgttttctttatccgaccctgcatccatgtatgctcttgcttttgtcaggatgtatgtcagctatatactccataactcttggtcaagtatgctatagctagagctagcttatggcggccactttggttgaccagaaacagaaaggcaagtggctgatggctgatgacattgttccgcttgaagatatatgcttttttaaaat

SEQ ID NO: 2631 - DNA, 1501 bp, Oryza sativa
aatattcctctctcgaggcatcggatgtttcattatgcttgtttgatgacttgaattattcacttcatctctcaaatataatggaaggtctggagagcctacgacactattgtcagggttacgggtaaggtataccctctacccttcgatatacgtcacgtatcgatatggtatgtttgcgcatatacggacgttctcagcataagttaaggaagtctatcatggagtctatagatggaaagagtcctacttggatagaaatcggccgtcattatatcatgtcgggtccgatgtctctgagtcctacatggagaccagttgacctacggtataaaagggaccccccgggaggacctaaggcattaaatcttagagccaacacatctaccacagcctacgaagccggagcttatcaaagccaggtcgccgggagatctagtcggatcaactcgactacgatcctgtcggtatcatcgagctttactattccttttgtaatctgtggtttccatcatataatcccatatcaattggattagggctattaactaccaaggggcctgaaccagtataatccctgtttcctgtttgcttgatatcgtactacgtagatcctcgtaccagcgtaccccaataccctctatatccggtctatgggtatcccccgtcgacaggcgcgcctccatctccaggtgtggcagcagcaacagcggcgacggcggcaccagacatggtagcagatgacgacgatgaagaggagcaatcgtgcagaagcactccccaaaaacctgatcacctgcctacccggtgcagatctcaggcgaaggtatggttccggaggccctgcttgttccgatttctcgtgcgcacaagcgatcagaagcggggaagcagaacagtagcagctcaggcgtgcacgaggaggaggaggaagaacaacagatggaaagtgagtagccgcatctgatcggattagatctttccttgtagcgtaggagcgatatccgccctttgccgcagtaacgacgcgatcaattggaattgactcgcctgcccgttacgaaggcaatctcattacggaggcaatctcgggatggtccattgcaaaaaggatagagacaggcgtaggcgcaccgcacgcctcgcccccacgcccgcccggctcgcgcgcgcgcgtgtggctttccgatcctcacctcaaccagtcaatagggagcctccaataactccctatttaagttgagatactcctcatttaattcccaaggtggtattattatccttaacatttattatgggcctttgagatttaatagaataaatcgggcctagcccatttattattctagggaaaattggaaccatgccattataattttgtaaaatttgagatataccatcctgacccacatgtcattgactcatgtgggtcctacatgtcattgagataccgatggcatatctcaaactttgtaaaattataatggcatggttccaaatt

SEQ ID NO: 2632 - DNA, 1501 bp, Oryza sativa
catacattttttaaaaaaatataatatattttaaacgttctgattaataatatgggtgggcaagtttgaccgcaagaaaactaaccagttgaactacgctcacttcataatgttggatataaagacaaccataatttttaagctacatttttaaaatactcctatgccttttaaaccggtagaagcattatttctaaccgttagatctatcttatatagaaaaagtgtttattcatggtacatgacatttcaaaaatattactgtgcaatgataatacttcgtcgttatcgtgttatttctaggttgcgtggagtctctcatctactctacataaaatgttcatagatagatcgcttcttaaaataacccatgtatttagtggagcttcatttcccacccaacatcctttaacatattatgataatatattatacatcaaaagaaagaaaaacaccttacgttttattttacacttactttactttcgttgacatgttttctaagaaaataaatctacattcttttgaaatgattaagaagattataaataattgcttataaatattacttatatatgatataatataaaactgataggttaaaatattattaaacaattaattaacgctaacaaaaataatttatggagaaatcgtggcggatgttctccggttaatatattgcttttataaatacgtcaaaccactactggtgaaagggttttcactcacggttcgtaaccccatatagtcccgattatacaactaggaccacgaatctatctctagtcttgggtaaaataaccagaactaaaaattatctttagtcccggttcctattcaaaccgggactaatgtggtttttgcaccacctagcaaagatcacttctccagtagttaacatagcgtatgacgtacgcccgcgcgaatgcacgggctacctttctagttttataacatttaaaaggaggtatagtccaacacatatttttcatttgctgatatatacatcacatgtactgctagtgtgagagtactccatccggttagaataacatcacacgctgctacttctaatattacgcaatttataactgtgagcaggcagatcaagcaacgcatatattagattacttaaacccgtgggatctttggaaggttagggacgccacgtcatcggttttttcaaaaacaccactcacctctgattaatcacgttttgggttaatcacgttttggaaagtaagtgtgccacgtcattgtatttttttgcaaaaaaacgcctgcacttcctgttaattgtgcgttggttcctgccgctatggtccgttcgatcacgcgcgagggactagcgtgtcccagcgtggctgctcttccaccatcgtgagatcgttggatcagaaacggacggcctagatttggcaagaaccctagccacctcgcgctcgcctctcttctcgctcgtgctgccccaccctcctccctcgtgcgggtcgccgcc

SEQ ID NO: 2633 - DNA, 1501 bp, Oryza sativa; identical to SEQ ID NO: 2628

SEQ ID NO: 2634 - DNA, 1501 bp, Oryza sativa; identical to SEQ ID NO: 2629

SEQ ID NO: 2635 - DNA, 1501 bp, Oryza sativa
gaaagattcgtctcgcggtttccaggcgagttatgaaattatttttttcattcgtgtccgaaaaccccttcaaatatccggtcaaacatgccacgtgacagttaaaaaaaaattcgtgaactaaacaggcccttaaatcctacagatgaacgtggaaagaggaacagaggaatgactagtctgcccagtataaccgctggcactgtgagtgtgatggagacatggaaattaagggcctgttcactttgacgccaaaaaaaaccttaccaaattttggcaatgccaaattttggcaactatgccaaaattttggcatagttgccaaaattttggtaggatttcttatatagttatcaaaatttggcagcaaactaaatatagccacttttttgataactttatcaaaatttggtaaggttggaaatggcatcaaagtgaacaggccctaattaaccttgtcgtgcggttggtggtttgcgtggctcagatttcaggccctgattagataagactaaaacttttaagtccctatcacatcgaatgtttggatactaattataaatattaaacatagactattaataaaacccatccataatcttgaactaattcgcgagacgaatctattgagcctaactaatccatgattagcctatgtaatgctacagtaaatattctttaattatggattaattaggcttaaaaaatttgtcaagtgaattagctttcatttatgtaattagttttataagtagtctatatttaatactctaaattagtgtctaaagacagggactaaagttaagtccctggatccaaaccccaccttccacatgaaccaatcaaattctacgaatgcagcttgcgcattttttctaaagataattgaaatgcgttgcctctatcattgctgaaattaataaggtttgtagagtagctttctttgctgaaaggaaaaatacattagctaaaataatggctagttcaatctccgttaaggaaaccagattctaacaaataactcaatagatattagtactacatacacatttcaaaaaaaaaagaaagaaaagaaaacgtcaactatcaattctatgagtgcaactctatagtatagaaccccatttctcctctcatgtaatcatagaccaataataaaattagatgaaagaaaaaaataatctatataaggttagaattttttttttattcttaaaatactccatcatttcagcaacgctagattaaccaacacaacaggctaatcgtaacaaaaatccttttttttaataagttggcatgtacactaccttgagtcaaatcccaaaaatcaattttggcaattgcagcttgtgcatacacctaactcctctctccaatctaaatttcccccactaaattctcatcaaaatttcttaaatattcactcggaaatacgatatgacataagtccatgagctagtagctcctagcaagacacacagacacagtggaagcaaaa

SEQ ID NO: 2636 - DNA, 1501 bp, Oryza sativa; identical to SEQ ID NO: 2630

SEQ ID NO: 2637 - DNA, 1501 bp, Oryza sativa
aggacgccatcggaggatgcatcaaggtgtggggttgcgaacgacgccgagactgtgagcgtgatcatcccctgtcacagattgaaattttataacgaaatttcagaaatttttcgttctttattgttttttcagtccactggtgaagaccatcaaaataatttgtgaaacaaaaattaaatcttaaattttgattgacctttaagaaattcttgattgccataagaagatgttcttttctaaagaacttgtgaaaaaaaaacataatatcttcttaatttttgcttgacatttcgcagaaattcttgattgccataagaaatttattgttctctctctttttcagtccctgtaaagcatgaagaccataaaaaaatttgcccaaaaaaaatcttcttaagctttgcttgacctttaattccgaaattctctattgtcatatttgatatgcttttgtttgttatctaaatcttgttgtaaaaacatttcattcacaaaaatgtctgaataatgaaaattgaataaaggagtatgatatattttcacattaaaaactaagaaaaatctcttcaaacattcagtttttcgcattaacaaaaaacttgtttgagcatacttttcttaataaataaaaaagtataccatggagtagatggagaggaagaggaggatggtggtgcggcgacccaagaaggagtcggcgatgaatgcgccgacgagcggcgtgaggaagcaggtgcccgtccacgccgacacgtccctggcggcggcgacattgctctcccctaccacgccggtgaggtagctcaccaggttcctcgcgatgccggcgaacgccaggcagtcgctcagctccgtccccagtatcagcacgcacgccctccacccaccgccgccgcccttgtcctcctcctccttgccgccgccgccgttcggacgaagcagcagaggcctcttctcctcgtcttctgctgctgctgccgccgccgccgccgccatggagattttgcttccactgtgtctgtgtgtcttgctaggagctactagctcatggacttatgtcatatcgtatttccgagtgaatatttaagaaattttgatgagaatttagtgggggaaatttagattggagagaggagttaggtgtatgcacaagctgcaattgccaaaattgatttttgggatttgactcaaggtagtgtacatgccaacttattaaaaaaaaggatttttgttacgattagcctgttgtgttggttaatctagcgttgctgaaatgatggagtattttaagaataaaaaaaaaattctaaccttatatagattatttttttctttcatctaattttattattggtctatgattacatgagaggagaaatggggttctatactatagagttgcactcatagaattgatagttgacgttttcttttctttcttttttttttgaaatgtgtatgtagtactaatatctattgagttatttgttagaatctg

SEQ ID NO: 2638 - DNA, 367 bp, Oryza sativa
gcgtagccgcctggcctcgcgctgccaatcgccacccagccgcgcctgccgtcgccgctcgcgcccgcccccacaccgccctgcctcgccgccgccacgctcgtctcgctgacgccgacgcctcgcctcgcctcctccgccgccgtgctccccacgcctcgtcactgcctctgccgtcgcccttcttgatgcagctccaatggagaagagagtaagagattgggaaagagacacaagacagatagagaaactgataggtggggcccacctatttttttaacaatgaattgttgactggactaccatgtaggatcaaaaccacagcggattgagctgggggggggggttatttgttcgtttgcaaaga

SEQ ID NO: 2639 - DNA, 1501 bp, Oryza sativa
tggaggcggagacgacggaggagcgtggcggcaaagctagctaggtggaggactccgactccagtgactcgttgatgctattggtgaggtaaggacggcggcgagtagggggcggagccagttgtgggtggcggagggggcccgaggacgatggcggctggcgacggaggcggaggctgaccgggcacgcggggacgcgcggtgggcgatgggctcgtcctcctcgtcgtgggcgcgtggggacgcgcggtgggcggcggcctcctcctcagctgtggcgcacggggacacgcggtgggacaccgccgctactgcgggctcctcctcctcgtcgtgggcatgtggttgccgatggcgcgcagggactgcggtgggcggcgggctcctcctcctcgtcgtggacatgcggtgggacaccactgccaccgcggctcctctttcgagccatcgagccgcgtctcgtcctacctccccgcgcctcgctccccgtccgtctcacgcctctcctcgtccgccggcgatgcgccggcgccggcgcagagaaccgggcccaagggcgggaggaagagcgtgccgccacgctcgcctcacctcgctctgccgccatgctcctcccccgccgccgctgccccgtgatagagagagagaggaagaatgagacacagatagagaggaaaagtgagagagaggaagagtggaagagtatgacacgtgggtcccacatttttttaataaatagaatgttgactggactagcacgtgtacgccacgtagaccaaaatcaccgcggattgagtaggggggtaattcgtccggtttgcatagttggggtgaagaatgtccggttttatggtttagggggtaattcggatgaccgcgatagttcgggccgggggagggggtaattcgtacttttcccctgcttatatgatcattgtatgaaggcaaggaaacccctgatggctactttggcgcttaggaatttcactgaaaacaattcattttccacataaactgaataaaaaaactttttttcgaggaggcgagcaggagttctgccgtttcatattaggagaaaagacttaaaaaaaaacttttgtacaggagtagcaaatacagtaaagaagaaaaaaaggcaacttcaggctaaaattttggcaaactacatttgggccagctcttcttcctttgatttgaaaagtaatccaaaggaatgtttcctggaccaaaatcccctataaaacccacctacactgatagttgtccaaggcagtatcaatccaactcacaaacacaaaagtgtaccaaagcacccttaactggtgatgttttataaacaccacttcaaaaaaaaaaagaagagaaaaagccatctttatctctcaaaagcagaggattacacaccataagccataatctttctttgtaaaccactgatcatcatcaagagtgaccaacacaacacttgctctcactcaccctctgtcactcttttcttctc

SEQ ID NO: 2640 - DNA, 1501 bp, Oryza sativa
ggcggcaccccgacatcgatgtggtggcaaaccaccggagcagagggaggggttgatctagttttttttttttatttgaatatttgatgtttcagttcatgtacttggatgtttcattagttaaattgaaatgttgttgtggggttttccatggtgtttcatttttttcgatgcacttggatgtgttgttttatatattgtaccaaaatttttcattgtatgatttgattgattgtgttttaccattttcaatattgaaacattttttgaatacatcttgagaaataacgtcgggtgcccgattcgtagtcaccccaaaagaataacagctgctagctgcgtttcagatccgctctgcatgggagagagagggagagaaaaagaaagagtgtggtgaaagctgagagagaggcagggaacaaaagtttggactgaaatttacaaaattttgggtctattggatcccatacaaaattatttcacctggaatttttggatttttgcaatattcgtgaattccacaaaaatatttgaatttgatcaaattttgtttaaaacttcaaattatttcggattaaaataaccgaaattttggaaattgtgaccatatcgatacccccgatgcaactaactaaattaaaaaattgaaccctaaagagaggagcaggatagaatgacttagcttgtaactgtcaagctcaggtggatctaccgtagttttaccactgccgctcaccgtggatctgccgccgtcaccgtggaaataaccctcacaccgcttgctccaccgcattgggctggttcgaggtgactggttccattggctgatgcaccacataagggcaggagaggtgggtgctgctcaccaaagaagtgaaaaaggtagatgagagggagaggagttgagcagacggtgtggtagagagtgggtttagggttactgtcagtgcgggtcaggtgggtggacaggaaaccctccctctattattagtgtgagtttttcttaaccgatgccgataggtggcacagttgactgttgacatgttctccattagcgcaaacaccaaacagtaagaaaactatgcagggtgtcacacccacattgtgttaactgtacagttgttgtagataaactagtgtaattaagaaaacaaattttcttattttccaaaaatacaataacagtgtgtgtggatgctgtcatacgcttgattgctgacatagacacgtttggctcttccaacttgcagccactcccgacacgtatgggcaaacattcatactataatatatatagcattatagctctccatgcattaattagaggctgcggcgacaacacgtatttagacatacatatatatatatatatatatatatatatatatatatatatatatatatatatatatagttagtagtatggacacacaatatatacttcatcaatcctgtatctcccacaattgccccttcgatccccccatggctgcggacggtg

SEQ ID NO: 2641 - DNA, 1091 bp, Oryza sativa
cagagctcctcctacctctgccgcgtcgcccccgctccctcctcctttcccaaagaggcaagggacaagccctcttttctctccctcttttcccctttttcctcccgccggcgtcatcctcctcccccctccctgtcgccgctttggccacgactgccgagcgctagccctctcctttgaccgccctaagtcggttcccaaaccgacattgctgctcctataaacccaagcttccccctttcctttcctctcccattcgcctccacgccattgccgccgcctcccgtgctctgttcgccgtcgctgttcgtcgttgcacgtgtcggaggagccggcacgagcaaggacgcggaaggggactccgggcgcgccctctccttcctcttccctgccccgaggccggagagattactcccgcgccgtcggcctctcgtcactgcgcccgcccgcacggtagtgcctccctccattcttcctcctcgctccatctcctccccttagactcgggtagtagctcgagtagcctccccgtagctagccggcgccgccccgaccgttgccgccgctcgccgtgtgctcgccgctgtcgccgcccaagctcggaagcgccgctcgtcgccggcctcgctcggcgcagctccgcccaatccaacgctagcatcggattcccgtagccgcgtagatgccctcgccgtcgggaattggcccctcgtgacctcatcgccgtttcccccttccctcgccgccggttgccgccgccgcaatccgccgccgacgcactccctccggcgaatccgagccattggctggtctcccccggtcctgtgcgaccacccggtgtgctcgctttcgcctgtatcgccgtggttcgctccgccgctcgccgctgtcgtccgccgtccgttccggctggcgtcgtcgtctacctcccgccggcccgcgtggcagccacgtaggcgccacgtcggcgccaactcggccaagaccgggtcgagccgaccacggtcagcccctccctgtgcgcgcgttccaccgcgagccgtgaggctgcgcgtgggcccgctgcatccgtgtccacctcgaaccgcgcg

SEQ ID NO: 2642 - DNA, 644 bp, Oryza sativa
aaatacctgtaattgggcccaatcaccatgccattggattaagggccctcctaccatgatcctggagaaaattcggtgccaaatgggccagcaaaggtttggtcgaacccattcggccccctttttcacaagcagttactatcgatctcctaatgatggttgtgatagtttatagcgctccaaccgccatcaggaggatagatggcaagaagagagtgaagatgcccttagaattctatggatgatcacactcccaaggcacctccacctataaataccccctcacctccttcattccaacacacaccaagcatgagctgaattacaagaggctctattgtatcttttatgtacattagaattgggagagaataagggagaaagagttggagaaattctagagttgttggtactttcctctttacttttgtaccttgtcaattactcttctttaattcataatatctttattgagtaattgagatttactttgtgatgattatctcttagttagttcctattatcgagtaaatgaacctataaatagtgtttactttaatgtttcattggcattaaagtagtattaaatagtctagacgtggtgtctatactagagtacctgcatttgttgtgtatcccacagt

SEQ ID NO: 2643 - DNA, 1501 bp, Oryza sativa
gagatgaactcggggtgagttgcagctaccttctagctacagcaatggagtggatgtaacaccctgaaaattcaagacaatcaaaatcactagaattttgaactttttaaaatttttgcatcatgctggatgttatggttgcttttgcttgccaaactataaattgtcacaatggaaaattaaactaaagttatacaactaagtaataattataataataagatatttattatgaaccctataaatatttacgcacaagaaaacaaagccataaaaagggaaggttaattactaatttaatttatggatcaaatattaaatacttgaacatgtgatgcgtgccatgaaatataaacacttaggaaatgataatcgttcaaataaatggaactctatctatagaatagttttactgggaaaaaataattagatattatataatttgaattgaatcacaaatgctaaattatagaaatccatgtggtggtaaaaccaatccaagaagataaaccaatatgtgtgaaaacagataaataccaaaatcccaaatataggaaattatagaatctttaataaaccttaaatattggacagtattaaattttgggcaaattcacattgaacacttaatacggtcacccaaatgcttaggagtaaataaaaaattaatttgcaacttttctcaatttataaatcaaccaaagccttaaaagtaagaaaataggaaaactcagaaaaatatataataataataaggatatgttcaatattaaatttgaatataaattttgatggaataacatagattttgtgtgaaacacattgtaacaaaataggtggcaatagtccattttctaaattagaaaaaacatctaataaaatccaaataaatcggctagcactgttcattgccccctaggtgctcaaccctgtcccatcgccgccctccccctgcccgcgctgcgcctagccttgccctgccttgccgtgtcgcgcctagccctgccgcgccgctgccttgcgccccgcgccgccgcaccccatcgtgtcgccgtcgccgtcgctcagacgtgccgcgcgccgttgcttcgctctgcgcgcgctgccgcgccccctcgcgtcccatcgtgtcacgcgccgtcgccgtctccgatcgcgtcgcctggagccccacccctccgcgcgtcacgtcgccgtcgccatcacgtcgtcatcatcaccgcgccgcgtgccgtcaccatcgccgtcccgtcgccactgccgcgccgagcgccgtcctatcgccgcgccgcgctccatcgcaacgccgtcacccttgatccccgcgccactgctgcgctatcgcgtcaccgccgtcgccatcaccgcctcgagccccgcccgcgccgcgcactgttgtcgtcgcgctcgccatcccaacgccgcgcgtcaccatcgccccgagccccgcgtcgccgcgccatcccgtcgacgtttaaagccggccacccctcccccgagc

SEQ ID NO: 2644 - DNA, 1501 bp, Oryza sativa
ttttgccgatataactaatctaattgataccaagttgacaaacaagcgtgccgctgttaaccaaaatgaaatcaatgttccaaaagaccgtgacaactgtgaacagatcagtaagaacgataagattcagacagcctcaacaattggatttggtagcctactcataatgtttatattttttaatatgatatatttgtaaggctaacaccaacattacgattctatggtacatgcaatgaaaatgtgtgttctgtcatgacgcccgtgcatctaccatctacagagtctacttttcctccctgccgctacagtggcatcttcaacctccagccggctggagacagagcccgatgccgccattgccgtcgatttcccctccaaatccggtctcctctctcgtgttatttcaaaattagttgaggggaaatattcctcttatcctcctctatcctttcccccaagaatcggactttatcccgaagaatcaacgcggaatctagctcgattcgtgtttatctctccaaaccaaaccctagaaaatcccggctccgattctctcgttgttggatcgatctctctcccatggctataaatagagtcccctccctctcctctttcggctggcacctctacctctctccaccgtcgcttgtagcgtcgtcgccgcgttcgtcttctctgtccaccgccggcagccgctccagccgcccctagcagtcgcctcgtccccaacctgtgccgccacctccctcggcatcgcagcaccgaggagaagcccgtccacccctccgttgccgctgctcgtcgccggaaagtcgccgtcgtcgtcgtcccgacttcgccgccgttcggagctcgtcgctggtcgtcttccatcgtcgttcgtcgtcgtgccgccccttggtgagtttgtctcgtcatccccttcgcgtagatgccctcggttggtccggccgagtcctctagcgccggtggccgtgtggtccagtgccttgttccggtgatgatgtcataaagcccttttcttttctgaaataaatcgttaatccttttctgtataaggctaaaatcagtttaatcttgtaaaattcgtaactaattcagatgaactcggaatgaggccgttcaagtctctaaattcatctaaaatcatgatctatttggtttttattagtctttttcctcgttttgcgtgttagcttgtcgttttcgtcgttgcgaaggttcgtgagtgcgtcggaagtgttcaagaagactaattgaagaccgattattgcaaagcaagtcacatagatcccaaacacaatcctttgaccatgttgatcctatatttaaattctctatttatttcaactgtgtatttatttttcgaatgtcaccgggtggtgtgaacctattcctttgttatggccagtttgcattgattatcctattccttgataccttggataacaaattgattagtttgaaccttatatattagtttggttcagctaaaagc

SEQ ID NO: 2645 - DNA, 1501 bp, Oryza sativa
tctttcggtgagttgtgataactacaatttaggagaaacgttgacgatctgactacaaccgtatgagacgttgtgttgagccttagcgatcgatacacctctccgtgggttgctgatcttgccggtgcagatcaaccctattcctgcaagcaaatcgaagaaacaagcaagaataagataaaagcaatctgatattgcaaataggaatttaatacaaatgataagttggggttccgaagaacaagcagacggacggtctagctgacacgcgcgctgcaagcaagtagcaatggctaaactttaatctatcaaaacccaagaaactctaaagggctacctagctatttaaggaggtgggaggtcctctaggtcgtcctccacctggttgggatgcaccccacatgggcctcacttgggccggggtcccagacgaagttacaagcccataggcccattacaggtgtcacagcaacttgtttcttcagtttctgccgactgagatggaatttggcaatgaggttggatccattggaaagaggactccgagagctttccatcaagtactcatgggccgaaaacggaggtcgtatgcagattcggcggccgtttgaagtcagcagtgtagcagatggccgaattggattctggcatttggaggactcgaacttgatatcttattgttcttctatgatgtgatcaacggatgtatccgtagtaaccatggtcacattagccacggctcatcatctcgtcgtgaatcccctccgcctccgcaatccgcggcggcaccacacctccctcccgtcccgcacctcctcctagatcaccgccaccgatcccgcgtcctccaccgtagccgaatccccttcgccgcgcccatcgttggatcgagcgctgtcgtcatatccacctccaccgctgtccagtctgccgccccacatccccgtccccggcgtttctccacctcgcactccacgctgcatcgcctgccgtcgacgctcgtcgccgtcgtgccccgccatcgcctgccgacggcctccagcacctacctccgcctgtctcctcgcctcccgccccctcgctctcccccaaacgccaccgcctccatccacgccacgcagtcgatccccgctctgctctcctgcgtgcccccctatgcgtgcgcactcttcctgccgtgtgatctccgtcacgccgccacagagaatcaccgtcgcctcccaccacgtcaaggcaggggtcgagcaggccggcaggccatggacggctgtgcccaacgctcttgacatgtactacattgcttcgtgccattgctcccgtagtgctcgatcaaatgcctttagtttttttcccccaaaaagttaggcaaaaattcagttcagcctagacattcatgcagccccaaaagttcaccattatttaattatttcaattttcaatcatgctataaaaaccataatgttagtcatactctaccatactgctagcaagtaaaaacagc

SEQ ID NO: 2646 - DNA, 1501 bp, Oryza sativa
ttttgacttctaatcaagcaccctacgtacttaccacatatcttatttgggaccggcttgttcttactagttctactgtgatcatttataccactgtcacatcctgatttttgttttaggatttataaattatttaataaattattattagaatttatattaaatgttcactaatttacaagaagttaaatgtgggaaataaaatttcctaaatataaagcatggctggatttaatttttattaaattctccatggttaattatactctctggaattttcttggatttttcggagctcaattcctaattttaatcttacaaacaacatttcagtaattatccacatattaaattaatcattaaatggtctaattataatcttgttaagtacttcgagtgtccaagtattttcaggatttttcttgaaattatttgagcattggaagtatttttaacaattcaaagatcatttcagtgattaatttaattggaaaagtaattaaaattcctcttttccttttcgggccgaaacaggaaaagttctatctttcttggcccaatctcctcttttcctgaaggtcgtgctcgcgaaccggtccttaattgttatgagtacgatcttcaaaaccatgtgctcacaacccaccattgacaagttttaattatcaattaattatcataacacgattaaccttcgtgagctaccattaaatataaccataaataataatgtagaatgatccatcccattaatgagctaatgtttctaagcatagctaagcaattatatatatatatatatatatatatatatatatatatatatatatatatatatatatatatatatatatatatatagcttttagctgaaccaaactaatatataaggttcaaactaatcaatttgttatccaaggtatcaaggaataggataatcaatgcaaactggccataacaaaggaataggttcacaccacccggtgacattcgaaaaataaatacacagttgaaataaatagagaatttaaatataggatcaacatggtcaaaggattgtgtttgggatctatgtgacttgctttgcaataatcggtcttcaattagtcttcttgaacacttccgacgcactcacgaaccttcgcaacgacgaaaacgacaagctaacacgcaaaacgaggaaaaagactaataaaaaccaaatagatcatgattttagatgaatttagagacttgaacggcctcattccgagttcatctgaattagttacgaattttacaagattaaactgattttagccttatacagaaaaggattaacgatttatttcagaaaagaaaagggctttatgacatcatcaccggaacaaggcactggaccacacggccaccggcgctagaggactcggccggaccaaccgagggcatctacgcgaaggggatgacgagacaaactcaccaaggggcggcacgacgacgaacgacgatggaagacgaccag

SEQ ID NO: 2647 - DNA, 1501 bp, Oryza sativa
tattgaggaagggcattcttgtcctaattttcatgaaaaccagccatataacggtgttagtctaagcttgagttcagtgtcagttacattatgttcaaactgttttttatggcaaatttacaattatagtttttttagttgcagatccacgatacctgttcaatccagtggcaaatatgcaattgacccttccgaataacaattttgttttagaaaagtttatgaaatatatctaacgaattgatgatatcgtgatatatagaacttttcaagccaaatttgatttcctttgtattaaaactaagtatttgagaaattattaatggtcagaattttaaaagttctctcaaatctttatgaccagacccttacgagaaataatttttagtggtctggtcatagatttttagtggaatttttagagctctagaaataattttaaccaattaaaattgagcacaagcaatatttaatcccaggaaaattcatttccttcttttttttctttttcccttcttctctttcgaatgggccgccggcccattctctcttctctccccctccccgctaggctggccgaaggccacggcccagccagccgcccgagccctggggcccacctgtcgggcccgtctcccacctccagccggcgccgccgtgccccgcaaccgccgccgcgccccgctcccgtgacttccgggccacgtcgccctcgcgcccgcgtcccccgcgcccactccccctctctcccgcccgcgcccgcgctcgagacggccgggattcaatttttgaatcccgcctctctctcctccccacctctccccactccgccaacgaaatcgcggtctcctggccacgatcgaccctcgtgggtctatataaagcaccaccgttctgtaacgccccgattttcgttcgggttttaaaatcatttaataatacattttctagaaattaaataaaagttaaatcaatttaatcaagtaaaataatgggagaatttgaaattttcctttaaaaatcattggtcgggaatattttgtaatattctttgtgccctaatgtactctccggaattttccgtgaattttcggagctcgagaaatagttttaatagcacaaagatcattacatcaattaaaataaaaaaagaaaaacaaataaaatcctccttcctctctttgggcccctttcagcccaatcccccttttctctccctctcgggccggccttctccctcggcccgctcggctctctctctccctcaagtctgctttacctccctcgcccgttttcccctctctctctccccgacaggtgggacccgaggccccacctgtcatcttcttccccaacctcccgtcgccccaaccgccgccatggccgccggattcgccccacgacgccgcggctcccgcgccccaccccgccccatgagtgcgtgaaaacgatccccttcacctcctccacctttccccccactctccccgcgaaaatcggc

SEQ ID NO: 2648 - DNA, 871 bp, Oryza sativa
catgtgggcacacaaacgagcaattggatgcaaaagttatttaatcctgcacagatatgcaatgatactatttatttctacatgaataaactaatagaacatcttagatgataatcaatttgagaaaatcttaaaaaccttatgagatgattgggatggagagagtaattggcttaggggtgacaattttcatgttggagcaggggacgggtaagaatttttatctgcatctgagtggggactgggggcctcgcaaatatgcagggacggggatgggggaggggtttgacccgctggtcacccgcagggccccgggatagcctatttcaaggcccagccgacccattaagggaaggagtatataactatgccctaatttcctccacaccattcaatcgccaacttcccaccccagccaacgagccgttggagcgctgctccaggagggaatgggggattcgggtctagccagggcatgcgcacctcgcccagagctcggctgccccggcagccccgtcgccgcccctagccatcgttaattcgtcacctccccacagctgttgcaggccctctccacctctagcacgtctttcatcgtctcctttcctaacgtcgtcgccctccacctacgctcgggtagaatgcatgtgcttccttcctgcggtgccactctcctccgtcggcctctggatctggatcaccactgctaggggctatcaccgtcacggccaccgccccacctccatctccaccacccagccctgctgttcaccgcccttctccgcgcaaccgcgcctctctctgaattgctatcagaagcaatttgaggtctatttttgtgatttataattatgttggcaatgcggggcca

SEQ ID NO: 2649 - DNA, 1501 bp, Oryza sativa
ctgagacttgaatgggcttaaacggagctcggatgaattagatatgattttagaagattcactgtatttttactataacagaaaaaaatccttaatttatttattgcgcaataaataaatcccgggagagagagagagaggcgacgccgacatgcgggccccacatggcagtggctgcgggcgctggtccatggtggatcgggtccatggaccggggaaaaggggcggtgcaccacgtggtgcacacgtggcgcgcacgtggcggcctcatggcagccacgcgggcgacgggatcggatggccccgatctaccgctcggtagatcagacggcggatgcggctcgcggccggcgtgcacgggcacggctcaagccagcccggcggccatggcccgcggcggcgcgaggcggcgaccggccgacggcagagggcggcggcgcagcgactaagcggtgcgggagagagggagaaaggggaggaggggcctcaccgacgacgatcgacgacggcgagcgacagagggtgatggcgacggcgagacgagctccgggaccacctaagggatcaaaagggatagtaatttgcccgtgctaccgctacggtgacatttaataacataattcaagcaacctgctaacgctatagtgacatttaataacacaattcaaacaaccaaaaatatatacaagactatattgcatagttataagatcaagcaaaaattaaaaaaactatcactatataaataagtcaatctgttctgtacaatctgttgtacgcacataaataagtccaaagtaggtagttctgtacaatatataaatactgtgcaggtaataactatcactatctttgaccagtagtgaaacacatattgtttgctacagatcaataacaaggcaacatattgcatacacaccatcacagttcgatcatcatcgatccattaaagcagtcatggtcagtgcaaggctagttttctgtaactcaagacattttgatcttcagaatatgtttgcacggcctcataaataaaggagaaggcatattcacaaatcttggaatacaaaggaggtaaacgaaatttaatttgttctatgacaataatctgaaatctataacactctaagtatgacatccaacaattatacgagaaggtagtcacaacttaaaccttgaagccggaacccttcattttgcttgtcatcgtccaatgatatgaagagattccttttgcttgtcatgttatcctgcgaaggaagtgaaaaacatgtttgctccattgtacccgatgcacagagaacaattttggatcatagcaactacagttatgtttgctccaagtttatccttgtcaatgcaaacatagtgtatttacttaccaacaaacattgtttcttctttgatttcatattgacaaacagatcccttgaaagcttgctatttgaagaggatatacgcctcggtccattcttaaacagtgaataaatcgtaagggtaa

SEQ ID NO: 2650 - DNA, 1501 bp, Oryza sativa
aagaaacatccatactgaaatttgcagtcaaggggcatggtggataggttccatttgcgtgccaaaggtggtgatggcggcaatggctgcatcagtcttcctcgctccaggtcaggatcgccaaggcaagcctgatggtttaacgactcccctgctgcacagcccatggaattgtcacatggtgctagcagtaatctttttgtgtatttttttgtggtgtaataatgcctggtcgtgatcaacattagcctagatcttagtgaaaaggagtaagatctaggctaacttccttccccatctcacagattgttaattgcttacaaaataaaattcagcagcagcacctaagtagagtaaactatcagatgccctgtttttctacataatgcataacattaaatttatttctttctgaatagtctccagatcacaatgaatgcattggaaaatatgtcggtatttaatcaatctaaatattagttggccctaacacattgacctaacttaacacttacctatgatgagatcggataacgagtgattgacgacgacctgatggctgcgcggtggagacaggacggcgagcgatccgatggcggaacgcggtcagcgcgagggtgcgccggcggcatcaatctggaggcgggaatcgacggcggcgcaatggcgaccggatggagaacggacggcgatgggatcgagaaatccggatggacaacggacggcgatggagagaggggcggcacgcggcggggagagaggggcggctggggtcggcggcgacgtgaatcgcggcaggggcggcgtgatggtggagatcggtggcgggctggcgttgcatgagagggagagaagagagattagggctggggaggcgtgggctgggatgggggagggggcgcagttgagaggtgcgaggtggagaggatctgagcgttggattttacacagagatgatccgaaccgttccacgaggaatgaaagaatgagtgatgagtgataagtgaaaccatttgttcaactatagggtagaagatagatgagttagagagggagagggaaaccatggatgggtagggcggcgaccgaaggcgccggccatggcgaagctcaccggcgcgtggcacgggcggggttctagcggcggattactacggaggaggggtggacgggacggctcgcacgacggcgaacgcgacgacgtcgacggtgcggctcggcacggcggctagtggcgaccggagcggcggcggcagcggcggcggcggagaggaggacgacggcgctaaggcggtggagtgcacgggagcgggcgattgcaaaaataaaaagagagaggagggaacgtgtcacgcccagaaatttaacccaaatttccagactattttgcgtattaaatccctgtccaggaccagccagggtacacaaaacgacaagtaatatacagttccaaacgtaaataaagcgtaaaatacttacaaaagaggcacttagtcctcgc

SEQ ID NO: 2651 - DNA, 1501 bp, Oryza sativa
atatttcgttagttgttcatcgtctattgatctggtcaaatggaacatgctgctttaattggatcacgaagtcattcttgcttttaaagatatggtgttttatctcttgaaatctacttttcggataggcacttgcatcaacgaaatatttctaactcgcacgagcattcgtgacttgtgcagttgtcccctaagctataatgtgagtattcgtgacttgtgcaatcgtcccctacaatgtgtggtagaaaaggtagtacaaccaagaaggaaataaataaaatgattcacacactaactttacacgttgcatgtccactcgaccgattagctggagcgttccaataagaacaactagacaaatgtagatgtctgttgcatgttttgaatttggatttttctctatgtgctggttgctactgcaaccttttctctttaggaaaaggacactgaacatttcttatataattattagatcatccaattattttttagagtcatgttagcacaaatctcaatgtttcgatgttcaaacattgtagacatgaacgtagggaaaaatgaattataatatgctcaacacaagaaggaaaagatgcacaccacacaacacaatggttaggacacttcgctatttatgttaactcatgggatacacaattttgctctattttcactgatttaaactaacattgggaagtgttcggatgcaataatgtacaagttgactatagacacatcatcactgatctcaagttcttgtagcatctttagccatagtaggctttgtttaatcattgtgcatccttgtaaaaaataatacacgtactcgttcattgtaaaagagcacatacggcactccattgttaataatgcactgaacacaataacatactccattctaagaaaacacatatgtcaataatgattcccattcccaaagcctgaagcaaaaactgtaatacatagtgtcatactccctccgtactcgtaaaggaagtcgtttaggacagcgacacggtctccaaaacacaactttgacttcttatttctataaaaatatttattaaaaagtgatatatgtatacttttatgaaagtatttttcaagacaaatctattcatataatttttacattttcaaactcaacaacttgagagttattcatgatttatattcccatggtttgacttaaacattgtcctaaacgacttcctttacgagtacggagggtgtattaaaatgactatataaataacaattatgttagggttgtatttgaagtccttcactaaaaccaaaaaaagggcagctaatgatgcaacccaagacacgattttacaacccagatgactcaaggaaactgatgtgggatgatctatctgttgctaacctcttttgtcattttgtgtcataaacattgcatgaaccaataccacacacacctggctttatctataagaagatgatgatcttgcagccataggagacaacgaaggag

SEQ ID NO: 2652 - DNA, 1501 bp, Oryza sativa
ggccccacgtgtcaggttgccacgtcacatctctctccctttatggcttcacggggaggaggagtcagggggtcccacttcctttttcttttctttctcttttaattttgtctctttctcacggtttcttctcttcgccgttctctttctctctctgccttttttccctcctcacgcacgccgtcacgcgcgcgcagcaaaggatgggcgccgacgacgcaggtgatggccggcggcggtggggaagagggggccggcggaagggggagagcttggcggcagggagagagagcctggtggcggcgcggttgcgtgcaggagccgcgcgcaggaggagaaaggttgcgcggcgcggcgtcttggtagggcgaccgggaggcggcgcagaggggaggaatcagggcggcgccgggcagaggagggagggagggaagggagtggtgccggaaggagaaggtcagggggccaattggagggggcgcaagcggcggcgtcggctccgcttgggcgatggtcgggcgcatcggcgcggcgcggcgatcagcgcccgaggggaaaggggtggctacacggcggcgcacgtctaggcgcgacgacggtttgggggtggatgaagacaagtagacgacgacaatggcggcttcagtgccggaggcggaggtggttgctggcgtgcgcaggcgggggaagcagctgcacgggggacggtcggcgggtgcaagcggcggggggaggagcggcgcgcgggcgggcgccggcggcgggggaagcagcggcccgggcggtgccgctccactgccttctccatcctcctcgagctcgtcatctctcgctcctgcccctgccaccgctggcaaggagaacagctcaccgccgccggcgaggtcgaggacgaagtggaccgctgctggccgccctgcccagacaagagagagagagaagaggaggaggaggaggaggaagggagcggcgatcctgctgctcgtcatcgtcaggctccccgctggtgtcatgcggcgggtcatgaagcggcggcgcaagagccgaggccgccgcagggggcggtggggctgcaggagggccgccccagacgagtcgctgtcggggagcgccaaggcgatgatcgcggccgcgtcaacgttcgatatgatggacgacaaggtggcgtcggcggcggagtgggggcgcggcgaaactgacgcggccgaggcggcgtcggagctggagctcgagatgatgcgctcccggttctacagcagcggcttctagcggagcccctcctcaggctccagctcccgcgcctcctccctaagccgaaagatgacgacgatgaggctggcgtcctccgcttggtttcaccgccccgccggcttcgggtgccgccactctgcccacgcgtccgctcatcgctgccccactccgtcccaccagcttcgcgtggcgctggtgactcagcaacgaagaccaaggtcaaagcgccacggtggacaaaaccagcgcc

SEQ ID NO: 2653 - DNA, 1501 bp, Oryza sativa
caccatagttctagccccgccagtggaaaaagaattttacaggcgacatcctatatgtaccgcttgtggtaacagcggaccaacgtgacacagttgataaccataaaatattctaaacccgatacgagccatccccctatcactcattcaattttatcctccccctttccctctcctcgccctatcggtggcgcggaagtaggactgtcaacgagccgagctcgaacgagctcgtctgcttaaagctcgagctcgagccaagcctataaaatattcgagctaagtaaaacaatatatatttcaaatataatctttaaaaaacaattaatttctagttcatcatattaatataagagaaaaaaagaataaaataaatatatgatgttaatataaggcatacaaataatatattttatcttctaatttattaaataacaacaaaaatcatatattactagactcgttggaagctcgagctcggctcgacaaagctcgcgagcttagggagaggctcgggctcggctcgtctagagctcgagacgagctcgaatcgagcctaggacgagccgagctcgagcagctcgcaagcctcgagcttttttgacagccctgcgcggaagcctatattggtgatgggggaggggcagtgatggctcggcgaaagagcgacggcaggcttgatggtgaccgtggcgagggcaggagctcgggaaggcaacagcaagggcgactgctcaggggctgcagatcggtggcacggccccagatccgcgggtggaccccgttgatttttatttttatccttgtcattgacatgtgggtcccacaagctgactcagttagttaacagggtcaaagatgccacgtgggacaatctgcctccaaaaccgctcggggagtcaatttgtaacagttttgggagttggagggtggttttacccggttttgcagttgggggatgcgattcagccagggtcaagagttgagggataacaaataaacttattccatccaaacagctaccgtgatcagattacgttggcccagtattaaaatttatatgggcttttcggggctgtaaatgaattaggcccaaaattagaattgacacaaaccggataagactcccatctcagcgtccgtgagctaagctacctactaatgccacgtggcggccgtcaagcgggcacctaatcctcatctcgtataaataaattcatttacccccctcgggatccgagaaatttccctcctctttccacttgtcaccgccgttcgccttcccaaccacgagacgaccctgccctcgccggagatgctgccgtcggcgaccggggacatcgccggcgacgtccactcggcgcgagagatgctccatcccatcctcctttgacttcttgccgccgcgggagcttgactggatctgagctagctggattggtgggtgggcgcgtcaagaaggggatgagctttggcgccgttgacgtcgacgatggcggcg

SEQ ID NO: 2654 - DNA, 1501 bp, Oryza sativa
ccagcatggtaatggcagcactgagtagcgacaccggcaatggggcggatggacagactcgccagtggtatggcagacggacagattgatcgctgtatgacggcccgatcttaggtcacaatattttggacggaggaagtagctatgtaggattagatttgacatcatctgcgaatctaaacaacatgttcagcttcgtagtgctaggttacgtcaaatctagttcaggttcatagttgttggtgatgttaatccaatacattttagaacggaggtaatatttttgagtttgacttggtgatgaaataaatttaaagcctgattctttaattcaattctaaactttaacttgctcatttttcgttagcgtatttttttaacttattaaatggtgtatttatttcaaaagttttctatacagaagttgttaagaaaatcaaataaatatatttttttcaagtttaaaatagttaatacttaattagttgtgtgctaatcagctttctgttttgacatgcgctgaaaatctggctcagtttggagcgaaggattcaaggaacgcagtaggtgcccgtcattagcacgtgtttttttagacaagtcccaaaaccaacagtttgggaagacaaagcgtagaggttacaacagatcaagtgattgtagggaggaagaaattacatgtttccagaccgggattatgaccctgtcttcagcgttgaaacgcacagcccaaaacttgatctcgtcttggcattttctcaaagctgaacccagcgaaggttggacgttccgaaaaaccacatcaatgccggtgaacccagagaaatatctttgctgggtcattagcacgtgttgctagcttctactttcttttgggagaaaagaaggcacaaggtacgcgtcactgatcagatcatcgacgcaaaatgttttaccagcagctgagccaagtaggactacgcaagcacaggatgatatactctctgctttactctgttttatctgaaaaaacacggatgtggattttcatccctcgaggggacatccccttgttgtttgcatgtcatctaaatagttatcaaaaaaattgaaaaaaattgacaacataaattaatacgaaatatatcactccacaaacatgcaagaccaaattcaactcctataagttgcaacaaaaataataaattaaactgaaaatagttatggcacattcgcaactatatttgttatttttgttacaacttgtagaagttcagtttaaacttgtatgtttgtggagtgatatatttcaaattaatctatgttgctaatttttttcatatttttatgactatttaggtgacatgcacgaaaaacactgcaggccgaggcaccgactatatatatataccgtgtgactgcgtcctcgatacttcttcccaaagagagcgagccgatcgagcagaagagaagccaaaagctccaatcttcgaaacgtgcgtagaacactcgatcgccatgg

SEQ ID NO: 2655 - DNA, 1501 bp, Oryza sativa
tgctgcatgcacaccacagatgcaggccttataggcttatatatcttgcttagtgataatgtaggcgtctatttatacccgcgtgaagagctacaaatatggttttcagcctcctggaaagtcgaaacaaaaactgttttgaactggagttccagaaagaaaatggttttggcgagttactgaaaaatggttgtgaacgcaaagtaaaaaacaatggattgaataatcacacaccattggtgatcgtttgagtgttggactataactccactaataaagtttccgccggcaatgatttacgagtacgtgcacggtgcacctgaaattcaagaagcctacgatgaatttgcaacttctggtagggcggcggctagtctgagaccactgtagatttgtagtttgaaatgcctttgagaaattctagccaaaattcgcggctttttcccatttgcataattgcattccaccacatgtgggcggctccagccctacactgcactaccatagtcagacggtccctacaggctgcggatgcggaggcaactttgtttcataacaaaagcatattactacatttcacaagctgttactcgtctaaagttaacgcaaattgttgattgagaaagcgacaagatatgattttgtgatgtttcgatcacttggaagttggaatccttcaatggtagcaatggagactgaactcgacacgagcctgtccgcgtcaggcatgacgctgctcacagcatgggtcagctacagggccaacttggcttcgtcgaggccgttgacgccggggatcttctccgatcgactccttgaacggccaatgaccaatgtgagaccacagaacggcgttcaggaagccgatgtcgccgccgccaaagtatcgcttcccttggctgcacatgacgccgggatgcctcgtctgtccagatctcttgtgttgcagggcgttttttatttttctcaaaaagaacttattttcaaaagtgaaattgttagccacgttatttagactgacgtgacaagacaatactagcacatccactgcatatggcgcagctaagaggttcagatttaaaaataaatttttttaaaaaaaatggcttaaaaatcaataaaaattcgcagggcggtgagaactttggagccttttggagcactcgtacctgggttggtgatctgttaagactttgagcctaatatatggataaaaccagagttacataatgctatgggctggtgacaattgttttcggctggttaacatcttagttaacgtgaaaaacaatcccgcaagtctcagattatatactgcatctagctagtaacaaactttaataaatctctaatttgatctctttatcttatctaaacttcaaaccaactctgacgatgaccccgttctcccgtgcaaccttcatctttacgcgtcgctagctggtagctagcctatccccatctgacactaaatacggtagcgaatggctgatggtcatta

SEQ ID NO: 2656 - DNA, 1501 bp, Oryza sativa
acggcgagtcactgttccagccggggaacaactccgccgcgaacccgctcccgctcgtgtaccccggcgcagacggctccgacacaagccgcgactgcagcgtgctccgcgacgccgaggtgaccggcaaggtggtgctctgcgagagcagaggcctgaacggccgcatcgaggccggccagaccgtggcggcgtacggcggcgccggcatcatcgtgatgaacagagcagccgaggggtacaccaccttcgccgacgcgcacgtgctcccggcgtcgcacgtcagcttcgacgccgggaccaaaatcgcggcgtacgtgaactccacggacaacccgacggcgagcatcgcgttcaaggggacggtgattggctcgtccccgtcgccggccgtcaccttcttctcgtcgcgtgggccaagcaaggccagcccgggcatcctgaagccggacatcaccgggcccggcatgaacatcctcgccgcgtgggcgccgagcgagtcgcacacggagttctccgacggcgtcggcctctccttcttcgtcgagtccggcacgtccatgtcgacgcctcacctgagcggcattgccgctctcctcaagagcctccacccggactggtcccccgcggcgatcaagtcggcgatcatgacgacgtcggacgccgtggaccgcaccggcgtccccatcaaggacgagcaataccgccacgccaccttctacgccatgggcgccggctacgtcaacccggcgctcgcgttcgaccccggcctagtctacgacctccacgccgacgactacatcccctacctctgcgggctggggatcggagacgacggcgtgaaggagatagcccaccggccggtcacctgctccgacgtcaagaccatcaccgaggcagagctcaactacccatccctcgtcgtcaacctgctcgcgcagccgatcacggtgaaccggacggtgaccaacgtcgggaagcccagttccgtgtacacggccgtcgtcgacatgcccaaggacgtgtccgtgatcgtgcagccgccgatgcttcggttcacggagctgaaggagatgcagagcttcaccgtgacggtgcggtgggccggccagccgaacgtcgccggcgccgagggcaacctgaagtgggtctcggacgaacacatcgtgaggagccccatcatcatcccagccacggccgcgtagtaattttttgcaacttcagcatgtacagtatgtcagtaaatagctaagatcaataaagatccatcaccttggtttgacctgtgttctgttggtcaagatgtgaagaatgtagcactccttgactagttggccgatcctgtcaactttgacagctactactggagtactactaattaatttccatcttattcatcagaaactatacatcagagattatcattaatagatgagtcaatgctcattcatactctctccgtctaaaaaaaagacaaatctggtttccgtacccaatgttt

SEQ ID NO: 2657 - DNA, 1501 bp, Oryza sativa
gcgcgaatgattctattgtttgcatcactgtttacactgagcgcataatgggagagttgcagcttttttttaagtgaaagtgctgttacagtatcactagccgtttgcacagtactcctcctatactttttttttttttgaaaacttttgttcctgttcttgggccagataagcccatgcattgaacatggatgtgcaactagtgacataggagtatcggatatggagtatttatataatagatgtgcattttacacatggatgtttatgtcaacatctaatctcactaactattctgatcatgtagacctagcagctacaacatgtaaaacgagttgattctaaatcgaaattaagtagtaactcgaactttgtgaagtcatttggtcaattttaagaggtttgacaagtgtcagtacaggcgtacagaatctgttaagctcagcagcggaagtctaccaaccgaggatttgatgccaacgaggcaatgagctgtatagaagtgcaaatggcaaccattaactttggtttcatgacaccaaaattgggttttttgaactgtacctttgttcattcttctcatccaactttcctgcgaatttatttatttttcattttcgaaatgcaaactgtttcttggataagctgacaggagtcacaggaccttatattcttgcccatcacaccgaatcaggtatgtgcctcttgctaaaccggtgatggcgaccatatgaggtagactggcgattttattgataatctctcctacctgcaatggttacctgtttcttgcattgcaactttgcaactgatagtatcatgtatggtagtgtggcaacttgcatgatagagtgatttttactgtgtttgaggagtaaccaataattttttttattaatttgtggctcctcatctctactctaaagagagaatattatccaaacaaatctgcaaagatggtaatctgctatatgcgactaatcgttttgtgtggacctaaatgatagcaacatctatctcttttctgttgttgtggggcaaggtgtacgttctgccaaaagtatgaaggagacatgatatcgcttgaaaaaggataaaaagcaactgaatatttcagtacaacgctctgttttataaccagccggactcagcctttttcactctcagtattgtcactgtaataagtttattatatgattcagccgaatatttcctcctgaattttttctttccttctccctggagcgtgtggctcatccactacgtataaggtgacaaagaaaacaatatcatgctgaaaattctatcatgtattggagaggcatattagcatatactacatatcagaagcaaagttcaggaaattctgtcagatgcagcctgaaattttatctctctcataacaccaatatatacaactttcagcaagttctgaagtaagtctactacatctcaaagtctcaaactactatactgttcttattgtacaaaaaaggaagga

SEQ ID NO: 2658 - DNA, 1501 bp, Oryza sativa
gtttcagttgttcatgatacgcgtgcaagatgcggcttacacactgcatgatcagttcaggtcccggattcctctccagctacatgggagagcaagcattgctcggaacaattcaaccgtgtggtcaccctctctatctctctctatctccctgcattattgtccaagatatggtacataattcagatcttgccaatttggcaggtgacaaagcaaggtctcttgcaatgggagttggaggtgggtaagtaaggttaaaatgacagcaaagaactgtgaccacaatgaccaagtacatactaccacccaagtaacccggttggtacgctgctcatcgtgactcccaaagtctccgggccacaggccatgtggagatgcatcgcacacgcacagcttccaccaatcaagccattctcaccagccacggcagagaagagaactccactgtttcagagctctgaatttcttataagctttcagcaaaaaaaaagaaagaacgggggagaaacgcaccgttttcgctggaattctgtgggtttgcagcgcgcgatgtgtccgtttccaccgccaaatgcggccaaaccgccgtacggttccatgtgccacacatgcgatgaaaattcgcacattttgatacgggatctgagcctttgctatcgctcgcttgtgcctttcatttcgttgcagcctgagtagaccggttttatttcggtcacatgtgagcatgaggttgcagttctctctcagtgttcttgtgactctcagttatcagggccctcgcttatcagtgatagttactactcctcagatctttttccctgctctgttgaatgagcctgagccactggaagagtgacaggggtagggcctcgatttgatttgattccccttgccaaaagaagctcgttgatgaaccagtaatttaactgttttaagtgtaactaaagcataatcagatggttggagctttccttctaatgctaaggttagagattctctgaaaattcacatgaaagattccgtgaccaccccgcacaaagctccacatggattcagattcccctgtcggctcttgattgaggacagatgccccccccaaaagaaaaggagcctgtaaaaatattgtcttccccggttatcatgtcagtatcagattttaaaatcagtcgtagatgcccagatcattttctaatattagcaaaagaattagtactatatatcatatcactaagcagagactcgtgcagctcgtgtgcgttaagtacccaagtagtgcatttcttgtggaggtaatcaactatatttaacagttggaatccacatgttttagtggtttacaaagtctcaaacttgataatacaaaatttacaaaataccagagctcaccttgtaagcagagtagtagatcaacaagtacacaacattaggtgtgtaaattacattgtcttctgtacaaaattcagtgtattacagttagtaacagtgacaaattcaggtgctc

SEQ ID NO: 2659 - DNA, 944 bp, Oryza sativa
accccgccgccactggtctcccccgccatacctagccgccgctcatctccgccgccgcacaccgccgcccctcgcctcctccactgcaccccgccgccgcttgccgcctcatcccccgccgctcgcctcctcctcctccgccaccaccgccgcctcgcctcgcctcctccgctgcaccctgccgccgctcactgttgcccacatgcctccgtgcgcgtgaatgagagagaatgagataagagagagaggggaatagttggataggaatttgatatgtgggtcccacattttattaataaataaaatgctgattaaacagccacgcgtacgccacgtagaccaaaaccaccgcgggttgggtcgaggggggtaattcgtccggtttacatagttcgaggtgaagaatgtccggttttgtggttcaggggggtatttcagacgaccgcgatagttcgaggggtaattcataatttttccttttagaatttgttagaactaaatcttccaattatatactgatacttgatcttttgctcgagactttcaggtgttattaattttcatttttcatgtattagactaagatagaaactttttacctcaaattaagtagtcagggggcggagtcaccacccggcccgccagcgaaaactccaataaattttgatatggatgagtaaatcaataatgaataaatttctatagtaaatattagttatattaaaatttatccgagcttaaaaatctttttggctccgacactccagactggtactcctcttgtgcaaaaaagacgaaagccccggtttgaaacgtgagaaaaatcttctctttacgcatagaaattgaaccgtttcctatggaatccgcacgaaaatctcgtgaatagcatgagtagtcacacacataaggaagaagtacaccgaagatccctgaacttatca

SEQ ID NO: 2660 - DNA, 1501 bp, Oryza sativa
aaggtgaacggtgtccgaaggcagtgacgtaactagcactttcaccctagagacacacacgcgaccaccagaatgccaaaactgctaataaggtcaccgcccatcgcacctcaacagcacgcatggatacgattgagctctaacttcaactaaaaagtgtagttgctttgatgtcagcattatcaacctcatcaactgatgcagcaacttcgatgccacctagactcagcctatcatagaatatcgtatgccagcaccatacactgctacatgacaacatcgaacatctctatgtttatcattacccacgccccaagcgagtcttgccaatgcaagaaaaccctaaaacacaaaaacaactcctctatcataaattcagagaaacatgagtccttcacatgtaagacccaccctcataaactcacacgtcatatgctcgtgtctctctaacattcgttagaaaagcctcatggcctaaaacacagtgcggttaggctggctagcacggagataagcgatcaaagctgtaggttagaccgttagattccgatcagacggcaggatcgactcacaaccaatcgctcccaaatcccaatgactaagggtgtgtttggttcacggtcatgcatggtgtgatatggcgatccattttttattggatgacgatccaattttttgttttatttgtatagatatgatgaccaaattacttgtttggttggagggatatagcatgaatgggaaaaggcaaaagttagtgggacccatttttcatatatatatatatatatatatatatatttcaaaatataataatccgaaatcttgttttaaaagatttagttgtaacaaatataaaggtgtgatcaaatcataaattagataaacggtttaagagaaaaaaaatcatttggagcttacttaatagaaaatcaaaccaaccacagccaatcagaataggacacatcatccagaccaaaactggatggcttcatctagccaaatcggctagatgcactcatccagtatattgaggtaatattccctatttcgagccgccccatccaccttaccctctaaccaaacaccacagaaaatcagacggtcatctcctatcaatactcgttcattcaaccaaacacaccctaaatcaatatggttcgcgtgtttaaccaccatttataacccttcactttcatccgcaatctccgtcaattacacggtgaacaacaccaataaccgggggagccttcaagcccttcaccctcatccgcagtctccgtcaattacactgtgaacaacaccaattaccgaagcctttaaggcagaagcaagaaataaacagtaaacagccaattgtaagcagcaaaccagagccaaaccgctgccgaccagccgctgccgccgtgtgtttataaaaagtcagcaaaaccttcccccaccacgctcgttagctaaaactgtgaaaactctccattttccttgcctctctctctcccca

SEQ ID NO: 2661 - DNA, 1501 bp, Oryza sativa
cccatcgccttctccgactccaccgtggtgttgcgcagggccggtcttatgatttcgtgggccctatgcgaactcatcacgatggcccctataagctatatataaaattttatgatatatatagacgctaattttacttgcaaaatgaaaacaaacatatccatatattaaatttaacatatctgttaattatcgagaaataaagtcaaccaaaacaacaatatatttataccttggaactaatatcattatcttaatgaagaaaagaacccaatcatatccattgcttctcatgaaaagatacttcttcgggcatttctgatgcaaaatcatcaataacggtattaagatcaatagtgtctaagattgggcgacgaggtgacgacgctccaactcctctcgtttcggcgtttttgcttctaggtaggccatagacaggtactagactactagtattaggtgttggtccccccactatcatgggccccccaccatcatgggcccccggcggtcacctcggctgcatagggccagggccggccctggtgttgcgtaccgtgaggccataggcgatttgggaggaggggttgtcgggggcggtggatgtgtcgccagtggtggatgcggctccgccgccgtcccgcccgccacctcctcgcactgcggttgctgctcccgctcccttctcatctctacggccgatgacctcctcagcctcctcaacgacaatgacgacgatgacaacccgttccccgccgctgctaacgccatcgccgccgccgaccccggccgcgcgcgccgccttgggcgccctagcgccggcatccccatgccctgcgagagcagagagagagagggagggaggaagcagagaaacagagaaagaaaagaggtgaaaggggaagttgacgtggcacgctgacatgtggggcccacgtgggtcccacgctgactcagctgccacatagaccaaaaccggggtcaaaactaccgaaggatcttcggtgaccgattttatatagttaagggacctcgtatatctggttttgcggtttgaggacgttttttttatccccatgataagttcagggatcttcggtgtacttcttccttatgtgtgtgactactcatgctattcacgagattttcgtgcggattccataggaaacggttcaatttctatgcgtaaagagaagatttttctcacgtttcaaaccggggctttcgtcttttttgcacaagaggagtaccagtctggagtgtcggagccaaaaagatttttaagctcggataaattttaatataactaatatttactatagaaatttattcattattgatttactcatccatatcaaaatttattggagttttcgctggcgggccgggtggtgactccgccccctgactacttaatttgaggtaaaaagtttctatcttagtctaatacatgaaaaatgaaaattaataacacctgaaagtctcgagcaaaagatcaagt

SEQ ID NO: 2662 - DNA, 1501 bp, Oryza sativa
tggtgaaccatttggtcagaatacatgaagctgtagaattccctttcttgtcgaaacattgatgaaggataggtctagctcctgaacctttcagctgactggtcctaatgattagttgggtcactaatgtcaaagagatgctgcacctgattatggtagtatacaggaggtattggtgccaattcatcttttcaattgaaatttgaaagggacccatagaacttgacaaaaatattttatttgatgcgcttgacgcttgggaggctgtagggtgaagtaaaatcaaacacctacagagaactccctttgagatatgttattgtaaactgattgactgaggcagaaatgccaaattgtctaccggagttgaaaaggagttttatccaaactagtattactatgatactactagactagaattattgaactaacagtcctcaccaaattgaagtctgtagcagttgtttctgttcctttgttttccttgatgtggttggaacttggaaagctgatttgcttgaacatgaagagctgaacaaagacagccctgtttgtaacaaactagtaatcagataattcagccgattactacgacaattcagctgtttggttgtgcagaaggtatattgaccatgcagggtaattcggctgattgcatgaacttgtttggtaaaaactattgtgtataaatcgtgctccaaactcttgagcggatgctattagtgggtgtttttgattggacaatctgagcggcgagtagtgcagtactatgttgtgaagaaacactagtgctgggtgctgctgagttgctaaaaagtatgatatggaagggaagtatggatgtggttggggcagctactgtcccatgatggtttgtgctaatgaaggatggggagttgattgcgggagggatgagtgtggacgcaggcaggcgttcatagttagtgctggatggtgacaggaaacggaacaggaggacttgagagctgggcctaatgtgtggtttgggccgactaaaatgctaaagcactcccttctgatcgtacttgtgattgtagtaattatgtactagtaacgaaaattctgtttagccttttcgattaaaaaagaagaagaattaaactgatagcggacgcactggccgcatcttgtattcttaccaaaaaaaattccatgtcgttgttgtttaaccgccagcagtggactacttttaccaccggtgcacaagccaaattctgagacgcaatgcaacgacgtcatgctatgcttgcagagttgcaggctggtttgtgctgcgcattcgcgtcaacactcccatttattatgccaactaattccaaacaccagcaatactctcctcattaacttcttccgcgggacgagagagggagagagagccaaccgcgcactacttgtacttcctcatcttcctcttgctattaatcgaatcaaattactactagtctcccttccacgccacgcacacgcacccaatccccta

SEQ ID NO: 2663 - DNA, 1501 bp, Oryza sativa
gctgagttccttccctttcccttgaataaaataagtgcacatatccagaaaaagttacacatgaaattaccatttaatactttgaagaaattaagcaccctcggtctgcagtcagcaaaagttacacatgaagactgatatattcagggatagctcggtagtctgcatcatgtccatgtgttttgtgttttgcaagggggcggggacactgcatgcgtttgtttttctctctgtacgatgagatgatgacgatgttgagtttgattttctcagctgcatgcacagtctatagacaaaattatttcgtctaattttccatctagctctcatactgtagtactactgtattacgcggaagtgatgaatttctagcgcaaacaaattaaggatcacaccacacggccggaagaaagatgcatgtgtctctgttcatcgagctataagctactctagttgggacagagcatcgacaaggatgtcctcgatcagtcgtccttgaggcatctactgccttttctctctttcatcgtctcaaacaagaatgaatggtgattaaaacgtgatagatactctagatcggttggtagtactagctccaccgcgagatgaacaaggcagatcgagtggctctacagtacagcacagtgaatgagacctgaaacaaacgaactgggattaatttcaagaaatatcagctggcacaagtctgggactaacagtagcaagtcaagtgcatgttagctgctaacatcttgtatgttcagctgaataatgttctgttgtttataatgtgtgttactcatctctgtcaagtgttacgcacttccaagctaagctctgctccatccatcatcgatctgtgtcatatcaaagcgtggtatagcaatatgatactagcagaagaatagcctaataataaaggattcccacttctaaacaaaataaaatattgctggagataggatctgtttgctactcacatcaggtgtgtttagttcatgctaaaattaaaagtttggttgaaattgaaacgatgtgacgaaaaagttaaaattttatgtgtgtagaaaaattttgatgtgataaagaagttaaaagtttaaagaaaacttttgtaactaaactcggcctaacacagaaatggtctcaagtcgctcggatagacggtcaagtactcacaaactgaacatgctgctgtatgggctagccgtctataaaaaaatactctctccgtttcttaatagatgacgccgttaattttttctcacatatttgaccattcatcttattcaaaaattttatgcaaatgtataagatataaatcacacttaaaatactataaattataaaacaactcataataaaataaattataattacataattttttttaataaaacgaacggtcaaacatgtgagaaaaagtcaacggcgtcatctattaaaaaaacggaggtagtaggaaggaaaaggagaagcagttccatttctccatctaata

SEQ ID NO: 2664 - DNA, 1501 bp, Oryza sativa
gcgcgcagaggcgaaggaaggcagaacgggagcaccggcaatgttgtcggcagtgttggagaagcaggagttaaggccgctcagcaggttcaggacgagctaggactcggtgacggggtggccgacgtcatgtagggcatcagcagcagtcttgaccttctggcagtaatcagcaatggggagatcgccttgcgtcatggagtggaactcgtggctgaggtagatggcgcgtggttccttgttcgcctgaaagatgtcgtcgatggagaccctgttaggaaacgataggcgaacaaacgataaagaacaatagatcaatcacaaaaaacacgagatttaacgtggaaaacccttccaaaacaggagagaaaaaaccacgggcgccagccagcaaaatatcttcactatatctgaggtaaggttacatcgccgcacggcggcttacaagaggtatatatatagtggagccctaaaagggatgatgatccgtacggcagaagctggcctttattaagtgcaaatgaatttagatcacaactcaacagacccaaagatcacgggctgtctggtccggttccatagcgacatcaagaatcgcgttggaaacagaaccgaaaagccaaccccggacacagcaatcagcttgttcccaagccggatcttcagggcgagcaggagcagtaccatcaatatgagcgaggagtccggacttgccgcacatggaagtgaagaaggatttccatctgttgaaattaggatgcttaagctcgagggtaatcgggatgtgtgtcttgacattgacagtggcataagggttgatgacgatggcgccggcagaatctccagtggtgccggcggaggagccggacgtcgaggacgacatggtcgcggaagcagtggtggaagcggtagacatggcgcagaggaggaagcagcgcggctagggcgcggctggggcgtggcgcgagcgagggtgcggctgggtcgcggcgcgaagtggggcagggcgcgacgcggcgtggggcagagcgcgcgacgcggaaggcgcggcgagcagggcgcggcgcgggagcggcagaaacgcgtcggtagggcgcggagaaaaatcgcggcaacgcgtggagagaagccggcgaattaggagaggagagggaaaccggtatctgataccatgtagaaaattatgagacgccacacttcccaacgtggggggcgattatatttatatagccaaatacaatagagattacaacaaactcttaaataagagatatatacaaatacgagacatacttagactatacaaatctaatctaattctaatacatataagctatttaaattactgtaaattcttttgttgtatgttctgtaaccatgtcctaatagatttatttttagaacatcgacggatgccttgtgcatttcatatttaaaattaaagctgataagttcctgaaacattgatgttgtgttaggttccatctacctgtattccact

SEQ ID NO: 2665 - DNA, 1501 bp, Oryza sativa
gtttgagttttgcaaaatctaagtcttctatctaacttctgatcactaaaaagttaaggatgaacggaacgtccattggtatattcacaagttcacataatacattctggaagcgacatgcataggatccagcctctaattggtagaatgaaagaggaacccagtagatatattgctgaatacggggagactgaaactagtgcagcacaccaatacaaccgaatattgtagaattatgtcaaaattctagtgtaattccttatatttgtgggcaatgtcacaggtgggctgccaacatgtatgaattacaaaagagttattctatacttaaggactctgtttcttaatttacatataaagtagaatgaaatgtcactgtttaagggttcctttggaagacagaaactattcaggaactttacataaagcaattcatttcccgcatggatcaggaaataaagtcccatgttgcagtgatcatctcaacaaaaaaattccataatacctcgtattataccccccaaaagctacataaacagtactgacacagcttttactcatatgcattatattctgacatgatatatttcagatttcaaaagaatgcccttcgaatagggctggtgtgatccgtactacttggtttatcatttacagaagaagtgttctctgtacctaatacattgagcatatacaaaggaataaacatattatctggcagtaaaatatgtacacaatgcaaaataaatgagatgaaaaataaggagttcaatattactaagtaacggctacacatatattacaacagaatatcaggtagtatgcacaatacgattagtataatcatctgatataaaaacacaacaaattagtgtaatatgtaaaatgcagctgtgaagctgaatgctagaggaatagtgaaatccacacaaagttaagtagtatacatagacattttctaggagaaaagagcacgatattctttggcttcttgggccatttcttccatcgttctatcttttctttcaatatctaggtccaatgtctcattttttgcattcatctgttatgaacagagagattattcagatttatttgatggagtatcagatgaagtgagagttgttccaagcagcatcactaaccatgcctttattgttatcattgttctcaaaatcttccttccttcggggaacgatgtgaacgtgaacatgtggaactgtttggccagagtgaggtccgtcctgataagtagcaatatttattcaacttcatgcccggcgaaaaatttattcaacttcatatcatacacaatagaagataaagttagttttcattagtttttacaacttttcattaaaaaatgttacgaacatactaaattgtgatctgaaaccacaattttgtgagcaacatcatacttgtcatgctcacacgaatttagttataacatttcttaaattcaaagtgaaagacctcacaggttacaagataaatcgaa

SEQ ID NO: 2666 - DNA, 1501 bp, Oryza sativa
cagccttttcttctcttcctcctccagttaacggttgctgcccccctctcgctctcccaccaccgtccatcccacttccacgcgcacacagcaaagcaaaccaacaccaaaccaaaccaaagcaagcttcgtttccgctgcccccccacaggccactggaggatgaagagcacgcagcatcgcctctaccggcggcgcatggcataggcatcgcctgcccccaccccgcccccgcccaagaatgagagcttgggcctccactacaagagatagagacagacccaccaccatcaagaacatcaggaggagaagtagatagatgggcaactgcgggacgcgagaggagaatgccgtcgttgcggcgcacgcccaaggtattcttcgcttcctcggatttgatttcttgggggatttcccggtgattgttttcttgggatgctggttgttgggatgggatctcgggttggatgatctgaatttcatcaaaaaaaattgatcttggtggttatttctgggttcccctgatctctaggactctaggttggtgggttcagtggggaattgacaaaagcactgtctttcctttttgctatatatgatgacttatgttattgggacctttggatgggtgttttggttgcaaatgttcattcttgttagggctattccaaatcggcattttggtactctccggtttaggtttgattaaaatctgatatcaacatttgctccaaatcttcaacattgtttttctgtttgttgcatatgaatgttcaacattgtttttctgtttgttgcatatggggattctgggattttggtttacagtctacatttgctcaacatctttttttttcctttttttgcggggaagccctcatccccttaatctttctggtgtggttgctctgtgatttcttctctgctgcatatccttatcttcttggttgctgtatcagaaattctgcttcattatgttcatcgggacaatttacaggcacttcccccaatagtgctgcaatttctgtgctctctgcttcactgaggcactgttgactttcagtttaacagaaaatagagttatgatcctgcaagttggaaaaacataatcacttcttgcagtttgctgcattgtttaagcaatttggagccctttttttattgcatgcaactctgcagtagatctggtctcctggtcctgtttacctctttctgtaatcaacttgcccatgtatgtacttttttacagtatttttaggtagaataccatattataattgctaggaatcgccaacgctcgtttccagtagttctcttgttagtttgtgattatagcttccctaaacgtatttcagcaggattagctctctttcatccatccatctctgtgaatgctgaaaattcaatatgaaaaaaaaagcttgccttttattttgtttgtacgagaatttctggtaaccttaattcgtttataccttaactattttttctttcttattgt

SEQ ID NO: 2667 - DNA, 1501 bp, Oryza sativa
agatccatatctgaaactgcagaagttcatggctctcatcgaactcttaccggactatgcgagaattgttgatgacggactctaccgtgccattgacatatacctgaaggtaagctaactgtactgcaaaccttgataactctttctgattatgtccaatggcaaattcagtaactgccactctgtcagcattacaacattattcaatgttgatgaaaatgtggcacgaatactttcaattctggatgtaatctttagaaccatttgcaatctgtatagtgtccgatgatgtatagcttgctgtgtgtggtgacaaaaaactgaattgtgataacaaacaggctcatccatctctgacggagtcggagtgcaagaagatgtgcaagctgatcgactgccagaagctgtcgcaggacgcgtcgagccacgcggcgcagaacgaccgcctccccatccagacggtggtgcgcgtcctctacttcgagcagctccgcctcaagtccacggtgtcgtcaactaccccccacaccacctccctcggcggcgacggctgcggcgggtcgctgtcgcagcggatgatgatgaccggcggcagcggggtggcgagctcgtgcgtgtcgccgcagcgggacaactacgcgtgtctgcggcgggagaaccgggagctgaagctggagatcgcgcggatgcgggtgcggctgacggagctggagcgggagcagggggtgatgaggcaggggatgcgggatggccgtggcggcggggagcacggccgggcgctgctggcgtcgatctcgcgagggatcgggaggatcgccatgctcggggtgggggcgcagggcggagcggagaggaggaggaagacgaagacgaagaagagctctcactcgcagtctcagtggtcgtcggatggtggcgggaagacgatgatgatgagcagcaggcggaggcacaaggcgtcatctgtcacctacgctgctgcctcctgaatcatcatcaaactgcatgcttgctcttgttactgcatgaatgcattttacaaggaaaagatgggcagggaaaatgtaaaattctacagctaggtgaagagattaaagtgttaacactcctttattagataagctaatctagttctattgtacaagtagtaacattttcattttgggtgtggctttttcttggtcattgcggcctcctgcgctaatggaaggaggcaaattttgcaaaagaacactacaaatccaaatcatgaatattttgcagagcacctctttagactaattttttaaattaaaattttaaacttaatcagagaagtagatttgaaaccgatttaaagacattatacattattgtcgttcaaatttaagattgatttggttggggtgcgccaggcccgggctgtagtgcaacgcctgggcgacacgcgagggccccagtggcaagccactgtggtggaccctcccccacaaaaaataaatttaatatcaaagtggacaca

SEQ ID NO: 2668 - DNA, 1501 bp, Oryza sativa
tgcatcacggcatgctttccatgtggatgacatccgaaagttttttaacagtcataggtctttgatgcgtggagaatcgtaatgtgtgggacgcgctgtcaatgataccaaggcatgctaaactaatattttggtatagatagaacattttggaaatcttctgcaaccagtcatgtataagggttccgttatacttactccctctttctcacaaaccaatctcgtacaaaatgtcacacaaaccaatctcgtacaaaatataatatattttagtataacaaatctactccagagaagacataaggatgtccggtgtccaaattcatcgtacgagaatgtatcccatcttatacgagattgatttattttgtaacggagggagcagaaattatcagtagcatataagtattgaagaatggactattgttttgtactttcgtatcaccacacttactccgcaggtttagaaattctcccgttaataaataaaacaaaacataaactgcaaagatgattttgttcaaaatacgattggaaacaaaagttaaagttgtatatggaatccaattatattttaaaactattgtatagaaatagtacaatatatctatgaaaatactccctttgtactaataaaggaagtcgtttaggataatatttaagtcaaaccttggaaatataaatcatgaataactcttaagttgttgagtttaaaaatataaaaattatatgtatagatttgtcttggaaaatactttcataaaagtatacatatagcacttttcaataaatatttttatagaaataaaaagtcaaagttgtgttttggaaatcgtgtcgttgttctaaacgacttcctttacaagtatagagggagtatatggtaagagctgtggaccattttaacttttaaatctacaatatataagttttaagtatatttatagaatcaaaacataataataaaatttgtatatcaaattcaattatgcttttacttggacaatccgctagttactttaaacacagatgacgtgtttgagtcggtttttaagtttattcgcttttggaaatacaaatccgtgtttgagtcatgttttaaattaatttgcttttataaatacataagaagtcatatacaaaatttttaattaaaaaatttttgcatactaacttgttatgatcgaacttctaattgtagttcatgattttattaaaaaatatatattcaagcaaattctaatattaaattttatcttaactaaactatataacaataataatattaaaataaccttcatctattacaacacgtaaaggaaagaaataaaaggaagaaaaatttgaccccagcgcccaaatctcacccgacccgacccaactctggtcttaactccgacgcccgaactcctaaacccaccccgtgcccccgccgtcgtcgccgccgccgccgcagcagcagccttcctccaaatccgcgcgcctcctccggccatggcca

SEQ ID NO: 2669 - DNA, 1501 bp, Oryza sativa
ccgcgaggagccctaccccagctctccaagctcgccgccacttcagatgtagagatctgcaggcgcttcattctgcagtatgatatcctctctcggcgcaaagtactcggcattcatctctgaaaccttcactcaaattacaccacagaagatatcaactactcctcacgaacatccaacaagaattggaaagaaataaaaatcacatgatcacattgagatcatgtgattaaaaccaagaacacacgccaagaaaccatcatgtgatgtgacttgtgagtactagagtatactgaaccaagatagaacaccaaagaattgctgttgatcaagaaacagcaagggatcgatcaaagaaagtgactactaacgaatttcctggtgcggctggtgccatggacgacagggttggtcatgttgccgatgatgtaggcggtgaggctgaggttgaagagcatgtaggcggtggtgtagaccatctctccggtgttctcggcgtgcatgtcgccgtagccgacggtggagagggtggtgatgaaccagtacatggaggcgacgtagaactgccgacatcgacttggccacctcctgcgggcgacgaggcggcccaaagtggcgatgaagaggatctacctgcgcgctcgccgctggcttccttgtctcctccctctccatgcactctcgccgccggtcgccgcccttcccactccctccactcttccccttccctgcctccacctccccccaccttgccggcggcgacgacgaccgcatcgacgcgagcacctctttccacatcgcccgtcgccgggcgcctctctcgcctcgccctgccgacctcctccccacccggccacccgccggccgggggccagcccacacagagaggagatgatgagagagagaggaagggagataaagaggggaaagtgagaggaagggaaatgacgctgttagcctgacatgtggggcccacgctaactcagctgccacgctagataaaaccgatgtcaaaaacacggaaggatcaaaagtaagcggttatatctggttttgtggttggaggatgattttgtaactcgatgacaagttgagggacttcagtgtactttttgctattgggttcggtacgtggagtggagccccacctcccgctccagattactgtcatcgctgttgccagcttttaaagcaaaccagcagaagggaggagggcatttcttctctcttgtttttccctttcccctttttatgtttatgcatctgcacccactacttcctcgcatattgcattaccaacattgtggatatttcatatttgattattactatgtattactcctccgttctaaaaaaatattattttttagcttttagaatttattccaaaatataacaatttatgtaccaatattcttttcttaaccgatcataaccatttactattaaatttttttaactacctatacttcttatccaatcacaatatttttagaactca

SEQ ID NO: 2670 - DNA, 1501 bp, Oryza sativa
ggctcagatgggccgtaaaaatgcaggcccaccttaattttaggcccagaacaactctacattgctttcctctcctccgtcgattcgttcgccgacgagacggcagctgatgcttccggcgctctccgccgtcctccgccgcgcgcccactcccttctcccttctccctctccctctcgctccgcctccgcctcctacccttcttcgccgtcgtccactgcttctgccgcgagccatctcctcctcttcctcgccgccgccggtccaggagatggaggcggcttacaagttcgggccgtacaagatcgacgcgagggaggtgttccactccaccccgctctcctacgccatggtcaacctccgcccactcctccctggtaataacctcctcacttccccttgcccagttttaccacttgatcgctttattccctccagccgcctccgttccccttgctcagtaggagtagtaccatagtacagtcccaaaatttgtagcggaaattacagagacgggttttgtagcttgccattgctaatttgtttgatgaccagttcgcgaatcatacggtacctgccaaatgctaacaagcacgtttttgttttcttgaacacgcttaacaagcacaatgtacacgcagatactagctacttcctccgtttcacaatgtaagtcatttttagtatttcccacattcatattgatgttaatgaatctagataggtatatatgtctaaattcattaacatcaatataaatgtgagaaatgctagaataacttacattgtgaaacggagggagtagtctgttcacatatagtagtgtttttctgcaattgatctcttcttctacctaacagattcaccttaatacagtaccatttcaccactataccatatgcgattccgtcaactttgaccttgctgttgctgcatgcatttaattcctattgctatatattggttggttcatattctgctattctttcttaaccataccgttccttattgtgcaggtcatatccttcaattgcaccaaaagagactgctactttttctgcaaaacgctgttttggagatatttacagaatcacagttgatttctttcacgtgcatgcactgctagctagttctgttggggtcgtcgataaaatgagcttgcttttgctggcttgtgtttgggtaaagtttcatcaatgcattcaaattaatagtaaataaatggacctgtggaatttatttattcatgaaaggattgtgttggtttacccttcttctatacttgacaaatatcaagtctggcttaaggacaattttgtggattggctgaagaggtgatgtaggtgtttattttgccacatgtcatcttacttgattgatcatcttagaggatgtcatctttaccatgagatgatgtccatatgtagtatttatctgctacttggttgtgattgatatggagtaactgtcaattgtactgccgtgtcgagcaaatcttcca

SEQ ID NO: 2671 - DNA, 1501 bp, Oryza sativa
agtagtatacatagacattttctaggagaaaagagcacgatattctttggcttcttgggccatttcttccatcgttctatcttttctttcaatatccaggtctaatgtctcgttttttgcattcatctgttatgaacagagagattattcagatttatttgatggagtatcagatgaagtgagagttgttccaagcagcatcactaaccatgccattattgttatcattgttctcaaaatcttccttccttcggggaacgatgtgaacgtgaacatgtggaactgtttggccagagtgaggtccgtcctgataagtagcaatatttattcaacttcatatcatacacaatagaagataaagttagttttcattagcttttacaacttttcattaaaaaatgttacgaacatactaaattgtgatctgaaaccacaattttgtgagcaacatcatacttgtcatgctcacacgaattttagctataatatttcttaaattcaaagtgaaagacctcacaggtacaagataaatcgaacctgaattgtgaatgtgagcgaagaagccctctggtactgctcaacacgtacaccaatatcctttgccatgatccacaaatcacgagtctcatcagggctaagatcagcaaatagtttcacaagactctttgggcatataagaacatgtataatttaagttaaggaagggggtgggggggggagttaaaagtcttaggctgtcaaaaatgcagtgccacatacaatccatcataggacaaaggcaacaagagctgagttgccagttgtcaccagggattaactgaagtaattagcacgaccagaaattaacaaggtaaagcaggtagtattaattgtcttgaaatagaaagcacaataacccttctgaaggcaaaaacaagtgagcactgtgatgtacaccactaccatttttcaatgaaccgatatcgtacattacttatgtagttcagtgcagagtctttctttctttcctttttttttctttttgaaacagaggcacatttcattgatgaatagcaagagaagttttttttttttgcaaataataataataataataataataataataataataataataataataataataataataataataataataataataaagtatgagaagttgagagcagataataccgcaatgtgaagtagatactagaaggcactaaattagagagaggagtagagcagctgtgcatacacataattggcagaaataaaggatatgacctgcagggacaagattggaatagaatgatgaacaaacaaagaaggagagagcaatcaggaatgatagatttgttctgaggagaggagaggagaggagaggagaggaaatagctaggtaccagggcgggtgggtcggaggttgacgatggcgaaggagaggggcgaggtgcggaacacctgccgctcggctatctcgtgcggaccaaacctgtacctgcttccc

SEQ ID NO: 2672 - DNA, 1501 bp, Oryza sativa
ctagccgaagaaggaaaacaaatcttcagttgctagaggtccttccatgttgctaatttgctataaatgctggtgaaccatttggtcagaatacatgaagctgtagaattccctttcttgtcgaaacattgatgaaggataggtctagctcctgaacctttcagctgactggtcctaatgattagttgggtcactaatgtcaaagagatgctgcacctgattatggtagtatacaggaggtattggtgccaattcatcttttcaattgaaatttgaaagggacccatagaacttgacaaaaatattttatttgatgcgcttgacgcttgggaggctgtagggtgaagtaaaatcaaacacctacagagaactccctttgagatatgttattgtaaactgattgactgaggcagaaatgccaaattgtctaccggagttgaaaaggagttttatccaaactagtattactatgatactactagactagaattattgaactaacagtcctcaccaaattgaagtctgtagcagttgtttctgttcctttgttttccttgatgtggttggaacttggaaagctgatttgcttgaacatgaagagctgaacaaagacagccctgtttgtaacaaactagtaatcagataattcagccgattactacgacaattcagctgtttggttgtgcagaaggtatattgaccatgcagggtaattcggctgattgcatgaacttgtttggtaaaaactattgtgtataaatcgtgctccaaactcttgagcggatgctattagtgggtgtttttgattggacaatctgagcggcgagtagtgcagtactatgttgtgaagaaacactagtgctgggtgctgctgagttgctaaaaagtatgatatggaagggaagtatggatgtggttggggcagctactgtcccatgatggtttgtgctaatgaaggatggggagttgattgcgggagggatgagtgtggacgcaggcaggcgttcatagttagtgctggatggtgacaggaaacggaacaggaggacttgagagctgggcctaatgtgtggtttgggccgactaaaatgctaaagcactcccttctgatcgtacttgtgattgtagtaattatgtactagtaacgaaaattctgtttagccttttcgattaaaaaagaagaagaattaaactgatagcggacgcactggccgcatcttgtattcttaccaaaaaaaattccatgtcgttgttgtttaaccgccagcagtggactacttttaccaccggtgcacaagccaaattctgagacgcaatgcaacgacgtcatgctatgcttgcagagttgcaggctggtttgtgctgcgcattcgcgtcaacactcccatttattatgccaactaattccaaacaccagcaatactctcctcattaacttcttccgcgggacgagagagggagagagagccaaccgcgcactacttgtacttcctcatcttcc

SEQ ID NO: 2673 - DNA, 1501 bp, Oryza sativa
tgtgtgcttaaggggggttaactatccggttttaatagttcggggtacgaaatgactggttttcgagttcggtgggggggggggggtttcggtcaaccgcaatagtacgggggtaaaacgtactttttccttaaaaaaactgacaccccttaatcgagctgagccaaaccgcacagcaccatctatccatatcctctccgtcttaattataatctccaccgcatcctctcccctctctctcggtcccccctctctctctctgtcggctctcttggtcgcaacgacgtgcggcggtgtgaggagaggcagcaacgacgggcagcaccctccccttcgccagatccgacccggggggggggggggaggcgatggtagtggcgtgcggctagcgatggtgggaggtgaggcggcaacgacgggcaacgccttccgacgtgctgctagatctgtttcttcgccaccaccgacgagctgtgcgagatgggacccgacgtgctgctcgtatgccactccatcctcttcacggaggccgtcgtccatcctctccatcttctctgtgttttgtgtttgtgttgatgttgttgaagttcttggatcaatgttcttgaattcttgatgccaattgattgtatgaattaaatgttgggtgaaatcgggtgaaggggagctgctcgatgcatcggctcgattcgagcccatgcattaagccgcttttttcttttttttggaccttaaaggtgtcggttctgtaaccagcacctttgatttttctaatatgttatgctttctatgtgtcggttgaaaaattcgacccctatctagttttacctatctaggtttatgtagtagtgacttgaaataggcaaaacataatggttcaagaaacgtgcgattaaattgtttaattgccgttgattcaactcgtgcaagtcgttgacatttgaagcatacagcagagctggaatttttaaattcatgtttgaaactcgtggtctcgtgaaggccccttttgtatagcagcgtacgcttcttcttctggaatttttcgtgctctctctactggcatctacggttgccacgcgccgtgtatatatacaagctgactttgccgttgtatgtacgtgccaaagctacactagaagcagctagtagttgacttggcaccgccttggctttcgtaccatcattaccatgccacagcccacagcatggctctacagctaatcacatccacggatgggtcccgtgtaacaagtgagaaagtaacaccagcttaattaaccagcgcaatattagattatgagagttataattaaggcatgtttgacaggctccggccgctagctctagattcatctcttcttaaagtccaatcaaatgatttaaacttcacccagaaaacgaagggctaaagtgatatgaaagagtggaaccgattcaacacggttaatttaggctgcttcatatgtccgttccatactccgtttttagagttagattt

SEQ ID NO: 2674 - DNA, 700 bp, Oryza sativa
cgccgcgccacccctccctcgtcgcgcctcccccacatcgccgcgccggcgcccatcgccgcgcctcccctccctagtccggagaaggagcgcgtcgattcaatgaaaaatccggcgcacggcggcgagggagcgagggggaggcgcacggcggcgagggggcgagagagcgctaggacgccgaggaggagatgcggcgctgatggtggaggatgcggagagagcgcgaggagaggagatgcggctctgtgtggtgggagatgcgagagatgcgctgggcggtcggatctacctcctctgttgattttgggccattggatgtgtgacatgatgaatgatgaatgagtaaaagcatttgttgaactatagggtagataaaccaggtataacgactacctcatctccgaaaaccggtgcaaatcgacccccaagacagtattgagtccagttatagcttatgtggcatccacatggcacattgactaattcttcatcccacgtggcatctagatggcattcacaataaaaagaataggtgggacccacgtggggccacctatcacccctcccatctctctttcatctcctcatatcttacagcctcacgccttccatcggctcgagcggcggcggcgggtgttggggaggagctcgtcgggagggcgcggcgggccaggcgcgggggaggggctcgccggga

SEQ ID NO: 2675 - DNA, 1501 bp, Oryza sativa
cgttcctccggcggagtcgcctccgtggagaagcctgctcggagttcgccggaggtcggcgttcgtgcgacactgacccaaggttctccctcgatgccggccgaatgtccgtcgacgatgtaggcttctcctgggacgagccccgcgcgtcgtgggacggctacctgttcggcgccggcaccggcattggcctcggccgcgcgcccccgccgctctcccgcctgccgcccattctctccgcgatggaggactccccagccggcatcgtcgagcgttccgacggccaaatcccggtggaggacgactcccagccggagcccgatcccgacgccgacaccccgggcggctcggtgcagacccgagactattacgacacgtcgtcgtcaagccggaggcggcggagcctggagcggaccagctcggtgcggaggccgtcattcgaagtcaccgacgcaaagccagtgctgccggcggcggccgccataacaagcgtcaaagattcgccgctaattgggagctcagagttctaccacttccagcatgccgaggacctgctcgaacaccaccggttcagcaccagctccctcatcgaagacttccccatgagcctggacgccgcgttcccgggccccgacaagaagccccggaggtggcgcaaggcgtggagcctctggggcctgatacaccgccgcgccgccggccgcaggggcggcgcgtccgacgtcgcggacagggccttctcggagccgtggccggagctgcgcgtccgcgggtgcaacgccaggatgcagcggtgcaacagcaacgccagcgcgcggagctctttcagcagcaacagcggcggcctcggcagctcgaggcgcagctacgtcgacggcaacggcaacgtcgtcaagcggcggcgggaggagtgcgccctggagcgcaaccgcagcgcgcgctactcgccggggcacgctgacaacggcatgctgcggttctacctcacgccgatgcggagcgccagcggccggcgcgccccggggctaccggccaaaggcggccggcaactgaggtcgcaatcgttcgcgcgtagcatgctccggctgtactgagttgtgtttttcgttgcagcagtagtggaggctcaatggcaatggtataaccataaatctttttttacatccttgtgtagcgcagtgttaattccgttcatttggggggttggattggatagaatggaggtttatctcataatcacctcttaatatcttgtcttgtgccgtagtatctggacaacgtactaactatcgataacgtgtagtagtagctgtagtaatgctgcaggccagaatggcagatcgaccgatgatcgggatcggaggatagaagctgcagctacagctatcctgcaaattctaaactggtgtccaagtcatggtgaagaggggtcctactagacagtgccgaattctgaattcgtttgacatggcgctgccttgccaagcggcagctgagcgct

SEQ ID NO: 2676 - DNA, 1501 bp, Oryza sativa
accacaaaattgtgatgttctgtagcaaaatttgcctaatttataagaaagctcgctgttttcactattttagatatgctactaatatggtcttccatacactcctttgaccatgactaaatgtaaaattgaattatttcaaataaaataatatcagcatattatgatagtttgtttaacgataaatctatcaacatcatttctatgtcattggttgttatgattttttttctttcaataggtaaagttaaaaatatttgtattattattattctaaaagtgcttatatttatacatagagagagtatctaaaacaatataaacaatataggagtatatgacaaaccccgaggttacgaaatacgaacatacttgaaagtcatgccctaatcgttgaacttctttttgcattataatataaaacgtgatcttacctgagcgtgaaatttgccatgtaatcccaatatccttatgaaatagattcatgtgagacgtgtacagactccacagaattagagtagtacgccagaaacagaaaatgccaaaaagaacaaacgctttagaccggcatcggaggtagcaagatctgtttgcaactttgcactgcgacatgatcgcggtggcagaccaacaagatgccaatctatattctctccgtccttataatcgttgatttttgtttctataacgtttaatcatcatatatcatatttaaaaatgtagtataaagtatgacttaagataatagtttcttcaataataaatcaagtcacaacataataaataatatttatgtaacttttaataaaacgaagggtaaaatcgacaccatcatacgtttatagagggaatatttatctttttatatattttcttagtctcataaaaaaaaagtaaattccggctatgaatttagacataggttacatctaaatttatggctagatgttgattttttataacacggggaagtacatgtcttgtcttggttatatctaaaaatttatggctagatattgattttttatgagacagaggaagtaactgtctttgtctttggttacatctaaaaatttatggctggatattgatttttctatgagacgaaggaagtaccctgtcttgtctaaaggcaatttgactgtgttcggatgtccctttttccaaccctccctcccttatttttcgtgcgcacgcttttcaaactactaaacggtgtattttttaaaaaagtttatatacgaaagttgctttaaaaaaataaattaattcattttttaaaaaaagtagctaatacttaattaatcacgtattaattaatgaatcgcgctattttccgtatgtaccgtagccggttggaaaccagcgtctgcgaacacaccctgaatgaaggaggactgggcggcggtcacaactccagagtccacaccaagcagccccccggcgcgctgctggtcgcacacgacaagggtgcgcgcgcgtgtatcaccggctgcactcg

SEQ ID NO: 2677 - DNA, 1501 bp, Oryza sativa
atttctgcagccatgaatgattcttaagccttttgcacatcatctttccctctccctgctacgtgctggtttggaaacctttgcgacctcatataacaaagagcagccacaagctttggagaaacctttatgagacctttcagctcaacaatccatattgatctcacagcgtgcagtttcggggtgcggaaaagcgacaggtatagcatccctgattggtgtgtagtgggatgaatcacgctaaaatcagttcattcctcctaccgataatgggcgacgcactgatgaggtgcagaataatacaagattgggcgtcggagatagcctataaaccactctatggatttgacacgcaggcatgtgtgcacatgatccgttggggctaagatcaaggaacacatcaagaagcaagctctttgaccggtgatgtatttcttatacgggagttaagctagtatcactctctaagtatgaatcactgtactgtattaataattcactggcgtatagtagtgctttagatagttagatgatgatctgacaggcaatttgcttgtccatgggcatgagttgggctgagctaagtgtgatgtgagcaaatgtcaacatctgacgatggccgatctcatcttcattcatactctttaatttagtcatgcaaaactgataaaaagagagacaaatcgttcctcgtcactcacttattggaattgatcaagagcaccgttgacaccaaactagtccacaaatttgtatgctcttttttttttccttcatgctgtggcctcaaaagtcatctttttttttttccttttcgtggtcgcgcgcgagttatgattgcattttattcagaaggggtcctaatgagtctggacgtaagagggcggttgcagaggccacttgttgttttgtgtaataaaatttgtgattaggacgtgggggagtttggattagaaacatgtactccctccctgccccatattatatactccctcagtcccaaaataaatccaatcctaaagattcgtatttagaattaaatttattttgagacgggagagtataagttattttggtttataagttaactttgtttaagtttgattaaatttataaaaaatgtgataacgtctacaatataaaatagatatagtactccatttgttacaaattacttgtcgttctaggtttgttctaaattaaatattttaatctttgaccatcaatcttcataagctcatatagtttaattttataagaattacatttttttattatatacttcacatgttattaaactacatagatttctaaaaagtaataatcaaagaaaaatatgtttgacttaagatatacacggaacaataagtaatttgaaaacaatgctgtggagattatgggtaccccatacccacacggcatggttatccgactagttataggggataacttatatatatgtaatatgtaacagatcatgacttgggtgttacgtttcctt

SEQ ID NO: 2678 - DNA, 1501 bp, Oryza sativa
  unsure (1)..(1501): unsure at all n locations
tgtcattgatataatgcaatgggtcaaatttatgcccacgacctatatcacttaagaccacgaatatagacactgattttttttcttttaaataaaacagagagcgaaatgacagtactatgggagagtgggaggctagcccacttaaagggctcactgtcaggtttgcgctagtggtggagaacaaccaccaccaatacatgtttttcatgtaggatagatattaatagaaataatattgtaaaatagcactttgtggctgtattcggcagcacgttacagcggcagcaagcctgctacacagctgtgctacacaaaatactgtgcaaggcggctctgtcgcagctcgctgtagtgcagccgaacatgccctgtataatttttatttctaatctactattgtcggagatatggacccgggggtatgtgaattagaggggaattactttccctccggccacgtgactctgcaagttagccccattcgcgcggcacgcgagtcgtggaagccgccgggggggggggggggggggggnctcnnngcatggcgtcaccccctcgggctatcccgcgtcttcgccccgaggctctcacccggctgccacgcggcggagagaaagagggagagcacaggctgaacagccataaatgtgcgatgccccaactgtccctcaccgcatttaatgcggtaagggcagacgtgcggcgcgcctagctaacctctgtccaacggatgtgaccggtctgtaaccggcctggcaccgtcacatccgatggatagggcaaccatgtcctcacgtcgcccttgtacccggcggagtgggggtgggtatgacccgtcacgtccgagcgtcactcgaggaagggctgtcacaggtcatcgttcatttatgaggaaatgacagggctgtcccccgtgtcaggcggggggcggcgcctggttccactcgagaaccggttgttgcttagcttcggggagaaggcacggtttaaagcccaggaaaagtgaattgggatccccctccgatagagggtaggtagaggcggcgcatgtggtatccccttgagctataaaaggaggaccctgcccactgagacaagaaaaaaaagaaagaaaaaggggagagagggagaaaaaacctaaactccaggagggaggaagcgagtgcgctttctagagtgaagaaatctttgtaaaactcatccataatcccaaacacaggagtagggtgttacgctctatagcagcccgaacctgtctaatccgattgcgtgcaagcttgccggtgatcctagggacgagtgagtgatttccaagagatgagcctccgcccctagccgaactcacaaatggggggtctcacgattccccgctattgaggatctctcctcaacagctggcgcgccaggtagggggcgcctgcgcattccgagaggaagtcgctttctttcgtcccaattttctccaggccttagccgaccatggttgaggtcctggaag

SEQ ID NO: 2679 - DNA, 1501 bp, Oryza sativa
cgcccttgccagtcgccgtcgccgccgccgccgccgccgccgccgccgcgcctcgctcgcgtggtctcgattggccaccgtcgcgtgccgccgccccaccccgagcccaccctgactcgtcgccctcgccggtcgcggtcgccgccgccaccgccgccgtgacgagaaagagatagagggaggagatgccccaactcatcgcccgccgtcgcgcgccgcctcgctcgtgtcgcctcggttggctgctgtcgcatgctaccacccttttccgactcaccggccgatgacgacctcgccccgacatggtggccgagacaacatgagcgacggcggcgcagcaatgaagccagcggtggtcaccggcgacctattcagccattggagggagggaggaagaagagctaaggggtatttttgtccgggatggtatttgagcaaatacactttggtagaggatggtattctagcgaagcccattttagtgatggtatttgagcgaatcctatcttatacgatggtagatatacaattttctcgaactaaacacagccatactcctaccagaaaaaccgatcctctcttgatcagaagattctcatggatttccagggccgcggagataccgcgtccaccaccggaggccgggggaagttctccccaagattgcgtcttccctgagcaaatcaaccggcaccacctttttaccctttccagggaagcatctccccgttttttcaccgatgcgcacggccgccgggccaggccaagcgaagccccagagccaggcaccgaagctgccccgattcccctcccttctcttcccccgatggcgtgccgtgagccaccaatggcactttccctggggtggatctgtgtgtgcaggcagcctggcgcaagttgaaggtgttgtgccaaatgaatcctgcaacagcagcgaactgttttgccgtgcccaccctttgtggtggtgtggtgccccgttcccttccattggtgtttctgtgggctgtgattgtgaaacacagaggagagaagagctagcaggaggatgacacagagaggtttatggcatgtgatgcttggttctttggtggtggacctccaactctcaattccctgctactgttgcctgtgtgacagccacacctccccatcagcatcagctgggggtacttgcaaggtacaacctccatttcagctaaactaatcacggctcatgcgatggcaagctcccattggccgcccagaggaggaagtaaccaactggactcgactgcgggtgaagtagtagtagagtgtacggtgtaggcctgatctcagaccggtcattaataaagtgtcatttgggtaaagcaagtactccggtgcttgaaatccgtaagacgaaattctcagccagagtgaagtcaatggggggaagcttcttattagaggggagtcattagcgcacaccacgtctgcttcaggttttattccctcaaaagcgacaggaaagagcaga

SEQ ID NO: 2680 - DNA, 1501 bp, Oryza sativa
agtaggaatataattttgaaacaactgaaattgaaaataaaaaataaaaacattaaaagaacacaatacggttgtcaatgtttgatgccgcgattccggtatttacatagtatggggatcgttggtactaggttatacgcgaggctgaggtaaaagagacggggatgaggtttttataggttcaggcccctgaattgtcaggtaataaccctacattatgttggccgaagtcggtattgctcttattcaccataatcacaccattaaaatatttggggtagcctatctaattgttgtcaatatggcggtctgaaggtctgactcgtagtcgacaacagggtagccttcttcctcgaatccgtgccccagagattagagatagcactttcgtctctcctgacagtatccggagacaccgtaagggactagccgtgcttatccctaaagtcgatatctggcgtcttgtcttggcttatgttggcttgtatgttgtggcttctattgtgccgtgtcttctatggtgggtctctcccctctcctcctagggggccttgtatttatacccataggtgtccccttatccaagtagaactagagaaaccaatatggatataatctgagtagtccttgtcgttttcatgtagaactctggttgtctttccttatctggaactcctcctatatctacaggttgtttccatataggacatggtagaactctggttgtctttccttatctggaactcctcctatatctgcaggttgtttccatataggacatggtatgtggtgggtcctgccgagatttagtcgactactattaggtatgtggtatccataaccccgacaacggtattaaatatttttttaaaaaaatctgaaataagaaaaaaaagatttcaattaggattaaaatttataaataactaaaatttgtgataaacataaagactattgaaagaaaagaccatctaaaacacatgacgagataaattaagtaacatatctataaaggagtagagttggtggcggttgatacggcatatagaaattgttaataaaacaccaaatagaatactaatgacgattaaaaggaggacgtcaggcaggccgtaaaacaaacaagtaaggcggttgccgggacttctagaaagtaaaaaaaaacacattgataatcatattcgaattttaaaatctcaatgacaataaaaaggagaagcagcgggcggggtgtataagagtatagttgcagagccgccgacagttgacgggatttctagaaaataataaatgaattgcaacgatagttatgttcgattttttgaatcacaatgacgataaaagagtaggcggtggatgtgttgtagagggacatagtggcatcgtttgatgggacttctaaaaattatgaaaataaaactacaagtctaatttttaaaggttcggaacttctaaaaagtaaaagatacaatcataatcatgttcgattttaaaatcacaa

SEQ ID NO: 2681 - DNA, 1501 bp, Oryza sativa
cggggcgaagacgcgggatagcccgagggggtgacgccatgccccgaggccccccccctcccccccgcggcttccacgactcgcgtgacgcgcgaatggggctaacttgcagagtcacgtggccggaaggaaagtaattcccctctacttcacatacccccgggaccatatctccgacagtagcccccggtgctatatcaggtattgatttcctgagatcgttctgacatggcgcctcacgactcctcgagctggggttgtgggcccggcaggggatccaaaaggatatcaccgcgtggccaggttggcgtgccaaccataacagcagtttgaccgccattgaccgtgctcatgatgaagatacttgaggcgcgataatcccgatgggtcagtcagaccacgcctcgattctcccgctcgctactcgtgtggcggtagtggtgatggtttgctcaacctgcgctcatagccattgtgcactccacctcgaatgcgccactgacagacgcactaaaggcgggaacggatacaacgggcgacatgatgattgggcgcaagatgcgaagagacaaatgcgggcgcgagaatcgtgggggcaagtatgggagcgcgaaacgaggaggcaagtgcggatgaagcgaggataaaagggggcggaggcagagactctgcccccttcctttcgccaaccgcccactcgtcatttcgcttctcgaaccctaacattctcgccaccttatactgtctcgcgctccacgctctccgccacttctccgccggttgccatggcccaagacaccgatgacgcagtgcttccttcctcctgcatcacagcagacaggcaccttagccttcccttcaagatcatgccggacggtgccatcatgcgggcgggagagtcgcggccgcggccgcgatatccggagcgatccgtgcacctcttgtccttcgccatgacgggcttgattccgccgttctccagattcttccatgaggttctggatttctacgaaattcatgccttgcatctcgcacccaatgccgtgatgacgctggccatcttcgcgcatttgtacgagatgttcattggggtgcgaccgacgatgcggttgttccaggccttcttcattccacagctgttgcaaggcgcggtggtggggggatgctacttccaaccccggccaggcacagcgggtcagtacatcgagagccatctccgcaagaaatgggaggactggaagaaggattggttctacaccgcgttgctggaccatccgcgacttcgagttcccgctggccctcctgaaaggtccgctgcatggctggcgacttcggagctgggcgaggaatacgacgcggtgtgggatcgccttaggggcctgcggagcctgggtctcacgggggcgatggtctttggcgattacttccgccgccgcatcgcacctcttcaggaatgatcccgtggagcgtgggaatacattggtcccaacgaccccatgcg

SEQ ID NO: 2682 - DNA, 1501 bp, Oryza sativa
tgaatatcctatttcctctggtcagtagtcatggtctcactggtcttttcttttttttttctattttcaactggaccctactcttgttagcttgtcactatggcctttttgtatttgaacttgtttacttgattatgttgagctatgaaatggtagtacacctgcaattattgggtctctttatatgtttattattgaccattgacacgttgaaaggtggttcctacatcaatgcattttttaagagcaagtttaacaatgtagctaagtgctagcttcaaaaatgctacattatctataaccaacctaatactttattaattatgaatatatactacctcacatgtcctaaaatataacaaattttagcctttataatttatcctataatataataacatctaaatcaacattctattctcaacaaccacaaccttccaccattcaatttccctacctaccttcatttctcaaccaatcaaaatcttccaccatttaattatatatactttcttaataattatgtttaactctaaaatttcttatattatgagacggaggtaatacatcatcaatacatggctcatctctctttctcacatggtttattagggttgtattgtagctggttataaatttgatctcattttttcattgccctctctgcatataaatataagagtgataatttttatgcctgtttgtatcattttgttgcactaaataacaacggatacttctactgtacactgtgtagtgagcagggatgcccaatagtgagagtgcgatatgcagctctacagttcctcacctcttttggcaatagatacaacagcaaggagttgctctttggggaaatgaagggataccattgcataaattaatcgttctttgcccaggcgttctgatgcctccatcacatgacctcacaaagaaccaaacgagcattttggatgcattgcaactccattgccaggaagaaagtacaccaaatgctgacacaagagcttggcctggaagaggattcccctcatgtcatttgttttgttcaaaaaagtgacttttgctggcagttttgtatgacaaaaccattcaatttctctccttgttgggagaaagaacaaagtagggagaatcttagggaggttggtcatcagcattgctggcggttgatgcggttgaatattgcgaccttgatgcgagagcatttgctcaaggaaggcatctggtgctgcttatggcagaaacgagagatgcatcttatttggttagaaagccagccaccgaagaaaaaacgatgtggaagattcgttcgtcatgtaagaagatatttgatgagctcctgaaaactcatgttctctcttgagtttacctggccgagaaggtagagtttgttggacttaattcagcccatggctggatgctcatacatgttcggaaaaaaaatccactttacgtctcacaagtttggctgtttgagtcaactttcatttatgcccat

SEQ ID NO: 2683 - DNA, 1501 bp, Oryza sativa
tcttttgggttcattttttactttctagaagtcatgccaaaccatcagcagttgtgccattgtactctatacggctcgcccattacctctcctcattattgtcattgagattttaatatcaaacatgatgatcattggggtttatttttttactttttaaagtcctgccaaccgccgtgaacatgttgcttaatggcatgtccaacgtctatccttttaatcatcatcgagattctatttagggttttgttaatatttttagatgtatcatcaaccgtcaacactcaattgctttacatgtctcatcaaactgtcaacggcttcgttactatactcctctaaggcccacctgcttcctcccctctttatttttttttgagattttaaaaactgaactgattgtcattagtgtttatttttctactttctaaaagtcccatcaatcgtcgtgactatgctgcttaacggcatgctcatcgttcctcaccctaatcattattgggattctatttaaagttttgtttatttttcttagatgtcccatcaatcactaccattctacttctttacgcgcatattgtcttctctttttattgttatttgtcatcggtgttctagagatggacttcttttcttttctttttattttgaaaattccatatttttcattccgatggtttttatttataaactatattcctatctgaactcttttaattatttttttgtttttggaatttattttatttgttcttccgaatattagtatttggtcatatattcttagatggtcctttattttaatagtcattgttttttattgcgaattttagttatgttcatagatggtcttttatttcaatagtctttattttttattacgaattttagttatttatagattgtattcctagttgaactcttcgttttccttttctaattttggatttttttttctaactctatgtggcccacacaattgcgcagctagcacccataaagaattatctaatcggtgcggtgttcattggcaaattatcacgtttatggagtgagtttgaacggtgtcccatgggccacggctaaaaccacgaagtcgaagtgtcctgtagcaaaatttgcctttgtataaagattagtacactcctgaacgtatctaagctattattaatttatttttattatgaaatttattttctttagaattcttattgattcgtattttaaatttaatttaatcccgcattgtgtttcatttgtttttcatctgtacggtatgtacttggcggtagtaatggtggcaataatcactgtacataaattgatatatatacatgtcttacgtcaaatggaaatgctgctagggtacataaaaggaagtgcttctatgaagaaaagaaaaggctgagtgcctcaatcggacaataagtcctattcaaattaagcttaagctgccttggttaggagtccgatccaagccagatcgtatatatttctatgt

SEQ ID NO: 2684 - DNA, 1501 bp, Oryza sativa
ttgtgtgcttaaggggggttaactatccggttttaatagttcggggtacgaaatgactggttttcgagttcggtgggggggggggggtttcggtcaaccgcaatagtacgggggtaaaacgtactttttccttaaaaaaactgacaccccttaatcgagctgagccaaaccgcacagcaccatctatccatatcctctccgtcttaattataatctccaccgcatcctctcccctctctctcggtcccccctctctctctctgtcggctctcttggtcgcaacgacgtgcggcggtgtgaggagaggcagcaacgacgggcagcaccctccccttcgccagatccgacccggggggggggggggaggcgatggtagtggcgtgcggctagcgatggtgggaggtgaggcggcaacgacgggcaacgccttccgacgtgctgctagatctgtttcttcgccaccaccgacgagctgtgcgagatgggacccgacgtgctgctcgtatgccactccatcctcttcacggaggccgtcgtccatcctctccatcttctctgtgttttgtgtttgtgttgatgttgttgaagttcttggatcaatgttcttgaattcttgatgccaattgattgtatgaattaaatgttgggtgaaatcgggtgaaggggagctgctcgatgcatcggctcgattcgagcccatgcattaagccgcttttttcttttttttggaccttaaaggtgtcggttctgtaaccagcacctttgatttttctaatatgttatgctttctatgtgtcggttgaaaaattcgacccctatctagttttacctatctaggtttatgtagtagtgacttgaaataggcaaaacataatggttcaagaaacgtgcgattaaattgtttaattgccgttgattcaactcgtgcaagtcgttgacatttgaagcatacagcagagctggaatttttaaattcatgtttgaaactcgtggtctcgtgaaggccccttttgtatagcagcgtacgcttcttcttctggaatttttcgtgctctctctactggcatctacggttgccacgcgccgtgtatatatacaagctgactttgccgttgtatgtacgtgccaaagctacactagaagcagctagtagttgacttggcaccgccttggctttcgtaccatcattaccatgccacagcccacagcatggctctacagctaatcacatccacggatgggtcccgtgtaacaagtgagaaagtaacaccagcttaattaaccagcgcaatattagattatgagagttataattaaggcatgtttgacaggctccggccgctagctctagattcatctcttcttaaagtccaatcaaatgatttaaacttcacccagaaaacgaagggctaaagtgatatgaaagagtggaaccgattcaacacggttaatttaggctgcttcatatgtccgttccatactccgtttttagagttagatt

SEQ ID NO: 2685 - DNA, 1501 bp, Oryza sativa
caggttatatttttgtcacatttgttgccttacgcctttacagggatttgtatggcaaacactttgtaacaagctttgttgagatatttacagaaatgccggatcgtacaaatggagtacctttgcttccattgagtaccagggaaaaggatggcaggttgaaggaggagaaagacagcagactgaaggaagagttccataagctattaaacggaaaccatggggatcctactgatcgggtattgtagaagtcttctccctatatactccctgaacaagcctagcttagtacagtcagcctgtctattagatgaacttgcctatactttatactatgctggatcctactttctccgtcccaaaataaacaaacatattatgagatgcgataacctgctcagatcattatactagaatacgtcacatctcatgatttgtttattgagacggagcgagtactactaaatttgtttacaacccttgctagtttaattactccctccatcctaataatatactacctccgtcccaaaatgtagctatttctagcacagtactttatcccaaaatgaagctatttttctacctaccttctcctctcaaccaatcacaaccattttttttcacctactttctcttttcaaccaattacacaccttattcaatcattctcacctactttcttaatacccgtgccaacctaaaaaatgcttacattttgggacggaggaagtacttcctagaatatacttagataatctggatttgacgtaacctagtagcagcttactcccttcgtcccaaaaaaggcaaatcttgggtttccgtgtccaactttgattgtccgtcttatatgaaatttttttataattcgtattttcattgttgttagatgataaaatatgattaatattttatgcgtgacttgtctttttaatttttttcataattttttcaaataagacggacggtcaaacgttggacacggaaaccagggtttgtcttttttttgggtcggagggagtagtttagtatcggattgtattctagtactatgagaatctggatatatacgttcaatctggttttaggttagtattatattttgggagagggattacaacaaaaacctcgatcttgattggaggagccatctactaggcatactggaacaaactgtcacattgcactttttttttctgacgtgtctgtttctatcaattcagcgacagcgcgcgcagatgaacgggaggcacgatgaagacatcaatcacgcccacagcacgctctccgacgctgctgtcaatggtggtacatgagccgcggcatctgctttccaccgggagtttgtcttctcgcgtcgaccccgaggagaatcctctgggggcggattgagaacaaccgcccggtccatctgcatagtgcatgcacatcctgaacaagattccagcggcagaggcagcattacacatggtttccttgtcgatttctgctcatccac

SEQ ID NO: 2686 - DNA, 1501 bp, Oryza sativa
attaaaaaaccacagaacccacttatcaacgctcttccccctctctccttttccctagtcaatctagtttctccttcatgctcggcgcaactacacaactcaggtttggccccgatggtcttgttatggcatcgccaccgccggaggagggagagggatccgttgcggcggtggaaacgcgctagtcaggcgtcggtccgtagggagcgctgcctgtggtatgaggaagaattgggcgggcagcctcaccctgacatcaccgccagcggaggagagggagggatctgctgcagcagcggtggaggatgtggtcagcgaggagcattgccctgtggtaggaggaagaagggacggcctgtgcggtgtccaccgttggacaacaccacaggacgtggtggcgaggctggtgagcaccgtggcagccatttgctgctccctcgtctccaatcgattgggcgagaaccttccaaaagctttgggaagcccacctgatcgagccatggagaagcagaagccaaccctcgacggcccctcctttctctaagctgctccaaggtcgagctctgcttgccccacgcgccgccaggaaggagccgtcaacctcacggcttgagctcttgctggggtgagatcgagggagaagtcgatgctcgctactgctagctccctactccacccaccatcgtgatggtgggacctgctccgcgcgagctgctgctccttgctgctcgggatgtttctggtgctaccactccttgcccgtggtggctacttctgcttctccttgacatgccagatcaagggcgccatctggagctcgagaacttcacccagagagtaacgcgaggagcggaccggggagataacggcgatgatcggcgagggtggaaagaaagaaagaatggaggaggggggctcgtatgctgactctgttgattggactagtcaacaagccacgttagcgtaaaccgctgagggagttaaattacaccagttctagttctaatagttagggtgttataatatctggtattgtggaaatacaaacaagattaaacctatatggagggaggggcttattctttttagaactgctacccaagcacaaggcctacggaagatgaggttttatggataagagaattttgttcggaccaattactgtctcacggacataactggcctggtaatttgtcttaaaaaactaaggttacgttgtttccgaaacacaggactggtttggtttaaggcctaaattaggcttactaatatttggtattttcaatagtgtttagtgtgtatttggtttgaagccaaattttggcatgcctaagaaaataggtcatttcaatagtgaatttaggctattttggcttcaatccaaacacaactttaccttatcaaaattaaacataccaaaacttgctaaaatttgacattgacaaaaattggtaaggcctatttatgccacaaaccaaaccaacccacagtcttttttgtg

SEQ ID NO: 2687 - DNA, 1501 bp, Oryza sativa
attacattgactatagatgatttggagcaagtagtgtgttgcactattgacctcgctctaaatacaaataatcgatctttcactgactgctgcctcggtcaattcggtcacaagctccaagccaagaaatgctctcggttatcttgaaaaccgtacggtctccgtctcctctgatcgtcctatcaccaaacttcgccagctttggagctctgttttcttcggtaaaacccctcttaacaacgtccatttggtacgaccaccggcagtccggcactaattatccgtctaataaaaacacactactagcaggagtactgtacttcattacactgtagctacgtgaaaattatatcgatccatggacgctagcgggcgccgctgcagctgcattttctgacctgttcgcacggcacgcgcatgcgatgcagtgtagacgcaacagctactactactcacgagccaggcagccaggcagtagcagcagcagcagaggcagagtgcgtttctttcaccgaagcggtgcgctgttgcgacgggcgtgtcgctgcggcggcgcaggcgagtggcgaaaggttggccggagcgactcccagaaaggggaggagctacggctgcgctgcgctgccgtgccgcgtgctgtgggagcgtgcaggccggtctggagacaaacgccaaaacaagaagaggaaaaaaaacactctactactcgagctactgaggttcaaaatgctcgtcaaaccgtcgagtctttgtttgcgcgttctttatcgttgttttttcgcctgtctcctggttggtgttcttgcatgtcttggcaatgtagagacagggttagagagtactccctccgtcctaaaaaaagacaaaccttagatttccatgctaatgtttaactgtccgtcttatatgaaatttttttataattagtatttttattgttgttagataataaaacatgattaatactttatgcgtgacttatctttttaattttttttataatttttttaaataagacggatggtcaaatattggacacggaaaccagatttgtctttttttttttgagacggagggagtaatgtatggttatagtactagtactactactgatgtccatcttttatgaactgtgctcgcttgaatcggtcgggaagaacactcgggcccctcgctgctctcttcctccactcgaaacaagatcgcttttggaaaaagttgcgtctttctcgcagcagagagcatccaatgcacacaccaacatttcgtttttcaaaaaagaaggcaaccgtgcatgacgcccatccgattcaaaaggaaaaaaaagcaaagaacttgtagttgtaagcaagtctaatagtataagctaactactggctctaattcatctacagccaaatctaatagctaattcatataataattacagtgcatactacattattaataactggttccacctgtcatacacacattgtgtcttggagtccgtgctatagct

SEQ ID NO: 2688 - DNA, 1501 bp, Oryza sativa; identical to SEQ ID NO: 2677

SEQ ID NO: 2689 - DNA, 1501 bp, Oryza sativa
aagacgtgactcatctactcctaccccccgtgtcaccagggagggggtgtaagagatggcttcatgctaaccttcctgaaggcggcgaagacgaactaggcgaggctcttgagcagcgtgcccggtggcagtggcgcccttctcatcccagcgagctcctcctctgcgctcggtgggccgcaaccacccgatgagctccccggcggctggccggccgtggcctcccgatgagctcctctcccgcgtccggccggctgcggcatcccggcgagcccctcccccgcgcctggcccgccgcgccctcccgacgagctcctccccaacacccgccgccgccgctcgagccgatggaaggcgtgaggctgtaagatatgaggagatgaaagagagatgggaggggtgataggtggccccacgtgggtcccacctattctttttattgtgaatgccatctagatgccacgtgggatgaagaattagtcaatgtgccatgtggatgccacataagctataactggactcaatactgtcttgggggtcgatttgcaccggttttcggagatgaggtagtcgttatacctggtttatctaccctatagttcaacaaatgcttttactcattcatcattcatcatgtcacacatccaatggcccaaaatcaacagaggaggtagatccgaccgcccagcgcatctctcgcatctcccaccacacagagccgcatctcctctcctcgcgctctctccgcatcctccaccatcagcgccgcatctcctcctcggcgtcctagcgctctctcgccccctcgccgccgtgcgcctccccctcgctccctcgccgccgtgcgccggatttttcattgaatcgacgcgctccttctccggactagggaggggaggcgcggcgatggacctcgcgattcccaaccctaacccccgccgccggcgcgtagcgccgccgccgcccctgctgcccaggatccccccgccttttctccttccgcccacctgccaccgacgccgccacccctggcagtgactcctcctccccgccgccaacgccaccgccgtcgacgcctactcctgtggcagtgtggaggactgctgcttccctgtctccatcaggtgtgtgcacgatttgtgtttgttaaaatgcttatgtgaaaaagctgtgggtatacaatgatatgctgcagattatcttttcctgttataggttgatcaataatggtttccttaattcaactttcatattgctgaatcttttggtctacattgatagctgatgcattggggtgtgattatacaaatgatttctgttggtaatgatttttccctaccttgcagacagaggaataccggacagttttttttctttcttttcttctgttggggtgggttcatttcagaaatacccaatttgttaggttgaccacatgtccccattttgatctgcaaggtcacagacaattctcttgtaatgtgtatgtgcattgtttgtc

SEQ ID NO: 2690 - DNA, 1501 bp, Oryza sativa
aaatggttacatccaattaaaaacatatatgagtactctaacctgtttcccttcgtctccaaatcgaacacatgctaggagaaaacacagtgcaaaatgcccaaccaacatctacactgcttcaaacagaataagtatcatgttttttttatgtgtttttttagtgtattggttagtaatatgctgataacatgtgtaacaaattgaagcatgagaaaaggtataacaaaatagttcttgatgtcacgatgacaaagtagtgttattggatagaggggaaaaatgggaaaatacaaagaaacaaaaggtcagctcacgaaattgtctgcctaattctgacagtccttatcagcatccaacattgcccggtcagctaagagtaacagatagcaaaagccaacgttccaacaaatggcatgttctctcgcatgataaggtggttaacgcccaatggacaaccgagtttttgctagcacaaatcctatcatgccctgtctgtaactgtaagtggaacaagtatacgctgacgggacgatttcaccggatccagattttgctgctggtgtcttagttttcaatttttctggccggtacgacggtacgctcgccacatttctgttgtttttatactttcgtaagttacaaccttattactgctttagaaaaaggagttggtgccgctggtataccgtcctctccaatctccatggctcacgtttaaccctcacgtttggccttgaaatatgctcacttcatctccaaataaacaaacaacatatcctcggctgcgttggaggtggcggcggttttgcatcggcggctgctggcgtcggtggctgatgacagcagcagcggcaacggcggccggcttgcggcggccatgactgaggaggcggcggcgacatcggcagatgcggcagtggaggcagggaaggagtcgggtgtgaggtgacggcggcgacagtgaggtggtggtgaccatgacggtggtgggaggaggcatggcggcctcggacggcttgccgagggcgtcgcagacggctacatcggaccggcgcagcatcgtttggaggaggggtcggagaccagcttgacgcagagtggcgcaaccgatggcagtggaggccgactcgacgcgagaggcgcgagtagcggagatggaggtcggcttggcgtgagaggcgcggccgatggagggaggccggattggcgcgagaggcgcgtccggtggaggaggctggcttggcgcgagaagcgcggccggcggtggaagaggcgacctcggtgcgtggtggagctactggtgggtgtggcacggtcttcggcgtacgaaggttggccagcggggggggggggcatcggtgcaggggccccacatgtcggcagagtttgagtggtggtggagcattggtgcgtcagccgtggattcgcaggtggggagcggcgggtgaaaacccagcccggcctttgccggaccgacaacgatggttaattccccctc

SEQ ID NO: 2691 - DNA, 1501 bp, Oryza sativa
ccgtcgggccttgggccttttggccatctatacgggagaggagcgatcgacgcgttcttctctctctccctcccggcgatccttcctcgccggcgagcgcacacggagagagaaaaaggttgcggccggcgaggagggcagagacggtcgctgtccaccgcccgctgcgcgcctcttcctccgcccccaacttgcgattctcgaagcagcagaacatgatctgcaaggaacaaaacaagaaagaaaaaggaaataaatcaaaggatgcacacgcacgccaattagttagcaagaatgatcaaccaagcaaccaaaactaatcaaacaattagttggagtagatggcggagccgagccggcaaatgaaaggcaggattaattgaaaaaggaattttgtttgggttagctagtactacacacctggtgaggaactcggtgatggggtgggaggagatgatgttcgagcggtcgccgttggcggtgcgctcgatctccgggcggaggtcctcgtaggtgacgatggggacgcgcgccttgaacacctcccggtcggtgcgtccttccatgccgtggcggcggaggtactcggtgccgttgttccgcgccaggatcgccgccagcacccgctcctggaccgcgtagaaccccctcgtcatctcctcgatgaactccagcttctccgcgtcacgctcccacgccgccacaacatcccccccccctcctgccaccttcgaccccgcctccgccgcagccaccgcagccggagccatgaagcactcagacggcgcacggatccaatccgaacaccaacggagggcggcgaccaacggatccgccgcctttttccctctccgtgcgctctcgccggcgaggaaggatggccgggagggagagagaaggacgcgccggtcgctcctctcccgtcgtccgtggatagggaggatggtgggtcccactattttttccttttgtctaactgacatgtgggccccacattttgtttttattttttatttttatatttttcttccagtgccacatcaccaccacgtaggacgaggaccaagtcaaaccggtcacgtaggcgccacatcagccaaaaccaccatcaaaaccgttaagggacctgcttttgctgatgcgaaaaacacgaggcgtgagagatctgcttaactccagtgctggtccaaaaatcttgcctttaggttcgtgagcgtgccagttgatttgatcctgccatcaacaagaaataaaaacagaaaagtagtagttaaatccacaaacgatagtcgatcggttagctgccgatgacgtttcatttatctttgagccgatgtcatatatgaatcgatcggcaatcataaataagcataaaagaattaaatctattcgatcggctgtagatatcaatggtatataatacttctgtcgatatatacttaaatcaagtgattgggatagatcggtcgccatgccgagacagtataaatcacttagatca

SEQ ID NO: 2692 - DNA, 1501 bp, Oryza sativa
cgctatcatcccccttcttatccttttgcttatcatccttcttatcatcacccaagtcatcaacatcatcatccccattcccaggatcagagttaccattcacacctgttgctacattaaataacgaatcgttgatcattcatgaatgttaggagtttccacctctcagtctttatatcattcatctcctccaacagtactgctcattacctctgtctacatcccactccgtccaagaaaacaaactagggaatgtgacgaggggctatatcaaaacggcaatacatcctctccttggacattaatgaagagcatagtagtgttttacctccttaatctgcctttgactagctgaaaatacagtttttttacagacgaagggaggaggctgaatgtatcctctctctgggcgtacgaggcattaggaaagcataggtagtactgtgccaagaccaaatgtaaccctggtgttaagaagtgacggcaaattcttaagacactgtatgtcaactagtgaatggttgtcagatggctgctgaaaggcaacattgcgttctaaccatggccaagagcttcccacattgtcagctgtaacatcaaaatgtttgattgttattttgtgatgaataattggcatatgaaattattggttttgatattcagaaattattgacgaagtggttttttaaggatagtaaaggacatttcccaccccaaaacctagccaacgaggtgaggggctcccccacttatatattaggtcatttacccttccttaaccaatgtaggactattaaacaatctcccccttcacattggtgttccttagctattccccgccccttcatcgtatccccatggttcctcaagcatacaggctccgcaagcacacacggtcggtccataagggcatcacacactttgccctcgggtcgaaggttgaacaagccagactctgataccaattgtagaatcgtaaagggcttttcccaccccaaaagctaacaaatgaggtgaggggctctcccacttatatattaggacctttacccttacacaaccaacgtgaaacacttcacagttttagagatgtgtgactttcagatgacgaaaaagagattgttgacagtgtagtctagtcaaatgggcaggtgttgccggtaagaccggcatatgttgtgcggtcagactggccaacccgacggtctaaccatccgattttgtctcggtttcgattttggattgtttctttggatatccgtgattaaatcatgtttatgatttccaaatggatactatgcgtatgtaatagtattgtgtattaatgttgagtcaagttggagataacttgtgctcggatatggtttctttgttggttcatatgtaggtgagtcttgatgcttcgggagagcgttgtcggtgatggatggagagtcaacttgggagaagatgacgtccggacgatcaggataacatgcgggatgcttaggctaaaaatcaa

SEQ ID NO: 2693 - DNA, 1501 bp, Oryza sativa
tttcataataagaaaaattgagaaaagagtgttttgttttatacatatagtatatttttgtgcatgctagcaatactatgaaggtttatttgtctctagcatagcttgtatgtattttagtctttttatgaggcttagatattggttttaagggagatgatgcatgacacttaaactctatacttgaattaagaaaatatgcaatattaatgttagtatatggtttgatttataaatgcttatatgtatatgctttattgattttttattcctcaaatagcttcgtaatttctcattgtacaagagaataaaatatctatgagagaaaaaaatgaataccgaatccttggaaacagtcttgatgacaaggacgtattcgatgtgggcaaaaattatggctgccgaatcctcggaaacagtctcgacgacaaggatgtacccggaataattgagagaaaaaaatatgagcaaaaaggttcaaataaaagataaaaattctcttggttgttttgtgctaaagctaatttgagaaagaatgctaaatgcaataggtatatatatatagtgtttatttttcaacctatgtgcttgtaaagatgttgcattataaatcgtatgaaatcttaaattttgattgttgaattgatcttatttgtaatatatttgattcatgattgtactttaatgcatgcttgctatattacagatgggttcatcttctttttattacaacacatgacttgatgtgctatatgtatgctaagctcttaaatattaatgaatataatttctatgcttgatgaattcattgttaaaagggggagaagagaagtttttcagaagagcatgtttttctgtttttcggacaagggagaatttctttctcttcaaaagtgagagaagttttcttttagattttgagcacgacgtgtacttttgtacgaagtgtgctttttactatttttgtttttattttttcaaacaacaaaacatttttgatgagtttgccaatgtgttcatgaagggggagattgtaaaatcaaagtattttttattcttattttgtgatgaataattggcatatgagattattggttttggagatgattgattttcaggtgatgaacagtgttgctgtttttgtcaggaccggtcaaaccgggctgtgcttgccggtcagaccggatttatgtgcatggcgcggtctgaccggccgactctgtgtcagttttggtttcaggttgtttgtttggatatccgtgattgttccatgtttatggcttctagatagatactatgcatatgtaatactgttgtttgcaaataatgagtcaagttggagatagcttggtcttggaatatggtttcttggtttgattcatgtgtaggtgacttgatgcctcgggagagtattgccggtgatggatcaggagtcgacttggggataaggcgatgtccgtgatggtcagatatcatgcgggatacttaggctacagttcaa

SEQ ID NO: 2694 - DNA, 1501 bp, Oryza sativa
tcctttttctcctcctcccattacatggccctaggggactatttatagtctcattacgggttcttactactagggtttaggttatacaggggaatttacatgattacccttacgaaagggacatttacaggggtacataatgttataggggctcatgggcccctgatgggccgtccggcgatcgccggccctatagcccctaggcttgatgggccggaaaggcttcttcggccctcgcgggtgcgaacttgctatggcgaagtcgtcttccttcggcagatagtcttcaccttgcacccttcgcctgagacgcctctgacctggcaaggcactagtacgactcttcgcctcacgccgttcttgctccatagcctttgccacgggtttcggcagatgtggtcgcagggcctcatgccatccgccaacaagctcctcacgggcaagggtgagattggagcttcggccgagaccgtgcaaaccatgtggtatggtatgcggcaccacctttcgactgatgctcctgccgaaacctacattattcccgcgcttcgcctcctgcgattggtggttatatattttcttttcccgggccgaacggaacagtattgggctttcccttcgtgggctttttactgtgccgctcggtcggtgggaatttaccgtttcgcctacccttgcgacacgtggcgctttattactggtgggtaggcgaacagtcgcccgggtgagctatatattcccaccgctctttccttttcaccgccacacttgccattttaccgcgtgcactctcttcctccgtttctttcttccacagcatctctccacccctcaagcgtttcgcccattctctttcttcgccaccgcaaacgcaccattctccatggcccctcgcaagccaaaccctgcttcggcgaaagggccggatcccggccgagtcgatgacgacagcaccgcctttttaggggtctctcttgtggatgacgtcgagctggcgaagctggacagctctggggcgttggttgaggggtaggctttcaccccagggaaagccatggtgccgaaacctatcgacaatcggacggtggtattcgccgtcttttttgaggcagggctacggtttccctgcaacgtgttgttgccggagatccttcgcctcttccaggtggaacttccacagctaagcccgtcggcgcttgttcggatcgctatcttcgactgggcgtgccggacttccgggtttgagcctaacgccgagctcttcggcgccatatttttcgccaccgtgaactcgaagacggtgattaccccggcttcaacgaagaagacagtgttcgggagcgtgaactttaacattcgtcccgagcggtccgatctctggccggtgaatgctgccatgtcgaagtgggaccgccattggatggctaggtggttctatcacaccatcccttcgaggctggcactgactcggcgaaagccctccattgccggcgtagggcga

SEQ ID NO: 2695 - DNA, 1501 bp, Oryza sativa
tatagaatagatttactgggaaaaattaatctgatattatataatttgaattgaatcacgaatgctaaattatagaaatccatgtggtggtaaaaaccaatcaaaaagataaaccaatatgtgtgaaaacggataaataccaaaatcccaaatataggaaaacaggaaaaattagaaaaatacataataaaaataaaatgtgggcaatattaagtttgaatacaaatttacatttgaataacttagattttgtgtgaaacacattgtgacaaaataggtggcaatagtccattttctaaattagaaaaacatctaataaaatccaataaatcagttaacactgttcattgccccctaggtgcttgaccctgtcccatcgccgcgcctagccctgcccctactctgccgcgccacgcctagccctgctgcgccactgccttgtgccccgcgccgccgcacgccgtcatgtcgccgtcgccccgacgcgctgtgcgccatcggttcgcactgcgcgcgccgctgccgtgccccctcgcgtcccgtcgtgccgcgcgccgtcgccgtcgttggtcgcatcgtctcgagccccactcctccgcgcgtgccttcaccgtcgcgtcatcatcatcgtcgcgtgtcgccatcacctcgagccccgcgccgctcgtgtcgccgtcgcccgtgccgcgccgagccccgcgccgctgccgcgccgtcgtcgtcgcccgtcgcgtcgcccttgagccccgcgcccccataccaccgagtcatgcgcgtgcgccgcacgaacgtcgcgtcaccgtggttgtcgtgctgccatcgccatcgcgccgatgcatcgccgcctgtcgccctcgcgactgcgcaccaccgcatcgcccatcccgtcgccgtgcatccgttgccgcgccccctcgcgtcccgtcgcgccacgcgccgtcgctgtcgccgttgcgtcggctccactgccgcaccgcgcgccatcgccatcagcgcctcgagacccacacgcgctgcgcactgtcgctgtcatcattaggcaccgcccaacccctccgcctatataaacccccccgggcgcccattgcttcccacaccaccctcaccacctcccctccctttcccctctctttcccgtccccggcatcgccgcctctttggaagccaccgccgccgctgagccgacatgccccgccgccgcgctgtgcctcgtcgccacgccgtgctccaacgtcgacccctccgctgcgtctccgttgaccccgccgtcagtccggtgagccttcccctcccccaccgcttgacgtcgcgccgcgccgcccgccggttccagccgagccgcgagagagagaggaagcaaagaggttgcgcagagagagagaagagaaaggagaggagagaggttagagtgggccccacgtgattagtaaatagtaatccccttcttaatctttataagttaagtctattacatgtgggtccgagtggttaaaaatctagt

SEQ ID NO: 2696 - DNA, 1501 bp, Oryza sativa
ctgggggcggggagagggccgtaccgcttgaacgggttggatcctccctccgcgaaggctcgcggcggggaggactttgagagccatggcgatggtgacgagggtcacggttttcgcccgaatccccactcccagacggggtgggggtaggcgccaccgcttcctctgcttccaggacctcgaccatggcggtctagggcctggtccgacctgggacggaaggaagcgacttcttctcaaacgcgcaactgccccctacttggcgtgccagctgtcgagggaagacccccgatcgcggggagtcgcgtgacccccctttcgtgagttcggccgggggcagagactcgtctctccgaagtcgcgtgttcgtccctccgatccccgattagctagcacacaaatggattacctaggttcaggccgctctggagcgtaataccctactcctacgtttgggattatcagtgaattttaaaaggtttccctcgctccccctctttttggtgggcaaggtcctccttttatagcttaaggggataccatatgcgccgtctctaccctccccctccatcggagggaggggagggggcctttctccctactgcgaccgggtttcaacccgtgccttttgttggaagctaagcatcggtcggtccttgagtggggcccagcgccgtctcccgcctgacacggggggcagccctgtcattccctcataaacgagggaagacttgcggcaagccctgcatcaaacgccgtccggatgtgatggggcgtacctaccgccactccgcggagacagaggcgacgtgggggcacgaccgcccgtccaatcggccgtgaccggcaatagactggtcacagaccggtcgcatccgactgacaggggtcggtcgggcgcaccgcacgtctgcccccgccgcattgaatgcagcgagggacggttggggcgctgcacatttatggccgcccagcctggactcccctctcacacttccccccgagagagggcctcggggtaaaacgacgggagagcccgagggggtgacgtcacccccgaggggatgtcgtcgacccccgaggctctccccttcgccttagtgactcacgaggtatgtgggtgggaccagctcgcggagccgtgtggctggaaagggaagtagctctcctttactccacatacccccgggcctatatctccgacagatgtgatagggtgtaacatttttgtgcaggaaacatgacctttgtttttaagaccggatggagcactttgttaggcggtttgggagtttggaacttgtgcaaaacggtgtgttttaaaaattaaaaccattgctctcgtacataccagatatttataactaacggtcgagaagttcaaaatgtgtccaaaggttgagaagtttaaaatgtatccaaatcaacatattttcaatatttgagggagtaacgtgatataagaccatatatttataactaatggccgataagtttaaaa

SEQ ID NO: 2697 - DNA, 1501 bp, Oryza sativa
agctagctgtagcacggactcctaaatgctacgtgtgtatgacaagtgggagcagtaattaatgatgtactatatatttgtagttaactattgtataatttggctattagattatctataaataatttggagctagtagttggctatatactattaaaattcctctaagcggcaaaggccgtgttcgattattagtgttagaaactaaccctttgagcacgtaaaacgaaacggttcattaatgcataattaattaagtattagttatttcttaaaaatgagttaacatgattattcaaataactttcatacatacatacgttttaaaaaaaaacgcaccgtttaaccgtttgaaaagcacacatgtgaaaaatgagatagataagtaggaaaatacgataaagaatacttcctccatatcaaaatataagccttttttttttgtttttgacttcgacacggttttaaagatgctacattgataaacgatattcataaaagtaaaatattttaaataaaaagagttacatactgtgatagtttgtttaatgctaaatctagtaatatcattttttttagattgatcttttttaatttattttttcttattaataatcaaaggacttgacactatacttaaaaaatacttatattttttatattttagtacggagggaatacaaagttaaaatccgtcatcttctatgacagaagtagtaacacgaaattaatttagctctacatccgttctgtttatgaataacggtcgaaaacgtaataacccaaccacgacgacatgaaaaaaagaaagacagataaaacggtcgaataactaaaacaacttgctactactatttgaaatttgaacaactgtaacggcccaaaaactggggagtggattctaatccctcgagggatatcccctcgtatacctttttcttccaaattcgatacaaatagttatgaaaaattctgaaaaaaattaacaatgtagagtataatgatacctactagtccaccaaaattcatgttcaaattcgatctacacatcgagaaacaaaagaagacaaatttagatataaacagtacgctactattcatacgctgaatttgtctttttatatctcgacgtgtgagttgagtttggaattaagattttgtagagttgtatatatgtgttgtatgaatgttgtcaaattttttcagtatttttcataaccgtttagatggtttttgagcaaacgagggaacatcctcgagggattagaatagtttccccaaaaactggaaataatcgaaagagtcgtcgccattttctctcttctcctcctccgctcctctgagtcctctcctctccggctctcccctcctctgtcgggaagggaaggatccaagccctcgccctgctccgcctctgatccccgccggccgccgccgccctcgcaaccctcgcagcagcagcaggaggaggagggttcaggtggtggttgccgtcggccga

SEQ ID NO: 2698 - DNA, 1501 bp, Oryza sativa
cctgggggcggggagagggccgtaccgcttgaacgggttggatcctccctccgcgaaggctcgcggcggggaggactttgagagccatggcgatggtgacgagggtcacggttttcgcccgaatccccactcccagacggggtgggggtaggcgccaccgcttcctctgcttccaggacctcgaccatggcggtctagggcctggtccgacctgggacggaaggaagcgacttcttctcaaacgcgcaactgccccctacttggcgtgccagctgtcgagggaagacccccgatcgcggggagtcgcgtgacccccctttcgtgagttcggccgggggcagagactcgtctctccgaagtcgcgtgttcgtccctccgatccccgattagctagcacacaaatggattacctaggttcaggccgctctggagcgtaataccctactcctacgtttgggattatcagtgaattttaaaaggtttccctcgctccccctctttttggtgggcaaggtcctccttttatagcttaaggggataccatatgcgccgtctctaccctccccctccatcggagggaggggagggggcccttctccctactgcgaccgggtttcaacccgtgccttttgttggaagctaagcatcggtcggtccttgagtggggcccagcgccgtctcccgcctgacacggggggcagccctgtcattccctcataaacgagggaagacttgcggcagccctgcatcaaacgccgtccggatgtgatggggcgtacctaccgccactccgcggagacagaggcgacgtgggggcacgaccgcccgtccaatcggccgtgaccggcaatagactggtcacagaccggtcgcatccgactgacaggggtcggtcgggcgcgccgcacgtctgcccccgccgcattgaatgcagcgagggacggttggggcgctgcacatttatggccgcccagcctggactcccctctcacacttccccccgagggagggcctcggggtaaaacgacgggagagcccgagggggtgacgtcacccccgaggggatgtcgtcgacccccgaggctctccccttcgccctagtgactcacgaggtatgtgggtgggaccagctcgcggagccgtgtggctggaaagggaagtagctctcctttactccacatacccccgggcctatatctccgacagatgtgatagggtgtaacatttttgtgcaggaaacatgacctttgtttttaagaccggatggagcactttgttaggcggtttgggagtttggaacttgtgcaaaacggtgtgttttaaaaattaaaaccattgctctcgtacataccagatatttataactaacggtcgagaagttcaaaatgtgtccaaaggttgagaagtttaaaatgtatccaaatcaacatattttcaatatttgagggagtaacgtgatataagaccatatatttataactaatggccgataagtttaaaa

SEQ ID NO: 2699 - DNA, 1501 bp, Oryza sativa
ttacgttttcgaccgttattcataaacagaacggatgtagagctaaattaatttcgtgttactacttctgtcatagaagatgacggattttaactttgtattccctccgtactaaaatataaaaaatataagtattttttaagtatagtgtcaagtcctttgattattaataagaaaaaataaattaaaaaagatcaatctaaaaaaaatgatattactagatttagcattaaacaaactatcacagtatgtaactctttttatttaaaatattttacttttatgaatatcgtttatcaatgtagcatctttaaaaccgtgtcgaagtcaaaaacaaaaaaaaaaggcttatattttgatatggaggaagtattctttatcgtattttcctacttatctatctcatttttcacatgtgtgcttttcaaacggttaaacggtgcgttttttttaaaacgtatgtatgtatgaaagttatttgaataatcatgttaactcatttttaagaaataactaatacttaattaattatgcattaatgaaccgtttcgttttacgtgctcaaagggttagtttctaacactaataatcgaacacggcctttgccgcttagaggaattttaatagtatatagccaactactagctccaaattatttatagataatctaatagccaaattatacaatagttaactacaaatatatactacatcattaattactgctcccacttgtcatacacacgtagcatttaggagtccgtgctacagctagctacaaatctgcagcctgcttcttttctatctcctctctttatgttcaccacataagcttgtagccgacttatagtctattattgtacatgctattagatttttatatttgaacttggaatgtagtatccaaaataactttgggggtgtttagatccaggagtgtaaagtttttgcgtttcacatcgggtattatatagggtgtcgcatggggtgttcgggcactaataaaaaaactaattgtagtatccgtcagtaaaccgcgagactaatttattaaacctaattaatccgtcattaacagatgtttattatatcaccacattgtcaaaatcatggagcaattaggcttaaaagattcgtctcgcaaattagtcgcaatctgtgtaattagttatttttttagcttatatttaatacttcaaacgttcgatgtgatagggtgtaacatttttgtgcaggaaacatgacctttgtttttaagaccggatggagcactttgataggccgtttgggagtttggaacttgtgcaaaacggtgtgttttaaaaattaaaaccattgctctcgtacataccagatatttataactaacggtcgagaagttcaaaatgtgtccaaaggttgagaagtttaaaatgtatccaaatcaacatattttcaatatttgagggagtaacgtgatataagaccatatatttataactaatggccgataagtttaaaa

SEQ ID NO: 2700 - DNA, 1501 bp, Oryza sativa
cctgggggcggggagagggccgtaccgcttgaacgggttggatcctccctccgcgaaggctcgcggcggggaggactttgagagccatggcgatggtgacgagggtcacggttttcgcccgaatccccactcccagacggggtgggggtaggcgccaccgcttcctctgcttccaggacctcgaccatggcggtctagggcctggtccgacctgggacggaaggaagcgacttcttctcaaacgcgcaactgccccctacttggcgtgccagctgtcgagggaagacccccgatcgcggggagtcgcgtgacccccctttcgtgagttcggccgggggcagagactcgtctctccgaagtcgcgtgttcgtccctccgatccccgattagctagcacacaaatggattacctaggttcaggccgctctggagcgtaataccctactcctacgtttgggattatcagtgaattttaaaaggtttccctcgctccccctctttttggtgggcaaggtcctccttttatagcttaaggggataccatatgcgccgtctctaccctccccctccatcggagggaggggagggggcccttctccctactgcgaccgggtttcaacccgtgccttttgttggaagctaagcatcggtcggtccttgagtggggcccagcgccgtctcccgcctgacacggggggcagccctgtcattccctcataaacgagggaagacttgcggcagccctgcatcaaacgccgtccggatgtgatggggcgtacctaccgccactccgcggagacagaggcgacgtgggggcacgaccgcccgtccaatcggccgtgaccggcaatagactggtcacagaccggtcgcatccgactgacaggggtcggtcgggcgcaccgcacgtctgcccccgccgcattgaatgcagcgagggacggttggggcgctgcacatttatggccgcccagcctggactcccctctcacacttccccccgagagagggcctcggggtaaaacgacgggagagcccgagggggtgacgtcacccccgaggggatgtcgtcgacccccgaggctctccccttcgccttagtgactcacgaggtatgtgggtgggaccagctcgcggagccgtgtggctggaaagggaagtagctctcctttactccacatacccccgggcctatatctccgacagatgtgatagggtgtaacatttttgtgcaggaaacatgacctttgtttttaagaccggatggagcactttgttaggcggtttgggagtttggaacttgtgcaaaacggtgtgttttaaaaattaaaaccattgctctcgtacataccagatatttataactaacggtcgagaagttcaaaatgtgtccaaaggttgagaagtttaaaatgtatccaaatcaacatattttcaatatttgagggagtaacgtgatataagaccatatatttataactaatggccgataagtttaaaa

SEQ ID NO: 2701 - DNA, 1501 bp, Oryza sativa
tagctagctgtagcacggactcctaaatgctacgtgtgtatgacaagtgggagcagtaattaatgatgtagtatatatttgtagttaactattgtataatttggctattagattatctataaataatttggagctagtagttggctatatactattaaaattcctctaagcggcaaaggccgtgttcgattattagtgttagaaactaaccctttgagcacgtaaaacgaaacggttcattaatgcataattaattaagtattagttatttcttaaaaatgagttaacatgattattcaaataactttcatacatacatacgttttaaaaaaaacgcaccgtttaaccgtttgaaaagcacacatgtgaaaaatgagatagataagtaggaaaatacgataaagaatacttcctccatatcaaaatataagccttttttttttgtttttgacttcgacacggttttaaagatgctacattgataaacgatattcataaaagtaaaatattttaaataaaaagagttacatactgtgatagtttgtttaatgctaaatctagtaatatcattttttttagattgatcttttttaatttattttttcttattaataatcaaaggacttgacactatacttaaaaaatacttatattttttatattttagtacggagggaatacaaagttaaaatccgtcatcttctatgacagaagtagtaacacgaaattaatttagctctacatccgttctgtttatgaataacggtcgaaaacgtaataacccaaccacgacgacatgaaaaaaagaaagacagataaaacggtcgaataactaaaacaagttgctactactatttgaaatttgaacaactgtaacggcccaaaaactggggagtggattctaatccctcgagggatatcccctcgtatacctttttcttccaaattcgatacaaatagttatgaaaaattctgaaaaaaattaacaatgtagagtataatgatacctactagtccaccaaaattcatgttcaaattcgatctacacatcgagaaacaaaagaagacaaatttagatataaacagtacgctactattcatacgctgaatttgtctttttatatctcgacgtgtgagttgagtttggaattaagattttgtagagttgtatatatgtgttgtatgaatgttgtcaaattttttcagtatttttcataaccgtttagatggtttttgagcaaacgagggaacatcctcgagggattagaatattttccccaaaaactggaaataatcgaaagagtcgtcgccattttctctcttctcctcctccgctcctctgagtcctctcctctccggctctcccctcctctgtcgggaagggaaggatccaagccctcgccctgctccgcctctgatccccgccggccgccgccgccctcgcaaccctcgcagcagcagcaggaggaggagggttcaggtggtggttgccgtcggccga

SEQ ID NO: 2702 - DNA, 1501 bp, Oryza sativa
tccagccacacggctccgcgagctggtcccacccacatacctcgtgagtcactaaggcgaaggggagagcctcgggggtcgacgacatcccctcgggggtgacgtcaccccctcgggctctcccgtcgttttaccccgaggccctctctcggggggaagtgtgagaggggagtccaggctgggcggccataaatgtgcagcgccccaaccgtccctcgctgcattcaatgcggcgggggcagacgtgcggtgcgcccgaccgacccctgtcagtcggatgcgaccggtctgtgaccagtctattgccggtcacggccgattggacgggcggtcgtgcccccacgtcgcctctgtctccgcggagtggcggtaggtacgccccatcacatccggacggcgtttgatgcagggctgccgcaagtcttccctcgtttatgagggaatgacagggctgccccccgtgtcaggcgggagacggcgctgggccccactcaaggaccgaccgatgcttagcttccaacaaaaggcacgggttgaaacccggtcgcagtagggagaagggccccctcccctccctccgatggagggggagggtagagacggcgcatatggtatccccttaagctataaaaggaggaccttgcccaccaaaaagagggggagcgagggaaaccttttaaaattcactgataatcccaaacgtaggagtagggtattacgctccagagcggcctgaacctaggtaatccatttgtgtgctagctaatcggggatcggagggacgaacacgcgacttcggagagacgagtctctgcccccggccgaactcacgaaaggggggtcacgcgactccccgcgatcgggggtcttccctcgacagctggcacgccaagtagggggcagttgcgcgtttgagaagaagtcgcttccttccgtcccaggtcggaccaggccctagaccgccatggtcgaggtcctggaagcagaggaagcggtggcgcctacccccaccccgtctgggagtggggattcgggcgaaaaccgtgaccctcgtcaccatcgccatggctctcaaagtcctccccgccgcgagccttcgcggagggaggatccaacccgttcaagcggtacggccctctccccgcccccaggaggagggaggtcgcgacgcgtcggagcacgtcgccgtctcgactacggagacggtggttcgccccaaggcgcgcttcaggtggtgggcgcccttctgcggcatccccaggtgaacccggagccggagacccccgtgcggcgctggctggacgacgtggccaacttggtcaccgctgcccagcggcagttggccacgggtggccaatccaccgccacaggtacatcgagtaccccggctaccctttcctcgtcggcgaggagaagggcccgtcgatcggccacaaccttgaggcgatccacggctccaacgacatcggaggtctcgggaaggcggaggcgtcatgatgac

SEQ ID NO: 2703 - DNA, 1501 bp, Oryza sativa
ggaagaacacttttgatatgatcggccaaagatttagaaatgattttataagaaacattgcaaagactgattggcctaaaatcagcaggagaagtaggataattttttttaggaataagagtaatattagtatcattcataccttttggaaattggcctgaaacataaaagtcttgaaccgtttgagtgatgtcagatttaatccaaggccaagaaactctataaaaaccaacattaaggccatcaggtccaggagaccgattagattgtgttgcttgtagtacactgtaccattaaatttcacttctcttgatttgtgggcattttgcagggaatgttccatttgccacgttatgtgctcttagctttagaatgagtgttggggcattagcaatgcgtcctgtttttccgaggagcctaaacagccacgtacagaaaacagcgaagctcctcctctccacaatgcggcatggattcaggtggaccccaccaaacattttcctatgcgagccccatcactaaaattacttttttcggcgagcttctcccccttctctctttgtaattacctttttttcggtgagcttctcccccttctctctttgtgtcatgctttctcacgtgcagatgctgagatgcgattgaaaaagctgttttcttctgacgaggctctcggacacgcgaagctagtgaagacatgggccccacctccttttcttctccacgtatacaatcagtctagttggagagttgaggccaaatgccatgtagatgcattgtgaatgaccttatattcttgttatctatagcatcttaaaaagacagcaaccgtagtgtccgtttccgcgactgccagactaggcccgcattgtcagtgggagagggagcggatcaggccacgcgcgtgtgaggtagataggcggtgggatatgtgcggcctgcggggaaggagggggtgccagatcggagtgggagagagagagagagtagaggaaacaagagagaagtgggagagtgacggagagctcctgatcaccaagcgggcgctggatcagcccctcccgtcgccgtcactgatggatccatgcgtgtggggaaggcaaagaggcggctggatctatcgacgagaagggggacagatgagggcgggcgcaccaactgctggaagacggccacgtcagcaccgtcgttggcgcgcgctacggcggtgcgggtgctggccacggacccagatccaagcggcgtggcgtgtgtgcgatgtgatgtgaacggggaacgagtgcgggcgtggtcgtgtggggcagtgagtggaccggggttagagttagcaatcagggttaggcatgatgatgggctgctgggctgttcgtgggcttctatgccttgtgcaaagatcatgtggccaaaaaaacgtcaaatgccaggaaaaaaatcacgcgggagatgtttggcaaaatcgtaagacgtagcatttgtcttaagttggtcctgaaatttcatt

SEQ ID NO: 2704 - DNA, 1501 bp, Oryza sativa; identical to SEQ ID NO: 2703

SEQ ID NO: 2705 - DNA, 1501 bp, Oryza sativa
ccttatttatctccttaaaatatgtttgcagctagcttacagcttgctattgtacctgcgctaattaaaatctataacaataccagtgttaggatttcattaaccttttcaattataatgtataatgatcccaataatttaatttattgctcagctcttttacccgttgcaatgtacgtgtatttttatagtacaacaaaaaatttaaataattacgacactaatatattgtggcaagaaattgtaattgctaccacggagattaaaatcgtggctgtagtacttttgtattgcaacagtaatttttatcgttgtaatagcccatttttcattgcaacaaattccaaaatatcacaacaaatttatattgtggcgatatattaatattaaataaaaaaataaaattgtggtagctgagtaactaattgtaacaatttatatgtccttgcaatatatatgtggcaatagttaatttttcctgtagtgtggtgagcccttaaattgatgaggagtccagctgccagcaatcgctcaaggttagatcagaaatgatctacgtcgtcgatctgcccgatcgccacggcgatccgatgcttcgtgtgatgctccaacagcccatccgactgccacatcaccaaagagccagcaaaccatggatcgaccagcatcagcacattccatactccaatcctgtccacgacgcgattagcattgagaagatgaccggcaaaaaagaattactcttcctccgttctaaaatataagtatttttaaaattagacacggttattaaaaaaatagataaaagcaaacggtagagagttgtgattggttgagtagtagaggtaggtaagaaaagtgaatggtggagagttgtgattggttgagaagaaaatattggtagagaagttgttatattttgaaataaatcttgagagttaaaagttattacattttgggacgaagggagtaccatattgcaggaccactgcgtcgtcgtggcttgctcctacttctaccacgttgctgctgccgcaaccaaggatcgcatcgtggctccccaaggctatcgacgtccgcagcttctatcgcatcccacacctcccaccgctggccgccactccattcctcagctttgcttccggccgtcgcaatcgaggatactaaagccgggtgctgtcgctgccgcatgtaggaaatagaaatgaggagggaagaggatgacaggacaggaggataaaatagacatttcacaccctacatacatactagcaatctcatttatcccgccacgtaggtaaaattggcataaacttaagaatttctctctttttgatgacaaattagtaagcgcaaatctaaaaagaatatttgaataattgtgaaatgtaaaagtgataaataattaaattccccttttttgcgtggctttagtgaaggcctttgtttgttttagggctgatacgaccaattcatagccaaaaacattttataccaggga

SEQ ID NO: 2706 - DNA, 1501 bp, Oryza sativa
tttccatacatctaaacgtcttatcaaaggggggaattgagtagttccttttgggcaaacgtacttcatgatttgctaagataaattcatgaacttatcatagcattgaagattctataaaccttcataaaatgcttttggtagtgcaaatgcatacgaaaacaaaacattttataaaccaaggtaaaataaagaccaaataattttacctcataaggtatcctatccagatcagcatgctacaagaagtgcatttctcgttccaaaaagaaactttctttctagtcttgagatctgaacctcttgctccatttgataagaagctgttcaatgtcagcatccattcttgtgcccctacctccccagactaacatgtgagcaagatcaatcattgaagatccgtctacctcatgcactgttttgaaacccattctcgaatagaacctaacgagctgattagaaaggaaacactggtaagaacaccatcacgcgctgcttaaacaaaatgcaggacaaaaaaagtccaccaataaaatgaaacgaaaatattgcaatatgtggagatccagcacttcaaaacaaggaactgtgattttgtgaatcaatacttgcaaatatccaaatctaaatgttgtctcagcgggaataacgccattatcgacaaggtgaaccctaggaaatgataaacaaatcaaaactatttcttctcatcaattgtgctacccattgtttccaaggtgctttcctttgtgaattatatcaaagcgaatcacagcttgagcaattcgtcgaacaccatgcgcgcagcaacatatcaccaccactacgcagcagcccaggctgcaatagtatgttgtatgtaccttggagtggtagagatccgtgtcgttgatggcaagtagctcggcgcgcttgcagccggcgtcgaagccgtggcgcacggcgacggcgccgaggaagacgccgagcccgaacagcggccggtcgggcacctgcagcgtggcgcgggacatcctcatggagtcgaggtgcagcacggcgccgcctggccacgggcggacgacgccctgggcacggcccagctccacctcctccgtctccccctccccgccgctgccgccgccgcggcgcgccgcggtgacgcggaagaaggggccgagcgtggtgaggcgcacgcgcaggccctgcgcgcgcgacgcagacatgatgtccgccatggtagggaagacgacggaagcgcgcgcggcggggctcgccgccggcgtgggcggcgcgggcgcggccatggagagagatgaggggttggggtggagcgtggacacgtggcgagcgatgagctgaagatatttgggtgagggctgcggctggctggctgctgcggtggtgggttcagcagcgccgcgcgaaagaaatcgagtatttctttttcgaagaaaaaaattgttctactaccttcttaagatataaaaaataaaaaagaaaatctttcttatgcatttcc

SEQ ID NO: 2707 - DNA, 1501 bp, Oryza sativa
caaaatgtaataacttttaactctcaagatttatttcaaaatataacaacttctctaccaatattttcttctcaaccaatcacaactctccaccattcacttttcttacctacctctactactcaaccaatcacaactctctaccgtttgcttttatctatttttttaataaccgtgtctaattttaaaaatacttatattttagaacggaggaagagtaattcttttttgccggtcatcttctcaatgctaatcgcgtcgtggacaggattggagtatggaatgtgctgatgctggtcgatccatggtttgctggctctttggtgatgtggcagtcggatgggctgttggagcatcacacgaagcatcggatcgccgtggcgatcgggcagatcgacgacgtagatcatttctgatctaaccttgagcgattgctggcagctggactcctcatcaatttaagggctcaccacactacaggaaaaattaactattgccacatatatattgcaaggacatataaattgttacaattagttactcagctaccacaattttatttttttatttaatattaatatatcgccacaatataaatttgttgtgatattttggaatttgttgcaatgaaaaatgggctattacaacgataaaaattactgttgcaatacaaaagtactacagccacgattttaatctccgtggtagcaattacaatttcttgccacaatatattagtgtcgtaattatttaaattttttgttgtactataaaaatacacgtacattgcaacgggtaaaagagctgagcaataaattaaattattgggatcattatacattataattgaaaaggttaatgaaatcctaacactggtattgttatagattttaattagcgcaggtacaatagcaagctgtaagctagctgcaaacatattttaaggagataaataaggagagagaagagcagcgggctacagatttgtagccagctgtagtacggactctaagacacagtgtatgtatgacatgtcagaccagttattgacaatgtagtatgtaactattatataaatgagctattaaattggctataaatgaattgaagctaatagttggctgtactattaaacttgctcttaaaaaagttaatgaaaatctttcctaggttttgggccgaaagcctttctttcttttcagcccatggccaatccactacctccctccgtttagcctgctttcctttgacccagccacaagtggaccccataagaccagctcgaacagtccaataccatcttcaacctctcgaagatagtcccgtgcccgtacggttgctggagcaatcacccaaaattggttgagggtttttatccactcgatctactcttttcgtttttttccaaaatcatagcgtaaaactcaagataaaaacgaaaaatgattgaaagtttttgatcactcgatctactctttcctttttttttctagcgtaaaac

SEQ ID NO: 2708 - DNA, 1501 bp, Oryza sativa
gaggacccgtgctcggggagggggaggtggaggtcgcggtggcgacaggagctcggggttggaggctaaggccggtgcattggatccgatcttggtggaaggaaatgagagagagagggagagagggagagagagagagagtgaaagagagaagaaaatgagtgggtgggagagtgatatgggtattgttcggtggttttcatctgtgatgggtaaaaaagggaaccgttagagatgactgtcctcatcttcgacggattatgtctataaacccctacaggtgtgttgtcacctatgatggcctatatgtgggcttgttagaggtgttctttatcgggttcacaaatgggcccgtcacaattaagttcttagctgtgacgagctgtgcccgtggggccttatctagagtgggctttagtttagcccgttagaggcgaggtacttctgcccatcataggtaggccttagtgaggttatcttggtggagcatttatggagtcttttctgattcttatgcaacatctgatacctgtgcagcttccaataaaatatcaattactcttagctcgaaagtcgaaacgaggtgtcttttattgagtctgaaagtggacaaaataagtttaccgacatataggatattcatattgaaacgaggtttggctgggtagctcatctcttggaagccagataagttgctgcgtaatcagtagactctcgtcagcataatacatcgcagtttggttcaacttctatgtaatccatgtaactacggaaaataaatactactagctaatactccctccattccaaattgatctaaatatttcacaggtacacaaagaccaagaaaagctaataactctcttatactatatttactttagcaacaaactccatatatgcaccatccccactatttcctagccaatagcaaatcaagatattacatgtgggttataaatacttgtgtgcatggatgcatgcatcaatgtccatttactctaatgcacaaataacgaatagacttaataaatgaacacaaatatatagatcatttagtaataatctcaaaaaaaactataagcagatcaatttggaatgaagggagtatattactatgtaatcatgtaatatattaagaaattgtgataaaatggacaactggtgaattggagatgattggttaattggtgctctgcatgactgcatgccaaaattcaacgttgcaattaagaaattatcttgccaactcgaagaaccaaccgacccatgcaggcagatgcatgcaaatccatccaggaaaaccaagcaacgtactgtcatgtcacacatgcatgcatcatgcaagcaactacctatagcaagctagctcatctataaatagcagacgcacacccaaacaccagaagcaaaccgttcctaagccacacaagatagagcagccataagccagctcttgagtgatcactgactactagtagctcactcgatcccagctcaa

SEQ ID NO: 2709 - DNA, 1501 bp, Oryza sativa
ttgccgggacagcctgctcgccggggcagttgggtgtgcaaccgtgtgctaccacagcaaagaggaggaggctaagggccagaaagggagcgacgaccgtggaagccattgagctgggatcgagtgagctactagtagtcagtgatcactcaagagctggcttatggctgctctatcttgtgtggcttaggaacggtttgcttctggtgtttgggtgtgcgtctgctatttatagatgagctagcttgctataggtagttgcttgcatgatgcatgcatgtgtgacatgacagtacgttgcttggttttcctggatggatttgcatgcatctgcctgcatgggtcggttggttcttcgagttggcaagataatttcttaattgcaacgttgaattttggcatgcagtcatgcagagcaccaattaaccaatcatctccaattcaccagttgtccattttatcacaatttcttaatatattacatgattacatagtaatatactcccttcattccaaattgatctgcttatagttttttttgagattattactaaatgatctatatatttgtgttcatttattaagtctattcgttatttgtgcattagagtaaatggacattgatgcatgcatccatgcacacaagtatttataacccacatgtaatatcttgatttgctattggctaggaaatagtggggatggtgcatatatggagtttgttgctaaagtaaatatagtataagagagttattagcttttcttggtctttgtgtacctgtgaaatatttagatcaatttggaatggagggagtattagctagtagtatttattttccgtagttacatggattacatagaagttgaaccaaactgcgatgtattatgctgacgagagtctactgattacgcagcaacttatctggcttccaagagatgagctacccagccaaacctcgtttcaatatgaatatcctatatgtcggtaaacttattttgtccactttcagactcaataaaagacacctcgtttcgactttcgagctaagagtaattgatattttattggaagctgcacaggtatcagatgttgcataagaatcagaaaagactccataaatgctccaccaagataacctcactaaggcctacctatgatgggcagaagtacctcgcctctaacgggctaaactaaagcccactctagataaggccccacgggcacagctcgtcacagctaagaacttaattgtgacgggcccatttgtgaacccgataaagaacacctctaacaagcccacatataggccatcataggtgacaacacacctgtaggggtttatagacataatccgtcgaagatgaggacagtcatctctaacggttcccttttttacccatcacagatgaaaaccaccgaacaatacccatatcactctcccacccactcattttcttctctctttcactctctctctctctccctctctccctctctctc

SEQ ID NO: 2710 - DNA, 1501 bp, Oryza sativa
gacgagtgcaagaacgacatggagccacgggcccaggcgcatgggcccttctcgaaaccccctccccccactagacagccatctcactggcggcgggtgcggttgcagtgtcggaggtgtttgcgagctgaacttggtaggcaaggggcaaaatcatactttcgttattgtttctctgtccatttcctttggattttataaagttttttcagtgtcccataactgatacgcgttcttacggtgtccccggttaagtacatattttttagatgtccctagcaaattttaccctaaataaaataaaatactaaaatttctcactaaaaatcaaaatatcccagtcgatttttttataaaactggtagacccattacttatatcccattagacatctaacgactttctatcaacttagttatttttttctcagcgtgtatacaaaagctatttacccatacgttttgatattgatgcttttatcaataaatgatcattttaggagataaataaataatcttaagatgatcgtagcgtctaaattatatatatgatctatgaagtcatgtggccagttgaacaacatactgatcgtactaagcatgttggttgcaccaaggaatcttaagagtgaaacaacctgatgtcgcctcagcaatatataacccaattccatataggaatttaaagaccgtatccatttactttttggtaaaacttgctgcagtacatcgtgaatttgtgacatatagcatggaacaatctacaaacgtgtgattcttacctgacgctccagtttagcggtaatttgctaagaaaatactatggcctctatattaattttttttacataattggagcgagataatttagaattatggatgcctttacaccatgccaagttgtaggatcaacccacttatattgagatcaaagcatttcaaagatgcttcatatagtggatttgtccaaaaaaaatgaagataaaatgaaatgaaaattaaacaaaatttatctaattttaaaattctttttgttgggtttataacccattctagatagaaatattcaaacattttagcaggaccaaaaaatgaaaatatttaaaatttcaaataaaatctaacaaaagaattggacattcataggaaacacatcaattgtttcgttacaaaattttctcatgaattaaaaacaacacggtttgatgtaattttagttcacaatttatatgttgcaagtaaccaacgttcaaagcatgttaaataagttcaattttagtttatgataatgtaaaataatattttggatagaaaaccatctacacatggacattcgtaataaaattttacgcacatgcccgcgcatatgcgcgggctatcttcctagtttagatgaaaatgacataattataaatggatataatatgtttccatgtgataatttttatgcgcatgtattttttggctaatagtagtgtgtatattcgtaggtggttgtgcac

SEQ ID NO: 2711 - DNA, 1501 bp, Oryza sativa
acacacgcgtgcgccatcgcagtggccggcactgaagcatatggtcccgtgcgaccaatccgttggaccatgtcggtccaacgtgaccaatccgttggaccgcccctccatcagtttcatgccttcgagctacgtcgacggtgcggtagcgtggcccgaacccatggagaatgtatagttccacaaatattttaaaaatatgtatatatatatatatatatatatatatatatatatatatgtaaaattatgaacaataatgtatattttaaattttagttctggaaaatgcttcaactattgttaaaacatgcactcccacaaccacctgatggattacttcagcaattgttgatccacagtgtagtgggacatttaactatttaccacttttaagacgtggtatttaataatttgctactcataatctgtgacatgtggattcagtggaaaattattaaatgccacatttaagagtggcaaataattaaatatctcagtagtatttagttatcttactttcatagagactagaaaaggcgataagtttgcatatatgggtgttccagtttctaggtctcgtttttcatgtgcatgcttcctaatctattaaacggtacaatttttgtaaaaagttcttagggaagttcctttagaaaaaaaatcatatcaatccatttttaaagtttttagttgatacttaattaatcatgcactaatctaccgctccattttgcttgtttgaagggttagttcccaacatatactaacgaacacaatgagctacctgactttgaggaagttttgtatataatttggtataggtgtattgtgaccttctaagagcaagtttaataatagtatagtcaactactacctttaaaaattggcacatcatctataacaactttaatagcctacctatacaatagttttatataaatacatgatgcaccattattatttgacccacctctacacatataatattttagagtccaatctgtagcccatttttcttcgaatttgttttgaaaatatattattttaatgaaaaattaaaaaatagaagctgttcggctacaatctcaagtttaataccctgtcgaacaaccgcagttgggcaaggttgttggtccactaaaaaaaataaaaagtacatgaaagggcattggcagggggcctattgaactctgatgttcgataggtcctacatgcacacagtggcgtacagtggttgttctcttttttatttacttttttttatcccctgtcgatatataccctgttgaactttgcttgtttgatgggcgctaaacttgtaattttagtctgttaacctctattttgcaattctctattaaaaaggtattatttctaaaaaaaatctttttcttctctctcctctcctctatctttcacatgtgtttgtatctatagcatgctcttctacatggtctaataatcatttgaatcgtgcagatgacaataaaaaacaatc

SEQ ID NO: 2712 - DNA, 1501 bp, Oryza sativa
tcaggtcttctccagtctttttttccgtcccctctcttggtaggcatggtcctccttttatctctcaaggggataccacatacaccatttctacctacccttcttttgggtggggacccatcctactttgaccaaaacttggctcgtacttttgcctgacaccgggataaccctgtcctccctcattaatgggcggagatttgcaatggctgttgtccgaatgaccctccgatgggatgggtcataccaacctccactccgccggaagcaggtgcaacgtggaagcacggttgtttgccgatgacgcgaccggcgtcagaccagtcacagaccggtcattcttgtccaccacgtgtcagtttagcatgctacacgtctgcccttcttcatacaatgacttccttacaatggttgcgatgaagcctggaatgtatctggccggggctgacgtgccaactccaggagttcccacgccggcttcggctagggacgagtgcctggaggctctcatcattccgacgggacggggcgaggcgtgtgtcaggccgcctgttgccccctaacccgcgatctgaccggtctgtgaccggtcacacactgcgaccgatcacggaccggatgagtgtgctgcgctacattaaatgcggcgtggggcgctcgtccaacccgcaataaacgcggttaggtgagcgccgctgtgctcacctaacccacacacgtggcgccaaaccctcagggggtcggggcgccccagccctcggggacgaaacgggagcggcccgacccctcggggagatagagggaggggcggcctcatcaccctcgggcccaacccccccaagggggtcaggccacgtgggtgaccgcggctgccccaaacctctagtcaagatatccccggtcccatgtcaccgacagtagcccccggcgttatgccagggcgatcgccctcctcgaggaaaacgctcgggtgtgacgccactcctcaggcctggtgacaggtggggccggtctctacaggcggacaggaatccagtggtcgcaaatcgcgcgcatcggcaagggaaaaaccgaccgacaataatgagcggctttcttcaagaccgttacattacttgagtagcgcgcgaattgggacgagccggttcgtttcgcctggagatgtgatgatggtgcatcggtcggcgagcgtagttaacgcgcgcacgatatgtcccatctcgactgccacggccgcacatccgccttgtgcgccgcaaacgggcgagcgggattagtggaggagtgggcgcgagaaacgagggggcgagatagtgggcgcgggaagcgaggagccgggcatagcgtttggcaagggtataaagacgccgaggaagagattcgtttccttcctctcgccattattccccttgccttcgccgcttgcgctctaacttctcgtttcctgtgccctaccctcgccgcactcactcgctctcaaacccctcctccgccggcgtta

SEQ ID NO: 2713 - DNA, 1501 bp, Oryza sativa
aatatttaaaggacatctcttccaccatatctagttgtagccacataaacaaatagagacaacacaaccaatatatagtacagaaagtttctgcgtttgcgcaccgtctgatcaatcacttcctgctcaatcttcttttcgtctttactcctaacccctccgactccagtctcacctcaggctcttaccatattcctcatcgttacaagaattgttctgaactactgtagagaatcatccgaagaatcaggtagatgcagatcgagacgtacgggacgtgtgcaggttggaggcatcgcacgctaccgcggcggatatgatgcgacgcgtgcatctactccctccgtcaaaaaaaaaaaaaagacaaaccctggtttccgtgtccaacttttaaccgttcgtcttatttgaaaaattatgaaaaaaattaaaaagacaagtcacgcataaaatattaatcgtgttttatcatctaacaacaataaaaatacgaattataaaaaaaattatataagacggacaatcaaagttggacacgaaaacacctagggtttgtttttttttttttttaaagagggggagtacatgcgacgcattgggcagtttacggctagatcgatgcatcgatcgacagccacccgaccagcaaccggccggccggcgacgcgaggacgtgtggacggcgacctggcggccggccggttttggctgtacgcgcgtgcgttgctactctatgctacaggaaggatcttgtcctccgtcgagattaacaatgactaagtttgtactactccttaattagggacctgccctgccggctatatatatacgtagtttaagatggcaggtaaggaacgagaggggtgtgtggaatgaaaaactatatctcccactaaagaaaattaatattttgttttttttattttaggataaaatggtaatgtaataagttggtagtgcaaatatagtacagccttatatttgtaataattaattttgagttcaaaaaaaagagcctaattaaactattttcaacttcattctttatttaatatgaattctcaataaaatctatatcgaaatactacatccgtattttaatgtatgacaacattgactttttatgtaacgtttgaccattcgtcttattcaaaaaaaaaatatgtaattattatttattttaatgtgacttgatttatcatcaaatgttctttaagcatgatttaaatatttttatattcgtacaaaaattttgaataaaacgaatggtcaaacgttagtcgaaaagtcaacggcgtcatacattaaaatatggagagagtaacatgtttcgcctaatagatgatcagaatttagttaattagtactctctccattttaggttataagatgttttggctttggtcaaagtcaaactacttcaagttttactcattttatagacaaatatagtaatatttacattaccaaattagttttattaaattaataattaaatata

SEQ ID NO: 2714 - DNA, 1501 bp, Oryza sativa
cagattgcgcggctagcatcattatattttctctcatataatagcatatatgttttctcattatattattcaaatatattaaaatgataacataattttaatttttgcaataactttacaaaactactaatgtgtaatattcatattatattttatatacctgttagttattaattatttttaatatcaaattttagttatttgtaaattatatattcctatatagactttagactcgtcttttaatatttcatttttttaatttcgcattttctgtaaattgtatttctatatagactctatgcttttcttccagtattatttaattttatttctgaatttttattatttctaattgtatttatatgtggactctaaactcatctttcaatattctttaatttttagtttcgaatttcagttacttctaaattgtattcctatattgactttaaactcttcttcccatgtttttcttaatttcgaattttagttatttgtaaattgtatttttatacggactctaaactctacttttaattttattatgttcattccaaattttagttagttttaaattcctatacgtactctatactctatttctaatattccttatttttaattccgaatttcagttattttctaattgtatttctatatggactctatactctacttctaatattccttatttttaattccgaatttcagttatttcctaattatatttctatatggacttagtctcctcttctaatattccttattttttttaattccgaatttgagctatttctaaattgtatttctatatggactctagttttctcttctaatgttacttattttttaattccgaattttaactatttctaaattgtatttctatatggactctgttttttctttttctccgattaatgtaagaatttctaggccatgagaacgaacgtgggagctactttttctattactttaataatataatagattttgttggcagctcatgagtagtaaaattattttggcactataaactgaaaaataaaatggatggagacaccgttctcgtcttgggttaaccgctccaacactttcataattgagttttcaacggattttattttttttcctctctgtgtgtgtttgactgtacggaatgagaaggattattcaaatttcaaacggcacagggacccgccggcccccgtgtaacaaaccaaaccaaaacggccttcgtccacactactccagctcgaggaggaccgcgtggagctccctgacacgtgggacccaccaaacctcttgtccccacccgccatccaggtaccgaaaatgacgcgcctcgccagctgtatgccaccgtctccttccccccaccgcctatataatcccctctccctcttcctctcgccatcgagtccgacacgtccacatcgccattagagcagctcgaggaaggaggaggaggaggttgattcgatggggatggaggcgg

SEQ ID NO: 2715 - DNA, 1501 bp, Oryza sativa
aaaaaaaaatcaaccatcccggttcaaattcaccacaaatgcacggtgaaaaaccacctgttaattatgagatctgtgtagtattattagcactagaattttcctggttcatctttgtattttactttgagtaaaattcttctgctgctctgaaacagagcagcggtgaaggggaggtaaaaaaaaaatcagaagcgaaatgctagtgcattgctactaccagcacagcagcagcatcacggacaggttggccgttttctgtacaggaacgaggtgatggtgagatgtagcgacaggtttctccttccctttgaaccgtccgtgcaacgaagagtcgaagactacttgggcatcgatcagatgtgcgagttgaaagtgatagtagtagcagcatgctgtactagcagtacgcatattggacatttcagagcatctaacttttaaatgtggcaattaaggatttaccaaccacaatctataacatatgggtaatctttaattgccactttaaatagttaaatatttttattttggagctatatggccgtactcgagctgtaaataaccgatgatcttttctttttggaaaaaaaaaagcctttgtttcgaatgtataggaattttctgagaatctgaaagtacttatattcctcagaaccgtaagaacttgtttcttattggccgctttgcgtcgtttaaccgttgggcatttgtctctatcaactctatgtgcgtatagaatggatggattccgatctcattgtctctttccatcagtctatgtgtcacgtgtgtagagaatgatgaattgatttatactccgagtagaactcttttgctaagctaattcattcctattcccaaagaaaatgggcgtatgagtctcatagtaatacgagacaattcaatgcccaaaggaaattgatttctactgtagtgagctgtactgtccagcaaaacggttgtgtactgttgaccattcgaatcgatcgttggtgcagcgcacggtacaacgaagtaattcggccgcagcggccagaggagcagggagccaatatgagctggctcgtagtaaatcgagtgcaggacgagtagtagtaggagtgagctgtgacagttcacggttggcggtatttataccagcaagtgatgaagctagctgtacacagctgacctgaccagctgctccccccaaacatccctttcctgtgcagaacagtagcttaaaggattcctgacactgttgctgcagcagcagcagcagcactactagtagtagtactactagcaagttaattgcaaatctgcaatttgttcagcagcttgaaagcagatgcttgtttgttgaggccgtttttgccggtgatggttggtagtctggtgtctctgcaggaggcaacataggcctcggtaattctcacccatcgacagttcaggcccggcccaaattggccagatgagcccactgatcttaagcccaatgcaagtgaaacgcaagcat

SEQ ID NO: 2716 - DNA, 1501 bp, Oryza sativa
  unsure (1)..(1501): unsure at all n locations
acccgacgcagtcgtccgctgccctgatcatgtcgccgcgcaccgcggcgtcgccctccagctcgatcagcgggccgacggggatgagcggcgggcggngcggcgacgtggccacgcgcgtgagcgcgtccgccacgtgccgctccagctcggtgaaggagttgacacacacccacgtccccttgtcgatggtgcggatctgctgctgtatcgcctccgtgaggctcatgtaggggttcgacgggaggaggaaggacggcacgtcggcgaccgacatcgccgggagccccggcagcgtgagccgcgcgtcgaggtcgtcctcgggggggaactcgacgaggccgtggacgcggtggtagtagagcgagaacacggcgcacgactgcacccacagcacggccgacaggatgccggcggnngcggngacnnnnaccgnnnccacgggggattggaaacgggttcccgacgacgcacgccaccggccgccccgccgcctcctgccgcgcgagcagctcggcgaacgccgccggcccggccgtcccgaggtgccgcatcagctcgtcgaggtcgctcccgtcgaagccatcctccaagaactcgaacctgatccggccgccgccgagcggcacgccgtcgccgccgaccgacacgccggacgactccacgagcttggcgccgatggcggacgtcgacgagaacgtcacgacgaggcccttcgccgcgatgcgcttggcgagccggagcatcgggttgacgtggccctgcccggggaagcagatgaggagcaggtgcggcgcgccgccgctcgccgccgccgccgccgccgccgtcaccgtggccgccgcggcttcctcgcccatggctaagcaagctaacttagctagctgcgagctcactattttcttctcgccttttctccgagcagctggcgtgcagtgatcgatctctcgatagctttggtctttgatactgtggcaagtgagatgaggcaaccaaatttataccaaaaatttgtgacttgcagatgaacacgatgacgtctgacgtggcgtcacacatgtaaatacaaggcagcggtttatgggctacctattttattttctttacatttaaaattgaatactatctggtcccgctgtatccaaagataaacgtgagtgtaggggaaaaaaagataattgttaattatcatacaattaaagcttaggccattttgtgtatcaatagtcatgaccctattaaaaacaaatagttcaaattaaagaagatattgtgggtttttttttttggttgtgtatcaatttgtcattaatgtgtgcaatgttagattattgtagttgcaggaatagactacgagtggctagtcactgtctcattgttttggtaaagggacatggcaccaaaaaaataatctactactatagctaagggcccatttgaatcgtaggaatgaaaaaacggaggaataagaaaaatataggattatgataggaatgtaagt

SEQ ID NO: 2717 - DNA, 1501 bp, Oryza sativa
atgtgcaaatgtaggacctatgcagcccatcaattcagatcaagtaatattggagattgcacgttaatctgatttgcaaaaaaaaattggggcttcatgcgtgaaggtaaactagagtatgcagatgcaaatcggagtgctatttccttacgtgcttgttctgtcaatgtcgccgacgtggagcagccgccgattgttgctcttgacctaggtgaacgcctctttactagttaaggtgttgctcgacgtacggcagcgaggcccgaagcagcgccttcgcatcaaccgccaccggccaccgctcgccggccatcgcctgtcgtcgtcctcctccatggtgcgtcaccgatctgtgggctgggatgatggatcgatgcatatcccaaaaaaaaagaggaaaaaataaagtgggggcgagagtggttggttgggtacgggaaaaatagaatatatactggaatctgggaagttgtttttatcgaagtaaatcatttactccgataatagtgggagcaggatgatgggacgtggggtgggatcggaagtaggaaagttgtttttattatcgaagtaaatcatttactccgataacgatgggagcgatgggagcgggatgacaggacgtggagtgaggtaggcttagactaatacatgtttggtgctcgaaatgctaaggaacgtgctgcgctcctaacagcagtactacatatttaacaccgtatttcaaaatgcaagcacgccaaacacatgtttaactttgttggcaggatgctccttgagtggtgattctattgaactgttgtgaacaaactaattattggatgctgaattgatgagtacatacgtatacgtatacgtatataccaacaacctacctcagtacctctaattggcccgttggcttttgtttcagaaatcagaacaacattttctctacatttcaaatctaattcatcagtaaggatcatcaaaatcataatttgtgctaattagtaattttcatttgttttgcatagtagtgccgcatatcgatcagcttttacaaatcattgtgacatatacatttttcagtgtagtataaatatagtaaggcaactacacgattgctattggccagcaaataagagagttttttctcttttttttaataatggtatgaaacatcccggcctttgctcacaagagctatagtccattattacaaaagtagcacactaaaaagcttagtccaaagagttataaggctgatgattcctgcacgttaatgctaataagaaggcagcggaaatcacaccacagccaagctgtattaatgtccaaacctccaaatcgctttgcgcctttcaatttgcaattatttctcttgcctatgttttcattttgcaattatttttgtgctagacaacaaataataaatgaatcaacttctgtctatttataccatttccatgaagtgctcgacaactcacacccatggccatggtgcaatacgtcaccggct

SEQ ID NO: 2718 - DNA, 1501 bp, Oryza sativa
tagaaaacttatctatgaacattaagagcagtagcaaagttacttactaggatgacagctttcaagttgccggcagtaagaggcacctcgaggctaccttccttgtgtatcctgatgagctcatccatcaagtcatcctcctcctccttggcgatgtcaggcggcggcgcggccatggcctccttttgctgctgccgctggcggaaggcgctgtccaccagctcgtaggacgcccggttgaccgcctcgccgcgagccgccgatggcgccggcgagccacgacgacgggaacaggtcgtcgaggctgaacccggaggcgagcttgacgatctccgggaggacctcgaggaagtcctcccgcctctcgaacctctcaccgatcatggggcgcatcgtggtgtccgcgatggccaccttgatccgctcggtgaggttcacggcctgtcccggcggcgtcgcggcgacggcggcgacgaggcggccggcctcctcctcgcggacgccgtggaacgagctgacgcggcggacgctgagcagcttgacgatgcagatcttgcggagctggcgccacagcgcgccgtagggctcgaagaagatgcccttcccctgcgcgcgcagcttctggacagtcggcggccacggccgcgacgcgaagttgatgtcgtgcgtcttcatgatctcgcgcgccgcgtcggcgcacgacacgacgatggccgggacctcaccgatctccatgtacatgagcggcggcgcgccgagctgccgcacgacgtcggccagcgcgcggtggacgagcgggctgcggcggaggaggtggaagctgccgatgaacggcagccgcgacgggctgggcggcaggttcagcccgtcccactccctgcgcggcgcgaggagcatgcgagcgagcgagagaacaacgaggacggcggcggcggcggcggcgaagcacgagacctgctccatggcggcgggtggtggctgtgagtgatggtggagtggtgtgtggtgaggtgagtgccatggaggagatgcacccggctatttatacactggagagggttagtgacagcagagacttccaacctggactcttggagaacattggcacatagttaatacaccactatatggttggacaggtgtctagctagtgaagaagagggagaagataaatatgtattaatattttattaatatagagtgtataagtattttattaactacacgagaagatatatatgtatttatgatggctatatatatgattgggcaagtgtctattaaatagagttcgcttaaaaataagtcgaatgtattaatatttttttattacacgagaatatatatatatatatttgaagaaggaaaaaaaacaaacggagagcactgtttgagttgtcttgttaaagtctccataaaaatacattttatttgacgtcatcttgaggtggaggcgccacatagatcatctcttatctttctatttattattgtgtatatt

SEQ ID NO: 2719 - DNA, 1501 bp, Oryza sativa
  unsure (1)..(1501): unsure at all n locations
gtatggaatgatgttgggattgatggatggatgtatgttttgtatggttctctggatatattactgcctgtaaatntctgtgatttgatgtttgcctctgttgtgtgcaaagttttgctaaagtttagcagggctgggacgtcagcgccatgctaaatggcgctgacatgtccaaactcagcgccagtgcacctggcgctgaggtcccagcccagccatccagaaggcttgctgggctgggccacggccgaaacggccaagtcccacctcagcgccaggtgggctggcgctgagtttccaacagtcagcgccattatggctggcgctgaggtcccagcccgcaagccatccagcaggcttgctggtctgggccttgggggttgcggccaagtcccacctcagcgccaggtgggctggcgctgagtgtcccactgtcagcgccattatggctggcgctgaggtgccagcccgcaagccatccagcaggcttgctggtctgggccttgggggttgcggccaagtcccacctcagcgccaggtgggctggcgctgagtgtcccactgtcagcgccattatggctggcgctgaggtcccagcccgcaagccatccagcaggcttgctggtctgggccttgggggttgcggccaagtcccacctcagcgccaggtgggctggcgctgagtatcccacggtcagcgccattatggctggcgctgaggtcccagcccgcaagccatccagcaggcttgctggtctgggccttgggggttgcggccaagtcccacctcagcgccagtccggttggcgctgaggtagctgccacgtcagctggagatcggcccggccgccacggtagcacaatgtcagcgccagtcccgttggcgctgacacggccaacgtcagcgccaatgtgtttggcgctgaggcgacggcctatttttggttgaagtttttggcagaggttagtttcgaaataagttttccaaaagggtcaatttgtcaaaaaaagggatgaatatgcctatacaggctttacaaactccagtaccagaagtaaccacttaacggtaccggtccgtatttatagagctagaggtgtcaaattttggcgtatcgtttagacaataataaaaaaactaatcacagaatctgtcagtaaaccataagacgaatttattaagcctaattaattcgtcattagcaaatgtttactagtaccacattattaagtcatggagcaattagatttaaaagattcgtctcacaaattagtatcgagatatgtgcaattagttattttttagcctatatttaatacttcatacagatgtccaaatatttgatgtgataggtataaaatttctgaacagggcatcataaacagctgacaaaatttctggaataacagcttctcacgatgaatggtgaattagattgttcgagagatgtttcgactctacggtagcgacatcaaacagattacatcgtctccgtgcata

SEQ ID NO: 2720 - DNA, 1501 bp, Oryza sativa
cttcctcatccccacacggcagccaagcacaggagcccgacgaggcatggggagaaactcgagcacggcagccgccggcctccgctcgccgcgactgccgtcctccgcttgccgcggccgctcgtcgcggccgccggcccccgcgcggcgcaacccgccgcccccgctcgccgtggctgctggcctccgcgcggcacaagctcgccgcgcccgccgtcctccgcgcagcgccgcccgctgcctccgcacggcgcccgcctcccgccgcgcagcccgccggtccccacgcagcgccgcctcccgccgacgctgccttcaccgccgtcccctccccgcttgctgccgccgcctgcttcttgtcaacgctagaaaagaaaagaggaagaggggaaggaaggggagaaagaataagggagtggctcacatatgggtcccggtgtcatagtcaaaatagagagggtagaatagagaggctgttggagtatacagttaatttgactagctaaatcagatggagagttggctatatgggtgttttaggagttcgatttggagaggctgttagagatactcttatgtgcaaaatatgtgcagttaccatgcatgttggtactgaagagccagagccattccaagaaaggaaggatcttttcaccacgtagaactccatttttctgacattttttaaaagaaagaatgaaggtgactaagggacaatattttaatatagcaggatgatatagagattctcgagggacaataaggttttacacttttacaaaggattctcaagatatacatatttcattcttgctagggttagtgtaggatggtgcagtgcacaccatgagaatcggagaatctgtatgtggtgcgaagaaaaactaagaacaccagaaacagaaaaaaaatgaagaacagaaacaaatccatgcaaaacttgtcattcagagagcaaattatgtctcagatatctctatttacctgctactcctgaagagactggacttgttacttcctttgacagaaatagcagaacaaaaatatgtcacctttttgcaactttcataagattttcttttctttttgcaaagaatttatgcatgctaaaaacaagggggtgagttaggaactcactgaaaagagcacagcctagatgagtaggtgcgctcccgtttttgggcccagatgaaggacaaggcccacctagaactcctacggtggaccgcgggcggttttgatccaacggccagggttcttcatcacccatccaacggtgacaatcccactaaaatccttccaaattttcggtttctttaaacatcttcgaattcaaatttctctcatcacgtagtacagcccagcatttcctgtcctcacgtacccccgaataaaaacgaaacggcaccagaacccagaacagcaagcaacacaaacccatcaaaacaaacaaaacaaaaagaaaagaaaaagaaaaaaaaagagcaagcgacacgagcgt

SEQ ID NO: 2721 - DNA, 388 bp, Oryza sativa
caacacaaatcaaaataagggaagcacaatcagcagagtgcttatccatccaatcatcaagcctagcatacacgcaaggaacaaagggataaaggggcacacacctgatggcactgtccttctcaactttactgatctcgtcgtgcttctcaaccccctacgaagcatcaacagcgagcaacggtcagcacgaactccaagatctccaagacgaggcatcgcgaaggtgagatcgaagtaaacatccaacaaccctagctctagctcactactaaactagtacttgtgcttctcagctctcgcgggcgcagcaaacgaggtgctatccatgatccatccagcgcatggcagcacgacgcacacgaagcctcgctcggatacaggggtt

SEQ ID NO: 2722 - DNA, 1501 bp, Oryza sativa
gggctgtctgagctgcaacctaagttaaggtaaataagtcctctatttattttaaggattgcaatgattcatatttgtcaccgtgggtaccagcgctatgtcctgggactggtactgagatcgcggtttcgtaggaagcggttcgcgccgtttttcccacgacacgctcctgtcaggtgccgttgtacggcggtgccagattcggggcgtgacactatacagctaaaaattgactctctccctatctaaaataccttatattttgagattgagaaagtatctaattaatgtgccagatatctatacagctaataatttattatctccctatcttaaatctcttatactttgagaccaagaaagtatctaattaatgtgctatatatatatatatataattgattatctctctatttaaatctcttatattttgagactgagaaaatatctaattatgcgctagatatctatacaactaataattgattatctccctatcttaaattccttatattttgagattgagaaagtatctaattaatgcgccagatatctatacaactaataattgattatctctccatcgtaaatcccttatattttgatattgagaaagtatctaattaatgtgccagatatctatacaactaataattggttatctccctatctctaacaataaatctccagctagttggttttgctttacatatgaatcagtttattattgaaggcatgacagaactccactgtccatagctaccaagtgatctgacaacagcaaagtgagagtggattctaagttcaagatgtaggaatatattatatatactctacttacttgggttaagtggcatgttcacgagtgtatgagtatgaggtacgtgtctattgtcgtatatacatatgcattttccgtgtaatcaaaactaaataaatataaaatactctagttagttttcaagcgaacactctatgactcactcgacaacacttatccaaccatacacaggtaccatatacagatatgtatcatccgtgtactaaaaaatagtaatatgctctactttttttaagcgaaatcttccactcactcactagatacttgtccaaccatacataggtgccatgcatacatatatatcttctcgtgtaataaaaaatattaaaatattatacttatttttaagcaaactctccttcaatagacacttgtccaaccatacataggtaccataaatacatacatatcttctcgtgtaataaaaattattaatacattatacttatttaagcaaacactcctttaataaacactagtccaaccatgcagtggtggagtagtatatttgtctttttttctggatgtacaaggtatcatcaaaatcacagctatcaagccacaccacttcattaactttctcattaagaattgatttcgccttaactatctgccaatattctccaggttggaagcctctgctgccaccaaccttctccc

SEQ ID NO: 2723 - DNA, 1501 bp, Oryza sativa
attgtatgcatattggtctcctagttctacttggacaatgggacatctatgggtataaatacaagacccattaggaggagagggagagggagagagacgaagacaacatctgtcagaatagacaccaatacacgccgccggacatcaacatcagaaataagcctagacatacccaatctggcgcctacggaggatgacaagagggatctggcgctatctctaatcttgccgggtacttattcaaggaggaagactaccctgtcgtcgacaacgtgttggtgttccatgctgccaagttgacgacaagtagataggttatctcaaatattgtacttgtgtaattctgatgaataagagcaacatcggctttggccaacaggagtagggttattacctgattctgatgaataaggggtccgaacctgtatatactccgtctcttttacctcaatctcgcatataccctggtaccaatgatcaccttactatataaatacagtagtcgtgatctaaaacattgacaagatccgatcattgtatccataaattgatatacacaggtaatagatagatagatagatagtggatagagaaccaatctctatacacagccaagataggtagatataaatagatagatttagttttgataatggatagagatattgcccctacgttcacaagtggatatacacataaaagatagatagataatggatagagaaccagtctctatacacagccaagataggtagatatagatagatagatttaattttgataatggatagagatattgcctctgcgttcacaagtagatatacacatagatagatagatagatagatagatagatagatagatagtgaacggagtacaatctctatacaccgccaagataggtagatatagatagatagatttaattttgataatgcatagagatattgcctctgcatttacaagtggatatacacataagagatagatagatatggatggatttaattttgataatggatagagatatggtctctatatttataagtgaatatacacaataataaatagaaagataagagatgatctatgtggcgcctccacctcaagatgacgtcaaataaaatgtatttttatggagactttaacaagacaactcaaacagtgctctccgtttgttttttttccttcttcaaatatatatatatatattctcgtgtaataaaaaaatattaatacattcgacttatttttaagcgaactctatttaatagacacttgcccaatcatatatatagccatcataaatacatatatatcttctcgtgtagttaataaaatacttatacactctatattaataaaatattaatacatatttatcttctccctcttcttcactagctagacacctgtccaaccatatagtggtgtattaactatgtgccaatgttctccaagagtccaggttggaagtctctgctgtcactaaccctctcca

SEQ ID NO: 2724 - DNA, 1501 bp, Oryza sativa
atcaagcagaaaaatttgaaatataataactagaggattctcgtgtataatttcacacaaaggtaggtaaaggtataattagatttgaaatacaactcttatcttctatttttataaatagaagtatgcaattataatatctacatgaaaataaaaacaaatttgaatttcttactcaattgtaatttgtatatagaggcattttataaatacaaatagattcgatatacgactcttagcttctatttttataaataaaattgtattttgtacacaactatattgaacaatctatacagaggtataatttgaacaatataatttaatggccaggatctttcttttattcttcgattaatatgagaatttttagcctccaaaagaaacgtgttgcctccattttttttctattttttaatataatagatatatcgatagatataaacaagtaggtttattttttaataatggatatagatccaacctccgtaacaaaaaatggatatacacagttaatagatagatagatagattgattgattgatttatttatttatcataatgcacagagaaccagtctctatatacagtcaagataggtagatatagccctcgcaaaaaaaaaagataggtatagatagatagatttaattttgataatggatagagatattgtctctgtgttcacaagtgaatatacactaaagttagatagatagatatggatggatttaattttgataatgggtagagatccgttctctatatttataagtggatatacacaaaaaaaaaaagatagataagagatggtctatgtggcacctccacctcaaaacgacatcaaataaaatgtattttatggggactttagcaaggcaactcaagcattactgctctctccttttgttcatttttttcttctttagatatatgaagtaagcaatttgtatgtttttctctctgtttgattaattgagatggagatatatatagcatccatttgtggcacattacatgggattgagaattagattttcgagcggtactatgtttacagttcaattcccccacatgaaaacgagatatttcaaattccccaaattatgagatgtaaatacatggcctcaaaagcagcaagaaaacacaaggataagtacagtgtccgggccgttgcaaaaatcttagcctcttatgatatctgccgttgccatctcaattcagtgggcaccgctcgcggcgccaccgcatgacgagacaacgcggtttccgtggcgtgtagcagcaggcagcagcagcagccagcctcgagctcatctgcaatggcgccccgcgccaagacggcgccgccgtgcgccgtgcatcgatcttgcagatgaaacggctctctttgtcatctcatctccatcgcctcgtatatatctgttccctagcctagctagctagctatcctgcattgcattgcactcgcgttcgcgtacttacgttgtcgtcgtcgatc

SEQ ID NO: 2725 - DNA, 1501 bp, Oryza sativa
ggtacaggctgagttgcgtgacaaactagcagggaagccaagggtgacagaggatgatttgtccgacctaaagtacttaaagctcgttattaaggagaccttaaggcttcaccctgcagcgcccttgcttgtcccgagacaatgccgtgagccgtgcaagatcatgggatatgatattccaaaaggtaccaccgtatttgttaatgcgtggctattggcagggatcctaattattgggatgatgctgaggtgtttaggctagagcggttcgcaaatagtaccatagacttcaaaggcatggacatggagttcataccattcggggcgggaaggaggatgtgctctggtctagcctttgcggaagctattatagatctactgttttctaccctgctcttccacttcgactgggagctcccttgcggaatgacagcaagtgagctggacatgatagaggagatggcccttactgttcggaggaagaacgaccttcacctccgccccatcctccgtgtgccgcaaactcaaacttcttctgcacttctattttgtgagagagctcaaacttcttctgtatttctgttttgaaagagagttcaaacttctgtttgttttgagagagtacttttgtttattttgttttgagagagagagagagcgcgcgcgctcaaacttcgtttgcacttttgttttgagagggggaatgcgcactttatttcggtaaataaaatgaatcacgacgtggtttcatcagaaaagaaataaggctataaacttcagtgtgaaattctacaagtcaaaaaaaaagttggtgcatctgcaagatccatttctgggacatgcgctctgactcactaaggcgatacagattattggaacaatagatttatgttctgaaacagggatgttagatttatgttttaaaaataggaagctagattatgcacttcgagaaatgcttacagttttttgcacgataaatacactaaatctttgtactcctgttgtaacaccttgactaccattaataaaatagttataaggtagagcccctctacctttttcagtcaaaaaataaataaatacactaaagctgagcagcaaattctgtacaatttttccaggttaacatatggataacatgatgagaatcaacagctctccgatgggaaactacagagaagagaaaaacagatataattcagcaaatctacatgtcgaaagctgaccaaaatcaagggcaacctggtatccgtccagaaagtaaaatccttcactatttctcacctctccaaaatcagcaacaattttacaggctttggatatcttcattaactccggtctgaaggagttttggagaatatgaattacaggcagctgcctaggttgtcagcaaatccgccactggctgactagagaaggggttttggatcacaaatttatcattttttttctaggatttcagcagatgcaatatatcatgtaaacagtaagaggcata

SEQ ID NO: 2726 - DNA, 1501 bp, Oryza sativa
gtgtggttgtatcctacgtggtgttttgagaccactagtgcttgtggtcttcattgaacatgcccttacatgactcaatttaattatttgcctgaaatatatatggactagtagcagtttcatttttctatattctcaacaagaaaaagaaacaaaactactaaaagacagaacgggagataacagatggatggaatggcgttgctgcaaatctacgccaacttttcatgaaggaaagacggaattccaacctaacctaaccttaatttaggaccttgttagggcatctttagttcgcgaaatgaaaatttttgtgtgtcacatcggatgtttgaccggatgtcggaaggggttttcggacacgaatgaaaaaactaatttcataactcgtctggaaaccacgagacgaatcttttgagcctaattaatccgtcattagcacatgtgggttactgtaacactttatggctaatcatgaattaattaggctcaaaagattcgtctcgcgatttctcccctaactgtgcaattagtttttcttttaatctatatttaatgctccatgtatgtgtccaaagatttgatgcgatgtttttgggaaaaatttttaggaactaaacggggcctaagcttctactattttcttttgaataaaatttcgatcgtctttcctgcttcaaattacacgtactactttatcttctttttggtttactttcagaaaggaacaagtaatctattttgttgtagtagtagtagtatcaaacacacacaagtttgacgcgcaccggcaccgcccctgtaccgaaattgtttggtcgcctttatcaaaagacacacacgctgcctctctgttgctgctgcggtgtgtgtgctggtgctgcagctgcaggactagtactagcattcatttcagactgcaacgtccgacttgaagcaagtttatccaattgctatggacgctactgttatcgattcgaaatgataaaagcaagcgtcaaaaccatacgaattttgtaacctgtgataaaaatctagtagtatttgccaccgaatgtttttctgggatgctgtgtaccgtgttgttcgcaactaaagtagggggagtcgtggaattctaaacggttcgtcaaaggggagaggaaaacggaggccaacaaatgattccattctatcccatttacgttagggatacaacaccacacatgatagtagtagtagcataaaataaacaaaaaagaaaagaaacgttttcatcttttctgctttacagtagtaggagaaagctgcaggagctctccctcacactcctgatgtgatgagtggagagagtcccccactgctgctgctgctgctgcgcggggcaaccggccaccggctgcacctcctcgggtcggggatttccgggcttgaagcagcagcactaggaaggtaggtagggtagggtggatggcgtcgtcgtcgtcggggcgtcgggttggggggcctaggggcggcgggg

SEQ ID NO: 2727 - DNA, 1501 bp, Oryza sativa
cctccgcctgagaagatgcaccacccccgggaagccctgcaggtcttgggctcttggctattatagatcgatgtggacctgatgtgggaaaaaacctgttatgtaactaaaggttaagacaagtaaaaaagaaaacctagctttcagatctacaagagaagatagagcaaattcgagtagaggtgtgtgggtacaacgagagagagagagaaaaaaaagagggttctggtgcgtcggcaaggatgctcaccgcgcaggaacgagctcggcggaggccgaggggatgggggcggcgcagggagcagcaggacgccgtccggaacagctgctcgccggcggtggcggggatcggctccacggcggggcggcgggccgtgggcgatcaaaacgggttcggaacatcctctgaactcgtggagcccacatccagtttttgatgacgtgttcacggttttgcttccaaatttctaaaaatttacccagatgtaattcgtagtgtaaataaactataatgtaattttgaacccttatgtaaaattaaatttgtgtaatggagtattacatttatatttgatgggtggcctaatctacgagtttttctttaaagaaccgacagcgggagctctgccgaataaaagaaccttggaagactaaccctattcttttctccaacaaaattgataagcttttggatactcgtggcacgcttttctaaactgctaaacggtagtttcatgtgaacactttctatataaaagttgttctaaaatatcaaattaatatatttttcaagtttgtaatgattagaacttaattaatcacataatattatcacctcgttttacgtgaaacacttaatcttcatcttaaaggaagattcaaacaccacctaagtttctctctcctgattagtattcccagaggtctcctttgccttttgtgccgtatttgttttggctatcttgttttcccaacatctaatcgagaatactgtgtcggccgggttgtcaagtttcccggtacaaatcaagtccaaaggcacagtttctgaacaggtgatcagtatcctcaaaagcttctgagcaaagagagcatatccaattgcacggccacaaagtttatggttttgtgataaaattgttagctatccttgcaattttgtgaaatgcaagactaaacttgcggtgaggcaaattcagcaatggatactctcaagtctgaaccccaaaaacatgttcttgggtgaggttgcagtacagtgccactacgcctggtgtttagagaaacattaggatataactaatccatatcgagttagtatttctttatctctatccatacaaattatatatatacaccggtcccagaagcttaatacagtaatccacatatacggtagacatctccagcacacgctatcaaatgccaacgagacaaaaagatcataagctggagaaaatgtgagagacatgacagatattagatgaacacaaggaatctg

SEQ ID NO: 2728 - DNA, 1501 bp, Oryza sativa
tcggctggtacaccatctcttcattccgtattccttgtcgagatccagcaaccgttctcgagcgatcgagaaggcgtagagtctgcgacggagccttgtcaacatttgtcgtactcgccatagtcgatcttggtgtagaaccatagagacatagagtcttcgtcaatgtcgaatagaattttcctgaaatcaatactcagaaaagaatattagatagaaatagcccccgagcgaatgcccaaagggtgataatgttataatatgtatggtaaattgaaaatgaattaaatttaccgaccaatgttttgtgtatgagcgtcttctctcttaccgacttcgatcagtcagtttgtagagtcatacactctccctagcccccagccttgtcatcggagaatcgttctcggaggataaggctcttggacccttgacctgccttggttgaacaaacactgatcctagcccccagccgtgaagttggaaagctcagtttccgattacacggcttggttaatacgcacggcgagaactcttacacgaccagatcttacatggtcttttgtctctacaggatccgacaaggccttatcggctctgggcgtccccagccgaagttcccttaggttcctcggaggccttgtcaagacggcgtaatgggacagtaggataggtttcaacgctaggtgtcgtcgtggtaagggatctctgggtaaaacacttggcgatattgtataccagctatcaactttgttgaaatagaggtagtaggagagtcgttacaccgctggtcgagaaccaggcagtagtcataactcgaccacttaaagtggaaatagtgggagaaacgctacatcgctggtcgagaaccaggcagtagtcgtatctcgaccacttaaagtggaaatagtgggagaaacgctacatcgctggtcgaggaccaggcagtagttgtaactcgaccaattaaagtggaagtagtgggagagacgctacagcgctggtcgaggaccaggcagtagtcgtaactcgaccacttaaagtggaaatagtgggagaaacgctacatcgctggtcgaggaccaggcagtagtcgtaactcgaccacttaaagtggaagtagtgggagaaacgctacatcgctggtcgaggaccaggcagtagtcgtcactcaaccacttaaagtggaagtggtgggagaaacgctacatcgctggtcgaggaccaggcagtagtcgtcactcgaccacttaaagtggaagtggtgggagaaacgctacatcgctggtcgaggaccaggcagtagtcgtaactcgaccactagaagcaaatgtacgagagattactacgatcaactggttgagaaccggtgagtaggtgtccctcgatcatttggagtcgtggtacgaggaccactacgctgccggtcgaagaccagtcgtagctgttcctcaaccatctgaagtcatggtgcgaggaccgctacgatgccgtagtcatacct

SEQ ID NO: 2729 - DNA, 1501 bp, Oryza sativa
gatgccaaatttttttagcgggctctgttttttcgctagcggaagtgtttagtaaccactagcgaaaaccgacgcgaaaacgtcggttttcgctggcggacatttaagagatccaccacgaaaaatagagtatgttttatggcggacgtcttaacgtggccaccagagaaaatcggttttcgctggcagtcctataccccccacccctcatgtttttgctggcgattttagcatataaccgccagtgaaaattatagtgtgacgccatgaaaaattgtttttctagtagtgcgggagggggtggcggaggagcctcctaatctcccaaaaggctcccaaacgagacaggaccagcgagagaccagagacgaacctcctagtgaatgtattggaaaaccatcgagaccggcgaaagagaaagaatcgaaaaccctagcgttccgctctttccaaagctgtaggaaaccaagaggaccagagagtcgaaggccttacgaagatgctaaggcaggcaagccctatctaccggccaccagacctgaagagaatcgctacggaggggccgagcaagcctaggcaagccaaagggagaccggatgtagtgccaaacttaacgagcgaacacacagtcgagcatgatgtggctcgctatttcatgcttctgagcgcaaaatgggcaggtcgagcgtctgtcaatgccgtgcttatgcagatgatctgccgcctagcaacgctgttggaacacgtgacccatgacatttgaaatcgaagttgggaaaaccaaaaataggaagaataagaagaataggaacaggaaaaaaaagaaagaaaataaaagatggcaaggaaaaataaggaagaaataggaagaacatgagaaaaattaggataatcattgtgaaaaaaatagatggccaacggattaggatccgctgacatgaagtcagagggacgtggtgactgatatgtgggcccaaccgctcgcgagcccacctgtcagtgaccacgtcaagggagatttcacgtcagaggatcttcttctgtggccgaccgggcggagcttgttcttggtccttgctgtgccaggtctggccatgcacgacatggccaaatgggacgtgtggaagaaatatgtgcatgcacatgatgaaacatgaatgtgtggaataaatactatgtcgttttgactgtttgttgacttttggacgagcttttcggcacctatatgaagttatgaacaatgaaacatgcagatctatagagatactagtgcatagcgtttattggatggtaattcgttgtcctaaaaataaaatggaactataccagtccaggcgaccaaacaacagtttttttacaagtgtttctgggcagtcgttcggcagtgtgacaacaatgacgaagagttgacagtcggcaatgtggcaattaacgagcaacaatctgaggcactccctccatcctaaagaaaatcaaatcatactaaaggggccgaatggcc

SEQ ID NO: 2730 - DNA, 1501 bp, Oryza sativa
ttttaattttgcttttgaaagattaatgctacataacatttaaattattataaaccacatcatattatttgtttgtagcttttttcagtatttaaattattataaaccacatcatattaattgtttgtagcttttttcagtatatagtcaatcatatgagaaattatataaagtacatacaaaattatattgtccaattatcttacatattatttatgttattatcatacgaaattttcatagtaatacacaaggtttcatctaggtattcagaatctttagccggaaaaggtatctgagactacaattatgaacagagggccgatcagtggagaatatatgtattgatatgataagagtttattgtgttgtttcaattcaaaaaagtaaatactataatatcacggattctcgggttgctttaagttgtgttccattcttttggtctcttttgtcctcgatcgatcgtttcgttgggaccggtttgatagagaaaggacgtagagagtccagtccagtaatggagctggcacttgcaacggctgaaactaaatcggtgattatatattctaattctatgctgctgggctgctagctagtgagaggtcaaacgtatcatctactactactctactttattcaattcctccaacaatggcttaggtttagatgtagtaaaggccaatgaatggagtgctcttttaggtttaggggaggtgcatcatatcaatcgcgatggaaaagcatcggccaggagataaagagaggaacaccggccggagaccaaattaaccccgccctctactagctacctgatcgcctcctgcaggccttgccactatctacactacacatgaaatttaatttatgcatatatatggcactccaaattaagtaagacatatagtactccctccgtttcacaatgtaagccattctagcatttctcacattgttaatgaatctagacatatatatctatctagatttattaacatcaatacgaatgtaggaaatgttagaatgacttacattataaaatggaggaagtattatattatttcagtggactaaaacactacgacaaaattaagaagtaagcagtgttcttgtcacaccttcttcgaacacgcaagaagttcattatttgccaccatgcatataatatatgtacacgatatgaaataatcatatatagtgtagatcttgcactaaaaactgggaaattttttggggggggggggggagagagcttcaactaaaccaaagcaccgatagatagtaactgattatcagctaaatcaaggagtaatgttgattgaaattaaggtactctatcgatcgaatatatagatgggctgtaggagtatatatagaataatgatggttgaggggtggcgatcgatcgagaagaaaataaagaaatgaagaagaagcaatatatgcatgcgcattgatatagacatacatattgagatgcaatcatctaatgtgatcgatg

SEQ ID NO: 2731 - DNA, 1501 bp, Oryza sativa; identical to SEQ ID NO: 2727

SEQ ID NO: 2732 - DNA, 1501 bp, Oryza sativa
agaattaaaaataagaaatattagaagtagagtatagtctatatagaaatacaattagtaaataatagaaatttggaattaaaaataaggaatattagaagtagagtatagagtctatatataaatacaattaagaaaaaaatagaaatttggaattaaaaaataaggaatattagaagtagagtatagagtccatataggaatttaaaactaactaaaatttggaataaacataataaaattaaaagtagagtttagagtccgtataaaaatacattttacaaataactaaaattcaaaattaagaaaaacatttgaagaagagtttaaagtcaatataggaatacaatttagaagtaactgaaattcaaaattaaaaattagtttagagtccacatagaaatacaattagaaataataaaaattctgaaataaaaataaataatattggaagaagagcatagagtcaatattaaaaaaaatattaaaaaatgagtcaatatatataatttacaaataactaaaatttgatattaaaaataattaataactaacacgtatataaaatacaatatgaatattacatattagtagttttgtaaagttattgcaaaatttaaaattatgttgtcattttaatatatttgaataatataatgagaaaacatactattgtcagggttatggataccacatacctaatagtagttgactaaatctcggcaggacccaccacataccatgtcttatacgaaaactgacttcagttatggagagagttccggataaggaaagacaacaaaagttttacatggaaacgacaaggactactcggattgtatccatattggtttccctacttctacttggacaatgggacacctatgggtataaatacaagcccccctaggaggacacggggacacccaccatgacaggatcaacacagtcaccacgatcgacacagacgaccacctcaatcaacaaccaccacaatatacggaacaacagaagccacaacatacaagccaacacatgctaagacaagccgccggatatcgacttcagggatagcatggctattcccctacggtgtctccggataccgtcaggagagacgaaagcgctatctctgatctcgccggacacagattcgaggaggaaggctaccctgttgtcgactacgagtcagaccttcagaccgacatgtcgacaacagttagataggctaccccacatattgtactggtgtgattatggtgaataaaagcaataccggctccggccaacaggatgtagggttattacctgacaactcaggggcccgaacctgtataaaaatccttgtctccgtctctttcacctcagtctcgcgtatattctagcaccgatgatccccatactatgcaaataccagaattgcgacatcaaacgtcgacagtggcgcgccaggtagagggattttggtgcttcaggatttcgacgagatgggtttaagaga

SEQ ID NO: 2733 - DNA, 1501 bp, Oryza sativa
cctcttcctcttccccgtctccttcatcttcgcgccgacgaggacgtgacgtgacgatgacgctggtcctccccatcctcatgcatcgcaccaccattgctgccgacgccacggacggctcgcttgctcccatgcccgccggccggcggcgagcgcacgcgaatagggaggaggtagggagggacaaccagcacacggagagagggaggatgcggcgcaagagcaggccggggctccaagtccgccgagtccacctccacggcacccggccctgtctccgcctctgtgcccaatgccgcggcgcctgcccgcacggggcggaggcgacgcagcgccgtcaatgccattcgcgaccgtccgccaccctcaccttctcccgcgtcgcagccgccgtcgcctcctcctcttgcgcctcgccctggcggcctcctcctcagccactggccggtttgcccagagaagagaagagaagagtaagagagagagagagaggaggaagggagaggagggggaagagagagggtgcggacgtggcatcctgacatgtgggctcatgtgggtcccacactgactctgctcatgtaggataaaaccagggtcaaaaccaccgaatgacctaaagtgaatggtttttataagttgagggatgtcatatatttggttttgcgattgggggatgattttgtaactcgatgacaagttgagggaccttgggtgtactttgattggcaaataggcggcccaggccattcggcccctttagtatgatttgattttctttaggatggagggagtgcctcagattgttgctcgttaattgccacattgccgactgtcaactcttcgtcattgttgtcacactgccgaacgactgcccagaaacacttgtaaaaaaactgttgtttggtcgcctggactggtatagttccattttatttttaggacaacgaattaccatccaataaacgctatgcactagtatctctatagatctgcatgtttcattgttcataacttcatataggtgccgaaaagctcgtccaaaagtcaacaaacagtcaaaacgacatagtatttattccacacattcatgtttcatcatgtgcatgcacatatttcttccacacgtcccatttggccatgtcgtgcatggccagacctggcacagcaaggaccaagaacaagctccgcccggtcggccacagaagaagatcctctgacgtgaaatctcccttgacgtggtcactgacaggtgggctcgcgagcggttgggcccacatatcagtcaccacgtccctctgacttcatgtcagcggatcctaatccgttggccatctatttttttcacaatgattatcctaatttttctcatgttcttcctatttcttccttatttttccttgccatcttttattttctttcttttttttcctgttcctattcttcttattcttcctatttttggttttcccaacttcgatttcaaatgtcatgggtcacg

SEQ ID NO: 2734 - DNA, 1501 bp, Oryza sativa
tgttacagcataaaggaaaggaaaaccctttttacccatacccagtgagccggaacatttggttcagtttacatgccaaatctcttgtacaaaaaaaatactatatgctgcaaattgtgcagcaaggggaaaagaaatctttttaggctgcccaaatcaatacattcctgtaaaaaaaaaatcaaactttggtgcaatcaaatacggttaaccatcatctaagaaatggagtacctccgtaaggagaagccaaattaaagctacagttccaacttctgggtgcccaactgactgagcatgatggccatgtccatccctgaggtcattgttgccatagccatctcgtacgggcatttcctagagaagccaatcttgccagccttttttaccttcctcatgcagtttttgaatttctcatggcatttcacactcatcagacctgcaaccaagaaaaagaagaactaacatgagttggttcagtaagagatgagatgaccaggaaaatttcataaagaaacaactgcagtgcttgtctctcacccctggatagtatgtttcatgcatagcccagtgaaaaatgatcaggcaatccaagcaagcattataatggttgtgaataagagggtgaagatgattgttttcgcgtaagtggggtatctctgctagtgtttctttttaaagaaaaaaaactcctacatagtatctctgctagtagataaagtttgattgtccagtgatttgaattcatgtgagttgatgtgcagcaatctgaaattgtttcgtgtgcaatcattcaagtctaagacagtgaattgagttagagtaaatgtgtagtatgcttattattgtaggagtgaagtaattggtagagagatccagagaggaagaaagaaactcctaacctttcttgtcgacgcagtggtcgtggtcgcggcagcaggcgtcgaggtcatcgcagggctcctctccatcgcagccgctccagccaacgccgcagtacttgccataccggatccctacggctgcagagacaaagagttggaggattagatggtgggggacgccaatcagttggaggtaagcgctcacgacgcacagtcgcagttgagggcggcgcacgagcggctgcacggcggcggaggcggagaggtggccgaggataggacgccggcggcgaggaagacgagggcgagaagcggcgatctcggcggcatcgtcgtcaagattggatgggatggtgaatttgcgattggttggtgggccatacttgtcagtctcagttacctaaacccactccaccacacgggtcgactcgactcccactcgtcaaccacccaaaccccccaccactaccgagtaccaaatggcggcggcggcggcggcggcggcggcgccctctccggctccctgcttcccttccacccgccacacgctgcctgggctcgtatctgtccgcgtctctcggagagtcaaagtcgccgtcgccatcgccgaccccgct

SEQ ID NO: 2735 - DNA, 1501 bp, Oryza sativa
agaacacacatgaacatcaagaacacaagatgaacacacataaacaaaccagcatctatagtatagttgtcggacttttttcaaaatcggcacttataaatacttaaaggtgccaatttttccctttagcgccccccgcgggcgctccggtgggtgggaaaagcataataggtgccggttttagttattccggcacctataatactgacttttatgtgtctttttgtagtactgatttgcagttgacatgattatcatcgaacacttatgggagaaaaaaataaatttgttctagccaaatcaatagagagtgcagatgagaacttttgaaaaatggggtccaaaaacatgttgaaacacatttgtttagatccatgcatgtacatggaaattttcggggttgctagtctattggtcgctcgctttgcacctgccaattgataggcccagtagttgacgtgatctgacacacggctgggatgaacgtaggttagctgcttcccaaccagtcaacaggacctcttaaacaaaagggaagtcaaataagaaaatgtttaattaatctagcctggttcggatgctagataacagtaatggagtgattaaatattgatgagaccactataatctcgattatatttgagctagcgaacatgcctgctatagttccctcaaaatcctaaagatatgtatggcgttagcgtcctttccagtggatacgcttaacacaagcttttgacgtgaaagttaattaatttactactgtacatggaaagaaattctacaaatacatcgctcttaggtaacagcatttgaattgaaataaagatacatgttgtcaaatcgaccaaataaactgacctccttcataggggcggaactagccaccgggcggctgcttgggctcgttagcgaaaactacacaaaattttaatattaatgagtaaatagatgatgaaatttctatagcaaatatcagttatattgaaatttgtctgggctcaaaaatctttctagctccgccatgcatccttccatcaaatactgtgcttcggttgacacatgcatgatgcatctggacggccaattaatttactctatatagctccagccgaatttaaattaagttcaccgtcacaacgccaggtatggatcgatgtcaacgcctacacgttttatcagttactagctgttttgctccccatgttgttagacaacaagaactggcaaataactattctgatgattgctctccaaatattcctcaaatctcttatttaatcaatctcctcattcaaaaggagtagctcaattatcaatgatcaatttgcacatccatttgtacctataaatacatcgaatgtttgcctgtcacatcatcaaacatcaaccaatcctttgaggtagcgatcactacacatatattcattcggtttcaggcgtttctttgctgtctcctagtgaacaaccttgtcagaattcagaatgttcagcaggggga

SEQ ID NO: 2736 - DNA, 1501 bp, Oryza sativa; identical to SEQ ID NO: 2729

SEQ ID NO: 2737 - DNA, 1501 bp, Oryza sativa
cgcgcagcagcagcagcagcagtgggggactctctccactcatcacatcaggagtgtgagggagagctcctgcagctttctcctactactgtaaagcagaaaagatgaaaacgtttcttttcttttttgtttattttatgctactactactatcatgtgtggtgttgtatccctaacgtaaatgggatagaatggaatcatttgttggcctccgttttcctctcccctttgacgaaccgtttagaattccacgactccccctactttagttgcgaacaacacggtacacagcatcccagaaaaacattcggtggcaaatactactagatttttatcacaggttacaaaattcgtatggttttgacgcttgcttttatcatttcgaatcgataacagtagcgtccatagcaattggataaacttgcttcaagtcggacgttgcagtctgaaatgaatgctagtactagtcctgcagctgcagcaccagcacacacaccgcagcagcaacagagaggcagcgtgtgtgtcttttgataaaggcgaccaaacaatttcggtacaggggcggtgccggtgcgcgtcaaacttgtgtgtgtttgatactactactactacaacaaaatagattacttgttcctttctgaaagtaaaccaaaaagaagataaagtagtacgtgtaatttgaagcaggaaagacgatcgaaattttattcaaaagaaaatagtagaagcttaggccccgtttagttcctaaaaatttttcccaaaaacatcgcatcaaatctttggacacatacatggagcattaaatatagattaaaagaaaaactaattgcacagttaggggagaaatcgcgagacgaatcttttgagcctaattaattcatgattagccataaagtgttacagtaacccacatgtgctaatgacggattaattaggctcaaaagattcgtctcgtggtttccagacgagttatgaaattagttttttcattcgtgtccgaaaaccccttccgacatccggtcaaacatccgatgtgacacacaaaaattttcatttcgcgaactaaagatgccctaacaaggtcctaaattaaggttaggttaggttggaattccgtctttccttcatgaaaagttggcgtagatttgcagcaacgccattccatccatctgttatctcccgttctgtcttttagtagttttgtttctttttcttgttgagaatatagaaaaatgaaactgctactagtccatatatatttcaggcaaataattaaattgagtcatgtaagggcatgttcaatgaagaccacaagcactagtggtctcaaaacaccacgtaggatacaaccacacaaagatcacattaaccacaatggaaacaactccaaaacgtattttgcatttcagccactatctatttatatgtcagccttgtggtgtatcttattatcaaacctattaaaactttatattttagtccctataataactaa

SEQ ID NO: 2738 - DNA, 1501 bp, Oryza sativa
gagaaattggatgtggtattaacagtaaatcgatgtccaaaacccctcactctcccagcattttccattgtccaagaatattagtgacccagtagaaattagtgaaatttgtgcttgggattgaagcgatttgaggaaatgcatacatgttgtgatcaatactaggagaatatctgaggcaccgtaaggaacacataaaaaaaaaagtaccttcctactccaaagtggaggtagagataaccctggcaccaactctatcgagctgagcaacagtagctgttgctttgagattgccggcattggcgaatgcctccaccatcctccggccaacctcctcgcccttctcctccccgtcaatgacagccacagcagttggccctgctccactgatggtgcagcccaatgccccagcttccaacgccgcggccttgaccgcagccatgccaggaatcagcggcgccctggttggctccacgatgccgtcggaggacattgcggagccgatgagggtggcgtccccttgcagcacagcggcgacaagcgcggccgcttggctggagttgcggacgtgctggtggacggccacctgtttgggcagcgcggcacgcatcttgctggtgggcgcctcgaagtcgggcgtgacgaggacgaagtggaggcggagggcaggtggggaggagagcgggatgaggtggaaggggtcgtagctgcggacgaggacgaagccgccgaggatggccggggcgatgttgtcggcgtggaagccactgacggctttctcggactcgaggcccgcgaggacgaggtcatcttggtgtaggagggagccgaagagggcgtcaacggccttggcagcggcggcggcggaggcggcggaggagccgaggccggagccgagggggaggcccttggtgaggtggatggagacggcgtgggacttgacatcgagggcgcgaagggcagcgatggcggcgactccggcgcagttgcggagggggtcgcgggagaggcggtcggcgagggtggggcgggagggggaggtgacggatgcgatggcgacggtgccggggggcagggaggggtcgagggtagcggtgacggtgtcgccgagggagagggaggcgtcggcgacggcgcagccgaggaagtcgaatcccgggccgaggttggcgacggtggcgggcgcgaaggccgtgacggagttgaaggccggagcggggtcggcgatggcgacggcgactttgactctccgagagacgcggacagatacgagcccaggcagcgtgtggcgggtggaagggaagcagggagccggagagggcgccgccgccgccgccgccgccgccgccatttggtactcggtagtggtggggggtttgggtggttgacgagtgggagtcgagtcgacccgtgtggtggagtgggtttaggtaactgagactgacaagtatggcccaccaaccaatcgcaaattcaccatcccatccaatcttgacgacga

SEQ ID NO: 2739 - DNA, 1501 bp, Oryza sativa
gaaaattttatgccttattttgtttgtagccaaatttttgactgcctattttttggtttggttgattttagttagtccacgacgaaatactctttagtaggaaactaaacactagctagcctagctagcaactcttacttaaaaaaaaatggtactacctccgttttaggttataagaatttctaacattaccaacattcatatatatattaataaatcttgacacatatatatgtctaaattcattaatatatatgtaaatgtgagcaatactagaaagtcttataaactgaaacggagggagtaacaatctaaacatctgcaatagtcaattctaccattgccgaaaattggcaaggctacaaaaagcataacgataccggccctaagcaacaactacattttaatcattcaacatgcccccaatattacgggcacgtaacacaaacacgagagacaacgtctctgtatctacgtctgttatgtgggttatcacttacacggataaaaagcctctatgatgtggatcatcacacacgttgattccagccgcgcgtccatgagttgatttttcgggctaaaaaaacccaaaaaaatatatcatattttaatgtaaatccatacacggtgccacacaattttcacgttaaatacatacctggagtaaataattttaaagttattgattggtaaaattctaattgtttcacctctcatccttaactaaaatatctgtaattacggaaccgaaggaagtagagacagtgtactttaataaaataaaatttttcttttattatatattattaaaaaatcgttgttaatatatgttttggagaccatgtccatattaaaagtgttacagtaagaattataaatttggagggagtatacatctaaatgagaaactgtatgggttagctcctgcgtaaaaatcgcctgtgtcgaagttgtttgagatgtccaagaactgtcagggatatcagatgtgctcgacggccaaaagttttgcacatacttttctataattatgtcatcacatcagcaccatatatatggaatctgcaccacaccaaactaaccatgaaactgtcaattttttttctactatattgctatcgtcatacatgagtactaaactagaagcattgattagtcaaccttttccaaagaaaagcaacataagcatgtgcgtaactagctagcaagtaaagctaagcttgggaaggaatatataggaatttttaactgcctccataattacttgcagagaaataaaacttctgaagcagcagaaaagaatctaagcacgtcttctttctctgtagttaagcatgaaatttcaagtctgtttaattgtcttccttgatgattgaaccagtcagccccaacatctctataaatagttcatcttgaaccataatttacttcatccaaaatcaaatgaagtcacctgtccatctcgaacatccatttggtacacaaatagttaaggataata

SEQ ID NO: 2740 - DNA, 1501 bp, Oryza sativa
  unsure (1)..(1501): unsure at all n locations
acagtttgcatgtaaatcgcgagactaatcttttgagcctaattacgccatgatttgacaatattgtgctacagtaaatatttgctaatggtggattaattaagcttaatagatttatctcacagtttaccaacggaatatgtaatttattttgttattagtctacgtttaatattttaaatgtgtgtccgtatacgtaaaaaaaattaaaaaggaactaaacacagccatagtattttagtttacccatatttatatctcacctccatcttcacgaattaataggaataatctcaaaggtgcatatgtcaatcagctagctcatgtgggatgcatgcatgtgtacaattgagcaaaccctactccagggacatctggtctaccgagaccaccacctaccaccgatgtcattacggatctgggattgggcttctcagccgtaaggncncagcgacacactctacactctgcggccaagtgcagagaacgagctcacgagatagaaatcaaaccacaaaaacatccatccatgttagtatcatctgctacactcctcattgccttcattatctttctctcttcatctcttgatcagctcttgacgatggtttagacgacaggccgtacggtgcacggctggtcatggccatcactcatcagtcatcaccaacggcgccacacattccgtcttgtactacaagattaattaattgaaaataaaattgtactacacgagatggccccggtgggcccacctggcagccgctcacagagttacggccgcagaggatcccgagccccccccctaaaattaaccaaccaaaccaaatcgcgtttaatttttcgcgcgcctcctctaaacccgcctagcttaaaccccctcgtccaccgatacactgacatgtgggcccacacccactgacatgtgatcgcccaagccgacccgggcccacatgtcatcgactcatcaagcagccagccaaccgtggtagagagattttttgaaaaaaactggaagccacgggcccctacgcctacacgtacccccctacccaccgggtccactcactgacgaggtgggccccactttgtcagccttcctcctcctcctcctctttctctctcctgccaccaccaccatggcaccagctcagctcagctcagacacccacacagtgagcccctctctctctcttctctctcctctttctctctcttggttgctgctgcgtgctgcggtgcagtgcagtgcagcggctgcctcccgaaagcaacaacagtcacgtcgctatcggcaccacccccacaaaacaccattgctcccccccatcgatcgatcagagctcagagaaagagagagagagccatggtggtcgtggtggtggtggtaactcggccagggtcgatgcactagtgacacaacgagtgcgagtgccctgaaaggggggaggaggagcggcttgagagggaataagctaggtggtggtggttcttggatcaa

SEQ ID NO: 2741 - DNA, 1501 bp, Oryza sativa
actagttaccaattgtttcttacacttgccatctcataaacccactaacctcgcgttattaggtacccatatataaagaaaaataagcgatttaagcatataaactccattgcttagctcttaacattatagcactccctctctctctctctctctctctctctctctctctctctctctctcttataatagttgtataataatatgaaagggaagaagtgttattcgagttctcactttttcttttttctttttacttcaattcagcagactgatttttttatgacacatgatgtatggtatctcgttggcgtatctcagtgaaaactatcatgatggagaggattagaaaagtcagaatatcattggtagtataaaaaaacacatggaggcaactggaaaaggcacaaacaaatctaaccagacttagtttggactaatcagctcaggtcacagggagctaaatgcttaggcttgaacaacaactacagtaatcctcctgtccacttgtgaaacacaggtagaggagatgtagatccagaaaaggcattcttctttaactaaggctgagtttagatccaaagtttgaatccaaatttcagtccttttccatcacatcaacctgtcatacatacacaacttttcagtcacatcatctccaatttcaatcaaaatccaaactttgcgctgaactaaacacagcctaacctcaaattaaacaatcacaatggactgatccccagaaacatttcgatatccagagtcttcttgtgcattcatagaagaaaatattcagactttttgcagatctgaaccagcctttgtcagattgggaaaatagctgtttttgttgttgcaaggatagattcttacatacataccatggttggtggtgtcatgtagaagtagttagtttcagaacttgttggccggttgttgcctaccctgtttgtcactgacctggttagatatctctgaaaagaatgaaaaaaaaaagtattagctttgacaaacgcacacacccatccaataaaaaacaccattcgtgcaagtacaatcctgtggtctgtcattctgtaaatcaacaagaacatgagcagcaatttttcaacgagaacacaaaagatttgcgtgaataagagcaacaaaaccaggccaataaaccattcttgacacttgacaggatacagtgacactgtgttgttgcacatggtaatggcaatcagctattgagctcaccaagcactagcatccatgacactatgacagtatgacatcttgcagtttgcaacaggtgtccaccttccatctcaagcaagcacctttcaaccacctcccctctcttcctcccttctccacacgatctgaattgcacaacagtgaacgaatctgaactatctgaccgaggagatagcaaatttcagttcttgatcggtgattgattcagtgattattcccaaatttccagtagctggcaaaggggaggagaagtcagcggcca

SEQ ID NO: 2742 - DNA, 1501 bp, Oryza sativa
catttggtttcttgagggaataagttaaacaggatatttataaacgaaaaatattttataaataaaatttttatatacatgttcttaacgatttaaaaataaaggttgtaaaataaattttgataaaaaaaactcaaaattaactctaaatttaaggttgaaagtttaaattttggctgataagcctaagcgaaaagatgagactctacgactctttatcagttgccgtgtcattgtcattcaccccaaggtttccaactttgcatggccataaatctaatcttagttcatatcaagggaaaatggaggaaatatcggcttgctttcatccttggatttggttagcaacaggggcggagctagaacaaaatggagaggggtgccattcgcttgctttactctactttaggccgagtttaggttgatatgagtgcctgagtttggattagaggggtgcctatatggtgaaaataaatgaactacaactaaaaaaatttattgaccgggtttctgggcaccccctcttcaatgtagctccgcccctggttagcaacaagctaacagtcgaagcactggaagtctgcaatagaaaaacaattaattcggcagagaacatactgagtcattttggagatttttttaatcaaatatatttagcgagaataattacatgactacacgagaaggtaaatactgtaaataggtttgaccttcctcgcctctggtctaaaaaaaatatactactcccttgttcttgtctgaagtactacaatgattcgaaaagctcccttgttcttgtctcagggaagatgaaactgaattcaacaatgagaggctgagttctgcagtaagccagtaacaagagtctacaaaggcaaggagcttcagcagaaaataactccaagggccaattttttcatctgaaataatactatgacttgtgcagcctgtattggagtatctctgaagtagtgtattactcttttcatcacaagagcaaatcaatggcacatgacttgaaattgaattatcaggatgctaacataacagacatgaataatcctatgcctgtgtagtaagtattggagtatctctgaagtgctcttatacggaataagtctggaggtatgcgatgcaattcgaccatgggcaagactggagggatgccaaatagacttatttagactgggagatgaatcagtgtggcccactggtctggcctgataagtgtatagcggtattgtattgggctcagcccatgagcccatgtagccccgagcccgatagtgttcgttcccctccgccgcttgcgtggactagtggacgcccacgcgaatacgcgatcctccccttcctcctcctccccaccaactcgatcgcgcgtcgcggaatccggatgctcccggcggcgctgctcgccgtcggcgcatgagcttcctccgcgcgctcgcggactccctgtcgtcgctgctgtactcggcggctgcgaaggggggagaca

SEQ ID NO: 2743 - DNA, 1501 bp, Oryza sativa
actgacttcatttcgaggggtcttattcaaagtcgctattatcttttttgataataataacaacaacatcttctattatttttataagataaacatggaatacattgatactatatataaaagagtttgctggttaatttcttctccaaatttttctactccggctcatcgatggactctagttaaataagttatctttctaattattatagatatatagtgggcccaaatttgttgagacatgatggacgtgtattctggtaatattgcattatctttgttaccactagattatttttactagctggcttagaggtctgtggttgcctagtttgactagattatttgatcagggtacatttcgaatttaatattaggacgttccccctttaatttttgcaatgggaaattcctcctttagatctgtaagaggtttacatgttctgtgtactgtcaagcgacaactaaccaaggctaatcttgtttttttatttacaagacaaattcccatcagatgaaaaaaattgcctgaagcactagatagatcaaattaaagacaaattaaggaggctaattaccgatcgactgttatggcatatgttgccaagattgattagtaactagtagtactctagcttgatatagggctattttaggagcttatagaggttataactttttctagaattagaagctcttcaaattaaatcaccagaagctatatatagctgcagaaaataaattaaaagctagaagctgtttttctccagtttctctaaattctcaccaggtaaatttctttgaactgcttttgggaatctaaaaactccctattcaaggttcatacgagtacaggactgtactagcttctacagtagttaatgctagggggttggcagatgggcactacctctaaatccacttcaaacatataatgcaaaaatgtgacagcggcatacatgaatatgatctcaaccctaccctaccatttgtgacaaaaaaaaaaaagctcacatccaaatttgtacccatttctgaggcaaccaagatgcctagctacaccacataatcaacagatccacagggatgtttctgcaaattaggccacacacaaataattaatgcactaatcatgcccagcttctaggctctccagccagcttagccccttgatatacatacatacataccaattaagagatcatgtatcactcactatatatgagggacacaaaatgagaggagatgagatggatgtgtagtttgtgtacatggttagcttagctctagtactactagcttttgccaacaacccagctaagctgagctgatctcttcacgtttgtggcgtgagctagctgagcttattaactatctctctaccaaatcaagctaagttaattagctggatagctagctcggtgtggtggtggttgtcgtcgtcgtcgtcgtctccggcgtcggtgagacggcggccggcgaagaagggggtgcgtatata

SEQ ID NO: 2744 - DNA, 1501 bp, Oryza sativa
aaagaaacaaacaaacaaaaaaaggaaaacctaatctactggaaacgaaatgtacaatcggtcaaaaacaaaaaaaaaaagaaaaacataatcatattggaaacggacaatattttgggaatacgtgtgttcacaccacttttagaaacattgaaaggcaaaacaatcctaatcaaactctgccgtttccgaattgtatcagtattgtcatgccaataaatacataaccaagccaaaaattagcaagccaaaaatacataaccacgtttgctgtggaggctagaaattcccacattaatcggagaaaaagaaaagaagagtccaaatagaaatacaatcaaaaatagctgaaatttggaactaaaaatatgcaatattgaaagaggagtccatataggaactcaatacgtgattaattaaaattcggaataaaaataaaaaaaatcgaaattagaaaaaggaaaaataggagttcgagtaggaatacaatttaaaaataactgaaattcagaattaaaaataaggaatattgaaataagagtccatataagaatccaatacaagattaattaaaattcggaatgaaaatttttaaaaaaatcaaaattagaaaaaagaaaagaagagttcagaatacaatttaaaattaacttaaattcgaaattaaatataagaagtgttgaaaataagagtacatataacaacctaatagtagattaattaaaattcaaaataaaaaataaaataaaatccgaaattaggcgaattaaaaagagagttaaagtaggaatacaattttgaaacaattgaaattgaaaataaaaaataaaaataccaaaagaacacaatacgaaaaataaaataaattgtgaaattaggaaaagaaaaatactaggaataccatttataaataactaaaattggtgataaaaaatcaagactattgaaagaaaataccatctaaaacacatggcgagattaattaagtaacatgcctataaaggagtagaatggtggcggttgatacgacatataaaaactgttaataaaacaccaaatagaatcctaataacgattgaaatgaaggacgacgggtaggccgtgaagcaatcgatcaaggcggttgccgggacttctagaaagtaaaaaaaaacaatgctaatcatattggatttttaaaatctcaatgataataaaaaggagaagcagtgggcgggatgtatagtagagccgccgacggttggcgggacttctagaatataaaaaatgaattccaacgatagttatgttagatttttagaatctcaatgacaataaagagtaggtggcggaagggcagaggagtatagtgacatcatttaacgggatttctaaaaattataaaaaagaaaccaacaagactataaactctaaaaactacgaggtccaatttttaaaggtttggaacttctaaaaagtaaaaaaaacacaatgataatcatgttcgattttaaaatctcaa

SEQ ID NO: 2745 - DNA, 1501 bp, Oryza sativa
caggcacatatcgaattgccttagtttaaaaaaaattcgttggttggcgatcataagtcatggtctggcctgaaactgaaagctccattcattccggccatctcaatcggtttggattctatattgattcgatagatagacagacagatcgtgatgatgcactaatccggcccagtagtgtgactaggagtaaatatttcagttgattaatactccataattaggataaggatggccatgtgttgcattattattatcatggtatttattttgatgtcggcttcagcttgctgccaaatcaagtttttttgtcccgatcggacgcgagctaatcttcagccggtttgaaggcgagaagagccaaaccaacttggcttttgtaatctggctgtcgatcttgtggtcagggttaatgactcgcctgactgccatttttgacgggttttaataattgcttttcttttcatcttgcgttttgccgcatgtttatggtgtggtgttcaactttatttttttttcttttctttttttttcggggaaagggaaataaattactcaggaataatatcgtttcttaccagacctaaaatacaagtgcagctattaccgcaccagagattttcttttcggaatggtgttcaacagttctgttgcgtgtgtggccatcgtcgtatgcttgtcaacttattattaattattcactgctaaaaattgagttttgtaatttaattctaaatttttttatcatggtttatttttcaatgttgattttataaaccgcaaacaaaaaatacatagaaatttcgacttataataaaatattcgttttacttatcaatcatggctcaaacaattagtttaagatggaatgtttgtccaccaaccagcaatgatgtggacttgttgagccgccggcgccaacatttgatcggattatttatttattttttcccctcacgatgcaacatgatccacttgttcactgcatacttagagtaaaaacaatagcggactattagccagttataaacatattttaataaaataaaatatgagagaaaaaagcagcgggctacagatctgtagccaattgcagtatggactttaagacacattgtgcgtatgatagatgggaccacatataaatagcatagtaaatagctgttgtatgaattgactataggtgaattggagtcattaatgggctatactattgaacttgctcttacgggtgggccccaacctagtactgctggagcaagagaacgtgcggccgccgcaaaatccccaccacccacgcgcgcatcggtcggctgccagctaagccgagagcaaacatttcgtcaaaaccccctcaacctttcgtaatattcacaaccgtacccctcgatctacccaccgccgccgctgctgcaatgatcggaacaagcgagcgccacgtggcgtgtgatgtggacactccggaatatatttttttttaaaaaaataaaaaatatatcac

SEQ ID NO: 2746 - DNA, 1501 bp, Oryza sativa
atgaacaaaagtattacagcaaccagatgaacggactaaatgcaacgtaatagcaggaaaatgtacttaaagataccgtgtttatccaggaaattaatccgcagtaccttgtctttgcgagccttgttcttcgccgcatcgctctctccttgtttccctgtagaggacgtaggaatttcatcaggctataactacagttcagcggcagccggggtgaaaggcgtaaggggagcgcacctgaggagtctccggcaacggcgcccttctcgccgcccttgtgcttctcctggatggcgatgaggcggcggagcttggacgggagcgcgtcgagctcccgctgcttcggtggtgggggcagccgcgattcgccgccgtgcgccgcccggtagttcttctccctccgcctctgccctttccccggcatctcctcctccgccgccgccgctgccgccgcctctcactgctcccttggtcgccgccgccgccgccgctcggttcgattcgaggaggaaggcgaggtttacacaatgggccagttgccacatgggcccaaagcctatttatcattaggctttaggcccatgtagatataatggaatatgtctaccaacaatccctcttatttaattggcatccgcaacaactgaaatcttgaacctccaacttataaaatcaagttaaactagttgggtggcccgtgcaattgcgcggctagcacccaaacaaaatcatatatttttcagtatgattttacttaaaatttattaaattgctatcacgttgtcttaagactttgaaagaccaaagcttatcatccccgtatttctaattatatagtttttaaaagtcacaccagctactaccccttacttctatcatatcctttttatttgcttgcttgatctaccactatttgaaacctttaaaaatcagatcatatagtttttataatttctagaagtcccgtcaaacgcagtcataatactcctctacgagccgtgaactgtcttttctctatattgtcattgggattttacaaatcgaacataattatcgttcgggttcattttttacgttctaaagtcccgctaaaccgtcagcggctttgccattgttttcctttatggcacgcccgctgcctcccttctttatcgtcattgagattttaaaatcgaacatgattatcattgtgttttttttactttttagaagttccaaacctttaaaaattggacctcgtagtttttagagtttatagtcttgttggtttcttttttataatttttagaaatcccgttaaatgatgtcactatactcctctgcccttccgccacctactctttattgtcattgagattctaaaaatctaacataactatcgttggaattcattttttatattctagaagtcccgccaaccgtcggcggctctactatacatcccgcccactgcttctcctttttattatcattgagattttaaaaatccaatatgattagc

SEQ ID NO: 2747 - DNA, 1501 bp, Oryza sativa
ttaatttgcatgtataggttgtgtttagttccctcaaacttccgaaaaccaattgcacagtttgcatgtaaatcgcgagactaatcttttgagcctaattacgccatgatttgacaatattgtgctacagtaaatatttgctaatggtggattaattaagcttaatagatttatctcacagtttaccaacggaatatgtaatttattttgttattagtctacgtttaatattttaaatgtgtgtccgtatacgtaaaaaaaattaaaaaggaactaaacacagccatagtattttagtttacccatatttatatctcacctccatcttcacgaattaataggaataatctcaaaggtgcatatgtcaatcagctagctcatgtgggatgcatgcatgtgtacaattgagcaaaccctactccagggacatctggtctaccgagaccaccacctaccacgattcatacgattgattggtttagctagccagaaattaattggcaatcaaacagtacaaaaacatccatccatgttagtatcatctgctacactcctcattgccttcattatctttctctcttcatctcttgatcagctcttgacgatggtttagacgacaggccgtacggtgcacggctggtcatggccatcactcatcagtcatcaccaacggcgccacacattccgtcttgtactacaagattaattaattgaaaataaaattgtactacacgagatggccccggtgggcccacctggcagccgctcacagagttacggccgcagaggatcccgagccccccccctaaaattaaccaaccaaaccaaatcgcgtttaatttttcgcgcgcctcctctaaacccgcctagcttaaaccccctcgtccaccgatacactgacatgtgggcccacacccactgacatgtgatcgcccaagccgacccgggcccacatgtcatcgactcatcaagcagccagccaaccgtggtagagagattttttgaaaaaaactggaagccacgggcccctacgcctacacgtacccccctacccaccgggtccactcactgacgaggtgggccccactttgtcagccttcctcctcctcctcctctttctctctcctgccaccaccaccatggcaccagctcagctcagctcagacacccacacagtgagcccctctctctctcttctctctcctctttctctctcttggttgctgctgcgtgctgcggtgcagtgcagtgcagcggctgcctcccgaaagcaacaacagtcacgtcgctatcggcaccacccccacaaaacaccattgctcccccccatcgatcgatcagagctcagagaaagagagagagagccatggtggtcgtggtggtggtggtaactcggccagggtcgatgcactagtgacacaacgagtgcgagtgccctgaaaggggggaggaggagcggcttgagagggaataagctaggtggtggtggttcttggatcaa

SEQ ID NO: 2748 - DNA, 1501 bp, Oryza sativa; identical to SEQ ID NO: 2741

SEQ ID NO: 2749 - DNA, 1501 bp, Oryza sativa
gcccgtctcccggtttcccccgcccccaccgggagccaatcacgcgcggccgcgtgtacacacccgcctcgcgatgcggctccgcggccgatccgacggcccggaggcctcccgtgggccccacggagaccggtcaatggcggtcaatgtgggcccggcccaccggctgcagccggtcgccaccgtcccgggcgccgcgaatctatttaaccggtttgctcgtcggcgaggacgccgcctacaggcgcaggaagaggaggagaagaagcggaagaggagagaaaaaaaaaattcgcagcaaaaaagaaaaaaaaatcgcagctgcaaggtagaggaggagaagttggggtttgggagggccagcgattgagccgacgaactcaaggtgagagagatggtttggtagtgggggggggggggttgatggctcggaccgcgggaagtgacctaagtatttcttgtttttgctcccctttttggggggcgatttgtggttgggttgtgagaggaggggttgggtgattttttttttgggttgatgggtgccgattcctgcaatgtagcgtggtaattttgggggtgtagaggtggaatttctgttcttggtcgagtgttagcttaatctttgtagctcggtttttcgattggtttttggggggcgagtttgggctagggtttttatccatctgctacggagcaaagattaggggggaatttttctccttgtttcgtctcctgctcctctactttgctagggttggcgatccggctgcgggcacatctccggccttcgttgtcctctctctccatcctccccggacgtggcagtttcccctcccctcctctctcgattcgttgccctggagccttttgttgtgaagttagttcagtattctattttgtctgatgtgaacttgatttctatttcatttctttcgttgtttgatctgacctggaagacattttggtatatgctccattcttgtacttgtatgagaggaacctgggaaaaatatttttttttgtgtggtggaaagaatgctaaagctcggctaatttcaaccaaaagagtaaatttcagctcacaccctgcataaccagcatcaactgttttgcaatttgtgtttcatgctatattttctgtcccttattttcttttcaaagacgatttttttatttatttaccatttgttggattctagtttcattttctggttatgctattgcagtagcgtagtatggttagagaattgaaaaatggccttcttctgttttctgttttttcaaccattgaatcgagaaatttcatgatgctaaaatctcattactacttgcatctgtttggcttcagttactgctgaccatttctcagttctcacgcattaggctgttaacagttcttatccagtaagatatttgatgatttatttcctaataattcatgttcaccttttgcaggttcttcaaagtgatgattgggatcgaaccctggtaacctcca

SEQ ID NO: 2750 - DNA, 1501 bp, Oryza sativa
gcggcgcggggagggagaggagccgggcctggcggcggcggcggtgtctgcatcggcgcgcggggagggaggcggaggccggcgccggcgaagggaggggagccgggcctgcggcagaggcggcgctggcggcatctgcatcggcgcgcggggagggaggcggaggcctgcgccggcgaagggaggagaggagccgggcctagcggcgggatgcgcgcggaggggaggcggatccgcgccggcgtcagcttgtggaggtaggggcggcggcggcggcggcgggattcgcgcggaggggaggcggatccgcgccggcgtcagcttgtggatgtagggggcggcggcggcggcggtatgcgcgcggaggggacatgcgccagtgcctgctcgccaaggcccccaccgccgccgatgacgatggcctcgccgccggccccgccgatgtccctggcctcgtcgcccgctgactcgtcggccgcggcgccgagccccgccgacacaagcgccgggatggccccgtgcagcgagctcacgcccgcactcgcgcccgccgtggccgggaagagcatcgtcgtcgccgtctccgcctccgtcagcttcgttgccatcgccggtcgtcagcttcgttgcaagggcaaaatagactatttacccctaacttaacaccgtcaactcaccttaacagaacagggtcagaccgatcgttcgttttcgaaaagcagggtcaaataagcaaactcaaaaaaagagggtcaaattggtagttagccttcaaaacagggtcaaataagcaaatggcccttatttttatataaggtgaaacaacacccgatttaaacgagtgaaacattttcgatctatttagtgaaacaattctgatatacctggtggaacatcgtgcaacatttaaaaataattcaacagtaagctaaaaaaaatcgtcggaatatatccatgtgtggtcttattttgaagatttaattgcaacgaatttaatggtgaaatcgaatcatgatttagataagtaatttaagagaaaaattaatttaaagtagtttttgcacgtaaatcgggcgctgacatcagcgcccgatttttccccaaacgtcggacgtccgagccggagttgcctccacctgcaaattagatttcgtgtgcggtacaaatcttgctcctccacctgcaatcgaacgaagccgtcgcgtgctaagaataggcggccgacgcggcgcgcgtatgcgagaatttgcgagcggtggagcgcgcgaggcgggcccaaccgtaggggcggcctgcttaaactaaacttggcgcgctcattggcccacataacccgcccacctctccgccaccctcttctagactccctggccccacgccccctcctccctctcctccgattggccccaccaaccagagagagagggcgagagggcgccgcgcgcctcctccaataatacactgccacgtcttgcgtgccacgtaggccaccccaccacca

SEQ ID NO: 2751 - DNA, 1501 bp, Oryza sativa
tcacgacagttgcttctgcaattttcgctttgaaaaaaaaggtgtacaagcaactggcgtgaaatgtggagcttaaggggtgcaatttcttcgtaacattctgatggtcaaagcaagaggcgatgcagtagtgcaggagtttggtagagagcagttcagtgcttgaagcattttcaaaatgtttaggcaattccagacacagctgaatatgagttgctaccacttagaaaacatgtatggatgcagaaaaacggtaaagagagaagggcaagcaatgggtgtacattgtgaagtggggttgtggaaatttgcagtggatctcccagaacaagaagcatgatgatcatggtttgctaccacagaaattgcttttggcaacagagagagagatgcctccggaccaatcatctgattctgactttttcttatgttccagaccacaccatccaaccatcatcaactcttctctgctctgctctctctctctctttttctttttgagggatgacatttggaacgtttaataagaagccaggggttgaacctagttaaaaaaaattgattaaattaaaaacatgtctagctaatttacgtgctacgcaatttatcttccaattacaatacccaatagagacattctctaaaccaaatcctcgactgtgtgttcgctcggcaggtcaggttccgtgtgttgtcgcctcctggctagaccgctctctcttcctcttgtggcagtcggcttcaggattggtggccaacctctagggcctgctttatctgagcatctccgtgccggtttcgactctctgatacttctggtctcttggcactatggaaggaacggaactccagagttttcgattctacgctctcttcggtctcagtggttctagagtatatctgcttggaagatcatctgtggtctttagcgtgcattgctacttttggagatttattgaaaatgtaacgtggctctaccccttcccaccaatcggagtttcatagccgccgtagtagttttttttccttcctagctacaatttttgttttgcttttcttcattcccctagcataagccgatctggctgattgcgttgtgtatcaaaaactatttttcctctaatatattaacgtgcaattattttacgcgttcgtgaaaaaaaatagaccaaatctcaggacatgacattcatcaactctgctctctttcttcaaagagatacggagtatcatgttttgttggtctcctgttaattacgactactcggtgggcctcaaattgggcctggcatgtaggcctgccacgagggccatacaaagcccaaccccaacaaatccaggcccagtatgacagtgtccaagtcaaaggtgcgcgcgcgaggagcgcgggccagattgcggagccgagtccacgacccgatcttggctccgccctcgccgccgcgcgcggccttctatataaaccgtacctgccgctgcgtgctccggcgtgcaaccgcca

SEQ ID NO: 2752 - DNA, 1501 bp, Oryza sativa
  unsure (1)..(1501): unsure at all n locations
ctgcaacagataattagaccagcattattatgctgatcattatcgttggaagactgcaggtcgttgccaatggctgaaaaaaaatgatttattttttttctgatgatgcaaccgtggagacgctaagctgaggtcaggtcttcggtcgcatatggtagccctttgatcaaatcttaatgtttagatgtcatcatcaaagaagaccttgacttagtaataaaaagggaataatggtaattgcaaaataaacagatactaaattaaaatcaaagtaatggttcacacttcacaaggtgatccagtcttttattgcttctcttcctagttgggatgcagtgcagtcataaacaagaaaatgactacacgacctggtttcaggaaaataaaaagaaaaagaaaaagaaaagaaaaggactagatgtgatgcgctggaagtatagagataaacatgggtaaaaatattacagcttgtaagtaagaaaaggcactctgcacaagtaggtagcgtttgaaatagatttacttgttggattattgttgctgattatctacttcattattggaataaattaaatattttgataagtaaatttaacaaaatagtttagaacaagtagtctaagcaatgtttgacacttagcaatacaatagaagattttttttttaggaaaatgtatttctaaaagcatggagcaaagaatgcacatggtgaataagtttgtaacacctgtgatacagttagagaccaggatttacatttaacatatcatttttcagaaatcaagagacaagatgccctctccatgacaagaagttatccggagtgattcatgtagaagaaataaaatttaccatagcattacattaattgcatatgttttacaaaacaaacaatattacagtatatgtaacagttggacccctacctagcctagtccctttcagtcaagacaactactggacagtaaaacacttgcacacagagagagagagagagagagagaacgacttgccgatatataaatactcattgagccacccaccctcttaacaaagaattcgtccagccttgggaagccgagaagaggagagaaacaagagacagaccgccgagatagagtaactgagtaagcatctcgatcttggcatgttctttcttcttcccctttccatcaatgatttctcctcttgttttcctcatcacnaactcntgcagagacctgttcttcaacccaattctgctcttgttatattgcctggattcctttttttttttggttcttggaagcttctattgccgctgcttgttcttgagtgccctctgcaatttatagataattttcttcagtttttttatccaaaaagagttcttggattagttgtaaagaagaggttaaatcaaggaaggttgcatcttgttcttgactgattaattggtgtgccatgatctgcaggtaaacgggttcttgcctgacatttgtcttgtccgggtggccattca

SEQ ID NO: 2753 - DNA, 1501 bp, Oryza sativa
aacttgatgttccccaccggcaccgacacgtccttcaccgcctccttcgactgcacgtacggcgcgtccacgtcccactgccgccccagcgtatccttgtcgggcgcgatggccgggccgccgacgttgatccggtacaccacctggtacgccgcctcggcgagcccggtcatctctccgacgggagcgatccccatggccatgtctgtgatgagctcgtcgggggcgttcacgacctcgatggcgttgatgaacgcggcggagcccttgagcgggtagaacttgacggcgaggtggttctcggtggcgttcacgaggaactccttcatgaccggcttgttctcggcggtgaagctgtggaggaggacgttggtgtcggtggagacggtgaaggtggcggtggtgaggtcgaagtcggagttcttgagcgggaagaggtagaggcggacgaagtgccagcccgggacggtgagcgggaagctgtagacggcctcgtcgcggaagatccgggcggtgaggtagagcggcgagggcacgtcggcgtcggtggtggcgaccttgatggcgtccttggcggagagaaggctgttcgactgcgcgtccgtcttgtacaccttgccgccggtggtgacggggctcgtgctgccgcagtcgatgaggaagttgtccttgggcgtgaacgtcgacggcgtcggcgccgtctgcgcgccgctctcggtgaccggccgcccctgccccgacacggccgtcgcgagcgccgccgccaccgcggcggccagcagcagcgccggcgggatcatcctcccgcggcggcgcatggtggtggggtggcctacgtggcacgcaagacgtggcagtgtattattggaggaggcgcgcggcgccctctcgccctctctctctggttggtggggccaatcggaggagagggaggagggggcgtggggccagggagtctagaagagggtggcggagaggtgggcgggttatgtgggccaatgagcgcgccaagtttagtttaagcaggccgcccctacggttgggcccgcctcgcgcgctccaccgctcgcaaattctcgcatacgcgcgccgcgtcggccgcctattcttagcacgcgacggcttcgttcgattgcaggtggaggagcaagatttgtaccgcacacgaaatctaatttgcaggtggaggcaactccggctcggacgtccgacgtttggggaaaaatcgggcgctgatgtcagcgcccgatttacgtgcaaaaactactttaaattaatttttctcttaaattacttatctaaatcatgattcgatttcaccattaaattcgttgcaattaaatcttcaaaataagaccacacatggatatattccgacgattttttttagcttactgttgaattatttttaaatgttgcacgatgttccaccaggtatatcagaattgtttcactaaatagatcgaaaatgtttcactcgtttaaatcgggtgttgtttca

SEQ ID NO: 2754 - DNA, 1501 bp, Oryza sativa
tttttttactttctagaagccccggcaaccgccttactcgtttgcttcacggcctgcctgacgtccctccttttaatcgtcattaggattcaatttggtgttttattaacaattttatatctcgtatcaaccgccaccactctacttctttataggcttgttacttaatttatctcgtcatgtgtttagatggtcttttcttttaataatctatatttttatcacaaattttagttatttttaaattgtattcctaattgaaatcttatttttctttttctaatttcagattttcttaaaaaaaagttaatatcgtattgtgttatttttaatgtttttattttttattttcaatttcagttgttttaaaattttattcctacttgaactctcttttaatttttctaattttagatattattttatttttattctaaattttaattaatctcgtattgggttcttatatggattcttctttcaatgttgcttatttttaattccaaattttagctaattttaaattgtattcctacatgaactcttattttattttattttcctaatttcaaatttatttatttttatttcgaatttcaattaatcttgtattagattcttatatggactcttcttttattattcctaatttttaattccgaattttagctattttctaattgtattcctacttggactctcgttttcttttctaattttgaattttatttcattttatttttattttgaattttgattaatctcgtattgggttcttatatggaaacttatttcaatattccttatttttaattccgaattcagctatttttaaattgtatttctacttggactctcctttcctttttctaattttggattttattttatttttattttgaattttgattaatctcgtattgggttcttatgtggaaacttctttcaatattgcttatttttaattccgaatttcagctatttttaaattgtacttctacttggactctccttttctttttttcctttttctccgattaatgtgggaatttctagctcccacagcgaatgtggtgcctcctttcaaagctgttttaataatataatagattagcatataattaattaaaaaaaatactttatatgccctaaaatatatgagattttgattggatgaaatacattgtccataattcatagtattagaatgtattctatgcaaccaaaataccctatattttggaacgaagggaataattattagaaacatgaaaaataaatttagtttggctttttagtattaactaaaaaaatttcatacaaaacataccatttagcggtttgaaaaacatgttaacggaaacgagaagtagctatgctcaattagatcttggggtcttaattctcgtcttctcggctaattaatatgtctccacgtttaatttaactctcggatttcaaaccttaattcagcccatgatggaaaaattaaccaaccaag

SEQ ID NO: 2755 - DNA, 1501 bp, Oryza sativa
taaccgagtcttgcttgccaagcgagtgcgtgtagagtggttttattgattaaacataatggtctcacaatattttagttaccttttaaagaaagggttaggctttattgattaaacataatggttacaatcccgcaaaataagataatgtacctttactattgtgagacgtgacattactaacaaaaataattatttggatagggagactcggggttttcaaaatcgtgcagttgtcatataagataaaccttctcagtttttgaaaccacaatatacctcatggtaaccgtacggttttcacggtaatcgtacgattatcacagtaaccgctaaagcgtggggtgacggtaacccacctaggttcggtgaacttgcatggagtacacaaatcatacggacttgcaaaacaggtgcgggtacgttcccaagtgcgcgtagcaaattattagacgtgcagagggtggagtcgctgtcccgatctcctctcctaataaatcacaacttcgcttctcggttggcagcagcgatttcatccaagcaccacgccgccgccgccgtcgaagccgatctcctgcgcgcggagcggatcgcctctgtcaggtacgacccgccctcttcctcctcccctgctaatttctcttcgcttcgtcggccacgccacgccacgcgcgttcttgccaaccttggtctcgcgagcagcgaggatggggaggaggagaggaattcctctcgaattgatcgccggttgatgcgcccggcttgttcctcttctgcggcctaattttgtacgagttcgggggttgtttaggtggagaaatttggtacagattcgattttacccttttggtcttcttcttgtgcgtccatgccgccgttcatcagctacggtgaccttttccagtctagcttttggaaggggccgagctcccagccatggattagctatcatcaacttagtcaagtgacttgtcgagttgtcggggtgtagttcactgtctaggtgttctcaaaatcaccaccttttatagtggcacgcctcttaaactgtatccatgcaatcaaatttaaatcacatgtcattgagttaacctttatgctactttacaggccactgtaaattttaccgagtttatgaaattgtgaatatgtgctaaaggttatatgagctcctttttttttagcagagcctgctgtttaaattatagtcttataggtagcctgatgagtgatgacaaaccttattctgctactgccaatttttccgagattctttaaacctttagctgttagccctgttacattgctttcggttttggcaatttcttcgttatcactatgcaacagagatcacgactgagcctatattatttttggaattaatttgtttcttttcctgcttcaattgtgtccctgattctgtcacggtaatgctcatctattcactgctataattgtgacccaacatcttatcaccgatgcagtcaccagctatacagta

SEQ ID NO: 2756 - DNA, 1501 bp, Oryza sativa
gaatggtagttattagttggctatactattgaacttgccagagaccaaccagctactccctcacgtgcggctggattaaataaacattaatcaattaattaattatagagacaatcagttgccacttgccaattaaggaagaaggcataagtactgtagcactgcagccgcacactccacgtctccattgggaggaaatggaaaatagtttttcttttttttaaaaaaaaatagaaaatagtgctccttccgttttatattataaatcgtttgatatttttcttagtcaaaatttattaggtttgatcaaatatatagaaaaaaagaaacatgtacaacatcaaatttcattaaatttaacattgtatatattttaatataatgtttattttatattaaaaaacattactatattttgcttaaagtttgacttaaaaaaatctctactattataaaattgaagatgtttttgccggtattctagtacatcatctgtgtatgagtcggtttttaagtttgtttgcttttgaaaatatatatccgtatttgagttggtttgtaagatcgttcacttttgtatgatacaaaaggaatcatataagaaatctgtttaaaataactcacatgctaaattgagacgatcggattccaaactttagctcatgattttctaaaaatatatatatccaagtgaactcccacagtgaattttatcttaactaaactatataattaaaatagatttcacccgttgcaacgcacgatattttttctagtactccctccgtttcataatgtaagacttcaaacattggttatattcatatatgtgttaatgaatctagacacacatatatatctagattcattaacatctatatgaatatggacaatactagaaagacttacattataaaacagaggaagtaactcataaatacggaacgaaggggtagaaatatccgcatctcatacacacacagaagtggtcagccgccgcccaaaagcttgcctttgtcgccatctccacgtggccacccccatatactattgcttaacgctgtcacctcaccctctcgcggtttgagttttccacttccacggttccaccccgacacctagcgaagtactcgtagtaatccgaatcccaccgttccatccgtcgcggacgccacgctctcggctctcagctcacgtgacgtcaaccccgccaaaacgcgttattgccgtagtactacgcctcttcttccacctccatctccccctccgacatctccagccaattccagctcagctctcgccgccctcccctctcccgccacgtgcgcgccgcccctcctccaaatctccttttcttttccttttctataaataaatcaaaattcacacaccaaatcctatataaacttcttcctctccatccccttcccgctcaaactcaaacaccaacaccttcttcctcttcttcttcttccagcagcagcaacacacactactgaca

SEQ ID NO: 2757 - DNA, 1443 bp, Oryza sativa
ttttttcagccacttacacagtagttacacctcatttacaccccacttacatatgtaattagtatgtaattttcgaatttacatatgtaattttcgaatttacatatgtaattttagtacttagacttacattataaatacactaaaattacatatgtaatttagggacttacaatgtaaatacatgccgactattttttcatgaaaaatatggccccataaatatagctacacccaaagaaaatgctattataatttgtgaatgactattctacccttgcttcaatgaaacaaccaaatccccaaaccttgctgtccccgatccaatcgaaaaacctagcttgttgggttgcaagcggcggcggcgcgcggcagggaggagcggcggctcgggccagcgcgcggtggagtcgggcgtgggcaggcgcggcgcggtggccccgaggagcagcggctccgtcgacgcggcggcgcggcggccctgcggagcggcggttccgtcggcacggcggccccgcggattgcaagcgcagggaggcgcggcggccggcggccccgcgactgaggagcgtcggaaaggagcggcgcggctctgtcggcgtgtcggcgcggccccgcggtgttgcacgcgcagggagacgccacggccggtggccccgcagccagcgagctagcaagcaacgagcaggaagtgtgcttgcagcgagctagcaagcagcgagcagaaattattgctgaaattttgtccttgatagtgtgctgttatcttctataatttgtgtccaaattattgatgaatttctgtcaaaattttgtcaaaaatattgttctgacatcgtttataaactgtgttcaaattattgcgaaagttctatcaaaattatccaaaatattgtgttctatcaacttttacaaaatttgtgaacatttatttcccatatgaaatttgctcaaaattaacttgaaacatgtatcctgtgcaagccaaaacatgtcaggggtatactcgtccattcaccacacatttaataccgttaccatcagttaacagagtaggggcaggcagctaccctgtttaaaaaaagcatgggcaaaatcacaaaccctaaaaagtatgggtaaaatcacaattgagatgtaaagcaagggcagagacacaattgcctctaaaagtaaatatggctatatagaaggaaaaaaaaggtaaagtcataattgattatgaaaataagggtttcaacaaaaattactctaaatatattttaagagtttagaaacatgggtaacatagatgaacaggtttagagagtaaaaattcactatttaaaattagaggtaacacgtttcttccccccacacgttattaactgtcatcgatcgagtatagcatgttccgtttctgagccaggaggtgcccacaatgtcgccagaggtgcacatgca

SEQ ID NO: 2758 - DNA, 373 bp, Oryza sativa
aatttccacttcagttcatggggtttatgaatttatacatatggactagcaatcaagaaaagtgcagttttagttggatagtgggtcaataggtaagcatgggtggacccacttgcagccctagtggcttcttctccttattgaatgtacttaccttataaaacttcgtctttcactttatgcatattaacgtatgctttattggtgatatggcgcataatcttgataaccctaacacagagagaaggcatgatttatacttgctaattttggtgaacacaagtcattgttgattagataggctagggtgctagaccaataacagaattctcccctcgtgctgccacctccctgcatcgctccctcccgtagc

SEQ ID NO: 2759 - DNA, 1384 bp, Oryza sativa
ttgtacaataaacagtgtgggggtatggagaggtcttctttctcttgtgggccttaccttcaccttttgcattcacacattggcatatataaatactagagttagggaataaaagagggtttggggatagagggacttgaaccctgacttagaaagtcgacggattttccttttaccagaaatttcattgttgtcagtattgacatgtagaatgggactctctctttatcctcgtccgattaatccgcttttaaaaagatttcaaaaactatgatttgaaggatttgattactcaatattcgattggaatggattttataacaccaactaaaaattatcacaaaaaattctaggaaaattcatacatgtactttcaatagtattacatctacgtgcaaagtcgcatcttcaaattcattctacatagagaataacaaaaaagataaaattctgacaaaattgcaaccttaaaactgtcagattttttgtttttttttgttacggctaaaatataatgaattttactttaagattttaaccctaggtgtaatacaattgaaagtatgtgtatgattttttctagattttttggtgacattttttagttggtgtgcacgtgtgtacacgtgagggcctgtgtgcataggatatgttgccacatatatatatatatatatatatatatatatatatatatatatatatatatatatatatatatatatatatacacacacacacatacaaagctactacctactgattcctaggcccatacaaatttatatttgtatcggtatatgcggaatgtgtgaaaaataaaattaccttgtgatggaagcaatagtaaaattaagtagaagatatatacctgctattaaaaatactatcttattccccaaatgtttgacggtagttaaccaacgaaaaaaacagagatagtattttttgctcatccatgtcaaaaaaacgaagccaatatctatactacattaaatgtgggcagtggtgatgccagtgaatcttccgtcaccaccactcttactagcgtgtaggctttcacgctgttggtggtgttggtgtttcatcctgaaacaacataagctttgtgtttcttggtctggctaatttagtaagcatctaaaaattgatggcaaaagacagccggaattgtagattcttaaggctttgaaatgaatgccaaaattatcctttaagatttggtggtcatgcacgggcaaattagctacaagtataaacaaacaatataaaacccgtctcctctcctctactgttgcctctttcccagtttgtgctctctcctctcctcactccgccttatccccaaaaccctatcgatcccatcccctttcctcctcaccca

SEQ ID NO: 2760 - DNA, 1501 bp, Oryza sativa
aaaagatttcaaaaactatgatttgaaggatttgattactcaatattcgattggaatggattttataacaccaactaaaaattatcacaaaaaattctaggaaaattcatacatgtactttcaatagtattacatctacgtgcaaagtcgcatcttcaaattcattctacatagagaataacaaaaaagataaaattctgacaaaattgcaaccttaaaactgtcagattttttgtttttttttgttacggctaaaatataatgaattttactttaagattttaaccctaggtgtaatacaattgaaagtatgtgtatgattttttctagattttttggtgacattttttagttggtgtgcacgtgtgtacacgtgagggcctgtgtgcataggatatgttgccacatatatatatatatatatatatatatatatatatatatatatatatatatatatatatatatatatatatacacacacacacatacaaagctactacctactgattcctaggcccatacaaatttatatttgtatcggtatatgcggaatgtgtgaaaaataaaattaccttgtgatggaagcaatagtaaaattaagtagaagatatatacctgctattaaaaatactatcttattccccaaatgtttgacggtagttaaccaacgaaaaaaacagagatagtattttttgctcatccatgtcaaaaaaacgaagccaatatctatactacattaaatgtgggcagtggtgatgccagtgaatcttccgtcaccaccactcttactagcgtgtaggctttcacgctgttggtggtgttggtgtttcatcctgaaacaacataagctttgtgtttcttggtctggctaatttagtaagcatctaaaaattgatggcaaaagacagccggaattgtagattcttaaggctttgaaatgaatgccaaaattatcctttaagatttggtggtcatgcacgggcaaattagctacaagtataaacaaacaatataaaacccgtctcctctcctctactgttgcctctttcccagtttgtgctctctcctctcctcactccgccttatccccaaaaccctatcgatcccatcccctttcctcctcacccatggcggccacgctcttctccaccgccctctccccgcacctcctccccctcccctccacctcctccaaccccgcctcatcctccctctccttcctctccaagccgctgctccccgccctcgccgtcgcgggatggccgcggaggaggaccagccccttcgtgccggtggccgtggccgtgtcggaggaggtcgagacggaggaggacgaggaggaggaggaggagggctccgggggcgaggagttctccgacgacctgagggtcttcgtcggcaacctgcccttcagcgtcgacagcgcccagctcgccggcctcttcgagcaggccggctccgtcgagatggtcgaggtcaccaccccattcgtctcgcc

SEQ ID NO: 2761 - DNA, 1289 bp, Oryza sativa
  unsure (1)..(1289): unsure at all n locations
cacaagccagcattatacgtgccggaatagcgaaaaccgacgcctagtattttctcaccttcataggctgaaaataaaaaaaaccaatacctttaaacgactataggtactagttcttgagaaaaaccaacacctatactataggtgtcagtgtaaaaaaaccaacatctttaatatattataggtgttggttaattaaaaaccgacactaaaaaaaccgaaccattccggatctaactctttttagcgcggaagccaagaggggggggggggcttatccactcaccccctcctctcggccgtctctctctctctctctctctccagctctcgagctctcctcccctctctaccagttccctctcttgtcctgccccctcctctctcgcctccttcgccatcggcggatcccggagagtcgatggcattggcgggtcccgtgggccggatctgacgggcctttacccttttccctttcatccctaagcttctctcgcgggcagatccagcaaaggcagcggcgatggcggtttcgatagttttctaaccctctccctttccccttctacccctaatcttttcccacggtagcgatgatggcatcggtgctcccacggccggatctagcggtggcgcttccgacagatggatccgacggtcctctaccccctcctcctccgtccncaagcttttcccgcaactgcagagatggcatcagtgctcccgtgggtggatccgacggaggtgtttccggcgggcagatccggtagcggatccggatctgccccaagcttctcctgtagcggatccggtggcggtggcaatgccgacggctcccgtgggcggatccagcttgattgttgttgtgttgttgcgatgatgttgttgttgtgttgctgtgatactgaccgatggattgattttggggggcgaagtagggggaatgtgctcggtgatgatgtattgagcatttttttttcatcccggaaaccttaaaggtactggcacctttgaggagactcaatggtgccgccttctaagtgtaggttgggaaatccgacacctattgccgcttcccaactggcaccaaaggtcttttctgcagtagtgttgacacttcgttcttcaacatgcctcttatacatgtacatggtgatgagtgacaatccttgcatagatttgaattggcagtgatttaccttgtatttgaatacatgttccatataacattgtgataccacctgagattgaatgactcaacagaatgattagattgatagaaatgtgga

SEQ ID NO: 2762 - DNA, 683 bp, Oryza sativa
cagtttgagagcgtttatagaaaatttaatgaacttttagtatataatagaagatttgtctgttcaattcctgttttgtcaacataacaagatgattaaggagacaatagtgtgcacataatctggaaaaaatgaattagttttactttaggaccaatcatcgtacaatccttattttttagttgcagaaaaaaatataccaattgtaaattgttggacatgctctattaattttttttaagacaagtagtaagatgaggactactctagatgggagagcaactctaatagaatggccaaatggctggccaagttaaattttagcaattctaaaaaaataaaaatcgtgctccaacaggctctccaaccgaagggccaagccatctggttggccaaatctgagttcccgctagccaaatctagccagtcaagccggctggccatccactcatctagtgggacccacgttctctctcgctttctctcccctccctctctctcttctcgcacaagcacgggagctcagccaagtagcggcggcagatggggatggtgccgaagcagcggctgatgggggcagagccggagcggcgatggcaggcggatggtgatggagcccaagctcggccagagctgcaatagcgggcggagccagagcggcgagggcgggcagatgggcaacc

SEQ ID NO: 2763 - DNA, 1501 bp, Oryza sativa
taactaaaattcgaaataaacataataaaagttttaaaactaactaaaattcggaataaacataataaaattaaaagtagagtttagagtttgtataaaaatacaatttacaaataactaaaattcgaaattaaaaaaaacatgggaagaagagtctaaaatcaatataggaatacaatttagaagtaactgaaattcgaaattaaaaattaaagaatattgaaagacgagtttagagtccacatagaaatacaattagaaataataaaaattcagaattaaaaataaataatattgcaataagagcctagagtctatatagaaatacaatttacagataacggaaatatggaatttaaaaaaaatattgaaagacgagtctagagtccatataggaatataatttagaaataactaaaagttgatattaaaaataattaataactaacacgtacataaaatacaatatgaatatttatataaatttcaatatgaattaaaaataaggaatattgagagaagggtccatataagaacccaatacgagattaattaatattcggaataaaaataaaaataaaatccgaaattagcaaaattaaaagaagagttcaagtagaaatacaatttaaaattaattaaaattcgaaatttaatataagcaatattgaaagaagaatctatataagaacccaatacgagattgattaatattcaaaataaaaataaaataatatccaaaattagaaaaactaaaagagagtttaagtaggaatacaattttgaaacaactaaaattaaaaaaaatattaaaagaacactatatggtattaattaaaatctgaaaaaaataaattctgaaatttgaaaaaaaataggaaatatttcaattaggaatacaatttataaataactaaaattcgtgaaaaaaaataaatactattgaaagaaaagatcacctaaaacacatgatgagataattcaagtaacaggcctataaagagtagagcggtggcggttgatacgatatataaaaactgttaataaaacatcaaatagaatcctaatgacgattaaaaggaggaacgataggcaagtcgtgaagcaaatgggtaaggcagttgtcgggacttctagaaagtaaaaaaataaacctcattgataaccatattcgatttttaaaatctcaatgataataaaaaagagaagcagcgggcggggtgtataggagtagtagaacagccgacggttgggggacttctataaaataaaaaaaaatgaattccaacgatagttatgttcgatttttagaatcccaatgacaataaacagtaggcgggtatagtggcatcgtttgacgagacttctaaaaattataaaaaataaaacccaataagatcataatctctacaaactacaaggtccaatttttaaaggtccagaacttctaaaaagtaaaaaaaaaatctaatgataatcatgttcgattttaaaatcttaa

SEQ ID NO: 2764 - DNA, 1501 bp, Oryza sativa
tgttcacacacgaaatctgtaattcgatggttcgaatatgtgtttccattatccatacagtatacagtagcagtatatcgcaaatatcaaggcaacaccacagtagagggcaacaaccaacgagtcaatgccaaaatgggtaaagaacaaacagtaaattctactagcacggaactattccttctgttctgaagcgaccctatttgacgctgtatgttagactttttaaaatacttttgaccgttcgtcttattaaaaacttttacgaatattattaaaaaaaacttgaatagtagtagtatatttaacaatgaatcaatgattggaaaagaattaataattacttaatttttttaaaataagatgaatggtcaaacatgtttaaaaaaatcaacagcgtcaaatatttagggacgaagggagtaaatcataaggagtaggggtatatatttttgcatgaccttaaataacatactttgaacattcatttatttcatattatgtcatcgataactataaaattagtatcacataaaagtatttttaaaaatattaatctaatgatataatatacataatacttgactagatattattagtataactagctaggtgggccgcgcaattgcgcgtctagtacccaaataaaatcatatatttttcagtatgattttacttaaaatttattaaatagatatctcgttctcttaagactttaaaagaccaaaccttatcatcctcgtatttctaattatatagtttttaaaagtcacatcagctgctatgctaccccttacttcagtcatatccttctttatttgcttgctcgatctaccactatttctattcattctctttgaaacctttaaaaattggatcatatagttcttagagtttattgtctcattggtttcgtttttataatttttagaaatcccgtcaaacactgcaattatactcctctatgacccatccactgtcttttctctttattgtcattaggattttaaattttgaacataattatcattcgggtttatttttttactttctagaagtcccgccaaaccgtcagcgactttgccattgtactcctttatggcttgtccgctgcctcccttatttattgtcattaagattttaaaatcgaacatgattatcattagattttttttttactttttagaagttctggacctttaaaaattggaccttgtagtttgtagagattatgatcttattgggttttattttttataatttttagaagtctcgtcaaacgatgccactatacccgcctactgtttattgtcattgggattctaaaaatcgaacataactatcgttggaattcatttttttttattttatagaagtcccccaaccgtcggctgttctactactcctatacaccccgcccgctgcttctcttttttattatcattgagattttaaaaatcgaatatggttatcaatgaggtttatttttttactttctaga

SEQ ID NO: 2765 - DNA, 939 bp, Oryza sativa
ttctgaccactcaggtcatccatctgccacgtaggctgattctggtgacaattcccaatccacaacaacttttcataaagcacaggcaaacagatctacgtaacgggaaccacctcacatccgcccatgaccgtgggcacggctgttagaatagttagttaacctctgcagaggggcacactttacccacaagatacgaacttacttcgaacacccgtctgtatcggaggttcgcaacaaagcctttcccaagccgacccagggttacctcatgccacatagaaggatcaaatcctcacataaatataggccatttagttttcacaaatcaaactccaaccacctcgatcggtaatctggcaagcttcgcgttcttgccttaccaggaacccgggttggctccaaccgaccccacccccgcgttcccaactattggcatgcgaggtttccctgaaccgactagttacttagctagggtgtcccataccaccttgtggttgcactttgttatgcttgatgagtttcccacaggaatcgatccttatatgcgaatacgggacaacgccacgcaggcacaacccccgtatcgcgagttttcataattcatttattttcaaacacaccgaatacggggcgactgctgttttataggcgcggggtggggcgtcgaggagaaggaaccggcattggggcgatcaaggggagcgagctggcggttgtgctcggagctagcggccaaacggcagtggaggtgcggtggctgaggttggaaaaagagaaaaagaagggggaaagaggagcttgatcatgtcgtttcggggagggagagaagcgggagcgagagctctggctcccggttttggacgggcgcgggtggagcggcttgggcacgcgctgcagagctcgcggcaggcagcggggctgagcggcagggcggca

SEQ ID NO: 2766 - DNA, 1501 bp, Oryza sativa
gccacgcgccgtcgaccgcccatcactgcccgcccggctcggtagtgccttcctcccgttcctttttctcgctcgccctcgcccctccttggctcgcgtggtagctcagctagactctcgaacgcacgtagacgctgcccctagccccgccgccgcccggcatggcctcgccgccgttgccgcccgctcccggaggccgccgctcgtcgctggccctcctcggtgctcttccaccccatccgacgccggaaatgggctccttgaaccccggagatgctcccacctccttgaattgaatcctcatcgcccctccgccgtttcccccttttcttgccgccggcgtgcgccgccgcgattcgtcgtcgccggccccttttcgaagaatccgagccgttggctcatcccctgccgtgctcccccttgtacggtaaactccctctcgatcgaatcgccgcgtagtgcttccggtgaagtcggccgccgcccgccgtccattttccggccggcctcgtcttcctcctctcgccggcccgcatggcagccacgaaggcgccacgttggcgccacctcggcgtggattgggtcgggctgaccccggtcagccgcctccctccactcccgctcgcgcgcgcgcggtccaccgcgagccgagaggctgcgcgtgggcccgccgcacccgcgtccaccgcgcaccgcgcccctccccctaaccctagcgtcccgctcgcatgcaccccgccatcggtgagccgagccgctgacaagcgggcccgccccggatcccgcgtggtggaccgcggtccgcccggtcggctccctctcacgcgggccgcgcccggccttggaccgcctcacccgtgcgccggcccactttcctcagccgcgccgcaaatgtcctgggccccgcccccttcgctcggcccaagtctaaatcacatccatccttcttttcttttccaaaaaggatttaataaatcctttttccctttttcataaatcaattcctttttcctttgctccataaatcatttcccttggccccgcacgtcagtgactgtcaataatattcttgagaatattatttctataaattccataaaccattcctttcattccagaaaattcagataaatcatttcctagtccagaaaatcccattcgagcttccaaaattcatatctctcaatccgtagctccgattgactccgtcaacttccagtactcctgtaaaattgagatctatttaatggcactattaattagtctaaatagggtctttcttttagtctttcatttaggttttgactgtttgcgtatagccgcggttaccggattttcgtcgatcagggatttctcgtagattcatgaagcttcgtgaagatcttgagcaaggcaagtcaccctttgaccaattgctcatataattggaaaatcattattattttgtttgtaacttgcattattagaatcacacacttaatttgcttggcctcggtttgcg

SEQ ID NO: 2767 - DNA, 1501 bp, Oryza sativa
gaaccgcttcctacgaaaccgcaattatagtaccagtcccaggacatagtgctggtacccacggtgacaaatatgaatcattgcaatccttaaaataaataaaggacttatttaccttaacttatgttgtagcttagaacagcccgagaatgcaaccgacgatgcggacgaggaaaacaccaacagcagcagcagcagcggaaccaacggactaacacccaacaccacaggcgatggctgggaaccaggacgaaaccctaatcttcacttcacgatggaggaactatatatatatatatatatatatatatatatatatatatatatatatatatttatatagagcaagggtgagtactttcgtactcagcaagtcacgggaatcaggtgtttaatgcaagcttggaagagaggcaagattgttttacaaatcctttgtttgaaatcattttgaaatcactaagtgatttatttctttctaagtttgggtcgaaaaggagacttgcgtctcgattcgacttaagagatgctgttcaacaactcaattggtaatgtattgacctcccgggtcaaatcattacttcctggctcccagagccatttcacttgattaagcggctcccagagcctttttcattttctcggactcccagagtccagctgcccagcagcacaacaatccgcttccactcgggaagcctaatctatgatgcccgcaaacattccgaatcacacagattcgtttctgaccactcaggtcatccatctgccatgtaggctgattctggtgacgattcccaatccacaacaacttttcataaagcacaggcaaacaaatctacgcaacggaaaccacctcacatccgcccatgaccgtgggcacggctgttcgaacagttagttaacctctgcagaggggtacactttacccacaagatacgaacttattccgaacacccgtcggtatcggaggttcgcaacaaagcctttcccaagccgacccagggttacctcatgccacatagaagcatcaaatcctcacataaatataggccattttagttttcacaaatcaaactccaaccacctcgatcggtaatctggcaagcttcgcgttcttgccttaccaggaacccgggttggctccaaccgaccccgccccggcgttcccaactattggcatgcgaggtttccctgaaccgactagttacttagctagggtgtcccataccaccttgtggttgcactttgttatacttgatgagtttcccacaggaatcggtccttatatgcgaatacgggacaacgccatgcaggcaccacccccacatcgcgagttttcataattcatttatttttaaacacaccgacaccacatgtcgggttttcaaggcttctcaaacccatttcccaatttttcgacagtcaacggtgtatgtgggatatttggtatacgcgctcagagagcacggatacggaagtaccacaagggtggagcggc

SEQ ID NO: 2768 - DNA, 1501 bp, Oryza sativa
ccgttgatttaggggagagaaagcgctcccctccgactcgtctctcacatgtgagggaggagcgtgatctattctgcacgagaattctatttatagtttaacagaagggtccacttttagttttttttataaaatttaattaggtttctcttgaagatatcagtttatttatttctatttttagtttaggaaaccaaaaacaaatttttaggaggagattattcataatctcttggtaatgcccttagataaatgtgcaattgatgtctggtttgggccaactatatcaggtctactttacatacctcaccttaggttcgagtttcagttgcattcctcaaccgttatactaggtataacaatctctcatcttttaaaattagtataaatatagtctcaaggcattactgaggctgattttggttgatatcggcgttcacctgacgtattaactaagttctcgtcccatgaggaatttatgtggcacttatggttagaaaaaaaaatatggtaagatccacgtggggctcacctgtgaggggtcttcttcttcccctttcttcccatctctctctacatctcccctatcttcctctttgtctctaggaaggcaggcggcgaggataggggcgacacctagcaggagaggagcaaggcagcggcaaactcgcctccgtgggggtgggcaaggtagaaggagtgtgatcgattgcccatgtgggtcctatcgttatttttttttctaacggtaagtaccacgtaaacgctacatggcacaaagaactagtgaatacgtcacgtgagcgccgcgccagctaacaccaacctcaatattgccttaaaattatatttacacttgttgtaaagatgatagatgtgttgtattcggctttagagttgacaacgtgattgaaactcaacccttacacgacgaatgtaaagtggacttcttccttatggcaaacatgccacgagagcctctaaatacaggcccaacactgatctaacatggacatgctcagctcatgcaaatttacaggtgggctcccagaattaatgagaattttgttgcaggcatcatcgagggtgctggctcaatcattgtaaggggaggccggtgcggtgctctgctccgttggcttgtccatggcggtgctctgctcctaggtccaagcagtgcctcatgttcaacaccgtggttgccgctgaccatcatctacaacttcaagatgctcctcctgcactgaactctgaaccattttggacagagttcatctggaaaatatgaaacatggaagaaatacttgtactgtactatgtatttagtggaattttgagatgttatggaacatatattcaaatgcgggatcaattgtatatttgtatcgccaattcagtatcatgtaaagattgtttttttccagatccaactcaaccatgcgtgaggctagtggcatgtacatgtataaccattaactgacaggtcgaagaacagaaattg

SEQ ID NO: 2769 - DNA, 1501 bp, Oryza sativa
tcaatttaagcaaaaacaagacaaactgtagccatcaggccatggcgtgccacgtgccacctagaatggcaaccacgtcatcaacgtatatgcagtgacgtgtccatatacagttgatttgcacgataagagtctcatatacaagcaaaactaacgaatatgtttgtttgcgtaaacatcatacactgaccatttctattaggcgtaaaccaaaatcaacttccgtgtacactgatgaagagaaaatggaatcaaaatctagcaatgtggagtacgtacggtaaatagatcaaattcaaggacaaattctttcgtatactagaaaaatgtccgtgcgttgcaatggatgaatgttattttaattttattattgttatacggtttaggtagaatgaaatttactgtgttaaattcgcttggatagaaaatcatgagctgcaactaggagtccgatcgtctcaagttagcatgcgaatttttttaatgagatttcttatgcgactccttttgtatttacaaaagtgaacgaacttaaaatccgactcaaatatggatctgtgttttcaaaagcgaatgaatttacaaaccgattcatccacatatgacgtaccaaagtaccaataaaaatatcttcaatttttataatagcagagattcgtatatatagttcctatgataggctatttggttggtgtttatagattcttcttttataatcctaccaatctagcctagaagtaaaatttactactccttccgtttcatattatgaggtgtttgactttttttagtcaaacttctttaagttgtctaagtttgtagaaaaatatactgatattttcaatacaaaacaaacatattttcaaaatgtattcaatattaaatttaataaaactagtttggtattgtagatgttgctattttttttctataatcttggtcaaatttaaagaactttgtataaaaaaaagtcaaacagcttataatattaatcggagggaatagttaagattgtttatgaagtaaacatgccatctttgggcaatgcacaacacgaactaagtgaatcctaaccatctagaagtaaaattgattaaattcaaaattgctcaagtaaatatgtcatctttggacgaagcacaatacaaactgaatcgtacccttctagaagtaaaagaatttactaatccagattgcttaccaagcaaacatgtcatcctcagatgatgcacaaagtacaaactaaatggatcggataaactgtaccttttgaatccgtccataattaacgtatcacctgtcgctgccatcgtctctccttgtcgctgcaattgactttcagcatccttcctaacgaataaccatgcatggttacaagaaattgccgcgtgtatgtcattacctttagctaattaagtcccttcataagctttggtaaattatggtgaaaaggtccagcactctgaaaaattccatcaagaacatcagtaaacagcatttg

SEQ ID NO: 2770 - DNA, 1501 bp, Oryza sativa
tagcaaaattggatgtctgcagattggagaggtatgtaaccaacctataaatatagatgaacgcctcgggtatcatcccagcaattgaaccacatagataagggttgaacttgatttctgtcacagttacagcgtagttaaaaattgtatatggaaatggcgagattctgaatagtgcaacaactctaaactgctggaaccaatttccttccccagcaagttttattagagctatctgctgaggccatctttttaaccatgcctgcattaaaaaatgtagagggaagaagagagcagaaaattagggcaaagctccttcaaaaaagatgcaggtcctaaaatagacatcacaagaacatgcagttcagaatttttacatgcagacgttcgcggaacaatgagccaatccaatatggaaccaccatgcctatagtagtcccaaccataataatcaagaaaccccaaccatagccaaagatcattccagctagccacatggaaggtccagaagggactaaagtaactgggaagagggctaaagatgcaacgagaacaacagccaaaactggacgcccaaaggcacttgcttcccattgcatgattggcaagagaacctacaacaaacagatcttccaacataagtccaaacaattttctggaaaatgaatatgattaaaatgttactcctatctggcacaacatggtacaaaaacaagagataattgaaaattttgtaaacttgaaattaaattgcattgtgacagccgtgcatccattaaccatacattcatctagcattccaactggtgtgcataaactagggtatacatgggaacatatggactagtcaaactatcaatcaacagtttgaaatttcataagcagaaacctccactaatgcatggtagtggaggtttcataagcagaaacctctgccgacaaaccataaaaagaactcaagtcaagatttcagtacttggtcaacctatgaacctatgacaaatattacccttgatgctcaccttctcgaaggcaaaggggactccccatttcacgaagacataagatactaatataagaaggaagcagccaagcagaactttcatccaccaaatggaccttgaggtaggttcttcaggtaggactaccgtgttatcatcagctattacactatgagctggtctgaccagcctttcatattcatcatcctttgtgttttgctcaggttgttcgattccgttgcctgatgccactgcggaagagcttggcatgtctgtaactacctcttcacgtctgtttacaaaccaagcagattagaataagaagttactcaaaacatgtaacaaattttatcaatttatctcattgaagtaaagatgccatgtgcttgttttgttttgtgtactggaaaagcatggaaattagttgtatggattaaatctaaccaagatgtgcaacaaaaattaatctgatatgctcacattcacaagcatggctcata

SEQ ID NO: 2771 - DNA, 1501 bp, Oryza sativa
tacacaaatgtagaattaatatatgtactttaattttgattgaatctatatatataaataccaatgcattattatgcatgtatgcaggatgaagcatgtggtcagctagcaataagcaagaacaaatcgtacgaggctgaaatcgctgccttgaagaatcaaaatgcagccctccagatgaagatacaagcactggagaattacaggcaggctaagcacaaagagtatgcagaactggaaaccatatataagaagctcaaagcaaagcacagcaactgtcgttgataaaatggattaaattgtatatacccttgcatgtacctacgtactattagtgcatgggagtatactatatatgtgtgtgccgagaataaagctgtatactgatcaagctatatcgtagtagtacgtctaaacgtatgtaacctgaatgcatgcgagatatatatgcaataagggtcatgctagctctccttcgtctccatgcgtgtaatagagatcaatatgtaattggctggtcagtataatcagtggatataaaataattaattttatatgcgcagttaattggtaaatttgctatatgatattgtcactttacagttttacatgtaagacaccaagttaaactttagaagaagacactctgtaaatgtcataatttgtcactggacaccgtctttattattttaatattttcggatcggcgaaaagagagagaagacatagtttcgcatcgagaataaaaaaaaaacaggcatagcatcacacgaagttacaccaatgtctccgtgctctccaggggcggaggcgggcgccggggaagggactatatagatatcgttgtagaaagtttcatttttgtggaaatgtatttaaattggctcaaatttcatcaaaaaatttgatccaaattttggaaaaaaaatctacaatttctaattttaccgctcccccctccccagacacacacccccaaattgttaaacctgatttagattgggactccacgatgttacatgcatgagcatatcatcactatttggtgtggaacggccaaggcatccttgatctccgtggtggagaccttgcgaccgtgtactgcttgtatttcgatatatcagtcacacggtccatcttgggaaaaacgtcctcgatcttcatctcctttttttccctatcttcctatccaaactagtgtgtaccccttgacaatttttctcaatctcattcatgccctatgtggagattatgggtaccccatacccacacggcatggttatccgactagttataggggataacttatatatataaaatatgtaacagatcatgacttgggtattacgtttccctgtatattatggaacagcctaaagtcctggtttgataagattgtaaagtagatttaggaaaccgataccgtattggttaaggtttctatcttgtaaccctgccccccaacctatataaggagggcagggagccccctctaggggca

SEQ ID NO: 2772 - DNA, 1501 bp, Oryza sativa
gtattaaaaatatggttaacgtactaacaacagatgctagctagcgaatacgtgcgacaacggtaagttgcgcaccccgattagagtttagagctttggtgcaagagcgttgcaggtgaacgagagcccattgcagtgcgcatgtctccacctaagcgagagcttcccattccccagtatcacatgaccacaagaatcctaaaacttttgtctcgaattcaaaagaagacttttaattcaaaatctagaaattccttcacaaatttagaaaatttcaactcaaatatgaaaacttttgtctgaaaaattcaaaatttttaattcaaaaaccaacaatttcatataaaaaatttaattgaaaatccaaaacttatatctcaaaaacataaaactttcaatttatgatgccttatcccaaaataaagctatttctccacctaccacctcctctcaaccatttacaatcattatccatttaatttattcatatatattctcttctcaatcaatcacaacatttctctaacaatttttacctactttcttaatacccgagtccacctctaacattttgagcaaaggaagtattttctaatttatggttaaaataaatcaacggtggatacttggttgggtggcttaggagctagtatacctccaagcacgataaaattagttctcatatataggcatgtcattcacacatgatcgtcaggaaactataggatcgtcagtccagtgacttcaatgtatgcatcatctaattaagcacaagacgagcagaatatttaatttactggatatatatgcgttaaaagctattctctaagcaagttgtgatcaaactatatatacccacgcaagagtgctgagatcaccttgatgacacattgaaattattcgtttattagctagctagtagcttggatatatatattggggcaaacgctccctgttttcatcattatacttacaccaaaacaattaattactagtacattttttttcacattataagcagggccggccctgggattcttggccatcctcaacgtctgattgtatggaagcttacagaaaggaacaaattttagtttttaccatgtcaaatcaacctgacggtaatatatagaactctgggagcatgcacgtaatcaactagagctaaatcctatttcatcacattataagacattttaggttttgaatatatatgtgtgggtgtatgtatatatatgtatatatatgtatgtatatatatccatatatgtgtgtttcatatatgtacctacatttatatagatgtaagtggaactaactcttgtgcctgttcgttcgaaacaattagtaaatcaacttggaatggcagaattaattctactatcaaaaaattaggtcaagttggagcaataattcatttttataccgctaacattctatacttctatatctatatacgttgggaaaaaaagttgttccaaaatacttttacttgcgcaca

SEQ ID NO: 2773 - DNA, 1501 bp, Oryza sativa; identical to SEQ ID NO: 2771

SEQ ID NO: 2774 - DNA, 1501 bp, Oryza sativa
acactctgagtggcgaaacatgatccaataatgaatcagaaccaggaaaaaaaaagcaatgatatttgtcattaactaacgaccgtgtgcttcatctatgtaatagccaccatctatttactgaaagaagtatttactaaaagaagaacaacagagataagcaatgatccactgtgaaaagggaaatatgaacacggggaaaatcgcctaaaacctaaaaactctgtgacagtaagtctcgtgcaacaaacaggccagtacatggctacctgagatgcaccaagcctaatcacaggataaaaaggaaacacacggcacagacacaaaggaaggcagctaggctagatacagaaaacccaccagcacacgcgttcaccccccagggttcatgatcgaacgaagaaagcacaacagcggagaatgggctagaacagacgacaagaagaacagcgaacgggcaccaaaaggcaatgcaaaggaaatggcgaaaaagcagaagggaaagagaagattggcaggcaatgagctacttatactggtaaacaaaacaaaaaaatatgtaacataaaaaacaacatactcagaggctgtcaataggaccccacagatgacagggccatcggtcagccacagcatacgacgtaacacatcagtgctctgacggaggccatcctcgagctctccgacgtaacacaccgagcagtaacactgcgccggaaaaagggcacatcggcggagcctgctacaacggccaactgcaattggcatggaccacgactacgtggggcccgaacaacagtggagcatgattggctaaagccgtgggaccgactactcgccagaacacgcacagacgccaccaatcacctcgcagccccgatgaccggctgccattgactaggcatgctcgagttctctgtcccgccctcgaacgacgagtggtggtgagtgcacctgacactggccgcactggtgggaccctcccgcagcgacgagactcgactggcatacaccacaatggcccaatcagagcatcttgagtggtgtgagcaggcaccctgaacgatttgtaccatgctatgatatgcagagacaagcgaggaagaacagcaagcaaacatccaacaccaattaactggccatccattaccagggagaaaatgtataaggaggaagaaatcacaccaggcatacagatttggcactgagatagaaagagcatcgattcaataccaaatcaggggggcaaaacaatggagccgctgatatcggagcaaaaatcgcacggaatggcgcggccaacgacgaagaggaaatgcgagtgcatccagaaaatgccatgccgtccccttccttctttaccacggatgcaccgcccaagctgccacggacacactcaaagacacgtgccttcacatgcaccaatcaacgcagcccgtacacatgaaacgcaaccaccgtttctgaacagcgtgaacaaactaaatttgccgcagccagc

SEQ ID NO: 2775 - DNA, 1501 bp, Oryza sativa
tgctgcgaacatgtcggagacgctccgctcaacagaggccttcagatcagaccagttggggtgtcctgagcgctgaagccagagccagcgaactctcaaggcaaagccagctatcctgaggtccggaatgcccataccactgagatacctaggatggcaaaccttcgtccaggacactcggcattgtcccccattggccgagtccgtacctgtccacaagaaggggtgacgcttcttgtcaatggctttgataacccagcctggcaagccgatcgccatagaaagatgtaccagaatagaagagacaaccgattggaccagaaccgagcgacccgccagagtggtgagacgacccttcgagggggggggagccgatgggaggctttatccacaagtggttgcagggccgcttttggcagcttgcgaactgatagtggaatgccgaggtaggtgcagggaaactcagagatcgagcaaggaaaagaggactgaaccagctctaggtcaagaaccgagcagtggatcggagtaatcaagcatttggtgaagttggtctgaagcccggaagcggcactgaagatagagaggatgccttggatgaactcaaggtcctaccgaacgggggaaaggaagagaactagatcatcggcgtagagggatgcacgatgtcgaatagcacaatcattgaggggaagaaaactactcgagtcagaggctttgcggagcatcgcattgagcacatccatgactagaatgaaaagcatgggggaaagaggatctccttggcgaagacctctccgatacctggcaccccattgaccagcacccgggaagaggaggcactgagaatgagggagacccaatcacgccaacgttgactgaagccaagctgggctagcacctcaagcaagaaaggccagctgaccatgtcaaaggccttcgcgatatccaccttgagaagaagtcggggaacgcatttggcgtggagcgcccttgccgcaagctggacatagcggaagttgtcatgaagggagcggcccttgatgaaagcactctggttaggccaccgacgccgtcgcacctcctgccgacggccccacctccacaccggctgtcttcgccgagccgcaccttcagatttggcgcgggccacctctgtccgactgcctcccgctgccgagggactcggctgcgcaggttgccttcctcccgccgctgcacgccgcctcctgccgccgaggggagcgggccacctccctcccaccgtagcgccacctcacgccaccgagtgtcgccgcacgtcccctcccaccatggcgccgcccgggataaggagagagagaagaaagagaagaggagaagatggagccgagtggaggagaagaggagaagaaagagacaaggagagagagatgtagccgagtggatggataagaacgacgacttgcggtcttgtgcggactcggctcggctcggtttttgtggggcccaccaatgatca

SEQ ID NO: 2776 - DNA, 1501 bp, Oryza sativa
gttggcgatcgtacctgcgagggggggcgtttgaaggtccacttcgggggctcgatgaaactcccccggcacggctccgtttgccctatcttccggagccgcttcttcttccttccagcctcggacgcggcggggcgcttgtggcccgccggcggtctgtccgccactcgctcagcgccccctccgcgcgggggagagggtggccgagattcgaacatcttccgtttccctttcggatcaccggccgaatctcccccgggcccacggctcggaccaggtgccctgaagtcgccgtccccgccggagttgccggttcggctgccgcctgcggacgcgctgctgctacccgcgccgacggcgccgccaccggcgccgccccgacgggaccgacccctgccggcgccgacggccgacatcacagccaggatactctcccggtcgcggaagctgcataaggggaggatcccgtccggagtcagcgtttgctcgacagtgtccaggcccagcacccgccggatcaccgtcttcgcgtcctcctcgcccagtcccagtgctcacccacatgggtgcgcatgggatcgttgtacctagtgtactcccacgcgccgcgagaccgctcctggagaggcgcgatgcgacgacggaagtagtcaccgaacaccatcgcccccgttaggccctggcttcgcaggcccctgaggcgatcccgcactgcgtcgtactcctcgcctagttccgaaactaccaaccacgtggcggatcgttcgggagggccggcggggagccgaagtcgtggatggtccggcagcgcggtgtagaaccaatccttcttccaatcctcccacttcttgcataggtgactctcaatgtattgccccgccgtgcccggccggggctggaagcagcatccccccaccaccgcgccttgcagcagccatgggacgaagaaggacaggaactgccgcatcgtcggccgcaccccgatgaacatctcgcacaagtgcgctaagatggccagagtcatcacgacgttgggcgcgaggtggaaggcgtgaatttcgtagaaatccaaaacctcatggaagaacctggaaaatggtgggatcaaccccaccatggcgaaggacaggaggtgcacggatcgtcggggtaccgcggccgcagccgcgactcccccaccctcacggcggcatcctccggcatgatcttgcggatgaggctaaggtgcctctccgccgtgatgcgcaatgccggaaggacggcgtcaccagcgtcttgggccatgatggccggcgggaaaacggcgaggagcttggtgtatggagcagggtggagcgagaggagcgctagggctttaggagcgagtatgcgagtatgcagttggcgagagaaaggggacgaactctccgcctccccttccttttatccacccctcgcccgcactcgcctcctcgtttcacacccctacggttgccccctcgattcctgcgcctgcggttgc

SEQ ID NO: 2777 - DNA, 1501 bp, Oryza sativa
gacgccgtggcgggggatgggggtggggcagcggatgggctcgccgtcgaggtcgacgaggcccccgtcgcggagggcgagccacggcagcggcgggggcagccgcgggtggcgaccccgcgcggcgcccgcgcgccaggagcggcagacggcgcggaggcggacgcggtcggggagggacgggaggcggaggagcacgaggcccagcaggtccgccgggaggtccccccacggcaatggcggctgcgccgccgccatcttcctcctcgtcgtcgtcggcggcggcggcggcggcggcggcggcggtgtttgggagagaggaatggtgtgtgagtgttctatttagatggactatttagatgggccacacggaaggcccatttcaagcccatgtgaaactgagtcttattgtttggcccaattaaaaaaaagagagaggcgaatttaacaaaactatagatttatttataaggtatggtattacacaaccacatttttattgtgataaagttatttaataactataaaatttagagtttataaagctgtagttgtgtgataaaattgaagttaaatatgtaattctgtgatacattgttttagatctatagtttcataacaaatattcatgttagctatattgaaaagaaaaaaaaattatacttgatttgttgttaaagtgtagtgatttttgttatgtatctgtatgaggatatgtccaaatacatagccaatagttactatatttatattttggaatggatggattaggatttaggtgtttaggggtgaggcgaggtgtggactggcctccgtcccgtcaaattcgggtgccctgtggaaagttgaaggataaaaacttaattaatgatataatatgaaaataatttattctccgtaatatatttcatagcaatctagaatggcctaaaatgataatccaatattagggattaccggattagaaattaccagaaagaattaggtcagaggcgcagcaggcgtcaggcggcacgatcgtacgagagaaagaggtgaggcgtcgtttactcctcttgttcgttgcgattggcgattggcgagatccacagtgggaggcgattcaagattgcgaaccggcgcaactgtgcgaaccggcaaaggcgtgtaatcgaagccgaaacaacaagaaaaataacatatttctagactagttaggctaccaatttacttattgagttgtatatctagttttgaagttttgggcttagggggaccctgaaaattgggggccctgtgcgggcgcgctggccgcacacccctaaggacggccctgctagagtgctaggatggatgagaacttttagtttccttgtcaaaccttccaagtgaggtgaacatattacacctccaataactcacgacatgttctaaaaaaaaccaataattcacgacataaagatagagaggtaggttctacaatgaataagaaataacattacaaaatggtcatcaagtcaaa

SEQ ID NO: 2778 - DNA, 350 bp, Oryza sativa
tgcgttgtatttatattacattgaatagcatttgtttaattaattactcatggtgacttttcttctcaaagtagctcatttaatttggtggtatgctattagttactactttcatcctgcataacttaggattacgccatttcctttttatcccctctaatcatccttgtttttcttcttgaagaaattcatccccttttagcaaggttagggatgcttcatatcacaataacagtttcttgaattaaaaagttctcaagctcttctcacttctcagcatccttatgttgacagtttaatttgtgcttgccatcacctgttaaatttcgactatacctatcatttgcagt

SEQ ID NO: 2779 - DNA, 1501 bp, Oryza sativa
cagtatttgacttaattaccagttgtccagtcttactctaatatggttgacgaggtagtcggccagctgctcaaggtgtcattgttgatcaaggattcaaaagctggtttcgcatgcatgcacatgaacacacataggacgtcagttgtatatgctaaggctggctggttgtgctggtcactctgatttgggggccccaaatttttgtggggccctgcgctgacgctccgttggcatgccctcgttgacgggcatgcaagatcacttcaagtaacaagagaactcctggtgcctcctatcccaagcatagcctcaaattctcagagtctctgagagtttattcagctttttatttagaattttgccacgataaaccccagatggatggggcccttgatgaactgttcatacctcagtttgttacaattattctgaagttcagatcccttctctgtttattcatggatcaaggagagattcgaacatcacatatgactatgagagtgtattgtttgacccctctcagttactcgtatatagaacctgaagaattgtccagctgcttttcatagacgtgcatctctccatttagtggaagcattaggaaccttcacagccatccaatcaaatgttgagatgtaattaagagaaatctgcgaacatgtctaaagacaaaaataggcaggaaagttctctttgagccacacaaaaacagcactcatcacaccaagtcaggcgtaaccaagaatgtcaaggtatagtaaccaaattgtatcatcgaaacaccagaactaaccaaaaccccaaactttttgcggaataaaaagttaccctcaaattcgacggatcacggcctgaccgaaggtgttgcgccggtctgaccgcctggaagccgtcggtctgaaagaggttgtatctccggtctgaccacctgatcagctgccgtcgcctgaaaccgccgtcggtctaaccgccttcactccaccggtctgactgccgcgatgccgccggtgactcgccggttagaccgccgaacccgagaaacacaaatcgaagaactcttaaagtagatgacaactttattacttctctctgtgtttacaaagtgcaacaataacactcctcacgaaaatctcgactaaactcgaaaccctaactaaactcacagctcaatgctctcaaaagtgataccgagaagcctcacgctccctctctatttatacatgaggtaggcagcctaaagccacgaaccaaaatcatactagaagtcctaatccacctaggaaaccttctcatacaagaaacaaactttacaaactccaatcataccaaatttggactccttccaaatttgacttcgcatcccatacgcacacaatacctccatcgtatgccatatggaatcttcaccaaccatgtgcgtttgaactttagcctaagtatcccgcatgatatctgaccatcatggacatcgtcttatcaccaagctgactcccgatcc

SEQ ID NO: 2780 - DNA, 1501 bp, Oryza sativa
aaagctccacagtctggtaatgtccagctcctattatgtgttgtattgtacgtggagtacatttacggtgatctctactagtagtattctactatcagtattattgtagtagaagtgatgtcaaccattgatttatgagttatactaccatttgaaaaacttacaaactctaacaattctactacacgtagtagatgcgtggtagtaatagtataaatggatatgatccattgaattagaaaaaggaaacgttttaaattagttccagtgtaaaacacctcccataacgtatgttagtggtaggtgctgcattgaaacagaaatgtaacattgctatggtcaatggtacctacagctctatatatacatggaagagtagactgtcgatgaaggagctgcagcgatgctcaagctaagagatgatagatggacatttcttgttgctttggtcagaataggatgcatcaggagttgccatgccacaagaatcatgttcagtaagttcctacatagtcactattaattacttttacctagcttgtcgatagttggttcaccgttctacatgcttaaactaaaattgcgcaaataactgttatattgcatcctgcgtacaggatctgcgagcaagaggtagaggacaaatgcttgagcatagcggttcatcagaattatgaacagttctcattcagaaagggaatgttggagctagtattctctctgcggtgcagccatgcaaatcctcttgtttataaaagcagattgactgataaccgatgtcgatgctccatgtagagtggtttatggtccaaggggttgggacagtggcagccatgtgatgaattcacaaagaccactactgttccaccgtacaactcgaagaactcatggtgctgcggtgaagctccttgtgtctgcggaagtgacgaatgcacgaagtagatcattgtggtaaagttcacatgtgaataattgttggaattcagtttaatttggtctagcagataaagggatttgtgcaaaatcaaagtgttttttattattattctatcatgaacaattggcatctgtgattattggttttaatatttgaagattattggcgaagtggttttggagatgataggatttacatgtgatatacaggaactgctgaatatgtggtctggtcagaccgggcatgtgctgccggtcagactggcttgtattgcgcggtctgaccagccgactttgtgtcggtttcggtttcgagttgtttatttggatttcatatttatggcttctagatggatactatgcgtatgtaatactgttgtttgctactaatgagtcaagttggagatagcttggtctcggaatatggtttctttgtttgattcatgtgtaggtgacttgatgcctcgggagagtattgccggtgatggatcgggagtcagcttggtgataagacgatgtccatgatggtcagatatcatgcgggatacttaggctaaagttcaaa

SEQ ID NO: 2781 - DNA, 1501 bp, Oryza sativa
tgcctagatgtttcttcagttacgtaccctaagacaaatcttgatcgatcgagatgtaatacataattgaagaaacatccactgtctcgatggtgatctagcggggtagggggaactcaagtcctcccaacaccccacgctggatccgtccctgagtagggcagagagggagcgacagtagtccaagctaccgtggcaatggcggaggggtgtgatgtcgccagatctgcctctccccaaccctatcgcatgcagatatatcctttgtcacaatcctccatgattgcatcctcattgagctctatcggttgccaccgctgcctcattaagcttgtagccctagactaccccttgagctctatcaccgcctcctcgtcgagcatgatgacaatgatgagcggtcaccgccagctcagcctccccctctggccctctttctcattctctcaaatctctagccttttctctcattctctcaaatctctagccttctctctcattctctcattctatctcggctcattgagaggaagtggatagctagactcttggagttggagcttagtcaaacaatttcagttccactcaaaataatagtgaagctaactggagtgctataacaaatgaactaaagagatggagttgggtttaggctgctcctcaactttactccagacctagctgttggaattatattaggagttggagtcctactaaataggcccaaagaaaagcggatttactatttcacttacgacaatttttttgtggctcttatatttcactttttcattcataggatgttacatcaagatctgtgttcttgtatctaacttgcagttacatttagttccagtgcacttacactcagttacagtgcgccaaaaatagatttacagtagttttttctttagatttatgattcttgacatgtttgtcttttttgttattggttgaaaatagatatattagccgaaactgtcacgtggacgacatattagccgaaaccaccctcaaaacaactatgagagtcgttttgcaccgatttaaatacttgacggggaggggatgatataccctttttacggttaagagatacgaatcagattagattaggtagaatggactttctgcacgtctttgtaataaaaaaaacaagtaggcatgtgggccatgttctatgggccgtttcttacgggagatagcttcgatgggctctatcttttgggcctcctgtgacctacatgggccgcacttctttctatgatgggccgggggcccacatggcggcatcctctctctctctctctgtgcaccttatcccctccaactccgatggtgggcagtggaatctgctcccctcaaaatcacctccccaccccccacctcctcgccgccgccgccggccaccgccgccgccgccgccggaggggggagggggacgacgacggaggcgcacatgctgggcacgacggccgcgcagccgacgagcaggcggggc

SEQ ID NO: 2782 - DNA, 1501 bp, Oryza sativa
ccccttgcaacaaaaggagaggagatgaagttgaagttcctgctttgtgcttttgcaggagacggacatcggacggcatgtgaacggtctgcgcaaacatccctccggtgaagtccggctactcgccatctcatcctcgtcttcctcatcggcctcgccatggaccggctcctcggcggccgcgacggcggcatcgtggctcgagtccggatctggctccgcgacgggaagcaccacggtagtcgccgttgccggctcgacgggcatctcggccaccagctgcttctcgttgccatggaatccctccccacggtggtagaagccgccgtacctatacgcatcccgccggtggaggccgccgctcctccggtgaagagaaaagccggggggagagagagagataaaggagagagagggggaggaagaagggaaggagagggaggatgatacgtgggtcctacaatatatatattttttgtatgacatatgggtcccacatattttttaatttttgtttttattctaatgccacgtaagtgctacgtaggaaaagactcggtcaaaaccgtcacgtaggcgccatatcagccaaaaccagggatattgtttacaccggttttgatagttggaggagtcgatatacccggttttgtggttggaggatatgaatactcggacgatagttgagggagtcaaattatactttttccaaaagttaatgtacgtccgtttgctttttttggcccagatgatacttgtgttgggccgtcatttttcttttcgttttatgggctaaacgcatggattttttttacttggcctatttcatttttcttgcacatgttgggctgaacacatttgcccaatcaagtgtttgtgattatgtttttctgttttattttaattcgaaactttttgtgtaaaagtttttataccggatattttacattacatacaaagttcatatgctaaatatttatatgtataaagtttctataccaattattttatgtacaaagcttatataccaatttgtcatatgttgaaagtttctatatataaactttctaggtataaagtttctatgtataaaattgctacctactatatttttttatattatttttttgccagctcaaagcaaaaaaatatgggctttttatctattcacacataggtcgaaaggagagggagggcatgtagttaatgagccttttcaaggaactagttttggatggatttttgaattcatcgtggactcccgcacgtagaagccttaccacaaacttcctccatttcacaatataacactttctaacattgttcatatttatttataagagaatccactcagtgccattgagttttgcctacttctacaatatacccatgactttgtcaagttgaacaatatgccattatgttttctttaaccttcactacgtgccatcacagaacagttagcatctgttagcgatgtaaaaagacctatttgcctcta

SEQ ID NO: 2783 - DNA, 1501 bp, Oryza sativa
attgtagggtttgcttcatgctaggtctcctactctacatccaatgaccccagtcaaactttggctattgacaatggttcggcaagttaggttttagggttcagggtagggacgggcaagggaagggaggtgggtgggatgaggtgaggggaggtagttctttaaattagagggatggttgtgggaggaggcggagcgaggaggtgggggtggcgatggggagccgtcggaaatatggatcaaagacggtgtgcctggacatctcggcgccgctagcttgagaaggaggaggggcgggggaggtctggtggggcttgccgtgacaccactggggcaatggtggtggcctggtggcataaacgagggaagaaaaaaaaaacgagaatgctcgttatcgagcactcgggagggcgcagcaaaaattggccgccgccctgacgcgcgtgcgcacgcccctaggggccccaccacgttttccctgccacactgccacgtgtccccaccacgcacgatgttgcaacaaatcatccacatattttagaaaccctctattaagggaattcgttttattttttgttgcaaaaaaatgttttacctagtgtactcacaatgtttcactatgtatagatctaatgttgcaatgaacgaaacattcttttgcaacaaatcacccacatattttggaaaccctctattagagaattcgtttcattttttattccaccaaaaatgtttcacctagtgtactcacaatgtttcactatgtatagatctaatgctgtagggaattgaaatattctttcgctatttgctgaaacattgtttttatataaggtgaaacaacgcttgatttaaatgattgaaacattttcgatatatttggtggaacatcgtgcaacatttaaaaaattcaataataagctaaaaaaaatttcgccggaatatatcaatgtgtggtcttgttttgaagatttaattgcaacaaatttaatggtgcaatcaaatcaagatttggataagtaatttaagagaaaattagtttaaagtcattttgcacgcatgtgtgacgcgcccgatttttacacatttggatcggactaccgatccgtagtcccctcagaaaaaaaatatggaggacgggggagtttattgtgcgtaaatctcaacacgatggaatggttcagaattgacatgattttaatgttgacggcagtagcagtcctattttttacattacctaaaacctaagccgacgaccactacatattttacttccatttccatggataatcagactaatcacacagtgaccaccgtccaccggagcacagtaccggcgacatgccggcatccaccgccatgtccccgcgcctccgtctccaccacctcctcctctccatcctctccgctctcccaacctgccctctcgatcactccacccccacctccgccgccgccgccgccgccgccacggcgagccatcaccacgtcgtcaccacgc

SEQ ID NO: 2784 - DNA, 1501 bp, Oryza sativa
ccaagtgtaatacatgtcccggtgctcaataactgcgagcacggctattcgaatagatttggtttactcacactgcagtggatgtacactttacccgcgctccgcgactgcccaacacatgagcctcgtcccaacacatgagacgcgtcacggcaaagcttttcgataacctcgcattggcagtacctgctccatgaacttaaatcctcatgcactctaggagtccatgtttctagcagtgtgaggagttctggcactcccgggaaagagaagtctcacacatattaaattatggttcaagttaagttctctctctcacacactcatggcagtcctaccaatggcgacaccgatgtagggcacgcctctcggccttacctcaacggctgtcccatcgtagcgcacctgcatcactcaggggtgaaccatctatgtagggatactgcctccgctcggctatctaatccgctaggtctatacccattcgagaagtacggttgtacgggggtcgtttcatgcttaacttcatggctcggtccttaattgaccggggacggtactagcctttcccagataccacccaaatcctccgtccgccccagtcgaaaacaattgtttaattttatttctcctttcaaaaatcatgtcatcaacatcatggcaatgtggcgctcatgtctccacatgccgcatctcaattgccttcccaaaggtaattgcccaagcatatagcatttgataaatatgagtatgcatgattctagaatggcatttctaagcaattgtcataattgactagggactcatacgtaatcatggttacaaggattttaagggtaaacaataatcaaggcatggcataatcacaagtaggatgttcatcattgcatacaattttatttgtaaacaaaacaatttcgcaattgggatcaacatgttcaaggaatggtgatgacttgcctgctcaggataatccctattctcgatataatcttgattaaccttcacctcctggaagttgcagacgttgcctcacgactaaccgatacacaaagtctataaatacgcgagaaaaaccaatattcaagcaacaatcaaatatgcacaaacaaaatatatttgctaaggtcgaacctaaggttgctcatattattcgcgcttgctaatggactctaatcaagctaagagctaaggtttcttagtctttctgttgtcatggtggttcagtctagctaatggctaaggaaggattatggttacacatgcatctatctacatggtggttcagtctagctaatggctaaggaaggattatggttacacatgcatctatctaaatagaacggttatacactagaggttctgttactggatggattttggatcggtcaaataattactgtgaatcatttgtattattattttattaatggaggctttattttaattatgtacatatttcacttgtcaaaataaattataaaaggttaacaattaccca

SEQ ID NO: 2785 - DNA, 1501 bp, Oryza sativa
tgtggagacatgagcgccacattgccatgatgttgatgacatgatttttgaaaggagaaataaaattaaacaattgttttcgactggggcggacggaggatttgggtggtatctgggaaaggctagtaccgtccccggtcaattaaggaccgagccatgaagttaagcatgaaacgacccccgtacaaccgtacttctcgaatgggtatagacctagcggattagatagccgagcggaggcagtatccctacatagatggttcacccctgagtgatgcaggtgcgctacgatgggacagccgttgaggtaaggccgagaggcgtgccctacatcggtgtcgccattggtaggactgccatgagtgtgtgagagagagaacttaacttgaaccataatttaatatgtgtgagacttctctttcccgggagtgccagaactcctcacactgctagaaacatggactcctagagtgcatgaggatttaagttcatggagcaggtactgccaatgcgaggttatcgaaaagctttgccgtgacgcgtctcatgtgttgggacgaggctcatgtgttgggcagtcgcggagcgcgggtaaagtgtacatccactgcagtgtgagtaaaccaaatctattcgaatagccgtgctcgcagttattgagcaccgggacatgtattacacttggctagactctaaattcttaacctgtgtgggataggatattgcatgatgatttttatgctgatggagccacttcctgagaggagggaaggtggacgtcctcagaaaaccatgacgactcaatggcgggaagctatccttgggatcacaatggatggtggacagaaccgtcgttgtttaatgtgaacactggtattaaaacttgatcaatctatgctaggtctcatgcttgtgaaaagatttgcaaaagcttgctttacgcaaaagaacctggagcccttccttgaaataccctctatcatatgcattgttgttgtggtggcttgctgagtacggttggtactcacccttgctatttatatatcttttaggagagtgttgaagagaagcccttgtcgatacgcttgcgtatccaacaagatgatcggagtgcggtcttgttctaggtctcgttccccagtcgactgcctgtggcatgttaaccgggcccttatattattttgtcttccgctgttgttctctgatagttgttggcctacctggccctaacgtaagtatttaactcttttagcctgaattcattcatgatatgttgtgatccaactatgtatgtgtgtaccaactactgatccagggattggtacagataaacacagaagatttccgatttccaaaatcgggggtctacacgccaacgaagccatcccctcggctactgctgccgccgtgtccctatggccagatcggggagagggaggggaggggagggagggcgtcaccggtctccaaccatcgcgccactggatccgtcccccgtcac

SEQ ID NO: 2786 - DNA, 1501 bp, Oryza sativa
tttggaaaaattgattaacgtctacctatcttttcttattcatgtatttttcttgctccattcaaacaatcatttctgtagtttttacatgtttttctatccataagatttgagtatcagtgtcttaaaatttctgccattttctaaacagtgacaaaaaggcctcctatcattttcctggaccgaaacatttctttcatctcttaacccaatacctttcatgcctctccatcaagcatctgtacaaatcttgttgactaaccaagtccattagcacggtcaccaagaacaacactaaaattaaactgtcattcaagtatacaatacggttaataaataattcagagctgtcaatcaacgaaagtttggcatttttcgcatcaatgattggtggcgagcatcacatggccggcccgaccggtcatgtgtccgaaaacgcgtgaacatgtttataatttaaaagtgtatttgtaaattgtaatcgcaaaaacaaagacacgatgattttttataattattagtaaaaaaaaaaggagagactgactgacacacacacgaccaaagacatggattgattgattttttttagtgcaaagcgatccggatcttgaggtgatgcgctctttcttaattgtcgttccatgcgtgttcaggctcccatattttttttaaaaaaagataataaaaataattccaaaagtttgatttttcggcgtgtttttttggatgtatgcattttcttttttgcgatgaagtttcctatccttttcctttgtgaaaaaagttatgtgttttttttccaaaaggaaaaggaatagaatctctaggttctttttgcctttttcataattggtggatggtatcaagggaaaaagtaaccttttttttatgtgcctgttctaacaggttttatttttgaaagcgactttgtgttgaccgatgaaaattagacacacaacaccaagatttttcttaaactttagccctcttaactataaaattcatgaccaggagtccaggaccacttgaccgctaactcttttttttggtgcaaatctgataacctgtcttagcttaatctagaccggtctcggaaatccaaatatgtctgttgatcgcttccatttttactcaaccagccgctgcccgttggtgtattacgatattctaaagagccgtaatatttttcacaaacgttgaatgttaaaaattcgaaaattatgtacatcctccgcttaaagatgactatgaatagttgaacccacagaaggaggaaagaaagaaaaatctcgagtttgtgaggaaaatgtccaggcagtacttatcaatgaagaaactaaaatctcgagtttcgtccttaacgacgtcgttgacttttcacataacattatactaaaagaacatataatttttttattataaattatcttatcaataaagaaactaacttatattttttaacagggattatctgtaatactgctggtgcagtagcatacaa

SEQ ID NO: 2787 - DNA, 1501 bp, Oryza sativa
ccagtgagcagatgttgtcacggagcacatcccataggtttctcctattgggtagacaaagtgaaaagaaattgaggacaatcccgggagatttacaatattagtagtgcaaaacattgtcacatatcgacaagagtactaaagcaatcaaacaaccattttatctaatgaatgttgcaattaggctcaccatgaccctctcaatcagtcaatcttatcaacgcagtaatcattgctctgctccttgcatggtgggcacggccttaggaagcacaacagggaagatctcctagcagccatggttagcggggaaaaaatcataagtatacatattgttaatggtattgaaggcagaaggctggtatgaagcacgaacatatagatgtacaactgggtgattatggaatagggttatatatgcaacctgtgcatctaacatttatgtacaactggatgattaaggaatagggttttggcagtaatacaactggatgattaagtatagtcccacttattccattgaaggcatattcttccaatcaatttaggtagtataaagtgtagcgcctcatgattagtaaagaattcagtcatgacaaaactatagtaataagcagaagctttgattatattgatgaataagcagaactaaacagatagagaaataaaccctgcaacaacaggcactagaagaaatttatagacatcacacggttatgcatcttcagagagcacccaggctgaatatggcatcctccctcttatcctgactcaagtatttgcagacacattagtgaaaaataattaataaaacgtgaacaaaatttcatcaaacactattaggcaaaatgaaatcgttatatcaacaatccttaaaccacacaccaaaatacttcctctccgttggtggcggtgtgagcagaccccagctatccttcctctccgtcgcggcgcgagcagggaggcagagcggctctggcgggaggcgagcggctccggcgggaagcggcatgcatgcaggaggatcgctttttgcggcagcgcagtggatgagtggatgacgggggagcgacgacggcgtggtggggaaggcgaggacggcggaggggcggcacgatgtgcggacttgccaaggaaaaggggcaacggttctttttctacgccaagggaaggatcgcgcgtgggcgtggaaggatcgcaagatgaatctcatccattgattgttgcggatctaatggtcagaaataatagttgtagaaatcacgacccccattacgatcgtttttatttaattatattatattatagtaggacgtgactatatatatatatatatatatatatatatatatatatatatatatatatatatatatatatatatatatatatatatatatatatatatatatagctactaatggtagctggtttgtctaaaccaactaccactctatctatgagagactctatccacctatactttaaataaaattttctc

SEQ ID NO: 2788 - DNA, 1501 bp, Oryza sativa
gactttatctagaaattaaatttaatcagcacagatcaacacacgtaagtttaacaatttttaaaagtaacttcaatgttaattggaagtaatttttgcatggttcagaagtaactctctataaatcttcaatgttaattagaagtaacttttggatcaatgaaaaaaggcatgcattaaagttactttttttttcgttataagttacttctataatatatctaaattacttttaggctttattgaatttacttttatatgtctaagaagtaatttagtgaaatctaaaagtaatttagatatattataaaagtaatttattatttttcatcaaaatataatcatgtgagattctgttataaagatttaatttttacgaacatgatggtgtaatcggatcgtagatcggatgagtagtttaagagaaaattttatttaaagtataggtggatagagtctctcatagatagagtggtagttggtttagacaaaccagctaccattagtagctatatatatatatatatatatatatatatatatatatatatatatatatatatatatatatatatatatatatatatatatatatatatatatagtcacgtcctactataatataatataattaaataaaaacgatcgtaatgggggtcgtgatttctacaactattatttctgaccattagatccgcaacaatcaatggatgagattcatcttgcgatccttccacgcccacgcgcgatccttcccttggcgtagaaaaagaaccgttgccccttttccttggcaagtccgcacatcgtgccgcccctccgccgtcctcgccttccccaccacgccgtcgtcgctcccccgtcatccactcatccactgcgctgccgcaaaaagcgatcctcctgcatgcatgccgcttcccgccggagccgctcgcctcccgccagagccgctctgcctccctgctcgcgccgcgacggagaggaaggatagctggggtctgctcacaccgccaccaacggagaggaagtattttggtgtgtggtttaaggattgttgatataacgatttcattttgcctaatagtgtttgatgaaattttgttcacgttttattaattatttttcactaatgtgtctgcaaatacttgagtcaggataagagggaggatgccatattcagcctgggtgctctctgaagatgcataaccgtgtgatgtctataaatttcttctagtgcctgttgttgcagggtttatttctctatctgtttagttctgcttattcatcaatataatcaaagcttctgcttattactatagttttgtcatgactgaattctttactaatcatgaggcgctacactttatactacctaaattgattggaagaatatgccttcaatggaataagtgggactatacttaatcatccagttgtattactgccaaaaccctattccttaatcatccagttgtacataaatgttagatgcacaggt

SEQ ID NO: 2789 - DNA, 1501 bp, Oryza sativa
tgggctgtttccagcccaagtttatttcccttccttcctccccacgggccgaagccctctctccctcctccctgctggagatgttgggcccactccttccgacggcccacacatgccccctacttcctgcgaggtctatttcgctccctctctgactaactggtggcaccaggacccacctgccattttcttctccaacctcaggtcgggagaaccggctacgcccccatgtcagcgcacacatctagcgcgcctccctgttcccgccctcgcatctcgaaccacaccaatgcaatcgccgcacgccttcccccactccccgtggacgtccggctcctcctatccgcctcgtcccggccttagagctgcttcctcgagctatatagagcttcactatcgtcccatctccaatttcccgctattggagttgccgcctccaccattagctccgccaccgcaagaggcaactcggcctccgctccgccttaccgaacaccgccgaagcgccacctcctcctgcaacccgaagccaccgccgctttctcctcctttggtcggcactcgctgctgctccagcctccaggccacctccggcattgtgtccttcctcactggcttcgcagtggcgataggaaaccgggcaccctattcctcgaagctcctcgtcaccggaatccctttgacaccacgtcggatgagttcacccattcttcctggcctctcgccatcccttctcaccaagtccgcccagcccattctccattgttccccagggaccgatgcaccgcggctgcccctctgtctacgccgggagccccgaatcttcgtcctcaccgctaccacaagcggagtagccgccatctccccgtcgccgagccccgcgcaccgcagccttccttgtttgggtgctcggtgaggccccttcccttttccccgtcccttccgccgcctcttatgccgccgccgtgtcgagtggtcgcctgtggtgaccatcaggctggcgctagctgccaatctgttgtgcctgcgcatgcctgtggtcgccctaaccatcgacgtggcgggcccgcatggcagtcccatggaccaccttgtggtctcagtacacggtggatcaactccgtttgagctgctgattcgtggggcccactttttgtggactcggtccacgcccgtcctctgctcacgcaataatccttcttgttttactttagagaaataaataataattacacgataaatggagtttaattctataaacacatttaaatggctcaagacttctaaaattcatatctaattcatacgaactccaagttgggccattcaacttgcaaaattcttttaaaattgagctatacatgtttgtttactttccatgtattgtttacttggttttattagtgtgtttccctgttttgcatgccaacatgaagaagcaaggcaagtcatgcgttccactttgagcataatgagcctactttataaaaggttttatctt

SEQ ID NO: 2790 - DNA, 1501 bp, Oryza sativa
tgcagctatgcggagtcttgaacatttgctttgcttgtaggatggcatttttacgtctggaaattttaaatttatttgaattgtgttgttcgaaatttcaaatttgatatggttgcactctagtctctatacattagaaatatttatgtttgaatttgtgcagagttaaactagacgtagatatagtgtacattgctggagatgaaatttttttttttttgtcctgaagaaatggaggtagccccatttagctcgtaggaagtttaaatacggacacaccaaagaagctgcataatgaaatcatgctatatgtggccatgtatattaaaaaatttcccaaaatacaatttaacaaggccgatgcagcatactaaatcaccaatcttgatgtggcacattgtaatgtttcggtgaaaatttaccatccttttaattacgcacctacaatgatgtctccagatatagctgaggtatttatgaaagacatgatgatgcctacatatcatggtagtgcacgcaacaatatattgccatcaatgtgatttgaaaaaaaacacaaaaataaaagttatcaccaagatagacggatacacgcagtaagggtgcatagctaggcgagacccatgctatgttgacatggtatatctaggtgggcccagctagccaacatgcgtagtagcaaagggttgtaggtgcacttttagcatcacctataagagaataataggtatcagacaaaagtgtcacgttgcaagaattgtgtgtgaaggtcggcgtggaggcatgataaaaaggcgtacatgccgaggtttgtattgcgtggaattaagactacaattgcactacaccatggtccactttcgccaacacacgattatgttggcaaaaggcatattcagcaactacacaactgtcggcaaatcctttgccgacaattttcaccatagtcggcgttgcagcagctggcaaaagtttgttgacagttttaacatttgccaacacataccctgaaggctatgatagctatctttgccaacagataaatttaccttttgccaacacttcatgtttaggggcacaatacttttgccaacagacttttggttttgcaatatgtaacataaagccaaaagtatttcaaataaattaatttcatcgagttataaattaatattcgtcatagcactggtggagaaagcgtttgtagtctcggttcgtaaccccctttagtcccggttttcaaacgggactaccaatccgggactaaagatcactatctttagtcccaggtgaaataaccgggactaaagatcgaactgacctttttttttttgcatggccctgttgctgtatataaaccatgcatatagtttcaatacatatatatgcataatatatatatatattatatttatatatgtttcaatacatatacatgcataatatatatgtatttatacatatatatgttatgcaaatgcatatatgtgtatctctctct

SEQ ID NO: 2791 - DNA, 1501 bp, Oryza sativa
cggtgatctttactcccggttgatgttaccagccgggactaaagatcacgggagggcctgacagccccggacaacatacgaactaggactaaagatgatctattaccaattgggactaaagatcaaatatacccactgtagccaccaatcgggactaaagatgatctttagtcccggcttttagtggaaccgggactattgtggattttggtcgaccgactaaagatggtttctccaccagtgtggcatgtatgactgggagttggaggcatctggagttccctgagtgaaaattgtgaaatggagctaaatgttgtctccactttcaccttattagggataagtagagcaagctcggatgtctgatgcagacttgcttgtgtgtctcatgcaggtggctaccaagaaagccctgtcatgtctagaaatactgccatgcatgtatggcatgctccagggatgaccaggtcaacatgtttctggtcatattacttcagtagtttgaaatggattgtattattgggcaaatttttccacaagaaaaaaaaacgtgtgcccaaaagattgtttatgtgaatagttttggttgaagtgatcagaatcacagaactataaattccaaaaactacacagtgttaaatatcctgctatatattttttaataagggattaaaacctggcctctagatctataatcaatatgtacacggccgaggaacgaccaagtatactactagttccaacttccaaataaaatagagattgtgttgaaggttgttgacatattttggagttgtactattcttcattctttattagcaattggcatagcagggagctggtaagggcgctaccatatataggcacccagcacgccttgaatcctataatattatacaagtgatccctacttagtccagttattatcaatttactgagctgtggataagccacaccatctacttgatttacagccgtttgatcagctctggatggtcatccatgttgcctatcgtaccaacgctgaagcgacacggagcgaaacgatagagccatcccggagagacccatatccatgtgccaaaagcccattagattgtttttctccctgtcactactccaagccaaagcatcgatcgttttctctgagccaacgcgtcacactgcacgccgaacacaggcgcacgtctcggccgcgccgcatgcccacgcgcatgcacggggtggccctcctcttgcaccacttctcgctgccatcccgccacctttcgcccaccctcttcacagacctcccgacgcgtgcgcgtgcgccgcaaggcccgtttcagccgcgccgtctcccctgcccagcgattcctcaacctcctcccccgacgattccttgcctggccgctccgctccctctccttggctcggcactacctcctaggctgctcgccttttgagagcaagtttaatagtatagcccattgatggctccaaatcatctatagctaatctt

SEQ ID NO: 2792 - DNA, 1501 bp, Oryza sativa
caggcaaggaatcgtcgggggaggaggttgaggaatcgctgggcaggggagacggcgcggctgaaacgggccttgcggcgcacgcgcacgcgtcgggaggtctgtgaagagggtgggcgaaaggtggcgggatggcagcgagaagtggtgcaagaggagggccaccccgtgcatgcgcgtgggcatgcggcgcggccgagacgtgcgcctgtgttcggcgtgcagtgtgacgcgttggctcagagaaaacgatcgatgctttggcttggagtagtgacagggagaaaaacaatctaatgggcttttggcacatggatatgggtctctccgggatggctctatcgtttcgctccgtgtcgcttcagcgttggtacgataggcaacatggatgaccatccagagctgatcaaacggctgtaaatcaagtagatggtgtggcttatccacagctcagtaaattgataataactggactaagtagggatcacttgtataatattataggattcaaggcgtgctgggtgcctatatatggtagcgcccttaccagctccctgctatgccaattgctaataaagaatgaagaatagtacaactccaaaatatgtcaacaaccttcaacacaatctctattttatttggaagttggaactagtagtatacttggtcgttcctcggccgtgtacatattgattatagatctagaggccaggttttaatcccttattaaaaaatatatagcaggatatttaacactgtgtagtttttggaatttatagttctgtgattctgatcacttcaaccaaaactattcacataaacaatcttttgggcacacgtttttttttcttgtggaaaaatttgcccaataatacaatccatttcaaactactgaagtaatatgaccagaaacatgttgacctggtcatccctggagcatgccatacatgcatggcagtatttctagacatgacagggctttcttggtagccacctgcatgagacacacaagcaagtctgcatcagacatccgagcttgctctacttatccctaataaggtgaaagtggagacaacatttagctccatttcacaattttcactcagggaactccagatgcctccaactcccagtcatacatgccacactggtggagaaaccatctttagtcggtcgaccaaaatccacaatagtcccggttccactaaaagccgggactaaagatcatctttagtcccgattggtggctacagtgggtatatttgatctttagtcccaattggtaatagatcatctttagtcctagttcgtatgttgtccggggctgtcaggccctcccgtgatctttagtcccggctggtaacatcaaccgggagtaaagatcaccgtgatctttactcccggttggtgttaccaaccgggactaaagttaggatttttagtcccggttgttaaacaaccggtaaaacaaagcctctatccacgggtgcgtatgcaagtc

SEQ ID NO: 2793 - DNA, 1501 bp, Oryza sativa
ccttataaatttggaacggtccttcccaattcggcgaccacttgccgaatttactatcacgagtcccaatcggcaaaatcaatttccatacaagttcaccttccgaaaaatctttgggtaccactttcttcttgtaatgccgagcaacacgttccttatccttggtaacctttgcaagggctcgcaatcgtgattgaacctgtcgcgaccgagaaaatttgcattttcccgaacgctagtgtattaatccccgtcccaggaaaagccggggtacaccacacaaacatgatacaaaaggcacatctttattatatcgataatatttacattattacaaaggcacttaaggcctgacaatcaaaaataaacagcagtggactagcgggcctacggctccatcttaacaggcgctcaactggggtataagccaggactccacctaagacttcttctccaaagcttctcttactgaagggggggaagattgagcaagaatgagtacaaccacagtactcagcaagccactctggcagatgcatgattaatgcaagggggtacaaggggtaataatataggggttaagttttgtagtaaacaacttttaaaagtcacttagttgcccaaagccattttataaagacaatcctagagctacacagtgttattaatcaaggccgtgaaccctcacgaacctgccttaacccaaggcctacgatgattcagaccgaactggcaacccgaccctgagtcctagctcgtcccaagccaacccaggccaactgtcacgtcctgataaattcatcccgaaataaaaatcattttctaaaaggaataatagaattaattaaaattcaaaaagaaattggcaaacactaaaatacatacaagaaaatttcgaatgtagcccagagaattttcgttaaattctccttggtctaaaatgagccctcaaattttacttgaattttcagagcaccggaaatatttattaagcaacaacaactatgatcaaagtttattaaaaagaaaacttaaaaataatcctccttcctcctttgggccaagcccagcccaaagtctccctctccctctctttccctcttctcccgggcctctcctcctcctcccggcccacctcttcccctccccctaccggcccactccctcctcctccctctccctcccgggctgcctctccctcctctcctcctgggccggccgcccggcccaagccgcgcccccccctctaggccgaaccgcgcctccttcccgtgccgtgcacgtgcgcgagcacgccgttgccacgcgttgaccgcgcgcccgcgtgggccccacgcgccaggtcgtcgtcttcctcccgcccagcttctctctctctcccgtgaaccctagtttcttcctccctcaaatccgcacgaatcaattcccttattttcaaattaagtgggggcttttaatcccctttccatcctctttgatttcccccgttttcccccttgaa

SEQ ID NO: 2794 - DNA, 1501 bp, Oryza sativa
atgagatcgaagcgcaatcagagataaggattgctgtgggaacagagtaagaatcggctgagtccagatcggctacgaccagaatcggctaaatccgaatcagactgggttaggtgatgcagccgattccgataatacgacttggtgtacaacatcgggttgagttgatatgcttcaagatgattgccgcacgtggatagagtcctgagaaggcaattgtatctattaattaggatattttatgtaatttccttagagatatgcttgggcaaaagtctgccgcaaagacttatggtatcttagagtttgttagagataatagtcgtgtccgttatggacatatcttgtaattctcgggtataaatagacccgagccctatgtaaaacacacacacacgttcaatacaatttcggcgcatcgccacctttttgctttagttttatttcgacgagttcttgcttttgggttgagctgcatcggttttgatcttcaacaagaggtaaaacttgttatgatggattgtgttctcgggattagtgcttccatctttacgacactctaatcttatttatgtaattcgtcaagttatcatatatcttacataatcttcgacaatatcgtcatctaacctacaatcggctaacatttgtcgacagaaggcagccgattaggttaaatagcgacgttgacctagattatataagatatctaccactttatgaaacatccggtggcttgattgtctagatattgttcttcctttcatacttaatgttgcgtcagttaagttcgatctattaagtcgtgcttagaatttcaatctctagcctgccttctggttgccgattagggtagtatcagagttttagccgatcttatctgatttaaccatatttgatctatatgcttcagtgacatgttaaatctgccctttatgtcaagatcttattgcattcaagtatattaacttttgtttggtatattatgcttgttttgatatctttatatagagtagtatcgaagtattagccgatacatgctagatcaatctgatcggctatgctataaacatatataatcctgttatttatatatatttcgatctaagtgatttatactatctcggcatggtgaccgatatatcccaatcacttgatttaagtatatattaatataagaactatatatcgttaatatctacagccgattggatagatttagttccttattgtctatttataaccgccgatcgattcacatatgacatcggctcaaagataaatgatatgtcatcggcacctagccgatcggctatcatttatagatttaaccacgaattctttgtctctatttcttgttgattacaggatcgaatcaactggcacgctcatacattcgaaggcgagctttggacttgcactggagttaagcagatctcccaggcctcgtgttttctatcaacacacttttggcacgcccggtgggaccatcaccacctca

SEQ ID NO: 2795 - DNA, 1501 bp, Oryza sativa
tgttcacttatgtgcagttaaatgtacttttggatgaaatatggttttagccgattaaatttaatttgatttcttttagttgtctgcttcgaccgattaatttgagatttcaacttgagtgttaacatgttaccaaaattacagaggataagtttgtgctaatcactgtccacataaatttttccatgattttatcttgcacaaaatattttagagaattaggatgacctttgtttgtatatgtattcccacttcataattgcatctaatattattatagggattacattaaatttcttttagactaagaagatgatatttgagtttaatattaagtccacatgttatcacccaagattaacagattaactataggtttgtttagtgaagtaattcttttagattatgctcatgggatctattatggaatgcaagaccaaaactccaaatgcacaaagaactcgagcctaggcatgcattatgtacatgtatgcttggtgacatttctagtctaatgttgggaatgaaaagattttattttgttctcaaattttaatcatgcaatggtttaagttgatcttcacctaaattaaaatggaaatttttggctctctctcaaaattggagaagttaacctctaactattttgacaagaaattttaagtcctaaaatttcgggtatgttacagtgacgctccaaattaacctgttaatcgataccagtcccaggaaacagtgctggtatcacaggaagacagaatatcacagcaacagaagtctctttattatagagtaggagtacagtcatgttgggctgcggacagatcccgagctcacaactgcattacaaaaggaaaacggaagccaggacttggaccaatcaacacaggcgcgacttgggaactaggccgaaaccctaaaactcatcgtagccagcttgctcctggaagaactcctcatcagcaggatccgcttcatcttcttcagcaactgggggggagttatttatatagagcaagggtgaatacgggagtactcagcaagccaggggaaataagtgtttaatgcaggcttcaaggaaaggctattgttttagcaattgattttatttgaactcttttctaaaagcaactaagtgagtgcttctcaaacgacacggatgagacagtgcgtctcgtccggtcggagtatgtgcaatgtgtcagtctttagatcttgaaacaaggttggcacccgaccaacagctttttaaacggccacccgagccaacaacttttcaaacggccacccgggccaacaactttccaaacggccacccgggcctagctgatcccgtcagctgctgatttttcaaacatcgaacccattttcacaacagcaatttcacgagcagtagtcaaacaaaactacgctaggaatcacctcacatccgcccatgaccgtgggcacggctgttcgaacagtttgttaacctctgcagagggggtacactttacccaca

SEQ ID NO: 2796 - DNA, 1501 bp, Oryza sativa
tcgccttcaaacttaaaatctgagtaacaacttgggtaaaactggagttttacaaaagacttggaaaaaacccgacacctgggtcggtgcttgtgaactaaatgaattcccaaaaccgcggaccggggaacgtaccgggtgtacgattacccgctcttgcacctaaggaccgtttccttggaatttcatccgaacataagacaagtacgaccacatgggtggaatgggacacccttggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcttggaggtctcccgacgtggctgatccccacgggctggatgatccgggttagtaatgtcatgtgggtaaagtgtaccccctctgcagaggttaacaaactgttcgaacagccgtgcccacggtcatgggcggatgtgaggtgattcctagcgtagttttgtttgactactgctcgtgaaattgctgttgtgaaaatgggttcgatgtttgaaaaatcagcagctgacgggatcagctaggcccgggtggccgtttggaaagttgttggcccgggtggccgtttgaaaagttgttggctcgggtggccgtttaaaaagctgttggtcgggtgccaaccttgtttcaagatctaaagactgacacattgcacatactccgaccggacgagacgcactgtctcatccgtgtcgtttgagaagcactcacttagttgcttttagaaaagagttcaaataaaatcaattgctaaaacaatagcctttccttgaagcctgcattaaacacttatttcccctggcttgctgagtactcccgtattcacccttgctctatataaataactcccccccagttgctgaagaagatgaagcggatcctgctgatgaggagttcttccaggagcaagctggctacgatgagttttagggtttcggcctagttcccaagtcgcgcctgtgttgattggtccaagtcctggcttccgttttccttttgtaatgcagttgtgagctcgggatctgtccgcagcccaacatgactgtactcctactctataataaagagacttctgttgctgtgatattctgtcttcctgtgataccagcactgtttcctgggactggtatcgattaacaggttaatttggagcgtcactgtaacatacccgaaattttaggacttaaaatttcttgtcaaaatagttagaggttaacttctccaattttgagagagagccaaaaatttccattttaatttaggtgaagatcaacttaaaccattgcatgattaaaatttgagaacaaaataaaatcttttcattcccaacattagactagaaatgtcaccaagcatac

SEQ ID NO: 2797 - DNA, 1501 bp, Oryza sativa
tgctgatctgcaggctcgcagcagtcctcccgttgctggtgtacggtgttgacgctgaggaggtcgcggtggccggctggccggcggttgccgtcgacgtcgaggagcccatcctggcgccgctcggtttggtaagatccaaaaaatgctgagagtgaacggttaatttctagaatagctgcttctattgatagtaaactagcaatcgtgcacgtgtagtacacgttatgatcaatataaattaaattgagcatattataagtacaagaatctgtttatttacgtgtattgtgtaaatatgacctaggtctagaatatatatgtaagtcctggtaattcataatctataacgattaagaaaatatgtacaactcaaaatacttttgatatattgtttcccattgccaagtcgataaggcagtgacaacagacaatgattgaggaacaatgttgagctggtagcgtggtttgttaatctcgctaattaaactaatacttgatactaacattgtataattcaccgcaccgagtaatagccagcatatgtctctcttggagccttatctactgaacaggcagaaatcagatttagtaaatctcctaactcatcagttaatggatgcaacaatggaggtaaatctctaaattgattcgtatgtgggtgattcagtaaaaaaaaaagagattcaggaaagggtcgacggcgtcgaggaagcccgcgtggtcggcggcgcggccgtgctcgcggtacacgaccatgcgccgccgcggcagcgacgccacgtcgccgaactcgtggaggccgccccacatggcgaccatctcggcgatgtccgagtcgttgcggttcacaaacgcaaccgacagcttaaatagcggctgcaacgcgagagtgacctgggagatggcgccgagggagaccttggccgcgtcaaggtcagggtcgccggtgcggcgtggggagggaagggcgcgcgggcgggcggaagtagcggcgtggggatggctgaggggcggaggttagatgcgccttttttttggcgttcttttttttcgttgttttttcgtgcgcgaagtggtctgcccacgatgaggtttctttgggcgatcacaggtgggtcccacgtgatagtggatctgaaggattgcaggattgagaatgaactcgtaatagatagatgaggcattgagtaggtgggaaacgtgggatgaatcaaattggaaccagttggtgcgactggaaggacgcgcgcaagcattttgtggccagtagagtgcctgcaatattagccagtggctatatatggcagggacattttcctgtttgtactcctagccaacgagggcatatgtggttctagttaatcccgtgcatgccgctgccccttgcatatataagcagggtgccatcccttccctcccaaacaaaagactgaataatttgaaaatatatattaattttctgagaagtgtgtggttagtactaacataataattgtaa

SEQ ID NO: 2798 - DNA, 1501 bp, Oryza sativa
aaataccctcggcgccaaaaaaaaattcccgccagccccacccctccctagggtttcaaatcacaaatcacaaattctcacaaatctcatccaagaaataaaatccaatcacagacattgtatacttgcaacacaaaagcattagattcaaattcacaacaagttaacatcaatgaacttgtaaactaaaaaaaacacgtcgtcgtcgtcagcgaactcctctattgcatggggtggccgccaccacctccctccctccttcggtcagatctgggaggggagggccagtgacgcggctggcactattcgtcatcatcatgcggtagggccgtcgttgtctggtagtcttcgtcgtcgtggccgacgccctctgcccaagccgtcgccgacccatccgccttgcgccgccgccgacacccatcccctccatcggatctgggtggggaagggtcgaggggaggggcagtgacgcggccgactgtagtcgtcgtcgttgctcgtaggtgccatagctggccccttccgcccgggcctccaccggccccctctgcccgcgctaacgccacccgcccgtgcctctgccggccccctctggccagatctgggagggagggagggaggggccgcgccgcctgccgctggtagctgccgctgcctccggccggtggctggggagaagaggggaggggaggtgaggggaggatagggggaaggggagggaccgagggacgtgggagaggagtggtgagggagaagatgatagaaaaaaattgcccctacgtaggtggtatttatattccgagtctattttcacaggcggactagtccgcctgtaaaaataaagggtatttttgcaggcggacctgtaaaaatgaagagtatttttgcaggcggaccgcttaaggcgtccgcttgcgaaaatgaatttttgcaggcggacaacgagctttaccccggtttacatttttgtaggcggctatgtggttccgagggccatgtccgcggtccgcctacgaaaataaatacccaacatcggtgaaaatgctttttctagtgtattaattagaatctgaagcactatgtacagtattaacatgtgaaatcctataaacgtacctcaacatcaggtcctatggacttcgggaacatcgaccatgcctactctacgtaaggctctcagtagtgagtgtaactctcaaaatgagagtcgtattgatgagaatatgagtgtggttgagtgcttcatgaagacgctatgttggtgatattattgtctagtgctaccgacgccgaatggaagattttcacacctaaagcaggtttcacatactcgacatggtgtgtgtgtttacgggattttgcttttcctgtgtgctcaagcagtctctaggacaccatggaagacatcatggaaacagacgccatcaaaaccactctgagaacacaatatacagcactgaggagatcattgatacattgtaggagtgagacatgaatgtgt

SEQ ID NO: 2799 - DNA, 1501 bp, Oryza sativa
caccgattttgatatatttatttattgtatgaccaaaataaaagttttagatcttgatgagttattcaactttgttgttgataatttttcagttgaaatcatttagtatttgaaaatattgtttgaagttgtcatattttcaaattcaaattcaaactgttcaaaaaatgttatatagaaaaatgaccaaaataaaagttatagatgttgatgagttatacaactttgttgttgatgacttttccatttgatatcatttactacgcgtaaaattgatttgactcataaattgaattactatactgcaagttaattattttgctatagttcaacatacaaatataaacatttcatatgtaaaatggaaaaatgctcatcggtgacgggctttagttaatgcccaatagagattaagtcatgtcaaccggggattaatatatagtccgtcattgatgagtcatctatgacgggcctcaagttggtgtacgtcacggatgatggtcatctgtgacgggccccaacttaaggcccgtttgagatatggaatgttatctcaattgggtctaaagttggtgcccgtcacggatgatggtcatctgtgacgggccctaacttcaggcccgtttgagatatggaatattatctcaatcggacctaaactacggcccgtcactgataggtgtcatctgtgacgggcttaagttttactgtaacgaaatctatctactaatagaaggtgtaatttgtttactgtaacgaaatctatctactaatagaaggtgtaatttgtttactgtaacgaaatctatctactaataaaaggggagggagagttatgcaagtaattttgttactacaaacgtaatccatcgaataatatgagtgaatgggagtagttataatttatttacaacagcttatctagacaagtgaagcgcagtaaatgtaatattttactacatcttaatctgtctatctagagaacgggggatgagcctgggaccgtggggaaaaaggggtaataattttactgtgtccacgggagcggggacaacgggaaaaaaaaacattgagtaattcttttaaggattaatttgtgcagggagccagaaaaacagggaaataagtggaacagatagcaaaggggaacggaaaaaaggagcgtgggagccaaacagaaaactaaattcaggggtaacggaaaaacggaaaattcggggggagggggtggcgcagtaggggctaactgcggcgtgcggattacaattccgagcgcagggagtggattagcgctaccataattttatggtatttttctagaatttaattcactaatagtagtctaacttgtaaagttatatatgatttacttaattatggatcacactcttgtttaattccacgggtacaagtcttaagtagaccggtcgctatcatgttggacgctatactagcctaatatttgaaatttcgtgaattctaaagaaaacttatattggtt

SEQ ID NO: 2800 - DNA, 1501 bp, Oryza sativa
cctatgaatcaaagggtttcataggaaaaaatccttaggaaattaaatcctccaaaattcctatgacaatcctctaattcaaaggggcccttatatctcattacgcctaccgtcggctgcaaaccgaggaattttgctttgataccccttacctatctatacaccaacactacttttatattaattatggtatagagagggttgcattggctattctttggttttgattttgtgcctattcataaattaaaatcattcaaaatcatcttccatatcgggatatgtatttttgtccataaaaattttattgctggattctatgaaatcaaacaccacatgtatatctctgtctatgttgtgtataacaataataaatttgttatgaaagccaacaaaataagcgtatatatctattcgccatggtactattgtaggtctatctgcatatctcttctagaattaaataagcatatctcctgtcttatcttctagtgtgtgatttggtttgaatttattctataattttcaatacagttctattgctacatatcgcagttaaatgatgattaggatgacaaccaaccatgtcataaataagagctagtagtgctaaaaccaaacgaccaataatacatagcttttgtcacgaacgagcattgtcctaccaattttacttcttgattctaaataaactagctcacataacaaaacttgaaattatatacaccaaactgaagaggtgccaagaacaatgtatatgtgtatctgctctttttttttatcaagagcaagttttatattgtttgtttgtatatatcccctccttattgttgtctcactcctaacttttactatagtctttttgttaatggagctagcattgctgtatatatgttgattgccgcttttttcctcctcttttagcgcatgtgtacttcgccggaagggtgaggcttgcatgcgaggaacatcccgtctaatagtagccaggagattgtgagggcaagtaattaattaatggagatgctctgcagtaactaccttcctagatcaccaccaagggttgaactatggatgctgcacagcacgatgggcagattttgatcgatcggagaaattggtatatgtacgttcttatcaagatgttacttagcgcatatgggtcttgtcgaaacatgatttcggcaataataaaaggggtagcgcacgagacctaaaagtggatggatgcggagacaaaggatttagacaggttcaggccctctcaatgagaggtaataccctactcctgtttggggatttgaatccgccgagtgtgtattgatctgacgatcaggttgtctcatctgccccctagagggcctcctgcccaccttatataggacggggagcaggattacaagatagaaaccttaaccaatacggtatcggtttcctaaatctactttacaatattatcaaaccaggactttaggccgttccgtaatatacaaggaaacat

SEQ ID NO: 2801 - DNA, 1501 bp, Oryza sativa
agaccggtcacaaatcggtcattcttgtccaccacacgtcggctcagcaacgtgcatgtttgcccttcttcaaacaacatcttgcttgtaatggttaggatgaagcctggcatatatcgatcggggctaacgtgtcatctctgggatgtaacacgctagctccagccggggacgagtgcctagaagctctcgtctagacaggatggggcgaagcatgcgtctgaccgcctgtcgccacctaacccgcgatttgaccggtctgtgactggtcacagaccggataatcgagtgcactgcactgcacttcgtgcggcgtgacacgcttagcagaggcgcgataaatgcggttaggtgagccctgctgtgctcacctaacccatacacgtggagtagaaaacgcgaggggtcggggcgcctcggccctcgggggcgaggctggagtcacccgaccccccctcggggaaatcaggaggagggcggtcacctcaccctcgggcccgacgtccccgaaggtgccaggccacgtgggcggttgtgtctgcctcaagcctctagtcacgatactcccggtcccatatcaccgacaacctacatgtcttaacaatttttttgaacactattggctagagacacaactagtatcatatttgctgccgttgatctgattaatagtaccaagtacctccctgccttacccatcgtctacaccctagagcaatgttgccacctcaccttagagtagtgttgccacctcacatacttcgattagccaggctcaccctactatgacccgtataatctagagcagtgtcatttatcttggtgaaaaattgaaatgcccattatttgctcctttcgaaatttaaagttgccaaagtagccacaagatgataaagatatgcctcttcttgtgcaaataattgataaatatgtgcatctctattcaaggaatagatttattttctttagcagcattaattttaatagaaatcttggtgtatcaaaattaatacagtgtactagagtccacaaacgtagatgtcagacgaatcattactcttgtagactccactccaacctacctaccctagtagaaacaaaccgagtggcaacataaaccatgtgacatactactcccttcccgtccctttccagatgagcgacccagatcgaaacaactgcacaacctccagtacaatctccaaacggcagaggatgcccacttaattcctctgcgtttcctacagagagagagagagagagagagagagactggcaacgcatgcaacgcagctaaagctagcccagccacggccaccgcgcgggcggcgcatccagccaccggcgacgtacggacgctccgctgtccgccgctgctgctgcgccagctagcccagcaaacggctagctagctagcaaaacgccagcacacgcaagccgtgacgccgccaagtgagatcaggaggaaagccttgaaacccgcgcgcgacaaaaagtgaaa

SEQ ID NO: 2802 - DNA, 1501 bp, Oryza sativa
taatccctctagatctgcctccctcccctgatcgatcccctctcgctcgctctcgcctcacgcttctcaggagagagtcactcacttgaatgcgaggccagccacagccacagccagcgccctaatagctttcactttttgtcgcgcgcgggtttcaaggctttcctcctgatctcacttggcggcgtcacggcttgcgtgtgctggcgttttgctagctagctagccgtttgctgggctagctggcgcagcagcagcggcggacagcggagcgtccgtacgtcgccggtggctggatgcgccgcccgcgcggtggccgtggctgggctagctttagctgcgttgcatgcgttgccagtctctctctctctctctctctctctctgtaggaaacgcagaggaattaagtgggcatcctctgccgtttggagattgtactggaggttgtgcagttgtttcgatctgggtcgctcatctggaaagggacgggaagggagtagtatgtcacatggtttatgttgccactcggtttgtttctactagggtaggtaggttggagtggagtctacaagagtaatgattcgtctgacatctacgtttgtggactctagtacactgtattaattttgatacaccaagatttctattaaaattaatgctgctaaagaaaataaatctattccttgaatagagatgcacatatttatcaattatttgcacaagaagaggcatatctttatcatcttgtggctactttggcaactttaaatttcgaaaggagcaaataatgggcatttcaatttttcaccaagataaatgacactgctctagattatacgggtcatagtagggtgagcctggctaatcgaagtatgtgaggtggcaacactactctaaggtgaggtggcaacattgctctagggtgtagacgatgggtaaggcagggaggtacttggtactattaatcagatcaacggcagcaaatatgatactagttgtgtctctagccaatagtgttcaaaaaaattgttaagacatgtaggttgtcggtgatatgggaccgggagtatcgtgactagaggcttgaggcagacacaaccgcccacgtggcctggcaccttcggggacgtcgggcccgagggtgaggtgaccgccctcctcctgatttccccgagggggggtcgggtgactccagcctcgcccccgagggccgaggcgccccgacccctcgcgttttctactccacgtgtatgggttaggtgagcacagcagggctcacctaaccgcatttatcgcgcctctgctaagcgtgtcacgccgcacgaagtgcagtgcagtgcactcgattatccggtctgtgaccagtcacagaccggtcaaatcgcgggttaggtggcgacaggcggtcagacgcatgcttcgccccatcctgtctagacgagagcttctaggcactcgtccccggctggagctagcgtgttacatcccagagatgacacgt

SEQ ID NO: 2803 - DNA, 1501 bp, Oryza sativa
ggtgtacaccggaatgacaaggggaaaagagagggagcgagccaacggctcggattcgccggagggagctcgacggcggcggattgctgcggcggcaaccggcggcgagaaagggggaaatcggcgacagcgtgacgggagatcgattcgggcgagctagagcatctacgcgactccgggaatccgtttctagcgtcggattggacggaacatcgccgacgaaggccggcgacgggcggctactaccgagcgcggcggtgacggcggcgagcctactgcgagcggcggcagcagtcggagcggcacaggctagctacggggaggctacacaagctactgctcgagtctaaggggaggaggaagagcgaggagggagaacggggggggtgttctaccgagacgagacggggtgctgtgacgagaggccgacggcatgggagtgatctctccggcctcgggccggggaagaggaagaagatgagcgcccggagtccccttccgatcctagcgcgcaccggctcctccagtgcacgcgacggcgaagggcgacggcgaacagggcacggggcgaggcgacaatggcggaaggcgaaagcgagggagatgggtttgggggaggggatcgggtttatagggcggctatgtcggttcagaaaccgaccttgggcggtcaagccagcgagctagcgccccggctagcggccaaaacggcgacagggaggatgacgccggcggtggaagagaaaagggaaaaaggaagaaagaaagggggcttgccccttgcttctttgggaaaagaaggagggagagagggcgacgaggcaggaggaggaggagctctgcctccatcccttggaagctagcgcgcggagtggcggggccgggtcgatgacgacggcgatgatggtggggcggtttggaagggcgcggctacagggcggcagatgcgggctcaggcgcggaaggcgctgacaacggcggcggcgacttgccggtcggccacctcggcgcgcgcgcacgggaagcaatgggtggtgcggcgatttgagcagcgtcggcgggaagcggcaacgagagcagagagggagggagaagtgaaagagagagagcgagctctctctctctctcgctcagcgcccaagcggcgcacgttcctcacacgtgcgggcaaggatggaggggagaggagagttgggctgaggaggaaatgggccggggagaagagatcggcccacgaactcgagggaggcaaaatagacttttcgagaggatttgatttgggatggatttgagattagggtttggatttcgacgatggattggagaattgagatctggaatggcacggacactagacaacaaacaaggagacaattttcgcatttaggatttttaagagatagttttcccactaggcgccacgacggaacggacgctacaaggtgcatcatcatgggacactgacaccctttctcccatgtcgtcgtagttgcaaacatat

SEQ ID NO: 2804 - DNA, 1501 bp, Oryza sativa
gttgatctcgccgccgacgccaaccagcgccctcccctcgctcagggccacctcctgaagcttgctaaccagcggcagcaccaccgccttcgccatcgcgagatctctcgtcactccactgattcactcgctagctagctacgactagcaggggcggattcaccgttggggctcgttggggctcgttggggcttgagccccagctccatctcggcagaaccagcagcagccgcatggtttcgggagagaagcagcgtatagcataagtgcagatcaaccaggtcgcaaggaaggagcaaacaaagacaacatatcgcgatccatgggtgattaagtggactaattggctgctagaccttccttattaagctactgtattagtttttgtttcttttttttttcctacttcaatggatggaacgatcaggggattagggaagtgagtggtttttactcacaaagtaatccaacaattatcaacaattgtgttattgaatttgtggttgtgcccttgtcgtattgtcttccatcatgggaaagcgtttttatccctcgaggggatatcacatcgttttgtgcatgtcatctaaataatcatcaaaaaattaaaaaaatgattaatgtgaaatatatcactccacaaacatgaaagttaaaattcaacttctacatgttgcaaaaaaaataaatataattgtgaatgtacgataactattttcaatttaatttgttatttttgttgtaactcgtagaagttatatacttatggagtaatatatttcatatcaatacatattgttattttttttcaaattaattagaactatttagatgacatgcaagctttcatccatacttcctaaaacgcattagaaaggagcacccctatattttcgttatagattcgccactgacgactagcttgctcgttattagtggtgctagctgtgtagctgctgtatcaatatgagcagaccttgtactgctagttttataactgcgagccgggggtaccgtcctttcgtcggacgtaccaccggcgccacgtgcttcctgtcggccaagttttaataacctttcactgttctctctgtctattagctcgtcaaaattattctcctcgttagatatagtcttttgtttttgcatatagttttgtcacgtgcataatcataaaagatactccacataattaagcatacacgacggcacgagaagctgagaccgatccagatggcattagcttcgaggtcatccctccttcaatattacgtggtataggacaactgacgagctgagcagctgaggaaatactaggttggcaaaaaggctatctaatggcgcagtcacgtggcttgcgcggagaagggggcggagcgtgggaaagaggcacgtggtcttttttttatatttttttttcagctttctcactcttttttttttctctagatggttccaattcacccttttttaatacatacctatacaaacttttatgtgt

SEQ ID NO: 2805 - DNA, 1501 bp, Oryza sativa
acatgctagatctatctgatcggctatgctataaacatatatagtcctgttattgatatatatatttcgatctaagtgatttatactgtctcggcatggtgaccgatctatcccgatcacttgatttaagtatacatcgatataaggggtatatatcgttgatatctacagctgatcgagtagatttagttctttcttacttattcatgactgccgaccgatacacagatgacatcagctcaaagataaatgatatgtcatcggcatctagccgatcggctatcatttatagttttaatcacggtttctttgcttctatttcttgttgattacaggatcaaatcaattggcacgctcatacattcgaaggcgagctttggacctgcactggagttaagaagatctcccaggccacgtgttttttgtcaacagatttatgctattcgtagcttacgcgtatcccatcatcagcctgtcacgggcgctggggtcgtcgcgctcgcggtggctgcacaccagagccgctgctatgattacccacgctagagtcgccacgcctctaggttcgggatttgacgctgctattaacgtgcgggaagaactcaagatggggaatatgaaccctagagcgagaggaactctcccttcccctcctattagtttgcaaccgcctggtcagcatgacaacatggcaaatacggtccagtcagtctgccacgtgtgcaaaacctcctcgtgaaacagcctagggggttaaatggactggattataaggtttggggggctagataccccattttatagttctgggtactatatagactcttgggcatagtctagggggatttggacttttttctatccagtaaaagtactacttagaatataaaaatgaggaggaagagtctcttttagtagaatttttactaagctattatgcaaattgaagcgcgggaggaaaggagctggctgtggctggggagggggcaagtgcgggtgctcgtgcgctcgcgtggtggtttggcccccttagtctctcatctctcctctctacacacacacgcacacacgcgcgcgcgcgcacacacacacacacacatatatatatatatatatatatatatatatatatatatatatatatatatatatatatatacactttatataaatacgtataaattttgtatatacgtacacaaattatatatacatatataaagtacgtacatatattgtaatatgtatatgtatatgttttttatatagatatgtttaatgtataaaaagatatatacacatgtataatgatttataggtgcgtataaaaactttgtatacgtacataatttaaaaacaaaataactgagagaaaagaaccaaaagaaaaacatatcacaaactttatatacatacacataaaagtttgtataggtatgtattaaaaaagggtgaattggaaccatctagagaaaaaaaaaagagtgagaaagctgaaaaa

SEQ ID NO: 2806 - DNA, 925 bp, Oryza sativa
ttctttgttccaagttcctacgagcagttgtgcttcctagttgcatttatttttaccttgaaacattgttagtactcccttcatcccacccactaagacactaagggtctgtttgacacagctccagctccacccctcctgagctggagcttagccaaacagtttcagctccatcaaaattgggagtggagttgggtggaactctgtcacaaaatatacgagttgtggagctgggtttagacagctccacaactccactccagactcaactcctggagttatatttaggagttggagctgtaccaaacatgccctaagatgtactccctccgtttcaaaatatttgacaccgtttcaaaatatttgacaccattaactttttagtacgtgtttgaccattcgttttattcaaaaaatttaagtaattatttattcttttcatatcatttgatttattgttaaatatactttcatgtacacatatagttttacatatttcacaaatttttttaataagacgaacggtcaaacatgtgctaaaaagtcaacggtgttaaacattttgaaacggagagagtatgtgtattttaatagtcaactctttaaatatttaactaataaatattttattataaattatattttatttgatgaaaattatatcattggattgttatttaatttacctttaaatgattatgattctattgctaaaaaaatgtagtatataagaaatttaaatataaagattagttttaaagtctgtgttaagtttaatcgtgttttattgagttggagggatggagtacttgttaaaatactggtaagtcaatgctgtttttagctacatccaccagcctcgttgaatgttgatccaaacagttgttctgttccattttatatattactctctccgtccctcagt

SEQ ID NO: 2807 - DNA, 1501 bp, Oryza sativa
gcgttcaaacgggcggatttgcccccgcaaatctcgtcggtgccattgatggcggccgacctcccgcgccggtttccttcccctccggccgctctctcccccttccaaccctatttaaaccctccccgcacttccttcgcccgtttccaccctttgccgcgccttctcctcgccggaatcgagctcgcgccatcgctctctctctccaccgtcgcagccgagctccggtccgccgccgtcgtcgccctggaccgcctcccacctcggcgccgcctccttcggcttcgccgcatcgtcgctgacctcgtccacccctccgtttcggtcgccgaccgccggagcgccgccgtccccgtcgacccgagccgcgccaccgcctccctccgctccggccgcctcctccgtcgccgccgtcgccccggggtgagccgtggaccgtcgcctcctttcccccttccctcccctctctcagccgccgctccgccgcgctggtggtcgccggcggcgaccatcggggcgcgggcgcgccgcctcccgccgaccgcgccagcgtggccgccctcgggcgcgccgagtggctgccgcgtggggcccggccgtcagccgcccgcgtcctcgggtgcggctgatgtgtggggcccacggcgccggccggtgtgagcccgggtgcacccggtccaccgtggaccgtgaggctgccgcgtgggccccactcccgtggacacggtccgcgcgcccctccccctcggctgacgcaataaaccctttttaaattaaaatttaaatgaagaaattcgcaaatattcatttaaagagcatataaacttcaaatggccataacttggccatttgaactcggagttggaccgttcaagtctctaatttttccttaagaagtcaagaacccatttttgtgctttgttcctgcttgttatatggagtttattagagtaaaagccttttcttttccgttggtcgtgtagatgctgcagcttcggaagatccgctcttcgtggaggttgaagccgacgtttgggaaagcgagcaaggcaagtcacatcatccttgaacatattggatcccattttataaaattattttgatttaaattattgcattatcgctttacttaaattcccgagttatcaatgttttatttagccatgcctatttacctttgttatgactttattattattgttattgatattattaccttgttcaccctagattaaacaaaaccccaactagtggacactctactcatggtaccactagtatgaatttaggtagatgtttcgctggttaattaggcaacattaggtggttttacaactctagactttgggaatattctcatcacctggacactatggaatggatggattattgtggaattggattcacacctccccctctattcaaaatcctcaaaatggttttaggctgggctcggggtgcatggttttgatagtagcacctcggccatataaggaccggt

SEQ ID NO: 2808 - DNA, 1501 bp, Oryza sativa
cgaaatttatatttcagtttctagataccactgggtaatactgctcatagcactggtgttgatgtttttgttctccatgcgtcgtagacaagcggttgaaccgtccgcttcagacgatttttttcacacgtatatatgtatgtattgctgtgggtttatttagcttatctattgtgttctgctgcactctgtgtgcttaatcagttaatcacttatatatattctaagtatcatttgttaatttgtgcacaagagttgagaaaatatcacacatgatgaatactttgcattcttttatactactcccttcgtcccatttttaaatacagccatgattttttcgcgctcaactttgactgcccgttttatttgaattttttttaaaaaataaaaatataagtcacgagtaaagtattattcatgttttatcatctcataataacaaaaatactaattataaaaaaatttcaaataacaccaacgttgcccttaaaatccagtatattgcaaaaaaaaaaacactgagttatgtattatctgttgacgtgaaattacgtcatgatacatgaaaacctgggaaaattgcttaacttcaatgtattatgagtttcgagcgcgccagttagtttgatccgacaactaacaagatgaaaatagatcgataatcaagatgttgatcatcaacttagggagccgatatcaacttaggaggccaatacagtatttagaaatcatcacaaaataacttatcgctccgatgaaacactacacaaaaacttatcagcttattaatagcaatctgatagatcggatttaactgagacagttataaatggtcgttaagtgaaaactttaaccgtcaactcctgcataaaaaatataaaatatattatcaaaacatagtggtaggggtttattggtggggttggccgaggcccaacaaattaaggttgcccagaccccaacagttcttaggcccacccactcggggaaaggcctaatctccctaaaagactagtccaataggggaagggtggctctcccttttaaggtggcttcctcctcccaagctaagcaaggtgggattattcagaggctcacatggttgccgctcgacttttgcgtctttgccaacgggtaatagtggaggatgtcctcatcaacctagatagaaatatcggacttaaccgagaaagttctagccacgctgatacaagtgaagttgatgaaacttacttcattgtcggagatcgaaactaagaactcactagaataaaatgtggcaatgtgtcacacccagaaattcccgaataaaattccaagcagaatgtgcattaaaatccccgtccaggaccggccggggtacacaaacgacaaagttgacatacagatccacgtcttacaaacattataaaagtcttacataaatgcagcggaaaacttaaaggataactggagctaagccttgacttggactgcagcgggaacaccactccacagg

SEQ ID NO: 2809 - DNA, 1501 bp, Oryza sativa
acaagtctatccatctacaccaaaaaatcaaatgtaactttgcaacaaaaattaaatctttcttcctaaacgtagtccaaaccgacatattataaccaatgcataacttaaattgtcccaaagctactactccaaaaaaatatttaatccacctacaactatcaacaagtttactagtgcattacacatcaaaatattacaaatactccgtcaaacaacccaaccaaaatttctataatgcaaccaaaattttctccccttcatataattaatggttaaaagtttaacctataggctatagcatcaagtccatcaaattaaaattactttcatgcctcaaccataatttttcatccatccatccaactaaaccatccaaaaattaacattaccacatatatggttcaaaaattcatgacaccaatgagtacattgcaaacatgtagcactacaacaagccaatcccaagaacaaattctaaaaatcacaaatttgggcaaaaaaggggttctagggttaccctccgatctacaaattcaaccaataaaaacgaaaaaaatagggggatggaggagtctacctttctcttcgatttccacaaaaaattcccgcgaaaaacagcttcaaattgagtggattagagatggagaggtgagggggagagagagggagagaactgctgctgctgctcgggctgggagaggggcgaaactgagtgggagaggagaaagggagtggggctcgcgcggctttatgggtgaggcccacacaggacgagtgcgccagcctggctggcgccgtgatagaaggggcggcgccagtgtggctggcgccctcctttaccacgtcacaccatccacgtacgccctattgccacggtggcacgagcgcggcaccagcaacagtgttgctggcgccgccatgttgggggacggcgccagccattctggcgtcctaaaaaagaccatttccggtttaagtttttccaggggtccatttgtaaaataagttttcaaaaagaaccaaaatgtaaaaaaatcagtttaagttagtttcatttgtttccctatcttttaggagggaaaaaaaagctgaattaagagatgtttgcgtgtaatttcccctgaaacataagttgttcattcaacttaggtcgaaatttactcaatgtactaatgactagcctccatcaaagatcaatatcatcagtggaaagttctgcactacactagagtgaaaggcaagcaccgtgttcatatggggtctgttggcatatttcaactaaatcgaatttttgaatgctgcagtgttacaagaggctagaacgcaaaagtatccagtcctccaagtttgatgctacgccattattggtgactgacatgaatccatcgccactcagtttgaagaaaattgcaaagtagtttccaagatactgggggcttttatgacttttttggcattactacttattcatgtatgagtgtatgacggcattgcagtt

SEQ ID NO: 2810 - DNA, 1501 bp, Oryza sativa
gcttggggaccagaccaatagaccatcatccatcaccgcgggccgcggggacgggctgtgcaatacaagtggaccgcgtgtcgttgcattgcacggcagattcattcacgaacatatggtactaattctattttggtcattatatgacggtttttacactaacgtcatatattaatgatgggagggaatactaattctttttaagcgatgtggaccgggcttatatatgaactttggtgttttttttttgccagcgtcactcccaaataatccatccgtccgaaaaaaaacaaacatagagcaagatgtgatacattactatgaatctgaacctagaatcacatcatattctagatttattttttatgggacagagagagtagcacggaaataacaattcagcctgacgtgttggcaccacccaccctcctccctccattgctgctacagagcaagttgtcggaattaggaatgattgtttggtttattcgtttcgatttgtactattttgtgcatgttcggctttttataaacactaaccgatttcattagtaacaaattaggaagccaagccaaggaaaaccacactatttgggttcggtgtcggtttctaccgaagaaaccggcggagtactctacaaagttttgaaaatataagcatacattgatacatgatattaaatcaatatatgcttatattgaactataagcatattgatttaatatcatgtatcaccatattccatcaaatgatatgaagcatgtaaactagtacaaccacatcatgtgatacatatatgtaaaccaggctgtaaatcatgaacaggtcaaataaatggaatatggtgaacacgtaccgagggttttgcttctgctgtggatcggattgacaaagagtagcacgcatcataggaacaacgcgtggtgctgggtgttgtcatcatcgcgcaaccctcaagcgtagaggaagatgagccatcgtggaagaccagcaagccgtcgcgtgaagcacttgccaaaaaccttattgtcgccttctctcagtgcaggacgttgagggcaaaggttctggagatctgctctcccgatcgccagtgcatgccgacaagcaagacggagtagactacgagtgacggcacggtacagaggaggaggcaaaccctagattaattttgtgtatgttgtgaggcggcggcggacggtttatatagagatatcagaacgcgtgatcaggacacttgcaagatctccacatggcgtaatcaaactggataaatcgcgcatatcttatccaaactccacgccgctccatgcatcaaattattcgatgtgtttccaaaaaccaaactgaattctacagcaaaaggaaaccacgtttgcacaagcatgaggagccctccgcgtccgatctggcccgtgccgagcctggcgaggcaagcaagtgcatgtgtgtccctctagttctctccattatacatgtctcaagtggctaggagagcac

SEQ ID NO: 2811 - DNA, 1501 bp, Oryza sativa
gtctcaagaagagtattgagacatacaagatcgacatattcaaggtactggagtagatgcatctggatattggcatatcgtccaaggtcatgtccatcatgaactccttcatcaatgaaatcctcgagaaacatgtcaaagttaacaagacatctcatcaagcagcatgggagtgtgcaaggccccaggagtacatgtgggccctaggcgcggatcgtgctccgggagtacagtctgccctggggatacagcggttcatggcacagatattgccacaaagtaagacttaggcgtatcattatcatcttaaaaggcgagctttggcggtgcttgttgcttgggcgctcaacctgaggactccgttggcaacgctcgctgccccgggcttagcctagcccaggatctcctcccagcgttctacgcagggtggtgggcccggtgattggacggcgagcgatggcattaagccgtagcagagcaacatccagagaattacaacttgagattacaggtcaattacatgcaagaaggaggtggaaagacatgaagtaatcaagctagccacgtcacccaaaggaacaagggcatagtgacatgtacatgactttgccgtgaagtaataaggtgggcggccaatccaccatgccctcatctgggcccaccatgctcggtttcagaataggtggtgcaagaagccttctctagctatcctaggccccttgctaagccttttcggggcacaaagcgtagccccgatcaacagcaatgatcacgttcaaactaatgtgacaggggaacgatgacaagaccaagcatagtgccatagtcacttccccgtgcaagaatgtaattgtaggctccccttagggtataaaaggaggagtcaggttactttgaagaggattggatgtttgaaagaactaagcttgaatagaactttgtatcacattcatcacacaaagtcccaaacacgagaatatgttgttacgcttccaagtggtccgaacctatatatttgattgtgttctttgtttaccgcacgaacaagctcgatctaaactcaccccccggctgaatatctcaacagggagtacttgttcccagctagaggagatccactctttgacaccctcctcatgggaaggcatgcttatgaaccttcaataccacctttgcttattctaaaagattgagacctccttaaataggagagtgctctcctagccacttgagacatgtataatggagagaactagagggacacacatgcacttgcttgcctcgccaggctcggcacgggccagatcggacgcggagggctcctcatgcttgtgcaaacgtggtttccttttgctgtagaattcagtttggtttttggaaacacatcgaataatttgatgcatggagcggcgtggagtttggataagatatgcgcgatttatccagtttgattacgccatgtggagatcttgcaagtgtcctgatcacgcgttctgatatc

SEQ ID NO: 2812 - DNA, 1501 bp, Oryza sativa
aaaagaaaagaattagaccaagccaattcaaatcaagaagttgcttgttgctttgggtgccagctgcatgcccgcaccaagcgcttctcaatcctcctctcgctttctttgcagctgagaactgggattactaactttttgggtgcactggagctttcacggcagagtttcacgtcgcgggagaaaattccggcgagacaggggtgaggggaggcggcgtgaagcagagcaaaatgcgtcgggcggatcggaagaggcacatcagaaacaaaacgatacacgggatcggcggggtggctgcgggacccacaaatgcatgtgtatctgtgtatcgcccggcgctacatctagcgcccgctctgttccctctctctagttatctctcctccacgtaagaatagtctgagttggaatattttggagcctgctgattaggcttattgtacttgctctaatgaccaagtctaggaaactgaaaatacgaagagacaccatcttgtgatcctgtcacgttctcaacaacatagaacattagcacgtacagatattggattattgaaccatatttacatcattttatagtttgcattctttgagtcatactgtgcgtagtggtgcacaatgacggatccagaaaaatcgattcgttggtgtctatcagtgtcatagtgtgctaatctggggatgcgggtggcaatctgggccgtacgatccggtgatccgacggtttggtttcgctataggttttaccgaaagtcgttgatgtcactatatatagtttgcattctccgagtcctagtgtgcatagtggtgcgttcgaacgttgacgttaggaatttatcgatggttttcatctcttagagtgtgttatagatgccactaccgctgatgtatagatgtgttactcaggtatagtggagcatgatcggttaatgttcacatcgaacatagcctatcatgtactccctccgtccaataaaagggcaacttagaattggatgttgacacatcttaccattgtccaatattagatgtgtcaacatccaatactatgttggttttttataggacggatggagtacacagtgaggctagagatttgccattgattgttgccagctcgagcgtgttacaaaacacattcgctgatatatgcatgagttcgtgagatttgggtgatgggatatggtcgccacattttgtatggtgtttggttcatggtaaaggtggaatatggccgcccacataaaaatattctataaagatgttggataaggctatcccatgattcctatccaaccttatcctccaagtaaatgggtatattcacggatatatacacatgaccttttttttttattctaaagcacaatacaaatgtagttgaccacaacactcacaccttatttttatgagcatctccggaagattgggctagtatatatcttgatattgaagaagtaacaacgggcgttttgctgtcataccttgagaaaaattt

SEQ ID NO: 2813 - DNA, 1501 bp, Oryza sativa
ggcatttaggacaatttcaactgtcacaaccgtcattagcagcctataaaaggagctcaccttctcaagaaaattccctgtgtaccctgaaagttcgtccaaccccttctattctatacccctgagatttgctcattcccttttatacccctaaatttcagattggatcccttttatactcctaaatatatttatgagtttattttgtgagatattatttaacaaaaataatttttatctcgcataacaagatttatcttataaaaaatttcatactactctaacaaaatatgctatatatatagtttttaatggtaaaaaatattttttttgttttatctcaaataaattttgtcatagataaaaattattttttcccttcgtgaggcgaaaccaaaatattacatttgttaaataatatctcacaaaataaactcatacatataatagtcgcatataataaatttatacactttatcaatatacttcataaatttatattttcttgataccaaatagcaaaatggactttatgatagaaatttaacggtcaactaatggaaggggtatagaagggatccaaactgaaatttagaggtatggaagggaatgggcaaatctcaggggacatagaagggattggttgaagtttcaggggtacacagggaattttctcttctccattccaaagtgcaccaagaaggatcaaattcaagacactctctagtttatttacattgttctagtgctagtggagtaggaatagaatagtttccttagttcttcaagtcttcaaaagatttcggatatggctctagtagcttttctttctattataagactttactcattaatgaaatattattctttatatagtttcggtcttttacttcacttgtataattattcgaataccgactttagttcatatttgtctcgttataattatgtagctagcttattggatatatgcaatggtgtttgtttaatgttcatttatatgattgctctatgtcacctgcagaaatgtagagtagtatttagtaatgtaagtgcggtgcttagattattatataccattaaatggtgttatgtgctactggtctgtagacgtagaccgctgatggtgatagctcagtacgggtatcctccatgtgtgtatataatactaagagaatttccacaaatttcctagtgtggatactcctacgtattcattaccggttggatgtctatgacaggttgtcataaggaagtcggcaatcagggatggtttctcgatacaccaggaggatatagttaggtggtattggttgcatagttgtatactagcaaatgtagactaaattgactatatattagaagtacagaaatgacacttttcttattatttcttcacttagtttggactacatattaatgagagtattctggttactttcttcagtgtgtcaacacattctaccctcaaattttggttagttacttctgtgtgtcaaca

SEQ ID NO: 2814 - DNA, 1501 bp, Oryza sativa; identical to SEQ ID NO: 2804

SEQ ID NO: 2815 - DNA, 1501 bp, Oryza sativa
atactttaaacaacgtactgatatcatagggatattatttacaaagagaaaatatatctttggttgtgtttagtccccttcaaactttcaaaaattccgtcacatcaaatatttgtacatatgtatgaagcattaaatgtgaacgaaaaaaactaattgcacagtttacatgtaaattgcgagacgaatcttttgagcctaattacgccatgatttgacaatatggtgctacggtaaatatttactaatgacaaattaattaggcttaatagattcgtctcgcagtttacaggcggaatctgtaatttattttgttatttgtctatgtttaatacttcaaatgtgtgttcatatacttaaaaaaattttaaaaaggaactaaacaaggccttcttttagaagttcttagagattatgtttttagagagagatagtatacacgcgcactatattgccgagtaaggaaggggatgcatttatctaagataaagaagtggattctaaactctcgagaagatatcccaaatagttatattatttttttaaaaaaatagaaagatatattaatatgtgatatatcactctttaaacacgtaagttaaaattcaacttttacaggtcttagcgaaaaaaagctatagcgttaatacaaaattatgagaaagaatcgtaaggttccattcttaggaatttggactagtaagcacactttccaaaagcccatagtgctccgatttttttttttgcaaaaaatctttcttcattagtatttcttccaatactttttcaaaacaatatttttaaactctgtaatactccatccattttatattataagactttctagcattactcacattcatatagattttattgaatcttaacgcacatatatatagattcattaacattatatgaatgtaggtaatgctaaaaaatcttataatatgaaacggaggaagtagttaatttatccatttgtgcctttgaaaaattatcatacacataatcatgtattcaaacattttttttaagaattacacttatagatattcctatctctttgcgagtgtaagaaaaatattaaagcataacaaaaatcccaaatacaattttcaaatcagagtgaggtgccaaacgcaaacttgaccagcggcagtgccaagcgcccaagcttctaaaaaaacaaattagactgcaaacaaccttggcacccacggcgattagccaattgcagccttggcacccacggtaattctaccgtacctgcccatgctgtcgtcatcccaccgaggggagtcaaacgcccaaaaccatcaaaaccctcttcggctcggcccaaacccctatctaccctaatccatccgccgccgccgccgccgccgccgccactttatgctcgtctgcctccggcgacgaggcctctcgctcctccggcagcgcccgccccgccccttcccccctctcccgcgcccgcgcagcagcccaccccgcgtcgcct

SEQ ID NO: 2816 - DNA, 1501 bp, Oryza sativa
gccccattacaacaaatccctcacatattacggaaacgctctattaagggatttcgtttcatttttttccactaacaatgtttcagctagtgtactcgtaatgtttcactatgtatagataaaatgttgcagtgaattgaattattcttttacaacaaatcacccacatattatagaaaccctttattaagggaatccgtttcatttttttccacaaaaaatatttcacatagtgtactcataatgtttcactgtgtatagatcaaatgttccagtaaattgaaacattctttcgatatttgctaaaacattgtttttatatagggtgaaacaacgcttaattttttttggaaaccgttgtttcatacgttgtagcaaaatgtttcatgagatgatttggttgtgtttcagctttttaaaaatactgaatttttttcgatttgtttagtgaaacatgttcgatctagttgatgttcataaatcgggtgcccgatttagaggcgcctccactttttaaggagctatttgtaaaataattttttaaaaggacctagaggtgaacaatccatggctaaacccaccgcgcggggcgcgcccgcagcgaaccaggcgcgcattaggcgccccccgagtttctccccccttcccttgttggcgtaaaagaaaaatctccccgtctcgtctcctccgctccttgcgccatctcgcggctgaacaggggagggggaggggcgccgatctccatccgacgagcagagcaggggaggggagggggatcctggtgagcatccacatcctctttctgattcatctctgtcccccaccggtagtacttttgtctggaatttgcttgcgttaaccctagcttctcttctagatctggaagaagggattaagagaagcatttcttaattccagagccttaatcttaatacaagtaacagtttgtttgttcccctaaaagtttgggggttcagtactgaacccccatgtcccaagttggatccgcccctgtggggagattgaatggtgcccttagggatctgtggtcgttcgtggacgaaaagcggttggtggtcgcaaagattagtttttaggtttctttttttctcctgaagtgattgcgattaccgtgcctgtgatgaagtggcgaagagaggtaatgatggcatagattttgcattggccgttcggggtgacgttcctgtattggggctcaatttgttgtttctcccagtaactaggtgcttcctggttgctgagcacgccgaggtgtagattttgagatatactcttttgactctttaactttgagtaattttggaaattatgatggttctcttgcctaaatgatgtttattattcaaatatctttatgtacttctcttttgaacttttattttttttccacattttgtttcgctctcaatacaacaaataagcagttctggtaattcttttattttcccatttcaggagatcatggagagtagttcttcag

SEQ ID NO: 2817 - DNA, 1501 bp, Oryza sativa
taatttcctgatatagagtagtatcggagtattagccgatacatgctagatctatctgatcggctatgctataaacatatatagtcctgttattgatatatatatttcgatctaagtgatttatactgtctcggcatggtgaccgatctatcccgatcacttgatttaagtatacatcgatataaggggtatatatcgttgatatctacagctgatcgagtagatttagttctttcttacttattcatgactgccgaccgatacacagatgacatcagctcaaagataaatgatatgtcatcggcatctagccgatcggctatcatttatagttttaatcacggtttctttgcttctatttcttgttgattacaggatcaaatcaattggcacgctcatacattcgaaggcgagctttggacctgcactggagttaagaagatctcccaggccacgtgttttttgtcaacagatttatgctattcgtagcttacgcgtatcccatcatcagcctgtcacgggcgctggggtcgtcgcgctcgcggtggctgcacaccagagccgctgctatgattacccacgctagagtcgccacgcctctaggttcgggatttgacgctgctattaacgtgcgggaagaactcaagatggggaatatgaaccctagagcgagaggaactctcccttcccctcctattagtttgcaaccgcctggtcagcatgacaacatggcaaatacggtccagtcagtctgccacgtgtgcaaaacctcctcgtgaaacagcctagggggttaaatggactggattataaggtttggggggctagataccccattttatagttctgggtactatatagactcttgggcatagtctagggggatttggacttttttctatccagtaaaagtactacttagaatataaaaatgaggaggaagagtctcttttagtagaatttttactaagctattatgcaaattgaagcgcgggaggaaaggagctggctgtggctggggagggggcaagtgcgggtgctcgtgcgctcgcgtggtggtttggcccccttagtctctcatctctcctctctacacacacacgcacacacgcgcgcgcgcgcacacacacacacacacatatatatatatatatatatacactttatataaatacgtataaattttgtatatacgtacacaaattatatatacatatataaagtacgtacatatattgtaatatgtatatgtatatgttttttatatagatatgtttaatgtataaaaagatatatacacatgtataatgatttataggtgcgtataaaaactttgtatacgtacataatttaaaaacaaaataactgagagaaaagaaccaaaagaaaaacatatcacaaactttatatacatacacataaaagtttgtataggtatgtattaaaaaagggtgaattggaaccatctagagaaaaaaaaaagagtgagaaagctgaaaaa

SEQ ID NO: 2818 - DNA, 1501 bp, Oryza sativa
ggcggtgctaccattattgctgtggcggcggccggcgacggcgatggtgctgaggatgacccaaccggagtcgggagtggaagggcgttccatcgtagctatagctagcttggcgtgaggattgatggcaatggacggggaagtgggagatggaatggcggcagccgccggaagcagcggggatggaggatgagaggaataagttcactttaggtctcttaattcgtcgcccagtctgattttcatcctccgtctacaaaaccagatacatcgcatcccccaacttaccaaaactgtgcagacgaggtccgttggtagtattgtgcccggtttgagatgacgtggcgcctacatggttggtatgactaggtctcgtcccaggtggcgcttacgtggcaatcggataaaaaataattttaaaaactgtgggacccacatatcaattacacacaaaataataaaagagggtggggccatcgcccatccggccatgtcgctgagcggtcgcctccagcagccggctagagcgagagcagccacccccctcgcctcctcgaggtggccggaggaggagctcgagcggtcgccggcgagcaccatccattttccggcgtcgtcgaaggagaccactccacgcgttgctccggcagcgacgtgggagcacggggtgggaaggtggcgctgctggagtaggcggagcggcagtgggcgacggcggtggtgctgcacgagcagggctgcaaccgctcatgtcccaggtgcactgaactggtcgccttcccagccacgaactcgtccttaaatacagctacccgcaatcaatcaccaagcagaagcagagcaagtttgatttgctgtggccaattttttatgccatctcgacatagctgctgctcgattgattcatatatggcactagccattttcgtcagcatcgccgccgtcgccagagggaagaaggcgcgcgaaggaggagggggaggtgaaggtcctgtagtggcggagcgccgagctagagcggaggtggtggcgttgtggtcggagctagagtccgagcggtggcgcgccgagctgaagcggctgtggcgctgtgcgtgcaactcggggaggcggaggtggaggccgtggagctcgtgcgagggtaccagtgttgtgtccacgagctcgcccgggagctcgtcgccgccaaattaatcgtctccacgtcctcatgagatgggattttttcatctcttgcggagacattgaaatgtcatcctagaggagcaggatgatgccgctggcgtcggtgtgggcacattggtaggccagttacatgacgacgacaatccgctccactccgctgttcgctgccgcttctcccgccctgctctgccccgccgctccacccgcggcccctttgccctctgctccacccgccccgctttgcccctttgctccgtccgtcgccgctccgccccaccaatcacccgttccggccgctgcccgccctgctctacca

SEQ ID NO: 2819 - DNA, 1501 bp, Oryza sativa
ccacatgacattgacgtggcgcttatgtggcaattcatctagaaaaataataaaatatgtggggtccacatgtcagtttcacacacaaacaaattaaaaaatggtggggcccatgtggccccacatgtcatcctcactactccctcttctctctatccctctcctctcttctctgtatcgtctctctctccagccggcggcgaccggagcggcgactcccggagcaagctggtagagcagggcgggcagcggccggaacgggtgattggtggggcggagcggcgacggacggagcaaaggggcaaagcggggcgggtggagcagagggcaaaggggccgcgggtggagcggcggggcagagcagggcgggagaagcggcagcgaacagcggagtggagcggattgtcgtcgtcatgtaactggcctaccaatgtgcccacaccgacgccagcggcatcatcctgctcctctaggatgacatttcaatgtctccgcaagagatgaaaaaatcccatctcatgaggacgtggagacgattaatttggcggcgacgagctcccgggcgagctcgtggacacaacactggtaccctcgcacgagctccacggcctccacctccgcctccccgagttgcacgcacagcgccacagccgcttcagctcggcgcgccaccgctcggactctagctccgaccacaacgccaccacctccgctctagctcggcgctccgccactacaggaccttcacctccccctcctccttcgcgcgccttcttccctctggcgacggcggcgatgctgacgaaaatggctagtgccatatatgaatcaatcgagcagcagctatgtcgagatggcataaaaaattggccacagcaaatcaaacttgctctgcttctgcttggtgattgattgcgggtagctgtatttaaggacgagttcgtggctgggaaggcgaccagttcagtgcacctgggacatgagcggttgcagccctgctcgtgcagcaccaccgccgtcgcccactgccgctccgcctactccagcagcgccaccttcccaccccgtgctcccacgtcgctgccggagcaacgcgtggagtggtctccttcgacgacgccggaaaatggatggtgctcgccggcgaccgctcgagctcctcctccggccacctcgaggaggcgaggggggtggctgctctcgctctagccggctgctggaggcgaccgctcagcgacatggccggatgggcgatggccccaccctcttttattattttgtgtgtaattgatatgtgggtcccacagtttttaaaattattttttatccgattgccacgtaagcgccacctgggacgagacctagtcataccaaccatgtaggcgccacgtcatctcaaaccgggcacaatactaccaacggacctcgtctgcacagttttggtaagttgggggatgcgatgtatctggttttgtagacggaggatgaaaatcagactggg

SEQ ID NO: 2820 - DNA, 1501 bp, Oryza sativa
ccactgcacgccgcgccaaaagtttaaaaccccagccaatgcgcgcaagggcttcttcgcgacggcgacggccattgcgttcgtgcatgcacctggctgatccgacgacctatcagagattctcgccgccccggccggacggatcgatgacgagctagctagctatagcttagtgtgtcgctgttaacttgatgcatgctgaattagttagttcagttcgcgccgtttctatcttatctatggccaaagtacaggttgttcctcgttgatgcaatctacatcatatcgatccatggtcttttgtgtacttacttggattaattaattatgtttcactcgttttgtgaacacccgctattactatacacacacacacaatagtactactatgcccttgttttcaaatcacctccgtgacttgtttcatcttcttttaatctttatcttttttgtcaactaattaattaatcgctgcatttcggggtttcgtgtgctgaatcaaatagatcttactccctccgtcacaaaatataagtatttttagaatagtgacaagtctaacatttttttaacattttttactagatttattattaaataaactatcataatattcaactctttttatttaaaacatcttttttgaatactgttggtcaaagtagcatatttagaacggagggagtaccatatattgatcgttaattggttggcttataatcctacgtttgagtctttgaaagatcgatgaatatgaacgaaagggttgccaattgtcacgtacgcgtgtttggtgttctgaagacgcagctgatctcaaactgcagtgcacgtgtctgcttgacttaaatctcagctaattttggtcagaccacgaccacgttccgattaagttcacacgtagtaccgcttgatgacaattaatattccctcaataaaatggatggcaacctaacttcaaacagttagtggagtatataccactccgttccaaaccagagctgttttgaaatgagtgcatgcacacttatttcacacacttccatctgaaagtttacatttagacgaagaaaaaaaatcatatttattttctcggtgtcatggcgatgagagaggttcaaattcgtacaagttttcttcaaaatttgatatataattattcgaacttaacaaattaacccttcttaatttcaaccaagctcaataaagtctataattgtcctaggtccaaacccaaaacatgggtaagtagtaactaacatgtaggcctaacctactaggggaacaaaatagtagagtaaggagggacatcgaaaaagatgatctaaataggatgtttcgccttttattttgactagtaacatatcttgcataccaataagcacgcacgattggtttgggcgtgttgtatgggctcatatgtggctgatgataggttgggagttcgaatcaagatccaaccgctcatggatggtgggagaacaggaaggagaacaacttc

SEQ ID NO: 2821 - DNA, 1501 bp, Oryza sativa
aatatatatggtcaatatataggagaggataaacatcacgttgttatctcccatgaaagttttcttcttcttattctcgtctatcttcttgagatgaactacttattcagagtgtacagctagttcactactttgtctgcagctagctttcctaagagatcaaaagggtttccaagtgcatgtcacgataattaaaaggtggccaccatgcatggttcatctttcgatcgagatcgagttctataaattgacctgtcaatggtatgtctgccagtagctagctcgaggttaatctattcgatacatattccatccgtttctaaatatttgacacagttgattttttaaacatgtttgaccgttcatcttatttaaaaatttaagtatttattaattcttttcctatttgattcattgttaaataatataccttttatgtatacatatagttttacatattttacaaaagtttttgaataagatgaacagttaaacatgttttaaaaagtcaacggcgtcaaatatttaggaaaggggagtatatattttatttgaaacacatgttaattgttttgtcgtacgtcctctctcaacgtattactactggtcagttggtttgttcttatcgtctaattttagatcgaaccggccgggtagtctgtccttttacggcagtcatttggtcaagtcatccgtgtacatgcatatatgtcgtcgcagccgatcaaagctagaacgccacataataaaatcataatcaactatatatatggtggttaatcatatatacacgtggattttccttgtttaattgtcgtcttgtgcaaagtgcaatgggctatcagcaagttgcattttttttattggcagatgattgcaatatggcagcacatatacataaatgataagcaaaacctgcagggtgtggaagacaatcatttggagcataaacaataagtacgtatataattataaatatttaaatacatgcatattattgctggagaagagaaacggtctttatatcaacgtctactttgatgaagagactctaggattgtttaattattccatggaaaaaataaagggggaaaaagaaatggctagctagaccggtcgttccatgcatgtagagctgcatgaattgtgagatggatgatcatgatcgtggtgaccacgacaaattaagccatcaaaatcttctctttccgttgagtgcaacagcacttcacttgggagtatatagctagcgtgccgtggtcgcaagctacgatcgagtcgagtatatatgaagctaccagagctgcactgctggtggtcaaaggcacccggccgcctcgttccttaactcttgcatgcatctatatatgcatgactgcatacagaaatatggtggattaattcctgaaattctccatagaaaagagaggcagatcgatgttaataagataattaatcaacacgtacaaacttagcttgtctcgtaacttaatttgttctc

SEQ ID NO: 2822 - DNA, 1501 bp, Oryza sativa
taaggctctcacaaactcattaatactaatatgtagtgcattttaaaattcattcactcctaccaaactttagtagtttttttttaaagatgtactctatgcacatcattcaacgtgttaactatatatgtcttttcacacaatcagatttggtgtatactttcttccttaatttgtacccaattgggaataatcccatatatttctggatggaggtattattaaaaagggaaggattactataacttgaatacaatacataggaacgcataaatgccaatagcgataatactacactagccattggagttgttcgtcgtataatcatctactatctatacgcctaaaatagacaaacaacataatgtccgcctataaatggtacctcatgcattagaggagagaatatgctcttcggtagacatgttaggttacatatgttatcttatatgtagatgggacaagaagaaatcatgagaaaagcgtttgttattcatgatagataagcaagatatccctcaagagaagctaacctcgtgcataagaggagaggacaaagaatacaacaagagtgtactgcttatatgctcaattatagcaagcgaattattgaatattccaataattgcgtgtcgaaagattatatattcagggtcgtttgtctcttacattaacccctcttaaagaaaaagcagtaaaaatcaaaatatataattctggaataaataatattcatcaacactttaattttgtaaaagagaaaaaaagcataagccgtagaggcaagccttgtaaaggaatgaaaataaaagcattctggatatataaacaaaccacaaaagatcgatcgcattcgcctcttgatgtatacacatggtcaaatccaaggaacatgtcgtgcccgatcgtaccaaaccaagtcacggtacacgcgtggaccgcgcacagattagccaaactctgaaagcaacacgcacggcaaacgggcaaagccggtgaccgggggacgcgcgatcgatcgatcgagccggcgcgcgcacgaagcaaaccgcaccgcatccgcatcgtcgtcagcaagagcaaacctgtcgcgtccccattccaagcccgccactttgtcctcttcctctggcgctcggctcgccggggagcagagcagcagcagcgaacccctctctcgccgcagatcccaacgccgcacacacacgcacacgcacccgcacgcgcacgcatttccagctcgcgacgacgcccatctcgacgcgacgcgatccccgccaagtcaaaccccacccgttatactctccactgcgatctcagaggcagaggcagagcccacgccgcgcagatccacctctctccgccctggattccgcggagcaggaggcggtcaagccgtcgccgccgccgccgggccgcatccgctaccgcacgccctcctccccggacctcctcctcgccccgccctccgacgccgacgccaagaacatgcgccgctact

SEQ ID NO: 2823 - DNA, 1501 bp, Oryza sativa
ggtaaattttgtttgcagataaccttctgtaccataaaaaaaagaaccagagatttttacccttctctaaaaagaagtgtctctatttagagatttctctacttagatgaataaatcatactctcttcgtctctgagtatttgatagtagttagttcgtcttttaacaaatcaacgtcaaatagaaaaaaccaaaggtaatatgctagcagcaaatagtggctgacaaccatatagtcgtagaatatgcgtgtacaacatggtctcttgcaaggtagagtagctacagtgatggttgccggtgcagttgctttcagttgagcaagtgggtaggagccgtagtagtagttaggtgaatctgatgtgctaaaattttggggaattgaagattgtggcaaatggcaatggacatggcaatggcaaaattatggcaagtgaggaggaggaggaggcagtgctaccctgtgctcccttgtgttgctccaaaacaccgtcctttgcagtagcccaggctccttaactgcagcatctattacttcattacacaaccatcttgcacgtgtcctgtccatcctctgcatatgctccatgtcctacagcaacaagagatactacatactgggtgtatccagcactaagatttccattttatttttaccacagtgctatcttcagtatctccccaattctaaattaacacatatatctattcagattgatatatcaaatcttatattaaagttgtttattttaaggcgaatggacttgtacataggagtaaaatcctagagattttttttgggtcagaatcaagtgtatgttttcggtacaaacacaaacctgcattatgatccatcatacaggtcatgatggaagttgtgcagccatgcatccgtgcgaaacaaaacaatccgggagattgttgttgttttcggggaaatttggtggtcgttttcgaacagtaggctgatttgaaggaagaaacggggagaggaaaggtggtggtgagctggactgaaatcagcagcggtggtgactgcaaccggccaagcaggacgacgttgctgctgctgttggagtcactcttggactgatacggcggccacaggagggaccacgcagttggtgacgacaagggatccggagaactcgcttcctccatgtgactatccatccatcattcgaactgggaggagcaaacttttctgcctgccttgatgaaagctcctcccctccacaatttctcaatctccccggaaacaaatcccctgtaggatttctgaaaattctatatgatccatagtagaaattcgatttcgatcaggtgtttgggaaccaaggattataaaaaaacaaaaaaaacgatgagaaccgctttttttttctggttttcgttgacttcgttgtggatcgagctgacaaaccagttggtaaatcttttcaatttttaaaaaatcaaataaaatttagaattttgttaacatttgtttaagtttatggtt

SEQ ID NO: 2824 - DNA, 632 bp, Oryza sativa
ttcaagcgaaggcatcattagttaggtttctcaatatggctcttcgttaatttaatttcgaaattaaaaattaataattaacaaattataacatacaccaactcttctttcactctacttcatatggcaaggttgttgcttggcttgtataattacatatataaaactccaatctctaaaactgaattcagggtatagcttctggcttcctattgagccacatggcgccctataaatctggttagcccttctaaaaatttgccacgtgtcaccacttgattcaaagccatcggattaaaaataaacggtagagatggggcaaaggacctaaccgtaaaacttgctatttaaagggagtttatggtaaaaggtaggatctctacactggtggagaaagcgtttgtagtcccggtttgtaacccccctttagtcccggtttctaaaccaggactatcaatccgggactaaagatcgctatctttagtcccgggtaaaataaccgggactaaagatggctcagccacgtggccggctgagccatcaatcgggactaaagattgagctgaccttttttttttgcatggccctgttgctgcatggtttatatataccatgcatatatatgtttcaat

SEQ ID NO: 2825 - DNA, 1013 bp, Oryza sativa
tgccatcctttggtatccttgtgcacttgcatatttgctgtgtggctggttgagtatgtcatatgctcattcttgcaataatcaatcaacctcagttgaagaaaaaagatctaggaggagaagacgtttggcttataccccagttgagctgcctgtgggagtggagccggagcttcgctagattttattttccgctgcagttttcttcatggtgaggactaagtgcatcttaagtaagtatttatcgttttagttaatttgatgaatttgtatattaaattgtcagtttgtgtacctcggctgattcctggacgaggattttatgcacaaataagttcggaaattactagtgaattttcgggcgtgacagtagtactcagtcttgctctcttttccctcgcaccagagttgaagttcttctcagttggagccgtctcagagaggttggtttcgtcgctgccgtcaaggtttgcctgtggagtggagtcgcccgctgctgaagtcaagcttcccggtttagctcgcttttatctttcccgctgtatttgtaatcttttatatttttgtaaggcgtgggtctgtatgtcaacaattgttgtttgtgtaccctggctggtcctggacagggatttaatgcacattcagcttagaaattcgggttcgagaatttctgggtgtgacaccatgtcacactgagatataaagtgagtgaggagtcataacattatctatcttgccaaccatcaagtatctgtgatgggcaataaagttactttgacgatggtatacaaggacatctgtggaggcacatcacgtaacttccaaatgacatgactcactctgatcccaatagaatatccaacaaaaacaaacactctagagcaaccgataaggaattcaaagaaaacccatccatcgcatctataaatagacaagcacaatgtaaacccccttcattcttctcacaactcaaacattacagcaaaagcataagaactagaaacccaccacaa

SEQ ID NO: 2826 - DNA, 1501 bp, Oryza sativa
ccagggcacgttgtcgccagtcctcagcctcttttgcagcccgttcgcgttcctgtggctcacattgtagccgttctcgctcttatgcttggcgctcctcttccagtcggcgtcgttcggcttcctgttgtacacgtagttcttctgcttctcgggctttacgctcttcttccgtctcattgtcagccatgaaaatgccgaataaaggggtgtgtagttgtctttcaaacccttcgtcgaagtcgtcgaggtggcgtagtcgtagcggtagccgaagtcgtcgtactccacgatctccgatggtcgcgagtcgatgccgggggagctgaggtagccatccagttgttcgtcgaaaccgtgccgagaggctggagtatgacaccgacttccctggagctaggccgggccggggctaaagccggatcccacctaggcctacggggagaagacgcccttgtggtgaatacagcagccaaatcatcgggagtttcatcaggattggcggataggccccatcgtcttgatcgggtcgtgttgaagtagattggatcccgtccgagtggtttgaagccaactcggtggagatgatcttggggtagacctcggccgagttcgggataccgaactaggtggagatctggcctcttcccgactggtttgaatccgagtcgaggagagaaatcttgccgaagtcgttggtgatgaagtcgaggctgccgaattggaacgcctgcccgggagggaagacaaagtcgtcgatgccggaaacgaaacccatcgcactagtcggcgaagaacttgacgcttcccatacctggcgtgccaactgttgaaacaagatttcgacaatactaaaagggggtggctatcaggctggaaaagtggatgggtttaaagacaaggaattttatacaggttcaggccttcttaatcaagaagtaataccctactcctgtccggggattgatccaccaagtatattattgatcatatgatctgggaaaaaatcgtgcccctagaggcacccgtacctctccttatataggggaaggggtccgtattacaaaatacagtccatatccctaacggaatatgtagttacagataaaatacaatcgtaaccgactaggaactcggatgtatccttgacatacaagtttagaatttaacccgagtccttctaaagatattctatctagacatggcaccccatatccagtcggactataaatgccttgtaggcatggggtatccataatctccacacagctataggttgggcatgttttatatggtgtaggattacattatagggtatatactgtttgccacaagcgttttgactttgttctgatcgaaatgaaaagattgacctgctgaacacactccgttcacgtcgagtagccatagtagcttagaaccgaatgtaggcacacatcgtaaagttgtaaatgcaaccatagtagacggtgacgataattaatttcaacaatgtactagg

SEQ ID NO: 2827 - DNA, 1501 bp, Oryza sativa
cggaatatgtagttacagataaaatacaatcgtaaccgactaggaactcggatgtatccttgacatacaagtttagaatttaacccgagtccttctaaagatattctatctagacatggcaccccatatccagtcggactataaatgccttgtaggcatggggtatccataatctccacacagctataggttgggcatgttttatatggtgtaggattacattatagggtatatactgtttgccacaagcgttttgactttgttctgatcgaaatgaaaagattgacctgctgaacacactccgttcacgtcgagtagccatagtagcttagaaccgaatgtaggcacacatcgtaaagttgtaaatgcaaccatagtagacggtgacgataattaatttcaacaatgtactaggatttatccttacagaggcattatgtttaaacttgcatgacatttttattcagatttgtatcaccccgatgtttcaacttgtcacacacgatgatgcatgactttatttttctctcctgtactactatactgctacaattcaataccagataccaccgacggtgggaatgctacagggagcagtgttgtagcttgggtagataccgcatattgacggcatgtttagggccaacatagcttgggcttgagcttgactctgatcgaagtagacgctagcaaactgttgtagctgtagctgctgcacaatagcctgaacactgctaatggcctggcagtgagactgttgtgcgatcatcctgagctgttggcagcactgctgctgcatgacttggcagtttctcagttgaaacacgggtgattggaagaagggggttgccactgtgctgcactgctgccttacgaactcaccgcatgggctaagcatctgttgctgcagcatgagatgcggctgcagctgatattgcctgtaaacttgagtaacagcatcaaactgcgcagaggcactgcatgcagcaatagcaaggagagcaaagaagaaaatgatcttcattgtggtgggtttctagttcttatgcttttgctgtaatgtttgagttgtgagaagaatgaagggggtttacattgtgcttgtctatttatagatgcgatggatgggttttctttgaattccttatcggttgctctagagtgtttgtttttgttggatattctattgggatcagagtgagtcatgtcatttggaagttacgtgatgtgcctccacagatgtccttgtataccatcgtcaaagtaactttattgcccatcacagatacttgatggttggcaagatagataatgttatgactcctcactcactttatatctcagtgtgacatggtgtcacacccagaaattctcgaacccgaatttctaagctgaatgtgcattaaatccctgtccaggaccagccagggtacacaaacaacaattgttgacatacagacccacgccttacaaaaatataaaagattacaaatacagcggg

SEQ ID NO: 2828 - DNA, 1501 bp, Oryza sativa
ctataacctatctatctatctatctatctatctatacctatactaattggacacttttaggagctctcacgcgttaattagaaagatccgtagattataatacgtatttatatatgggttttaatttagaacgaatttattatatacgtgttccaaaaacccatctaatatacaagtgtgttgaccaatccatatcgtgtttcatcatctttagtccgtccgcacggtcgtttcaattgtttccagtggcttttcatcatgatcatgcacgcggccattaagatgttgtcatgttgatgaacaaaatcgatacttcatggacgatgcatctacctgacaatgatcatcgcgggcgtcaaactcggcgaattcttgcagtagtagtatctgctgcagaaacagtgcagtgaggagcgagcggccgctgagatggccacatctcgttcgtgatcccccggttcgaatctcctgccactacgccggcacagtgaagtattgtttcgttaatcattccaccatctataatttaagtgacggttctaatgacaggtatatgcttgcatcatgtatgcagttctgctgcagaacccgtgcaacaaagccatggcaatctacaaagcatattagcatagaccaatgacaaggtgatcgtggaagatttcttttaaaatatggtcataggcgggtgaatgaaggatgcaaaacaggaggaatagttgtgattaatttacaaatttagcgagcaaaccaggttaggtgcttttcttccttttgtcttaatttaaatatgcattttcttttgcaatcttaaataataaatttcaagcgaaggcatcattagttaggtttctcaatatggctcttcgttaatttaatttcgaaattaaaaattaataattaacaaattataacatacaccaactcttctttcactctacttcatatggcaaggttgttgcttggcttgtataattacatatataaaactccaatctctaaaactgaattcagggtatagcttctggcttcctattgagccacatggcgccctataaatctggttagcccttctaaaaatttgccacgtgtcaccacttgattcaaagccatcggattaaaaataaacggtagagatggggcaaaggacctaaccgtaaaacttgctatttaaagggagtttatggtaaaaggtaggatctctacactggtggagaaagcgtttgtagtcccggtttgtaacccccctttagtcccggtttctaaaccaggactatcaatccgggactaaagatcgctatctttagtcccgggtaaaataaccgggactaaagatggctcagccacgtggccggctgagccatcaatcgggactaaagattgagctgaccttttttttttgcatggccctgttgctgcatggtttatatataccatgcatatatatgtttcaatacatatatatgcatataatatattatatatatatatatatgcatataat

SEQ ID NO: 2829 - DNA, 1501 bp, Oryza sativa
ccatctctaccgtttatttttaatccgatggctttgaatcaagtggtgacacgtggcaaatttttagaagggctaaccagatttatagggcgccatgtggctcaataggaagccagaagctataccctgaattcagttttagagattggagttttatatatgtaattatacaagccaagcaacaaccttgccatatgaagtagagtgaaagaagagttggtgtatgttataatttgttaattattaatttttaatttcgaaattaaattaacgaagagccatattgagaaacctaactaatgatgccttcgcttgaaatttattatttaagattgcaaaagaaaatgcatatttaaattaagacaaaaggaagaaaagcacctaacctggtttgctcgctaaatttgtaaattaatcacaactattcctcctgttttgcatccttcattcacccgcctatgaccatattttaaaagaaatcttccacgatcaccttgtcattggtctatgctaatatgctttgtagattgccatggctttgttgcacgggttctgcagcagaactgcatacatgatgcaagcatatacctgtcattagaaccgtcacttaaattatagatggtggaatgattaacgaaacaatacttcactgtgccggcgtagtggcaggagattcgaaccgggggatcacgaacgagatgtggccatctcagcggccgctcgctcctcactgcactgtttctgcagcagatactactactgcaagaattcgccgagtttgacgcccgcgatgatcattgtcaggtagatgcatcgtccatgaagtatcgattttgttcatcaacatgacaacatcttaatggccgcgtgcatgatcatgatgaaaagccactggaaacaattgaaacgaccgtgcggacggactaaagatgatgaaacacgatatggattggtcaacacacttgtatattagatgggtttttggaacacgtatataataaattcgttctaaattaaaacccatatataaatacgtattataatctacggatctttctaattaacgcgtgagagctcctaaaagtgtccaattagtataggtatagatagatagatagatagatagataggttatagatagatagattgtccatatagttgatgagtaaattgtatcgcgaagggcggtagttacacaaggacaaagcgtgattcctacttttatttatggttatcgttcatcactagaaattaattgcaaaaccccggccatctaccgatcatgttctttctatttactcaacctcttcatctttgttcctgttgcaaacgcacaatcaaaaaggctacagtagacggcatggcttcacttttgaccaatcatctactgttggagacatgttacgaggattttcgaccagaactgccaaaacgaatcaacgaccatggggcgaagcatagccaaggctccgggcaaagccgaagctcttcgctaccgagt

SEQ ID NO: 2830 - DNA, 1501 bp, Oryza sativa
ccagtaggggcccgtatgtgtaaaggacacagtgtgccctccataatgtccctatcataagggtaaccatgtaaattcccctgtataatctaaaccctagtagtgaaaacctgtaatggggctataaatagccccctagggctatgtaatagggggatcccaaaaaatttgaacaaagtaatacaattgttcttttatttcccatccactgttgagagaaccacgtctttcaacgtgacgcagttgtccattcgacaacagctggcgccgaccgtggggacctccgagcgaaaccactgagagaaaatgccaccgaagaaggtcgcaaatgagaaggttgcaagacataaggagagtgaaacaagagtggagatggcagccaaagagggagcagagccttcggcactcggcgtcgaagctggtgtggtaccatcgacgtcggcccctacgccgcaaccactaccttcggctcctgccgcttcagcggggcaggcgccgaatatggtcgatgcggcgaaggcggcagcggcagcaagggcgctccagactagggcagaaatcctttcgacaagtcaactagcggcgccccaagctgcttcaccgcaacaggctgtagctttgaccgcgctcgccgctgcataagtcaaccccaacctcgaagcacaggccgaagctgacatggaggccatgcgcaaaaacatgacatgactccaagacatgcttcgtcaaatgcaagaacagcagcaggtgtatgaggcagcgcggcaagccaaggtcgcctcggccccaatcctccaatattcgacaggttacattccaccccaagtccacccacaagcatcaatccaaccccttccgccacaagccatgcaagcgccagtgtacttcgccgggcagccttcggccgcagcaatacacccgacccctcatgtgcagctgcaggctcagccgatcgctgcccaagtacaccccttaccaccgggccaaatgtcacaagcattggcggaaggggcttcagctttgcaagcacagctttaagctttccttcagcaactcaaccaaccccacagcatttcaggtatagccccttcggcctgaccggaggggaacacaagtcaaggtgcgcccagttggttgccatcgagccagcccgatctgggggcttcgccttggagtcaaggaccgcagttcgacttcaccaacgctgctcaagcaccaaccattcgaccacaggcaccgacaccaggcttcggagctaaccaggcgccaaaccaggccgccatggcatggacccagccgtcgttcgacccatccatggcggcacaccaagcatcgccgttcggagccgagcagccgaacactgtggctcaacctcacgcgcaagccatgactttgcccttcgcaacgccatattcgcagcaaggtgctgcgaacaaagcgaggggcgaaaaggggctaccactgagcgggggaatcaagatccatccaatcctacccaagt

SEQ ID NO: 2831 - DNA, 1501 bp, Oryza sativa
tatgaggtaaagcaaagggaggtgaatagagaactaataaatgattgaattggatggataagtagtttcttgatccaacggttgctatctttataccaatgtgatctgatggtttaaaattgttgatgatatggattcttgcatatctttctttatatgagtaaatgcgttttagtgggaatcaactatgtagtaagataggattcattagagaaatatttgtttgaaaatacattttctaaaaagaatttcttctgtggtaatacttttaaaacttatttgttaaaatattgaatttattcttaaatagataattcacggtaataatcctttcaataatatgaatcaaacggcccaaaactgaatagtccggattcttttgtgtcgttcaaccagaagaaaggttggtttgcgtttcttttttttagttattatatttggactttcttgctctagtcaatctaaaaagaaaataatctctactatttaaaaaatcgggattggtgatggtgaagccaacgtagaggtgtgatccaacctggaaaggtacatcgacacgaaaaaaaaaacggcggacgctcctccgcaacgcgagaaaaaaaaagaaaaaaccccgcacgcctccacaccattgccaccccccaatccatcacccaccgctgccgccgccgactcctccctcctctctcatcgcgccttcccctactcgtaccactgccgaaaccctagacccgcaccgccctcgaccgccacccctccaccgtcatcgcatcccgcctcctccccgagtccggcgacaactattcccaaggttggtgtactccccatcctcttggtcctaggtctctaaatctgcatattcacatgttagtctcatccgtatggtagtttttttttttttttggtttcattgccgtcattggatgaaatacttcacatcttgttgacatttatagtcaatctttcactgtaaaattgtgggtaagaaatggtgtgcctctgataattctttggtgtcaatttttctatgtgattgcttatatctaccaaactgacttaaccttttatttcaaaagatttaatctgtaggacaaaagttcagggtgtccaagcaaagctgacaggacaccatgcataatcgagatcaaattattatttgcatgtgtgacaaaatacttgctctttaattttctttccacccactatagcatacatcagtgatataattgaaatcaaatttttatgtgcatgtgtgtgatattatgggtaccccatacccatacggcatggttatccgactagtcataggggataacttatatctatggaatatgtaatagatcatgactcgggtattacgtttccttatatattacagaacagggtttgataatattgtaaagtagatttaggaaaccgataccgtattggttaaggtttctatcttgtaatcctgcccccgcaccctatataaggtgggcaggaggccctctagggggca

SEQ ID NO: 2832 - DNA, 1501 bp, Oryza sativa
tttctaaagaaaataaatctaccttcttttcaaatgatgaagaagattataaataattgcttatagatattacttagatatgatataatataaagctaataggttaatgattataaaagcaagtaatgccaaaaaaacaatttctgaagaaatcgaggtatatattctccggttaatatttcgcttttagtgtctcaaatttagcatacgacgcatgctcgcgcattcgcgcgggctaccttcctagttattatatacttaaaagtccactgaacttcctacaaacgctcttaagccgacatgtgtcctcctacgaacgctcctatgccgccacatggcattctaataaataaaaaaattcattaaatccggtggacccattatttaaaactattagatctatctttgagaaaaatccaccgctaaaactgggccccactaagtacctgtacgtggatggatgtatatatgtaatgtacgtgttatgaaacaacagggtgatctcatccatataaaaggatggatcgcaaccgaaggcaaccgtgcctcttccctaggcgcttcttggcaacagatgcaatggttcccaaccatcgtgtctccggttgccaccccttctccatctataaattgtaccgcattgatcaataaagaaatctgctcattcattccctctacattcttgtgttcaattctctctctcgctcaatcaattctattcacaatacgttatcagcactttcgctctcgcgaaggagttcgcgaagtttaagaaggaagaacatcactttttgatctacaggaaaagcgaatagaaaaacaacggaaggtacgatgcctacctttcattggatcatggatgcccgttctcggcctccctcgccatcagcgcgcacgccagcttcgctatcttcttcgtcgatcgatgaggaggacgcgttggggatcccgcggaggcagggctagggttgtggccgccgccactaccctcgccgccgtgtgactgcaactccagttgtggttcccccgcctgtccttgtcgcacctcctcctccgcctccggttgccgaagcacctcgccggatccttgtgcagggggtacagtactgtgcccaccatggatggacggcggtggtgacactgcctggcaagccgtgtgatctctcactggagatggagtcgctgccggccccgttcgtcgccgctccatcaccaccaaccgctccttcctcacctctatcaacgtcgcagccgacgccaagctttcgacgctcccccactcccgtgccaccaggatttggtcgtaccggaaccatggcggcgcgcacgggggagccgcctctctttacaccgtctccaactcgtggccacgtcggagccgccgctgcacgccgtcccggcctccgccatacattcattgccgttccccatggctccccgagccgcatggtacccaatggcatggggggggaacggtgttagggtctggccggtctccaac

SEQ ID NO: 2833 - DNA, 1501 bp, Oryza sativa
ccacatgcgttttgactttgttctgatcgaaatgaaaagattgacctgcttaacacactccgttcacgtcgagtagccatagtagcttagaaccgaatgtaggcacacatcgtaaagttgtaaatgcaaccatagtagacggtgatgataattaatttcaacaatgtactaggatttatccttacagaggcattatgtttaaacttgcatgacatttttattcagatttgtatcaccccgatgtttcaacttgtcacacacgatgatgcatgactttatttttctctcctatactactatactgctacaattcagtaccagataccaccgacggtgggaatgctatagggagcagtgttgtagcttgggtagatattatgacctttaagaacaacaactatattttgtgactttaggtgaaaacaaatgaaaccgatatgcatgggatttaacgtggactattaagcatatatgaatttcattgaggcagtaatgcttaatgtttttaacttataaattgatatttccgtgaccaggccttcaaatatgaaaattttaacttcatgttacgcagagcgtattgtttcggtgacaaggtaagattgaattaacaatgatatgacaaattgtcccatcgatacttacattttgaatagtggatttataaccgctataggttgggcatgttttatatggtgtaggattacgttgtagggtatatactatttgccacatgcgttttgactttgttctaatcgaaatgaaaagattgaccttcttaacacactccgttcacgttgagtagtgtcacgtcctgataaattcatcccgaaataaaaatcattctctaaaaggaataatagaattaattaaaatttgaaaaaaaattggcaaacattaaaatgcgtacaagaaaatttcgaatgtagcccgaagaattttcgttaaattctccttggtctaaaaggagccctcaaattttacttgaattttcagaatactggaaataattattaaacaacaacagccattatcaaagtttactaaaaagaaaaactaaaaataatccctccttcctcctttgggccgagcctagcccaaagtctccctctcctccctctctttccctcctctcccgggcctctcctcctcctcccgacccactccttccaatcctccctcccctcccggtctgcccggcgcaggccgccctgccccctcctacctgggccgtgtcccagcccagccgagcctccccaggccgcgccgcacgcgcctgtcacgcgcgcgcccacgtgcgttgaccgcgccttgcaggtgggtcccacctgtcggacccgtctcccacctccagccgtcggtctcctctcatctctcccgttcaaatctatccctcatcctcctccaaatccgctcgaatcaagggctttaactccaaattgattgggggcttttattccctaatcaatcctctttggtttcccccattttcccccttgaa

SEQ ID NO: 2834 - DNA, 713 bp, Oryza sativa
gatcaagaacgagtactccacctccttctcctcacccctgggattcacgcaaccaccaaccaaccaaccaaccaccaactcccccaaatcccagcaaccgtaaaggtagcaaaaaaataaaaagcgagacaagcaaaaaaaaaaaagaaaaaggggggagagaagagatcacctttcctcctcttccccctcgcgctttccctctgctctcctcacgagctcgctcttcccaacccgcgcgggatttgttcgctgcggctgtgggagtccggggagatcggggggaagagcgggtaaaagaggcgaggagcggaggagcggagggagtggagaccggagagagagagagggtgggagaaaagaaaaaattagaaagcgacgggtgcggctcctcgggaagctcgcctggcctctccttggcgcggccccggccaatggtgagccgacgcgtggcgatgcgcggtcaaaccggggagtccgcgcgaggagaagaggggggtgcgtgggatgggcgcagtggaccggtggggagggagggggcacgtggcaaggcgccattggaccggccgggctctggctggctgccccggcggctttgacctggaggggtgggggtggctgcggcctacggaccggggagggaaccgtgcgccgatcgcgtcacgtggtatgcgcggctaaacaagtgcaccgaccgtgtaccagcatactag

SEQ ID NO: 2835 - DNA, 800 bp, Oryza sativa
tgattaataacactgtgtaactctaggatcgtctttatataatggctttgggcaactaagtgacttttaaatgctgttttctacaaaacttaacccctatattattaccccttgtaccctcttgcattaatcatgcatctgccggtgtgacttgctgagtactgtggttgtactcattcttgctcaatcttcccccccccttcagtaagagaagctttggagaagaagtcttaggtggagtcctggcttataccccagttgagcgcctgtgaagatggagccgtaggcccactagtccgctgctggttattttttaattgtcaggccttaagtgcctttgtaataatgtaaatattatcgatataataaagatgtgtcttttatatcatgtttgtgtggtgtaccccggcttttcctgggacggggattaatacactagcgttcgggaaaatgtatttttctcggtcgcgacagtcacactgagatataaagtgagtgacgagtcataacattatctatcttgctaaccatcaagtatctgtgatgggcaataaacttactttgacgatggtatgcagggacatctgtggaggcacatcacgtaacatccaaacgacatgactcactctgatcctaatagaatatccaaccaaaacaaacactctaaagcaaccgataaggaattcaaagaaaacccatccatcgcatctataaatagacaagcacaatgtaaacccccttcatccttctcacaactcaaacattacagcgaaagcataacaactagaatcccaccacaa

SEQ ID NO: 2836 - DNA, 1501 bp, Oryza sativa
ggagcagtggcggcaacaccaccgttgccggcggggacgcacctctaggggtttccgcgtgaaacggaggcgacgccggtggaggggaggcagctgcgacgccgagggaggagacggcgcggccgaccagcacgcgggcgaggcggtaggggcggctggagatggccggcggcacgggagagtgaggaggacggcggggagaggtggtgaagccacgggagagcgcgggagggggtaaaaattagagaacggatctagggggttccattttataggataggggagggagccgggcacgagagaggtgggaacggcggcggaatttgtggccggcggccggggaagacgcgtccgttcccgacgattgagggcgccattcaagggggaaaatgggggaaaccaaagaggattgattagggaataaaagcccccaatcaatttggagttaaagcccttgattcgagcggatttggaggaggatgagggatagatttgaacgggagagatgagaggagaccgacggctggaggtgggagacgggtccgacaggtgggacccacctgcaaggcgcggtcaacgcacgtgggcgcgcgcgtgacaggcgcgtgcggcgcggcctggggaggctcggctgggctgggacacggcccaggtaggagggggcagggcggcctgcgccgggcagaccgggaggggagggaggattggaaggagtgggtcgggaggaggaggagaggcccgggagaggagggaaagagagggaggagagggagactttgggctaggctcggcccaaaggaggaaggagggattatttttagtttttctttttagtaaactttgataatggctgttgttgtttaataattatttccagtattctgaaaattcaagtaaaatttgagggctccttttagaccaaggagaatttaacgaaaattcttcgggctacattcgaaattttcttgtacgcattttaatgtttgccaattttttttcaaattttaattaattctattattccttttagagaatgatttttatttcgggatgaatttatcaggacgtgacactactcaacgtgaacggagtgtgttaagaaggtcaatcttttcatttcgattagaacaaagtcaaaacgcatgtggcaaatagtatataccctacaacgtaatcctacaccatataaaacatgcccaacctatagcggttataaatccactattcaaaatgtaagtatcgatgggacaatttgtcatatcattgttaattcaatcttaccttgtcaccgaaacaatacgctctgcgtaacatgaagttaaaattttcatatttgaaggcctggtcacggaaatatcaatttataagttaaaaacattaagcattactgcctcaatgaaattcatatatgcttaatagtccacgttaaatcccatgcatatcggtttcatttgttttcacctaaagtcacaaaatatagttgttgttcttaaaggtcata

SEQ ID NO: 2837 - DNA, 507 bp, Oryza sativa
tcctgcagccctagcctatatggattaaaattctagacttgacagttgacgttagtacccgtatttatgactaattattctttcagtattaggcgaggtacctgtcaataacaatatgcccgtcatgtctgtgggtttataatgtgtttttttaaaaaaattaacagtggtttttatactactagtatgctggtacacggtcggtgcacttgtttagccgcgcataccacgtgacgcgatcggcgcacggttccctccccggtccgtaggccgcagccacccccacccctccaggtcaaagccgccggggcagccagccagagcccggccggtccaatggcgccttgccacgtgccccctccctccccaccggtccactgcgcccatcccacgcacccccctcttctcctcgcgcggactccccggtttgaccgcgcatcgccacgcgtcggctcaccattggccggggccgcgccaaggagaggccaggcgagcttcccgaggagc

SEQ ID NO: 2838 - DNA, 1501 bp, Oryza sativa
tctacaatgtccaaaagtagcaagtcatattggtgctttgcatggcaatcgagaattatgaaaaatcatgaaaaattagtgatatggattatatcatcatatgaacaagctcaaaatgtggggtccattttattcagcagttaggacagtatgggaataacctaaagtattcggagtatagggcttgtaattttttctctttaattcctattaaaaacaaatggtacatgggtgtttcatactcagtttggtaaattagggaacataaatcatacgaagcttatatatcagaatcaatgcaatgaaaatatacgatgtaaaaaaaagaattaaccaaacaaaattatactttagtccgcggtgactgaccaattacaaatgctccacacatacttatttcagataaattgtttttttcaaaaagaagatgggatgtgaaagaaagaagggcgtagaagtaaatgtaagtaaatatatcctaaaatctacaaataatctgtactataaaagaaattttgtaaccgaaagttctataaaataagatatgctaaatattcaaaaaagatacacacatagtacaaatgatagtctaatagtaatcaactctattattgcgacacaatattttctcataaatttaagattgcacggttcaagtaatattagtttagaattcatatgttgcaagggtagttcaaagagtatcataaccaatatactgatgtaatgttcaaagcaaccccaaactaattattgacaaaaacaaatttataagagagtcataaaacataaaagaaaaattaacccacacataaaacatccaaaataaaaattcaagcaacatcaaataagatgcctgcgtatatgcgcgggctacctttctagtttatattacaactagcatggtggcccgcacagattgcgcggcaagcatcattatattttctctcatataatagcatatatgttttctcattatattattcaatttttttagaatgacatcaaatttttaaattttgcaataactttacgaaactacaaatgtgtaatattcatattgtattttatatacgtgttagttattaattatttttaatatcaaattttagttatttgtaaattatatatattcctatatggactctagactcgtcttttcatattttttttaattccgaattttctgtaaattgtatttctatatagactctaggctcttcttccaatattatttatttttatttctgaatttttattatttctaattgtatttctatgtagactctaaattcatctctcaatattctttaatttttaatttcgaatttcagttacttctaaattgtattcctatattgactttaaactcttcttcccatgtttttcttaattttgaattttagttatttgtaaattgtatttttatacggacttaaaactctacttttaattttgttatgtttattctgaattttagttagttttaaattcctatata

SEQ ID NO: 2839 - DNA, 305 bp, Oryza sativa
atgattatcacaagtaatatataaatactagttgagttctctctacatgatcttcccacgggataaaataaatacgatacccttggaatactctcaggtgaaatgctacaatggtatatccgtgcgcttgcggatgaactctgtaaccataatataccataagtgtttctgcgccattgctgggaattatatttctagtaatgtcgttaagaaataccaacagcggtgcacaatgctgagactaagaattcggaagaccatagacacattgtttcggaaccattgtagattgccatcaactactc

SEQ ID NO: 2840 - DNA, 1501 bp, Oryza sativa
ccgaggcacacaataacaaattgataatagagtacaattattactctaattaataagcgaataaaatgtcattccagaggtagatagttcctctcaatcaataaagatctaagcagcggaaagaagataaacggcgcagacggctccactccacaggcagcttgaccagggctacacctaatcctccacaccatcagcatcattgtagaactcttcctctgatgaatgattgcaaggtgagtatatgacatactcaacaagtcacgcagcaaatatgcaagtgcacaggataccaaaggatggcatagtagggtttcatttgcataaacaacatttaataaacatttcagaatttaataaaacggttaagtaataattaaacactattaatccaacgctatacaacataccctgttgtataggcccaaccattctgaacaaccatacccggctgtacagatctatctccaaaccaggaatataccattccaaaccaggagctaaacaaattattaccatttatagcatctgttatcatgatgagaggtgtgagactaatcacgaaagacattgttagacccgcccataaccgcgggcacggctattcgaatagttttactctggccagaggtgtaccactgtacccacaagacagccccacaacatgtcaccatgtgcctcaataccaccacggtacctcggaaaggagctgtgacaatacccctcgcacaacacaatccaccacagggcacctttcctggatcataatcaccccgttataaacaaggcatggactccccagcgacccccgtgggcttatctccgccacttctcagtctggtgctccgcaatgaaccatgctatacaaaaggtaaagccgttgcccacgctggcttgtggttggcacggttaatgtttcacaaccgaaactcgtgaaccggtccttaattgtcatgagcatgtctctcaaaaccatgtgctcacaacccaccattatcaagttttagttggcaagtaattaattaaccaatcacgattggccatcgtgagctatcattaagccatcattaaataatagtgaatcataagttatcccaatagtgtgctaatgtttctaagcatggctaagcaatcatatctaatatctagctgaaccaatatatatatagcccaactagtcaagttataaaaacccaaggtatcaaggaataaagtaatcaagaacaaaaggattataacaaacaataggttaattccacccaatgacattcgaaaataaatgcaatagttgaatagaaacaatagctttaaacgggatcaacatgctcaaagggttgtttgggatctgtgtgacttgccttgctggccctggaactcttcaaaatcttcccctgcgaaaacggactctccggaaacgtcggaatctaaacagaaaagagcaaaatcaccaaaacagcatataaacaagcatgaacagtacatgtggatatttttaacatgt

SEQ ID NO: 2841 - DNA, 1501 bp, Oryza sativa
gaaatcttatttcgacatcaaccctctagtttaaccctaagtccacctaagtccacctggtcagcagacatgtgtcaacaccggccagcacagacacaaaggtggaggtgcatggaagagctcatggaccaaacccgaggactcagtggtggcactgctactggagctgtgtctacaggacgggctgctcttcccgctgctcgaatcgtcaccgccgacatcatgtgtaaggccatagcgccatcgtcgccgcagatgtcggcatgtccgctgtcctctcgcttccctcctactttgggcgatgccaggaatgtgttcctcgacagcaaggaaagtattttgactcgttaaccatactgtattcaccaccagatctctttggccatccttctctctccgatgggctaagatcttgtcacccgtgtcctgtttgtccacatcatattctgcaatgccagtgacctccctggtgtgtgccaccctgttggacgcatcacgccaccggatcaccggcgctcgacctcttgaatgcgcgggtatatgtcgtatgcttagtttgagatatttataagagcaaaatattaaccggagaacatctgccatgatttcggcattaattacttttataatttttttaacctgttagttatatattctatcatatttaagtaatatctataaataattatttataatcttcttcatcatttgaaaagaaggtagagttattttatttagaaaacatgtcaacgaaagtaaaaaataagtgtaaaataaaagtaagattttttttctttttaattgcataatattatcatggtttattagaagatgatttgggacatcaagctccactaaattttatatagcctaatatgattgacatatacttgtgatataatacttattttcacttttttataatattgtgttctttttgctatttggttaccacgcacaggataggtgtctatgttcaaatggctcttttttaacttaaaatttataattgtggagattatggatatcccatatctacacggcgatgatatttggactgaatataggataccgaatatagatagaatatcttatgtgtatcctgggtttgtttcctaacttgtatatcaaggaaacaccttgaaacttagtcggtcacgactgtatttaatctgtatctgtgtattccgttagggatataggttatcttttgtaacccggactccttcccatatataaggggggtctgggcgcctctaggggcagaggttgatcttctccaaatcatacaatcaataatacactcggcggattcatccccggacaggagtagggtattacttcttttataagaaggcctgaacctgtataaatcctttgtctccaaacccatacactttcctagcttgatagccacccccttttattattgccgaaatctagtttcgacagttggcgcgccaggtaggggttgcgtcaagcttttctccgatcagtgcaa

SEQ ID NO: 2842 - DNA, 310 bp, Oryza sativa
aagtgagtgaggagtcataacattatctatcttgccaaccatcaagtatctgtgatgggcaataaagttactttgacgatggtatacaaggacatctgtggaggcacatcacgtaacttccaaatgacatgactcactctgatcccaatagaatatccacaaaaacaaacactctagagcaaccgataaggaattcaaagaaaacccatccatcgcatctataaatagacaagcacaatgtaaacccacttcatcattctcacaactcaaacattacagcaaaagcataagaactagaaacccaccacaa

SEQ ID NO: 2843 - DNA, 1501 bp, Oryza sativa
taaatgattaaggttccgaattgaaatttcagacagtatggtacagttcaataacgaacgattacggccagcatttcagtttcagtttcagtcaataatcagcctagattcacactagaattttgtcaggagttttactgatagaatggtattgagaaatgcaactgcagttgttcaaaaataacaaaaagaaaatccatacctttgcagctcttcaggattctgcagaagtgaacctctgtagcggttatcattccacttgaacgatttcctcatgatcatccttatcctttatcatgtcgcgttcccaccttctgctgatctcaagcgcagggcgtccagggtgaatgctggctgcatccctcatagcagcttccgcagcctccaccctctgcctcgtggctcctcggcaatcgaccgtgacactaagttgctggaggcttgcgaggtgctcgaatccgaactcaaaaccgatcttggaccctgtttcctctgctctaatgtagaaacgcagccgtcggagatccggcattgctcacagcatctcaagcccgccaccgtgataatagcttccaaattcaaaccccttcaggcaccggatttgttgactgctgatgataagcctctcctcgggggcatgctgtgaattcaacttgatcaagagttcctcctgtttaatgctacaaacccatagcgaaagatgagtgagattagcaagacacgccatctgctctgggatatgactaatacgcactctgtatatgaccatcttccggagtgtcggaatagtgtgttgagttgtgatccaaattcatttgcacttaataaaggccaacttctgccgtgcacctgggtacgcccgggggtgcgggggcggagcccccgtgaaacggatcgtcattccttctagggttccaccatatatatacctcttgtaagccgccgtgcggcgttgtaacctcaccccagatatagtgaagatattttgctggctagtgcccgtggttttttctcttctgttttgggagggttttccacgctaaaatctcgtgtcttctgtgattgatctattgttttttatcgtttgtttgcctatcgtttcctaacacagtgcagcacaatatgtccatcagttttcctatcaggaatccattgcagccaatgtgtagtgactgaagcgcatgctcacccatcatagcgagagatgacttcaaagattcttcgtaattttcggtgttgtgatcaccaagtttgttgctgtcatgcagcattatgcgaagcacacttagcctggtcaaccgcctcaactcttgcacaaattttatggagtcatattttccagcatccgatagctcctgtaaggcttgtagatccccaatctcatttggcaattctacatcattgccaacaagtagacgcgctaaattttgcaaacgacctatggtcggtggcaattttttaattccactatggcgtatatctagtgtctgcaaatacttca

SEQ ID NO: 2844 - DNA, 641 bp, Oryza sativa
cctgcagcccctgtccttataccctactgccactggtcacatcatgcacgcacgtgactaagtcgtcgggaaccccagcatgttataggtggttggggtggggctaaaaatgggcatgtaatgagcttgaatcacttgtgtaccacactcgacggggtgtgtagcatttgatctttgttcatttcatgtgggtccagttgtacacctctaatcagagtataatctatttgaatagccgcgtcctcggttatggacaatgcttgatgtgttagtcagttatgttagcaccaaatatggattattatggatgggattctatttgatggtggtgttgccatgttgtgccatgttggtatggactttggtagtccatggttgataatgagagcgccgtttgggctcatttgcttatacatctcagaattatatacttgctgtccataaataaaaatgatgctagatttacttgtccttacttattttactcattaattgctcaataaaattagctttatgcaaatgttgaacctagagacccactgttggctagaaagcttgcatacttctctctcccttatgtatatttaattttgggtaagacttgcgagtacaatcttgtacttaacccggcgccgctgttt

SEQ ID NO: 2845 - DNA, 1501 bp, Oryza sativa
attttagccgtaacaaaaaaaaacaaaaaatctgacagttttaaggttgtaattttgtcagaattttatcttttttgttattctctatgtagaatgaatttgaagatgcgactttgcacgtagatgtaatactattgaaagtacatgtatgaattttcctaaaattttttgtgaaaatttttagttggtgtacacggtgtgtacacgcgagggcctgtgtgcataggatacgctccctatatatatatatatatatatatatatatatatatatatatatatatatatatatatatatatatatatataaacgtatatgaaattaatagccatcgtagtaaggattaatagccatcgcattaatgacctttaggcactgctgctaataatcctagtacaagaaaatgccatgtcatggatcatccaagaaactagagtaatgatgcctagagtagaaacaaggcaaaagatggcacagatattccagcaactatgctgtcctctcacaatccagaaataaaatgagagcaacaaatgtcagtacaattccaggcaccaagaacagctggaattcgcatatctcaattaaggagtttacacaattgagttcacaattcataattatttcacggctaacacattaggagctgtttaaaaacaacaatttcatcacaactcagattcacatatctcaattactcgacatcactatactcaccatcatcattagggatcataattgtacattcattttcactatcatactgccctaaggtatcatcatcgtcatcatcattgtacaggtcatcttcttcaacttccagatcccgttgcctgcgaatctgatcaactagggactttggtacacttataccatcttcgttgactggttgtttgtcgaccagagatccttccatggtttcaactcgagatatttcctgctcatcatcttggtatgtcagatcaacccctccctcttgcctgtcatcattttcctcctcattcacattccacaagtgccgatgcgaaaatttttgaacaactttccagggttcaccatgcttgttatcatccaagtagaaaacctttgttgcctgtgtggcaagaatgaaagcatcatccttgtaccaacaacttccatggctgatgcttttgaaatatccatcattcttcatcctaaactttttgctacaggtatcaaaccaatcacacttgaataacaccactgtcctttgactgtcagcgtcagagttgtactgcaactgtattacttcttttagctgaccataaagtctatatcttctccattatgtgtgccctcaaccataactccactgttttgtgttcttctactgctctcacgttccacggtgtgatatcggacaccatcaacaatacatcctgaaaatatacgaactctaagaagtggtagacttgccaatgcatatagtcttcatcgatttgttctccattcacaaacctccgagtagcaagctgcagt

SEQ ID NO: 2846 - DNA, 514 bp, Oryza sativa
atattgcttcttttcgatagattcggagattctggagagtaacgagccatatccagaggatgatagtgactaccctcagcagcaaggcaagcacctaagcatatagaacctatactttctctaaaaatgatttggttgcaatctatacgtatatatatgcatgcattgcctagatattaatattatcggtttatggtgtatgggtagaacctatttatgcatttagttcttgtgatattgctgtccttataccctactgccactggtcacatcatgcacgcacgtgactaagtcgtcgggaaccccagcatgttataggtggttggggtggggctaagaatgggcatgtaatgagcttgaatcacttgtgtaccacactcgacggggtgtgtagcatttgatctttgttcatttcatgtgggtccagttgtacacctctaatcagagtataatctatttgaatagccgcgtcctcggttatggacaatgcttgatgtgttagtcagttatgtta

SEQ ID NO: 2847 - DNA, 1401 bp, Oryza sativa
tggagcaatgtaattattccaaaattttccctcaaaatctcagttttctctcctcttcctctctctcccttctggacttttcaacaagtacctagcatgcgagaccgaggtcgtcgcttccaagccgacaacgccaccctgcccgcaaatcccgctgcaaggctgcacaaagccgaggccgcctctgcccgatgccctacctcgatgccgcgcctggcaaagtcggcctcgtcgcgagcctcgccaacccggagtcgccgccccctgccactacaagaaatttggccttctatgacaaaattcatatgacaaaacacattttagtcacagtagtgatgcctttatgacaatttttctttggatgacaagcgtttgtgactaagttgtaatttagtcataagaaaatgtcaccatgtgcctttcccattctttgtgacaatagttcatgacaaaagtgaataaatatgattgtcataatttaaaaatcatttgttttttaaaaaagaacaccttggcacagccacgtgagcatgtctaggtggacatgtgggacccatgtgtaagttagaatattaacttgaaaagactaaaaatgtagcgcttcttgcaatgaggagggatcgaacacacgacctctggcatcccaggtaacagacaaaccactgagctaatctttgattcttttcatcttgtagactattgctgggagacataagaatcccaacgcacatctagcaaagaccaacgccgctgccctttccccatcgcggctgctggacccgacgccgccgccactgccctttccccatcgcgcctgctggacccgacgccgccgccctttcccattgctcccgctggagcccaacgccgcaggctgtagccccaccctgtccccaacgtagcgcccggctgttggagctcgacgccgtcgcccttcgcccaacgcggcttctggagcccggcaccgccggctggatcccaagccccaccccatccccaggagctcgatgccagcttgctgcagctccaggacgccgggcttcatgggcacaactgctgggaacgcccccaagagcccgacgccgacgacagtagcccgcccccgcctctaggatctcgacggctgggccggctggctgcagatcctggccgctgggcttcacgggctcaaccgctaggaagcccccaagagctctagcctgggatcactgccgacggcgggtgaggtcgaccagagactgccccatccccttcaattaggaaggaaaggtacatatgagaagaacttatgttttggttttaaattttgaactgaaaccatagatttgaagtgatagaaataggaaaatagcagtctgggcaatgatcagtcattgattcaatgcttgtcttatttcaata

SEQ ID NO: 2848 - DNA, 1501 bp, Oryza sativa
tgcaaaaagcaaaacaattgattgtttctcatgaatctctaagcaagattcagccttttcaggttttctgcttgcagaaggtgatgttacattttaaagcttgtgcaatacttagtggttagggttttttaccgtgctatgctggcatcgcttgtgatttcagaatttcaggcaacactttcccgtaaataaaaagaacaaaacgtgtggttcatgtgaagttttaaaacccatttcatgttttatttgtaatatatgctacaagcttacgtagattttcaagttggctatgatgcgctgttgtcagtttggtgatgtacataagcccaaaactggttgtgacgaaactaaactgctcttcgatttagtatgtgaaattgtaaactgctcttcacttcactcacatactctaagcttgagctgaattataagagactctattgtactatattgtatacttagaataggaagagaataaagtagaagaagttggaggacttccggagttgtcggtaatcctgtccctttactttctgctctgcttattactctggctataatagaaatatcttttgagtaatatagttttgttcggtgagaattatttcttgttatttcctaattagagtacgggatcatcattcattatactcaattaaaatatagtgatttgctttagtgtgtagctagcgttaaagtaagtaattaatctgcttagacgcagagtgttttctccgcatcccacagtaggtgtgaggtgtgtgtagaggtgatgatagccctcaagatcactaaagtcctccctgtccggatgcgcagtagagcgatatctgggagcagcgagctggctagtgcccgaagtaccgcattatgattaaagctaacatttcaagatcactgaagtcctccctgtccgggtgcgcagtagagcgatatctgggagcagcgagctggccagtgcccgaagtaccgcattatgattaaagctaacatttccttggacattgttcttcattggagaaacctctctatcctttgcctatttatagcttcgtgtccttggttgaacctgaaccggagatagcacacatgttccctgtggaaatcgatacatgagaatactcccgggtgaagtgctacatcggtatattccgtgcgtttgcggatttatctgtgatcgtaagaaataacaacaacgtcaacgtggaggggggggggtagagttctctcgaagtaattcccgacgggtggaggtatgtcctcgctggagcaagcatagcatcttctccatacatgaactccggagtatggtatccctggcaaaacctaggcaagatactcctttctaaagttgctacccttgtgcggacgcgttgcagctcagcaaaggtggagcgataaagcatatctagcgcacgaacaaagcctgctagctggaggtgtggggtgtgcagacctatgcctatctcattcagccctgggtaggtagtgtgttcagccc

SEQ ID NO: 2849 - DNA, 1501 bp, Oryza sativa
ataatgggaaatggagagtaggattgggattggaaaatgaatgaagggttatgattaaatggaagaggaagaatgaatggttaggatttaaagataccttttgatgggtgagaaatcatttcccaatcccgttatcgaaacaatgcctaaattttttcccctcattcccagtggctcgccgccactactcttcctctctctctattctccctgatgccggtcctagtgtcggcgcctccgatgaacggggaaccacgttgctgccctgcgccatccacaggccctgtcaatctgccatccgtcgctgctcatctccggtcgacgacgagcctccgccgaccctcccccttccggtgaccggtcctagccaccatggactcaggtgctccagatccggacaccctgaactcggaggtcgcggatccaaccatcccgagtttgggtactccaaatcccacgaccctagcttcaccagctccagatccggcctcgaggtaagcggtccgccgtccctcacaccaccccgcgtcgtcgaggtcgacctgccatggggagagcaggcgccagctattccccttccacccgatcctcggtagtcactgcctcatctcttttaatcaggttagtggtcagtaaaagccgcccttgcctttccttgtgtccagatctgagttggtgcatcactaagatctgttgctattttccttgttagacctcttagcataagaagttttttttggtgtgtttttggatactctacaaatcccccaatttctatgctagctgaacaaattagacctagttctttctacgaatcgtgagcttcctgccagttgatgtctttccatctctttaggagagtatttaactactgaaatgcatagtgcatagggaggacactatgaaggatgggtgaaagaccaaggaatattaatgtgaggtaaatttatttttggcttctcactcagaatacccccattttattttgctgttttgaagcagcttatgttgagatctacatgcaaaactaggaaacggtgatttgtttgacatggaattaacctatcagtggcttagaaaattatgatactagctttatgataattttaaaggataatatatctggatattattctttttttatagaattggatatagaatttactccttatcatagactatgcttttattggtcacatttagttagaatttagatgttggttaatatcttccctagaaaaataaatctagttagaatgcagatgcagatgcttttcttatgctatttttgccttgtcattcatggtaatgattgtgtgaatgatgaacactatagtgttttgctttctctgtttcaggaacaaacaaaacatttatttagctctgtttgtatgtatgaatacattagtgctttccagtctcttgtactctggtagtgcatatacatacttcacacgtctaaatccatgtatatcttttggcaagacatactgatacatgt

SEQ ID NO: 2850 - DNA, 1501 bp, Oryza sativa
gtactgtttagttagtttttcattcatactgccaaagtgccaagctggcctatgcgagtcggtacgctttaccccaaacagtttttcttttctggccatcatgctgtcaatgttttacctacaatacctgattggttgctatacatgaagtatcacataaacatgacgagctaagagttgaaaattggacgtaactacacagctagtgatagccagctaccactccatctataagagatactatctacctatatttcaaatgcaattttctcttaaactactcacccgatctacgatccgattacaccgttgtgttcgtaacaattaaatctttacaataagatctcacatgattatattttgatgaaaaatcataaattacttttatgatatgtctaaattacttttagatttcactaagttacttcttagatatataaaagtaaattcagtaaagcctaaaagtactttacatatattatagaagtaacttagagcaaaacaaaggtaactttggcatgtcatttgaagtaaatccgttgtacagataaaaacatgactctatctagaaattaaattaatcagcacaaattatagaattaactaaaaacaataataaaagtaatcacctcagagcattatgaatgtataggaagtattttaatcaaatctaaaagtaagttatatatatgataattatatatatgatagtttgttcaatgaaaaaaaggcattaattaaagttactttccttttgttataagttacttctataatatatgtaaattacttttataatatatgtaaattacttttaggctttacttaatttacttttatatgtctaagaagtaacttagtgaaatctaaaagtaatttagacatatcataaaagtaatttgtgattttttattaaaatataatcatgtgagttcttgttgtaaatatttaattattatgaacacaacagtgtaatcggattgtaaatcggatgagtaatttaagagaaaattttatttgaagcatagatgataggaatatttcccctacttacttaatggattagtaatatagtaaagtaagattcttcaagttaacacatatctggataggggtcgctcgttatgactaaatcgagagtgctctcgatttagattttgcgttgaaaattaccatctcaaaagcaattaaaaaaattgcacagctacgaaaaggaaaaaaaaagaaaagaaaaaagaagcaaactttcgtgcttctagaatctattgcctagacaaaggttgggtgattatgtgactgcaacaaaattgcgaaaacgcttagtatcgtacgtccgataacaacgaaactccggacgcgtagggacccacatcagaaacccatcccttctccaaccttatcctattcttcctcatccaaaaccaaaaccatttcccccatttctctcccctaccatggacttctccggcggcggaggtggaggcggccagcggcagcggcg

SEQ ID NO: 2851 - DNA, 1501 bp, Oryza sativa
cgacagagtgatgtcgaggtacgaccatctgaagtcgtggtgcgaggaccgctacgctattgccgtagtcgtacctcgaccatctgaagtcgtggcgcgagagatcgctacttactactgattcgagaaccaggagtaggagtctctcgaccgattgaagttgaggtgcgacagatcgctacgattgactggttgagaaccagcgagtaggcgtctctcaatcacctataggggcgctaaagttgatttattacatgtgcatctcatgtggccagcatgactcacatacccaacttatagcatgtccggatatccatgtgcaattatgtcgggtgatcaagccgacaacgttcgcgaggaattatccgttaacaaccttttctcaaatagcccagctatggccagtgctatgagataggtcgtcggtcttcgttggtaggttgggtgcgacaactccacatttatcgataacgttctcgataatgtgtgtgtttgaccacaacctactcgagtgctcaattgttcctgaaattttttttctagaaggcaagacatatagcaggtcatattgagtatgtactcagaaaactgcatgaatcttctattattatcatgacataacgagcagatttaatatcaggcattatgtaaaccgtaaacaagtatgatttatacggaagaaaatagagcgagccctcagcattaaaccgtagatggcctaacatcggaagcactcgcataattgatattgtataaaaaacatgctctaggtaaacataaaaaattatagatctgacaatgatgtacgatatgtataggtacgataaattgcatataaaatattacgtacctttgtagatacatgccggatgtatctatgaaattagtagattaattttaaaaaccaatcctccaattaccttactgcgtactcgttcgacatcatacgatctgacgtcttttggtacgccgcgtatcttgaggcttggatgatctcgatagaccaaattgttgacgatgatggttccgatcttgtcggggcacgtactctggttgggtttgacttaccagatccaaaatagttgaagtatcccttgtcaaaaaatccatagtgacgacgacttggcgaagcttgacaaagatcccgatccaccggagaacgtacttcgttcaggtcatatcactcaacatacgaagtcgttgagtagtttgctgttgaagaatccatctcttgaactcatctcgtcaaaatcctgaagcaccaaaatccctctacctggcgcgctactgtcgacgtttgatgtcacgactacggttttgcgtagtatggggatagttggcaccaaggtatatgcgagactgaggtaaaagagatggggacgaggattcttatacaggttcgagctcttaaattgtcaggtaataaccctactcctgttggccgaagccggtcattgctcttattcattataatcacaccagtacaatatttggggtagcc

SEQ ID NO: 2852 - DNA, 1501 bp, Oryza sativa
ccccatttcgcagagctcccccgtgccctcctccgccctagcgccatcgccctcctctccgtcgccgccgccaccgctccggtcgccgctagccgccgcgccgagcctcgccatcgccgccgtcgggttcacgagcccaagggccacgctgtccgctcctccgccgccgatttctgccgccggagccccgttcgcaccgcacgccggtgagcttcgccatggccgccaccttcagctggcgtccccgccctctatgatctctctctctccctctctaatctttcccattgtgttccttaggtgatcccgaatctcgaccgctcgtcgccatcatcccgccgctcactgtcattgatcatcgccggtgaggaactcctccccttcctctctctctctcccacgccgcttagccgccgcctagccgctcagccgcccgcgccgctaccactgcgccgccgctgcgtcgagccgcgccaccgcgcgccatggccgccgggccggcttgagctgggcccgtgcgtgccggccgcgtgccgccccctccgccgtccgatccaccccgagtggattggggccatccatccggccgcccgcgtggtcgccacgtgtgcgccacgtggtggatccctcctccccggtcccgtggactcagtccaccgtggactggcgcccttgagcctatgacatgtggggctcgcatgttggcgccgcccccctctctccagggtttaattgttgcacaataaatcaattaaggatttttctgtttatagtaaaaacatagtgaatcttctaaaattcatagaaaattcatccgtgctccgtttaagcccattcaagtctcagtaaatcaagaaaaatacaaagaatccattaaaaatggttttattctctgtttcagtagtcttatagcctgtttgtattgtttgctttgtatatcgcatagattccggctctcccgacgctccagtgtactttgacatagtcgctgagtttcctccagccgcagggcaaggcaagtcatgcttgtcacttgaacatgttgatcccatattgcaaatgctctattgttttcctttaaatacaacattgttttacaatgatatcatgggatgattaccttctgtctcagccatactatttgttaccttgttcctttgttagcttggggatataacatgattagatgttgggttagggattgcttagccatgcttagttcaactagcacacaatgggggaactacattaatgcatagttttcagattctagtattggtgttggactagaaccattgctctggtgttggttaactaaaatatactaaatggtggactgtgggtgcatggttttgatggtcgctcccatggcaattaaggaccggttcgcgggatgccctggaagaacttaccgtacttactacatgccagtgtgggcaacggttgggcttgtagtgtagctttcctctagctgacgcatccaggcaagggtgagcgtgat

SEQ ID NO: 2853 - DNA, 355 bp, Oryza sativa
catagccgcaccgccgagtcgagccacgccggcaccgccccccgtctgcaacggagaggagaaagagagaaggagagattagaataggatccaagggtatttttggtcatctccacaaaaaaaaattacaaaaatcattaaagtgagaaggaatggatgaaatggcattgcaacatgttgccttgtttgaggatggcattttaacgaaaccacttttggaagtggcattccagcgaaaccccgttttgacaatggcaaaatatcaattttctctctctaacagcaggacaccgaagctttacatgtatgccttggtatgtatgtgcacatcgccgttggagccactctggcgcga

SEQ ID NO: 2854 - DNA, 1165 bp, Oryza sativa
cttcttgatagaaggccatccattattaggcaagcagtttgagctgaaaaatggtcctgactacaacaaggttgctgccctttctggatgcatgcgtcatacaaatcagagtaatattactttttattcactgttctgaatttagtattggaatttggaaattgaatatgtcatttatttattctggaatgtcaaatttctcgttgatacatagtacatagatctaattctagtgccatgacccgttccttgtagggaaagtttgggagtactggtcgaaattctgaactggcaaccaagcgaaactgttgtggacaagttctgatctggcaaccaagctaaactactgtgagtataatagttccgagttcgtaagaagtgatactccgtattacacataccgacacacctacacgcaccaattacatgaccattttgaaacgcaagttagcgcttacattttatatatttttgtatgcagatcgcttcttagcgtttacattgactgtttatggggatcggagaatttgaagatcaccagagtggtcagcacttgttaagttgcatgttttcatgaggattatgatgggttgcactggcttgaggagcgatctagttacccagataaatttgggtgtcagggtggcaaatggcatgcgtcccctgcgttgtgctgctgttcctgtgcaaattccaattgcatgctgcaatttgggttttccatgtgccaatgttactgaaatggtgcaccgttcggtttctgattatgcaaatgtgctcatgattcaatcggcaaaatccaatgcccacgttgttctcttcgctctatattgttcctgtttaaaatgtagaaaagctcagttgttgctaaagtggaattactggatttcaattcaatggctataatgattattctaggggtatgcaactaacaaatgttgatatttagaaataatgggtagaaatccgaactctatatccacaaatggatactccctccgtactcgtaaaggaagttgtttaggacaatgtttaagtcaaaccttgggaatataaatcatgaataactcttaagttgttgagtttgaaaatataaaaattatgtgaatatatttgtcttgaaaaaagtatacatatattacctttcaataaatatttttataga

SEQ ID NO: 2855 - DNA, 1501 bp, Oryza sativa
ccaatgtagtggttgcttcgctgggccctgaaaagctgtctacgcagttgattagatcattaaaatacgggtggagagattgattgcagtcgaaacccttaccacggccgagcgacaccacacaagacattgcttccggcgtaagcggaggatcgatgcggccgctcccctcgccgccggccagccggtgaaccggagctcccgttccatgtatccatgtcgggcagcgcagcgctcccggatcccccggcttgcgagttgcgacggaggcgttcgcccgccgccgttggccggggcggcgcagcgccaggcgatgaacccgggcatttaactatttgaaccattgccactgcaaatgtgtatatccagatgataaatgttactccctcccctggttttctttaacgttggaccattttagatataaaaatatttatgtcatgtttaaataatatttgatgatagatcaagtcacaataaaataaattattattatataaatttttttaataagacgaatagtcgtcaacgtcgtcatatattaaaatgttacaattcatctattcgtagttgtggcactaaaattttataaaattagaatgatgccatcgtcgtcatgttttcctcctcttccccattcgtaggtgggaccacctgtcagattcatcttcttcctccatccccgcctcttctcttttttcccatctctctccttcttagcctcctctccaccaatctatcatcttcccacggctcgcaacaacatcaccacccatcggtgggcagcgcgctccggtgcaacagaaatccgaagcgaaattgtgcacgcctcgcgatccttccatgtcgtccccatcgctccgcctcgctgtcgtcgacgcgggagctatgccgggacggtcacgcccccgtggcgttctgagtgcgccccacatgccccaagagaagagggaatgatggagaaagaagatgaatctaacagatgggccccacgtgtagatgaggaagaagatgcaaaatgtgacagcgaaggcatggttccgactttgtaaaatttgagtgatgcggttacgaatagacgaattgtaatgatatttataggaattggcacatttacaatggtacgatcaaattaatccaatttattaaaaaaaattttgtcgggtccgcaaagagaaaccggccaaaatttattaagattaaagagaaatttggttgctgtgaacaacaacacagttgatgaaaagaaaatcttagtatcaaggtgctaagatactatggagcacaatcacaagccaaaaaaacatagaccaaagggcggagcatcactcgcgcattgcattccttccagatcatccatcaaaacagggaaaaggccgcatcaaacgccttcttgcccagcttgtcaagccctgcacgtgcatccagccaccaaggcatggtttagttccccaaattttttcccaaaaccatcgcatcgaatctttggacacatgtatat

SEQ ID NO: 2856 - DNA, 1501 bp, Oryza sativa
gatggaggctggcttggcgcgagaggcgtggccggcagtggaggaggcgacctaggtgtgaggaggagttgccggtggatgtggcgtggtcttcgacgcatgaaagatggccggcgggggatgccggtgtaggggtcccacatgtcggcaaagcttatgtggtggtggagcatcggtgcgtcagccgtagatttgcagccggtgagcggcgggtgaaaacccagtccggccttggctggaccgacaacgatcctcttgagggcgttgtcgtgctgtctcacccctcaagggtgatagccgggcgaaagcccagtcttgattgagtcccgacggacggcggcggcggtttttccgtcgcttctcttcttgcagacatcgttttggcattccttagggggcgatctcgtctgtgtccctttgttggtctagtggcggtcggtcacgcttagcggtggccgctccggtgctagccttctcctgggcttgtgtgttggcgatgtcggtgtgtgggtggtggtattcttttttctttttcctggttacgatcctacagggttgtaatctcgtttttttttcctgctctatcaatataacttcgcaccgtctcgcgcgagccgttaaaaaaaaatttactaagcaagtttggacctttgaggggtcttccaccgagggtatgccaccttctcaaccacctgatgccatcgatcttgcatcttgaggcctgtttagtttgcaaaaagaaaattttggggtgtcacatctgatgtttgactgagggtataccaccttctcaaccacctgatgccattgatcttgcatcttgaggcctgtttagttcgcgaaaagaaaattttaggttgccatatcggatgtttgactgtatgtcggaagaggtttttggacacgaatgaaaaaactaatttcatagcttgcctggaaatcgtgagacgaatcttttgagcctaattaattcgtcattagcacatgtgggttactgtagcacttatagctaatcattggctaattaggctcaaaagattcgtcttgcgattttcatgtaaactgtgcaattagtttttttgtttaatctatatttaatgctatatacatgtgtccaaagattcgatgcgatggttttgggaaaaaatttggggaactaaaccatgccttggtggctggatgcacgtgcagggcttgacaagctgggcaagaaggcgtttgatgcggccttttccctgttttgatggatgatctggaaggaatgcaatgcgcgagtgatgctccgccctttggtctatgtttttttggcttgtgattgtgctccatagtatcttagcaccttgatactaagattttcttttcatcaactgtgttgttgttcacagcaaccaaatttctctttaatcttaataaattttggccggtttctctttgcggacccgacaaaattttttttaataaattggattaatttgatcgtaccattgtaaatgtgccaatt

SEQ ID NO: 2857 - DNA, 1501 bp, Oryza sativa
actcacttggtgaccttggcgatcctctcaccgaccgtgctctggttcttgctactctcaatggtttgaatgaaaagtttgataccttgcgtagcctcgtaaccatgcagcgtcctttcccgtccttcgccgacgttcgctcgcaactcttgttagaagaactcaccaaggccagtcgcccctccgggcagtccaccgtcctcctcgccggcgcttctagaggcaagccgccatcgacgcccaaccctgcccacgtcaccggctacggcgcgggcgcgtccggcggctccggcaacagctccaacaacaagaatcgccgtcgtcgcggcggcggcagtggcaacagcggcggcgggacgaacaccggcggcggcggcggcggcggcaacacaccatgcggccccaagactccagcgcaaggctgtcacgcccagaaatttaccccaaatttccagaccattttgcgtattaaatccctgtccaggaccagccagggtacacaaaacgacaagtaatatacagttccaaacgtaaataaagcgtaaaatacttacagaagaggcacttagtcctcacacagaaacaaaagcagcaacagcggaaaaaggcgatcctagcggggcttcagctccactccacaggcaaaactcaactggggtctgagccttggtcctctaacttcgtcttcagctcagaagcactacacttctgaaaaggggggataatagcaaggctgagtacaaccaccgtacttagcaagccacaccaacgatgcagacgtgcaaggggatacaaggaggggtttgtggctatttgcataaaggcggttgtaaaatattttgttgagcaaaacagtaacactgttgaataattaaggtaaattagatctccactgatcaacgctacaccacgttgaacaggcccaaccaacccacctatactacagtgcattgggtcgatttattaagtgtgagactaatcacggtgaatctggtcaatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagtttacccactcccgcttgtggcaagcgctgtaagtcttccagggtttcccgtgaaccggtccttaattgccatgggtgcgactcacaaaaccatgcacccacagcccaccatttagtcgcattttagttggataattacgaccataaaaca

SEQ ID NO: 2858 - DNA, 1501 bp, Oryza sativa
ccgtaggtatacaaagaagaatattccattaattccgagggtcttacaaaaaaggaaggaaaaactactagagccataccgaaatcttccaaagactcgaggactccgagaactatcctattccattccacttagcactagagcactaactaaacttgagagagagatcaaagcttcttgcttgagtgtgtgttggagtgtgaatgagctcctccttaaataggcaggtatgacggttgtagagtatgcgaaatgtcggaaatggcccgcaacggccatcagcaagcaatcctggacatccacgtgtaaggccaggctgaaccgacattgccagggtttggctgaacccctggttcagccgaacctgagcggcccagcaggcctccaaactttgtacaagggctgacagatgggtactcatgacggttgtgacagttatggcggtttctaggatggtttcacctgcatgtgggcctctctatccttgagcttgcttaagagtgagtttttccttttttttcttctccattaatttatgtgctaatctctgcaaacaaataatactccaagtacaagtggaaaaatattattctaaaataaatatgcattgcaagcatagctacttcttctttattttaagtatattgatggtctaaattagtctataatgaccgtcaacaaccatcttcacgtgctataggttagctgtcagatcctttttccaaatactacttttagatcttttagatctctcttattttctctttttccataaacttatttaagagagaagacgtataaaaatatagctagaaatgtaatatgctaaccatacatcaaaatattttcacaaaaaaatttggtagcacatccattcctcctcctttcactttgtagcaatcgcttgagctggaggagcaagaatacctataaaaaggatatgacctttaatactagttggtgttgaactttagtacaccagccaatacataattaatatcacgggggcctaaaaatgatttttagaactggctaaagattttaaagtgccgttgggtattttaaccagtaataaatatcatttttagcaccgattcgttttacatccgagatatttacgattttggccgatcgagcgaagatcggttctccaatagtgctcattgattccactaattaagaaccgctaactacgttgggtttagagcccagcatatatgatgagaggttgacggttaatttagaacattagcccctagtgtgaacatagccctagagttccgtggtgggcatgctagccaccatcggtcactgtcgtatatgccgtagaagtgacggcgtctcgccaatactgttatcacgccacaacaatcgaatctctcaaaaaatctcggcaaactctcacactagaaatgctgtggctttggctcagcatcgctatttatactagtggctaccagcctactagtacagcacatcgatcctacgggcatggaggaca

SEQ ID NO: 2859 - DNA, 1501 bp, Oryza sativa
  unsure (1)..(1501): unsure at all n locations
gtgattaacaaaattccagagtgacccttactataattccttcaatttggttaggtcaataactccttcaactaataaatttaatactatgtattctcacaaatgtcatgatatctagcaagctaaggtcacatggtacgcatggtaacaatagagagtgacccttgtaatgaaagtattttaaggataaagatacctaaccaaaatgaagcacatgtagtaagtaccacatagataagtttttttaccttaatcagaatccatgtgaattctctatgaaattcatttttatcttagaattacatgcacatggagcctgcataattaggttgtccacctacgcaaatatttctaaatatttatggacaagcaagcccaccaatgcatgcaaccagcggtgcgcatctgcctctataaagtgtttccacggttggttgctaagtcattcgcatacgaaaagatttttaacttatagctgtatttcaaaagaagctgcatgcaaaaatcatttagacataataaatcgaccagagtggttcagtgatttaagtctaggagtagtattctatccgaaataaccagcaccaccatggttacccgctagatccacgagctccaccccggttgtccacttgctctgccaacgccgccattccctgcaagatctccactcatcctacttttcccatacgcctccggcaaaggtgatgcatccgcatctaagtgacaacctcctgcgggatgtcccaccataaccacaaaacatcctggtacattgtccttacactgctatcgacggctatcgtcggagatttaagcttgcttgtgtataatgacagttgcttgctttgttgcttatttgaacactgccgagggtgatttcatctggtggcatttagggtgttaatagatctactcggtctcttgcttctctagttgtatatattggatgcatgggaggtatagggaaattacagagaaatcagccataggaaaaattgcctgcgacaacaagcattagtgcttcatctatttttttcggagcagagccttttcacaatcttttcttatgtccatgttcccaacctcactctctcgtttaccacgcgcacgcttttcaaattgctaaacggtgtgtgttttgcaaaagttttttaaaaagattgctttaaaaaatcatattaattcatttttgaagtttttttaagctaattattaattaatcacgcattcatccattgctccgttttctgtgtcaaatgtgagggttcccaaccctcacctaagaaaccagccttagaagtgtagtggatcggtatgttgatgcaaaacaaagtgcttaattagctatatgcattgattcatattgagcaaatgtttagagaagacagcgtagatagaatttatgctatatatatatctcatgcgagccagatgtatagattggatttgtatgacttaaaactatcattnncnngnggggttttgcatccaaagtgga

SEQ ID NO: 2860 - DNA, 375 bp, Oryza sativa
tcctgcagcccaccgatttaaatacggatctgtatttctaaaaacgaacaaacttaaaaaagacttattcacggatggcgtaccaaagtactggcaaaaacatctttaaaggtacttgtttgacgtgttagaagtggtttttatagaatgaagagaatatgcacaaacaatttcatcacactcattattaacattgccttacaaacatgcaagccatataatattactatactataaaaacattttaattggggatactggtcaggatctgaatactttagttggagcattgggagtttgagactatcgtcaagtgtgtccaactcacctcgacaaaatgaggggaattctgctgggagactgggaggtgagcca

SEQ ID NO: 2861 - DNA, 1501 bp, Oryza sativa
ggatcgattgaatgctcaaaaaaaatattttaatcaacatttgtgatctgaatgtaataaagtttatcacgactcacctttgcagctcggcccggtaatgcaggaagctttacgtcaccattgcttgcagtgacaagtaaataatacacatcatgttcgcttcttttgcaaagctgttatgccgctgccagttaattgctaattgtatatctctgaaattaatttatacagatcgatggtatgtaacagcttttaagcttgtgatttcttcactatatatcatgtactgtttgagttaactaattctaatttactggcaaacaccgtagggaataccactaatttaagtgctctcgagttaaagaagatagcaagcttggatgaggtatgctttgctcaattgtaagcagtagcaagctaaggttcaacagaaccatgagtacaagcagcggaaggatgcatcaatctacaattgccataggtgatgtaatgctctcaaatttttgcaaaagaaaaaaaaaacctgaagcggtgccacccgtaatgacatttgtgcaccaagtatttcactgtagttttactgcaatattcagggtttgcattctagaaattggggttttttccgtggggggagggggcgaaagaaccaaaatcactgaatttatttgaaaaattgacgaattttgaatgatttagaataaactttgaccaaattcacaaaaacatgaaaaaaggagaaatttcgggtgagatatatgcttgccggtggggggggaggcaaaattttgaaaattttgttccgaaattgcaatcacgggcaagatttccctaatcgcaatttccccattgcaatgttgagcttgcttttggctgtcactctagctggtaatcacttaatttcggaattgtttcaacggttggtttgacatgagcctatcaggttgaaatgtcctcaagcttaaatgtaagcgtctctttcagtttgtatgtatgcacatataactccataggtcaagagagttttattctagcagacttaaatataagtgaatatcccctttgtatataccaatgatcaattttggagctcaggacaatggaactatggcttcatttccttaaaaagtgcatcagttgaatccagtgtatattctacaagttataagcatggaatttgatgtttctcctctgataatttgcattgtttttgggaagtttgaatatttgctttgtgctgatgacttctaattactaatgatgtaattcataaattttatccatcggcatatgcttgcttggacggtttgttatttctttttatttggacatacgtagtttgcttgaaaattttgatgtggctaaaagagcatttggtttcttaggaagatgcctgatgctaatgtcttctcaagcttttggattgtaaggtgcttttcatgtttttaatccagtgctactatccatgttttaaatccttttcatcaccattatggatatatta

SEQ ID NO: 2862 - DNA, 1501 bp, Oryza sativa
catttcgagttgctcaggcaaaagttcttcatcctctctctctcgtgcttgtcgcacgagtgggatgtcaagggtgaaggtgacatggagcaagcgaactgacggagataatcgtttggactttcaagctcgggaatgaacggagctggggcggaggagcaaagttccaggaagacaggtcaggagctgcgcaaagtcgttgaggaccgcaatggcagaggatagagaagaactggtctaaagtgaaatattatgcaaacttccctagtcgagactagtgaaaactgtcctacccaagtctaacttggaacaaaggtaaaaaaagatggtccagggtgtgtgtttagttcacattaaaattgaaagttttgacgaaattaaaacgatgtgacgaaaaagttaaaagtttgtgtgtgtagaaaaattttaatgtgataaaaaaattagaagtttgaagaaaaagtttttaactaaactcggcccaagatgcaatttataccctaacaaaattggtcgggatgctccttcactaccgacacagcaaaaaaaattgtattaagtgtacaagaaatagttaatccaaattatataatgtctgtcataagttagtttttcccgtgcaaggcacatgcaatttgctagtgaatcaaattaagagaaatccaatccaacgtaacattgtgcaggtaacaatattaatggttcaactaagatgcagactaagtcaagactcctatacaaatacaaaagctctacatccttgattctactagccctcccttcttggtatacatagtataatttctatatctatatctatatactaatataaaaaagaggagctgtacctctccaatcctactggggaaatcacccgaatcaaatctctaccgtccatccgtcatctgatttaatctcatacgtccgctatcctcctaactgtgcgcagcgatgagcgattccacctattcagaaatcacgcgatgactacgccgcacaaatccccaccgcctcctccgccccctcgctcctccccgccgcgacaacttcgcccccaaaatcgcccccgcctcctcgctcctcctcgccgctgcctcctcgctcctcctcgccgcccggcgaatccccgcgcctcctcgcttctcctccacacccacgaatccccgccgtctcctcgctccgtgcgcatcctccctcctcctcgcgacggggcaacgaggtcgtccccttccgctgccacccccgctgcccacgccggagattaggtcatccccagccaccgccggagccgtggtcttccccggagccgacgtcgtccccagttgccgctggagccgagttcttccccatccgtggtggccgccgaagtccaccgctgcccccgacgaagtcgaggtcttccccaaccgcggcctgcccccgccagcgcttgaatacactcaaccgatccaacatcctccacttgcgccggcgagagccttcctccactccagcgcctcac

SEQ ID NO: 2863 - DNA, 1501 bp, Oryza sativa
ccaaacaattttacatataagggctattgcaggacccaaaaaagcaaagaataaaaaatacacttgattttaatagaaacataagtacaaaacacaaaaaagatgcataaattattgttcgaataaacggtagaaaaatacatgaatcgataagaatgaatgactatttttttttttgaaaggttggagctcatattaactttcctcagtatatgaatcaatattttgtttcaagtattttcgtaagaattttttctgtagaattaaaatcctctaaatttgttatggtttcctaatataaataaaagggggacttagtttgcatgcgtccatccaagtgacggcatgaagagcatggcgtggcttgtgattaatcgtgtgtttcatactaacggctacaagattgtcttggctgatctcctcttctcgttgccgggtcaccctcttgtgattaatcttttcgcgtgatgcatacgatactgaaaaggtgaggctagcttgccaatttcttatgggaaattcatgcattcatcatcgttccattttctagtctctttccctaccaaaagacagcaagaaggttctaggaaaaaagaaaaaataaagataaaaggagaaggtctttctctatatctccctgtctgcctctcaagaaaagagaagaaaagagagaaggtattcgattgcccaaaactagttacgacttacctgtcacagctttcttgcagagcccggttagttagcctgtgcttttcaattattagtgatcttttccttaagctgaaagcaggcagcaggcgggtgcatatacagcagttcaccagtgttggacagagcatcgaatccattttccttctccacgaacacttccatgctggcacgtccgcaccagctaagccccttcaacgctcgggatgcagattcgtttaacaaccatttgttcaatttattagaggagattgcacatgtctgaaacaactctcagatttggatctttctttcatcgccactttgttttgtttgggtgaccaatttgatgttttaataattaaacaccatagtttagtttggctccgtattagtagaaaagaatgtatagtgttgaatgggctggcgaagtgaagaagtgtaagaagaacaaaaaaatcgaacatctttggtgtgtaatgcctatgcaaattgttacaaacccaaaatggacaacccaaccaattaccaatatgcgaaaagcttccaccgcctcgccaacaactgatggttctcctccggttaagatcatcatcatctctttcaagcagcagtacaatatactagtatccgttcttgttcctcgtcgtgtcgtctcgtcccggcatatacattgatgtgtgccatgagctgcctgcgattattgggatagacgagttactgctgcagcctgtcgagcgcctgcagcaggattggccggaacctggtgaggttgacctcgacgtcctgcttcatgatagtcgcggcgagtgtc

SEQ ID NO: 2864 - DNA, 1501 bp, Oryza sativa
taattattatttaatgaattaaataaatggtaaatcatagtactatattggatttagagaaataataaggacgcagactgaatcagcgtttgtgggtatcaacgtccacaaggggacgttgttcttgcccacgtccatggtatctggtgcaacctgttatgaaacctatcttattgtggacgaattaaattatgagtgggaagcttactacagaagaaagctaacaccagaagctagcttacagaagaagctagcttacggcgcaagccagcttacagaggaagccagcttacaggagaagctagcttacggcgtaagctggcttacgacacaagccagaaggttcaaggcttacgatgcaagcctctaccctcctccgcctataaatagggcccagaaggtccaaggcaaggacaaccgatcttcggtctcctgcttctcctcttgtagcttgtactcaaatccagaagaaataaagcttccactcgcttatattttctgtgttccacagctctgtgtttatctgcttgtgtgctgatcagtagaataaactggtttctcaacacgttatcagcacgagactctatcgagctaaaaaggtaaaccagtgagaaatcagtttctactgatcatcttgctcttgatatgcaaattatccttctgctatagttgaaataagcagaagaacatggtacctgaagtaccatcctccgatatcctctcagcaatacacgataacatgatggctgctctgccgccattatcgttcaattgctaaagttgatacatcctctcagcaacacccagtaacatgatggcggctctgccaccattaccgtccaaaggcttgagatggtacatccccttagcactattcgataacacgatggtggctctgctgccgttatcgcccaaatgctagaggtgatgtaggtgcctgaagcaccggcatggcaacttaatggacggctctgccgccgttgccaccaaatatcggaggcaaacgaaccttctgcacgaccctgaagtgtcgttatggatgtcctttgttttatggatatcacccatatgggcccttgacgcctctaaggtcagctctgccaccatgaagcgtgggcacaatatgcatgaagtgcccatgaatgctcttcattttgttttacatgcttactttgttgtttgcatgactttcataacatttattttattgttatgaaattgatttcctagcatgattgataatatttaatcaagcaatctgtaatcctgaagattacttaagttaatttgctaggaaagattctatgggaaattgtgtgataatcttgaagattacacacactagtaatcctgaagattacgcatgaccaattcatgttgaccctgcacatcgtatttacctgtcgtaaataccaaatgatgttgcaggacatgtcggacatagcaaagaaggaattcgccgagcttgccttggatggtagtaactacctcacttgggcat

SEQ ID NO: 2865 - DNA, 1501 bp, Oryza sativa
aatttctttctccatattagcaacagcctcaccaaaaccctctgcaccttctccagtagcaatgtctttaccataaattgcagctagtgtatcatagtgagggaatgctacaccatacagaccctttgcctcattgtttttctgtaaaatacaaagaatgacacaaaattaaggtcatggtttagcaagcagaagagagacctatgcagctactgtgacatatcaaaaatgcaacaattacatgaaaaacacaagagaacatatttatgagagagcatactacaagaaaaccataatgttgtcttcgcaaacatttcaaaggaattttacatagcctcttatttggaacaaaatttcagaaaatatcttacagttagtttcacatatttcaattcaatgcactaatgaatcaataaataaattttgtattccatataattatatagttagtttgatgacttaccctgcaatgatcatcgtattgttgtttctcacattgtatcatctttctgttgtcatcccaagaaaagccacttttggttagcatcacttcaattgccccaaacttggtcctaaagtgtcttactctcgactcgatgtgcggaacagcagtaaggccagaatttggcaacttcttagcaagcacgttctctagaacttggcagtatccatttttgaaacccccttctgatttccagcttggatctaaagcaatctcgaacagtgccttgatcagttcctcatcctcgaagtacgtccaaatcctcttgttattgcctctcccacgcacaatgcttgagcttccaagatgctccataactgcaatattagaaattcaacagaaaactaacatcagtgagcgtccatagttgtaccaacatttgtttttagttctgatttgcaatcaattagaaattccatttaaaacacaaacctcaatgagccctatagctattatacatcccttgagcaagagtgttgcgaaaattcgtccaatcatcagatgtcgaaatagctgagataaactcaggttcagcgagttctcccttaagtatatccgacagtatctcatcctcatcctcaaatggatcactagacatcttttgcaaaattaagttgtgcaataaagcacatgccattataattcaacactgagttttgataggaaaataggatggagacctcaaaatcgctcaacgaccctttagtcttccaaaagacctctctataatatttctagcacttgtgtgcctcatgttaaagtactcctctgcactacatggtcggtcaagtgctgtgaaacgacctaaatgatatctttggcctccgtaaggggctaaaaaaccatttgcatttatataaccagcatcaacaaagtaatagcaacctttaaaagtgatctctctttgttagttcatagattgaatgtaatagagagacatctgctcttgggttggttgaacttgttgtaaatatttctttatattttaattaattttac

SEQ ID NO: 2866 - DNA, 1501 bp, Oryza sativa
atggtgtggaaggaaagaagttgtcgatgagctttggacggagaagaagctggagcgtggagcggaagcgagacctgctctcgtcatcatgccgtgggagagagactacaaaaataccgtgggagagaggccacgccagcagcggcgcaggcgcgcgatgctgccgagatgggaagtcggcgacggtgcagaggtggatgggacgcgatgatgcagatgttgatgggatatgacgacgcggacgcatggagcaccgagtagtccggagtccctcgatagaagatctgcacgagtggataaggtcggtgatgtcaagggatttcttcacagttgtatacatgttcaccaatttgggcctattgggttttattttgattgggccatataatgggatatacactttcggggccccatagggtcacccgtgggttaattttcacaacccgcccccacccccgcccccagtaacaatcggagccctgacccgactcacccatggggcaaaaaacagcctcatccccggccccatatgtgggtgttggcatatattaaatgccgattctatactgccaacatctatataaagtcccgataataaagcatcaaacatagtgataggtgttaaaatctcacatattccacaagtgttggtgtatatttgtatgtaggtgatgaaccccgaagttgggaggaaaatcacactaaagtgagagaaaatatgtatccatacaaggatagattgtggacttcatcaaaatacccgagagtcagcccaaaacttcgagaaatggataaaggagggccagaagaggagctaggccaaaggccaggccaaggggtcccagcccaggttcggcctaaccccctggtttgggcgaaccctggtgatcgccgttgatcccaggttttggcgtggacgctccagatcaccccctgatgacggttgcggggcagttcggacaattccccttcctataaccgtcatacctatcctataaatagacatcactttattcactctcacaaacactttcaagcttgagctgaattataagaggctctatcgtactatattgtatactagaataggaagagagtagagtagaagaagtcgaatgaattccggagttgtcggtaatcttctctcatttcttttattttgtttattactctaatttcaatataatattcttcctgagtaatttagatttatcttgtgagaattatctcttggttagttcctaaatagcatacgggattattgttcactataatcaactaaaatatagtgattgctttggtgagttataaacactaaagtagatattaattacttagacgtggtgtttaggtaattgttatccagtaattgctgcgtatcccacagtacgtttaaggtaggtgtagaggtggtgacagccatcgagatcacttaagtcctccctgtccgagtacgtagtagagcaatatctgggaacaacaggttgtcaatgcctgaagt

SEQ ID NO: 2867 - DNA, 1501 bp, Oryza sativa
tcggaagcaggtccatgcagttggtgagcggcgaaagcgactttctcctcatcagtacactggatgaggtccaacttcttattgaccgcgtgcaaccagtcatttgcttcgacagggttggttgtgcttgaaaaactaggaggtcggactcggaggaattccgacagctttgactgcggtggagcgtgtacgtgagcttgagcagcgggtgcttgcgggttttgcatttggtggagcaaagctgcgatgaattggttttggttggcgagcacttgtgctaagttggggtgatcatggattggcggaggtggcggcggtggtggtggaggggcgtggccttggtcctaattctggttctggttctgattctgattctgagctgaattcctagcacgagcattgttagcagcagtactccttgtgttcaccatctgtagtaaccaagataagagggaaaagaagaagggagagatcaggacaagaacacgagctattaaaccaacttatttaaattttattaatgtgatgttggttacatagagttcaagttgcttaagcaccacaaaggtatagctatatcacaacgggccgatatagtccataccaaaaagcacacaaggcaacaaactccagcagaagataaacgataaaaacatacgcgcactaagacttcgcgtctactcttgagaacgactcctagaggggctacggtccacaaatggctcatccacgttgctgatgccgtggcgaggacaggcgcttgatccaacaggtggtagggtcttgacgacggttccaggcatcccactcttcaagtccttcagctccttgcgtagagcgcgaagctcattctccttgtcacgattcttctgaagcactgcctcgaacatcctctccgtcatcctgtagtagaccatacggtacttgtccatcgcggccatcatcttggacatgtgcacaatggtggtgtccccttcattgcgggcatcgcggaagtcagcatcttctgcgaaacccaagcgagcagggtggtagtggaacagagtggtcttcaactggtcggagtgactctggcaaagggccccaatggcatggaatgcagcttcttggcaggcagattcacggctgtcaccttctcctgtgaaccagcaactttctagcatcatccggttggagatgatcatcaccttggcactccaaagtggttcaagtacaccctcgtcttcgaagttgagaaccacgcggtactccatagtgatacagtatccgacttcagcggccaaggcacgaagttgctccacaaaaccggccaagttgaagcagcgggtagtctcgaactcaggcatctacaacattttgaaataagagtcaatgaccagttttgtaaagagtggacaggtgaagatagaataacgaaggttttcacaattaaagaactagtttctaaaaaaaatatcatcctaaggcttagaccactggctcgtcctacggtcaaggtggc

SEQ ID NO: 2868 - DNA, 1227 bp, Oryza sativa
gtggcgggcggcgcgacggagagagatcgagatcggagagatcgagatgcatgaagggagatctggcggcggcggctctcaccccagagatgcggcggcagcggaggaggcggaggcggcggcgaggacgacgagctcgagacgacggcgagatacggcggcgtcggcgcggggatttgccctaggcagtggcggcgaaggagagagaggccgagagagatcgatcggccgaaaacgtctaagtgttggtgaagaagacgagggcgcaccgggaatatatatacccccggatctttactcccggttgttctcaacaaccgggactaaagatatctttagtcctggttgttctcaacaaccgggagtaaatatcttttcccgctatttcgaaattctttttaaacccggttagggttaagaaccgggactaaagattatagcactgcatatgattttcgcttacatatgtgtttataaaatagaagttaatgcattaacattatttaaagtacaaagattaatgacaattatttcgaaaaattatttttgtctgtaataaattaagtggataaatcgtaataagcaaatataattaataaaaattccaataatcatatatacttagcatatatatgaataatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatatgaaaggtagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacacgtgtgatttaaaacttttaaaaattgtaagtatcacatataactagcatatacatgatttaaacttgttgaaacctctaataatcgtgcgtaattaacatatgccata

SEQ ID NO: 2869 - DNA, 1501 bp, Oryza sativa
acttcctcaattctctgtttaatcgacagtaattttgtggtttgcatcttccatagccttctacccattataaataaacataactttctgggctaatgaagctggtgaaatccagctataattttggccgttaaaaattggggttagtttcatcgtgttcctgaaatgagctgggagagagatccatcgccttagctcgccggagtggcggcgcatggaatcgactcgccgtcgccggtgaggtgaacttgtgctgaagatttgcaggagcctccggtaatttcggctgccctagctgtggctgcggcgcagccggcacgaacagtgtcgcactcactgtgcgcagccgcagtagttggcctaccgaacagacccactgggccttcaggataggatgaaaacggtccgaaaatttttatatttatgaattcaactatttaatgtaaaattcaatacaacgttgatagaaattagacgattctcgattcagcaaaccgatgaagtcacgcagtgtgatgaaaggatgacagctaaaagcaatcttgtggatatgatatcatctcctttggctgtaccgaaaagaagtcacgtttaaattgatctatgctaccatccatccaccattccaccaactagcttgatttctaaatactcagctttacattctgcttggcaatacgctgttgcttctccaacctctttgccagacagagacgcctcagtgagttaaatactacaaggaggattgataattgagtttaacaaaatgcagctgaaaatgaaactagcactaacaagtagcctcacgagatgaggacacagagatacagctatggtttttcttttgaacaacatctccagtttcatgttagaagtaatatttttcagaggacagagaaggagagacatcaaccaataaacccaagaaatcctctcatttttcagttctcctttttgattgaaaaccagtccgatttttttttcaaactcctgaatctgtatgaaatgaaacagtttgttcaccaaaggcatgcaattccagaatccatctttcttatcttctcacctatccaaatgtcacacacattatatatctgcacattgcagcatttactgcccacaccaaactcccctactgaattccagcaaaccactggttccctgcgctttaaaccaacctttggcctggtttacttcacaaatttttcttcaaactttcaacttttccatctcatcaaaacttttctacacacataaacttctaacttttttcttcaagcttcttattttaacgtggaactaaacgcagcctttgattaatttgtgtggatatgaatttaaattcatattcatttgttcatattctactatacatttagcagaaaactatggatccgtgcagctgtatcccgtcgttttttctgacgtggcacgcatgtggaaggcgtgggacccagttgcctgccgaaacgcatgctgggcccacctgtcagtggctttt

SEQ ID NO: 2870 - DNA, 1501 bp, Oryza sativa
aacgcacgaacactctcagtaatagtgagatcaatgaatcgtatatgtgcatctttcgtgtgcgcgcacccaaaaaaaaaaaaaactctgtaccacgtacagtcaacttgcatatcgcgaacagggaactcgccccgtaaggtgagtccgttcagtgtaccctcgccgccgtatcagcagcagcagcacatcgtcctcctcgtccattcgtccgtcctgttacgctgatttccgctgcgagcgccggtgatgaggtgacgacggtgtgacaccatttgactcaaacagcctctcctcgggcctcgtgccggtcaaatggcacggccggctccaagccggacatgccgccccgcccgcccgcgccacccgtggccgtcgcctgcgtcgcgcgggcttgggcgcgacgcccaagccaacacgtgccgatcgggacaggggccgcacgtacggcccggatcgctccggacgcggatcgtacagccagcgccgcggttgtcgccaccaccgtgtcctcctctccttatctgctagtactacgactacccgcggctaaccgagaaaacgaacaagcggaatcgaacaaattgagctcaccgtcgtcatagtagcttttacctaacgcttactctatttttttttcttctttaacaaggaccccatggcaattgcagtgtaggtagactggtgccgtcatttatccctgcccatgtatctagaccggatcgtttctacaaacaaatggtgtgctagatacggtcgaaaatgatcaaaaaaaaaaagagatacggtcgaaacctgcttaaattcggcaactgtttgctaaaaaatctgttcggcatgccgtatatgagtatttggtgcattttgggcgaatttttttcaaaaaatgtaaatgaaactcacgtgacatgcaccatcggagatacgcaaggagtttacatatttttttgtatgcattaattcggttctctaatatattttctacaaatttctttcttccaattttagtgctccctcaaaccgttcagttcatcgagtttaatgagatatctgaaatttatcttctcactagggctcatatttaaacaagatcaatttaacttataaacatttgggagtgttcggcaggccagctgccacagctgcggctgcgcacagcgaggatggcactgttcatgccggctacgccgcagccacaaaaataatagccgaacaggtcttttatattcaatataaacatttaaaggatatgaagctttgctaaacagagcaattataagccgccataatgcagaagctaccacaccaagacatccgtgtgtcaccagccacgtgacacggcgatgaatgggattttggatacaagacgcaaaaatacaacaaaggtagttggaactcggcgacgaaatccaccgtaccccgggttttgccagcccaggaacccccgcccgggaccctctgccagccagccccgttacaggtgcggtggccacccgcccac

SEQ ID NO: 2871 - DNA, 1501 bp, Oryza sativa
attgcgtggggtattttccgtgctactctgtctgtctcagtgcagagtatttggtttagctgtcagaggatcatcatagtgtgttaagcttcggttgttaacgtgggtactctggtgccgggacagaacgaccaccatgtcagctgggtggggtgggtacatactagcacatagagactgaatcagtttgatcttttctagtagcctgtttataattatcttggcaagaatgcaatatactatgaagagatgtatgctaggaaaacaccaccagggtagggtggtagagttctttttttcttttgaaggaaaggtgaaaactttgacattttcaatggtaaacaatgtatccgtcgttagcgatgtgtccgtaataacttcatcaatctcaaagatatgctaggtgtaggatatgtgtatgtacgtttataaaaaacatatgtgcgcttgtactgtgtttctaaaaaataaaaagcctcaacaagattcgctcaccaatgctaacatgcctttcttgaattggaggattttcatagtatttatagaggattcaatttcttgggatttttattcctatggtatacttcggattgaaacaatggaactttgaatatcctatgaatttggttgtttcaattccaaagaaaaataagtatgagctcaaactcttgtatgcattatattcctttctctatctagtctctcccctatccaaacaaatttcctgaaaagtttatattcctatgtttgattcgtattctcgtgacctaaaattctgcagacaagagcatagcattctattagtatgtttttttctttctctgttttataaatcttactctctttatttatgttttataaaccttactctcttcgtttcagattataagttgttttgactttggttacaatcaaaccgctttaaatttatctaagtttgtagaaaaaagtagtaacattttcaacccaatacaaataaactatgaaaatgtatttaattatagatttaataaaattaatctagtgttataaatattattatattgtttatacaaacttaattaaatttaaagtaatttgatttagagtaaagtaaaaataatttataatataaaacagagcgagtatttcaaagcattcctaaaatattcacagtgtagttgttttatttagccagtatttttttttgagggggggatgctcactcgtataaaactttgcattctacttttaacccgcagtataaaattaggacgccacatttgacactttgacataacaaccttcccataactcctgttttaacccgccgctgatcgcgagagtcctttcccattaaaacccccccgcccaccagcgccgagacacagacaccaaagccgtctctgagaagaagagagggagagagagagagagagagagagctcggtcggtggaggcgacgacgacgacgcgcgcactgcggccgccatggaggagagaatacctctgctctcgaaac

SEQ ID NO: 2872 - DNA, 1501 bp, Oryza sativa
atgtttatattgaatataaaagacctgttcggctattatttttgtggctgcggcgtagccggcatgaacagtgccatcctcgctgtgcgcagccgcagctgtggcagctggcctgccgaacactcccaaatgtttataagttaaattgatcttgtttaaatatgagccctagtgagaagataaatttcagatatctcattaaactcgatgaactgaacggtttgagggagcactaaaattggaagaaagaaatttgtagaaaatatattagagaaccgaattaatgcatacaaaaaaatatgtaaactccttgcgtatctccgatggtgcatgtcacgtgagtttcatttacattttttgaaaaaaattcgcccaaaatgcaccaaatactcatatacggcatgccgaacagattttttagcaaacagttgccgaatttaagcaggtttcgaccgtatctctttttttttttgatcattttcgaccgtatctagcacaccatttgtttgtagaaacgatccggtctagatacatgggcagggataaatgacggcaccagtctacctacactgcaattgccatggggtccttgttaaagaagaaaaaaaaatagagtaagcgttaggtaaaagctactatgacgacggtgagctcaatttgttcgattccgcttgttcgttttctcggttagccgcgggtagtcgtagtactagcagataaggagaggaggacacggtggtggcgacaaccgcggcgctggctgtacgatccgcgtccggagcgatccgggccgtacgtgcggcccctgtcccgatcggcacgtgttggcttgggcgtcgcgcccaagcccgcgcgacgcaggcgacggccacgggtggcgcgggcgggcggggcggcatgtccggcttggagccggccgtgccatttgaccggcacgaggcccgaggagaggctgtttgagtcaaatggtgtcacaccgtcgtcacctcatcaccggcgctcgcagcggaaatcagcgtaacaggacggacgaatggacgaggaggacgatgtgctgctgctgctgatacggcggcgagggtacactgaacggactcaccttacggggcgagttccctgttcgcgatatgcaagttgactgtacgtggtacagagttttttttttttttgggtgcgcgcacacgaaagatgcacatatacgattcattgatctcactattactgagagtgttcgtgcgttcgttagaatgagagaataacggaaagcgactgttttccacgcgcatgtttccttagttgttaaatgttgtgtttttaaaatatagataagttattttttaaaagaaatacattaacctgtttttaaatttaaaatgactatactttcaattaatcaacaataatcgctcacctaaatatttttaggtcctgtttgtttcagtttaaaattattgtaatctagattattaagtcagattactctaaactggattataataag

SEQ ID NO: 2873 - DNA, 1501 bp, Oryza sativa
gcgatggcggaggcggagagcgggaggacgccggggaggtgccccaccatcatgttggacgccacctgcacggcgttctgcgccacgctcatcgcggccatgggcagcgccatggaccccacctttcctgcctcccgcgccagcccgctccaccacctatctccgccctcctcctccctccctcctcccactccggcggtgccgtccgccgggaatcgtttcgagagcagaggtattctctcctccatggcggccgcagtgcgcgcgtcgtcgtcgtcgcctccaccgaccgagctctctctctctctctctctctccctctcttcttctcagagacggctttggtgtctgtgtctcggcgctggtgggcgggggggttttaatgggaaaggactctcgcgatcagcggcgggttaaaacaggagttatgggaaggttgttatgtcaaagtgtcaaatgtggcgtcctaattttatactgcgggttaaaagtagaatgcaaagttttatacgagtgagcatccccccctcaaaaaaaaatactggctaaataaaacaactacactgtgaatattttaggaatgctttgaaatactcgctctgttttatattataaattatttttactttactctaaatcaaattactttaaatttaattaagtttgtataaacaatataataatatttataacactagattaattttattaaatctataattaaatacattttcatagtttatttgtattgggttgaaaatgttactacttttttctacaaacttagataaatttaaagcggtttgattgtaaccaaagtcaaaacaacttataatctgaaacgaagagagtaaggtttataaaacataaataaagagagtaagatttataaaacagagaaagaaaaaaacatactaatagaatgctatgctcttgtctgcagaattttaggtcacgagaatacgaatcaaacataggaatataaacttttcaggaaatttgtttggataggggagagactagatagagaaaggaatataatgcatacaagagtttgagctcatacttatttttctttggaattgaaacaaccaaattcataggatattcaaagttccattgtttcaatccgaagtataccataggaataaaaatcccaagaaattgaatcctctataaatactatgaaaatcctccaattcaagaaaggcatgttagcattggtgagcgaatcttgttgaggctttttattttttagaaacacagtacaagcgcacatatgttttttataaacgtacatacacatatcctacacctagcatatctttgagattgatgaagttattacggacacatcgctaacgacggatacattgtttaccattgaaaatgtcaaagttttcacctttccttcaaaagaaaaaaagaactctaccaccctaccctggtggtgttttcctagcatacatctcttcatagtatattgcattcttgccaagat

SEQ ID NO: 2874 - DNA, 1501 bp, Oryza sativa
gcagggggagtggctagggcacgcgcgggggcaccggcagcgacctcggcgtcggcggcggcggcggcggcggcggcggcgggcggagcaaggcgaagggggtgcgcgcagagtggcggcggcgagctacacttcccgccggcggcgacggccgtggcgcagggggggcggcgcgtgcaggggccagcaatggcggccggcgcctctagctattcgacactggactcggtaggagagaagggaggaggggacgagagaagggagaagaagatgaggaggagcctaagaggggtgtgtgtgatttgtgaaagagatgggaaagttaaagaaaatattttttttttgtgtctcgcaaacttttacattagggtccttgcaagattggaaatagagcataagaaaagtatattggagggaagttattatacgtttattgtgatatggaattactctcccttaattttgtttaattctcttcaaatcaaacaaactgacctatcttttttcgtttatgtttatacttatcagccaaaatttaaatttttaaccttaaatttaaacctggttttgaggttttcttatcaaagtttagttttcagtctttacttttatgcccctgagaacacgtatataaaagttttattaataaattacttctagtttacaaatatttccacgaataagccaaacaatgaagccaaaagacatgctaggttcactgaccggtttaattttcttggtttaatactttaatcgccatcgggtctggaccgcaaggaatggttcctttggtgtctcttgtggaacacaatttttaaacatgtggtagtagtacggacatgatcattatagaagagctgtgcacgccttacgatgtccatgttgattagaaaaccagctgcaaatctggatctttttcaaagcttcatcagatccttggtttacaaggagagattagccaataatcacatgctaatgctcaatgagaacaacaaaagaaaccagtactagtacgagcactacaattttcgagaaagtgtagggtggtatgtgcaaatatggtcctttaatcggagccccggcccatcagcacgggcagggggggacgggcccggtcggcggaagcccccccctttaattcgaaagacacggtcacgggcggagcgaggccgaccgtccgatggggagtggcagaggccgcacggcgcggggagggtcgtacacgtgtccggccgagccgggcggtgcggccgccggcacaatcgatggcgagcaaacgtcacgggtggcggtgggcacggaccaccctgacgggcccccgtgccgtccgtctcgctgctccttccatcgctcggtcgccgacaggtggggaccgtgagacggcgtgagagcctagatgtttcctgagtgggtatgtgcctgttcaattcagataattgtcaagatcaatctttcaaattttaacttttagttacttggtataattttcaaactttgatag

SEQ ID NO: 2875 - DNA, 1501 bp, Oryza sativa
ctcatcaagctggccaaggctgaccatgttgctccgaagattggggatgtaatagacacctgtgagtgcgcagtgatcgccgttcttgcaggcgaacagcaccgtgcctcgtcctttaatccggactctcgacgcatcaccaaacttgacagtgccgcgcacggtggtgtcaagctcggagaaggcatcacgggagcccgtcatgtgatttgaagcgcccgtgtcaaggattcagtctggatcaatgggctctccttcatcacgaagagaaacgtgagcacgttcctcgttcagtgtcacctccccatcagtaatgacagaatcggtagcaggggcaagctcgcacacttgcgccatcaggagtgtcggctccccttcgtccgcggggtgagctggctcagcgatgagaagatttgcttgagccagcttctcgcggtctcgcttcgccttgcgacagtccttggcccagtgaccaagtttgccacagtaacggcatttgtccttggacacattgcggctcgccgcttgggacgaacccgacttgccgtcggagccgttgccgtcgcgcctgcgcccactgcggtgtggttgccgcgagctggacgcgctccccccggctgagttatgcccagcttccttgtttgagtgagaagaggcctccttttcgctgaagagcgcctgacccgcgtcctcgccgtcagagtcggggtgatcgtcgacggtgagaagccggccagtcagatcctcaatagaaagcgaggtcagatcaatcaaggtttcaatcgatagagccatttggcgatacctccggggaacgacgcgaagcaatttttcgaacaaccttctcttcagacagatcatctccaaggagacgaagatcgctgacaacaccctggagacgaaggctgaaatcctccaggtgttcgccattcttgaatcgcatggactcaaaagtttggcgcagcttctatgctcgggactccttaacacgatctgcgcccactcgcatggatttgagcgcgtcccaggcgtctttggcactgtccttctcggcgagcggccggacaatctcagccggcaccgctcgcaagatggccgaaagtgcctggcgatcctcctgatacgggacatcgccggtgtcgacagcatcccatagaccttgagcctggagattgactcgcatcaacaccgcccaatcagagtaatttgagcgtgtgagcgttggataggagaccgagccgccttccttaacgatccgctgcacgacgagctgtcgcctgcgtggccgtggaggagacggcgagagccgatggcctgttcgccggggagtacgagacgtgccgccggtgggagcggacatggctttgataccaaatgaaagccaagcccaagatttgtgtaaactcactatctctctctcacgcgaattcactggtctcggaagaacgatgaacacgaacagagtttttggtgccgcttactcgctgtgacttttctgatg

SEQ ID NO: 2876 - DNA, 1501 bp, Oryza sativa
cgcagccgcaggcgccacggtgagccattctatcgagcatctctatggcgtcgtcgacctgcaaaaccgagaacaatttcagaatatcagaaattcacgccgcgttgggggtttcgattgtttgcacgggaacaatcaactccagcgccgtgcttagccgcggaaacctcaccgttttgcggctgtactcgccggagagctcggcgatgaagccgacgccgcaggagtcgcgctccatggaggggtcgtacagcccaatgctgctctcggggatcttcgacatcgacctgggaggaggacgcgccgcccccgccccagcccccgcctctgcctggcgcgacgccgatgcccgcggcgccacccggtcctcggcggggagcgcgccgccgaggaacccgccctccagcgacatggcgccgtggcgaggccgcgccgccgccgccgcggtcgccgatgccgcgcggcgccgcttctccccgcggacgccacccgccgccggcgcggcgcgcagcttcagcgcaaggccctgcgccgccgacattgcccgcgcgggaacgaatgcctccgctactagtagagtagaactgctattttaaatctgcacacaaaatttgcaaatgcaacagaaaacgttagagataataacaaaggtagttaattaaattataaaaaaatattagaattttttttaaaatatagaactgcacattagcttgcagaaagttcagaattgtctagttctacccatcttagataaaaccaagataagtactactccgtattacggataactaaaagtgaccaacaactcctcggataaaccgagaaatctaccgggaaaagaggaacagaaaaggagacgaacacacgtagtagaagcagatcacgccgtaaaaacaaacaaagctgagattcctatacctcacgattctgtggaagatttgaactgtcgtttcctcttcacctcggatggatggagatcgccggcgaactgcggctcgccggccgctttctcccctctccgatcgctcggcttcttcgcctctccacctcgtggtagtgtagtgtgtatcgcttcttctctctctgctctgaagttctacagagcagcacgcgccctcatttttatagggttattttgtgtgggacccgcaatagccgctaccaccccctatcttcccgtagattttcgtgtggtattttcttggacttctttttttttctccctctgattcttcgttgattcttgttgtagccttgtaggtggcatcaatgtttttttttctaaagcaacatggccgggaggggggactccaatgttttacagcaaatacttccagggacatatcataatttgaaaaaatttctacagtatgctataaattatactcctccgtcctaaatttattataactaagaattttatcaaatggcatgcattttggtaggaaatgtaactgcagtctgcaggtggtgaaaaaagtttttttttctaattatg

SEQ ID NO: 2877 - DNA, 334 bp, Oryza sativa
tggcgcccaaaaaaggaccatttctgggataagttttttaaggggtctatttgggaaataagttttttaaaaggatcaaaatgtgaaaaatccagcccgtttcttccccacgaagcctttttccaaagtccaaatcaccaaaccgtcgcggcgcaccaccatacacagcccgaggccgcgcagctctcgaccccgacgcggctcggcagtcggcatcgccaaccctcatctccccccctcctctccaccgacctcgatctcgcccctccccccacgcgcgcgatctcgcccagatctcgctgagccgccgccgccgccgcagcagcagcggcca

SEQ ID NO: 2878 - DNA, 1501 bp, Oryza sativa
ctttgaaaaagatccagatttgcagctggttttctaatcaacatggacatcgtaaggcgtgcacagctcttctataatgatcatgtccgtactactaccacatgtttaaaaattgtgttccacaagagacaccaaaggaaccattccttgcggtccagacccgatggcgattaaagtattaaaccaagaaaattaaaccggtcagtgaacctagcatgtcttttggcttcattgtttggcttattcgtggaaatatttgtaaactagaagtaatttattaataaaacttttatatacgtgttctcaggggcataaaagtaaagactgaaaactaaactttgataagaaaacctcaaaaccaggtttaaatttaaggttaaaaatttaaattttggctgataagtataaacataaacgaaaaaagataggtcagtttgtttgatttgaagagaattaaacaaaattaagggagagtaattccatatcacaataaacgtataataacttccctccaatatacttttcttatgctctatttccaatcttgcaaggaccctaatgtaaaagtttgcgagacacaaaaaaaaaatattttctttaactttcccatctctttcacaaatcacacacacccctcttaggctcctcctcatcttcttctcccttctctcgtcccctcctcccttctctcctaccgagtccagtgtcgaatagctagaggcgccggccgccattgctggcccctgcacgcgccgccccccctgcgccacggccgtcgccgccggcgggaagtgtagctcgccgccgccactctgcgcgcacccccttcgccttgctccgcccgccgccgccgccgccgccgccgccgccgacgccgaggtcgctgccggtgcccccgcgcgtgccctagccactccccctgccgcctccgcctccacattgccccgcccgcagctgacggagtcgccgccgtcgccccccgcgcatctggcatcgaaggcctcccaccctccaccgacgtcgctcggcttcgcggggaccctccggagctgtggccacaggttcggcgagggcgctgctgttggttggacgagctcgttggtggcctgatctgctcagtggcggtgcggggaggcacgacaagatccccgccggccggatcaggtggagattggttagatcttttggttggcatccgcggttgttggtccactcggtgctagccttggtacgctgcctcaaagccttgctgcggctatggttttggcgtgagaagctcggtggaagatgtggaaagggttcctcagcaagctgccccggaagacctcggcctctgggaggggcgccgacctcgactccggccagtgcagcaatggcgctgggaatgggaacccgatacagcgcaccagcagctgcggcagcatcccatctggccgctccacttccaccatcaagcgcatgtcatccgccatcttcccgtccagcgtcgtggctggtattg

SEQ ID NO: 2879 - DNA, 1501 bp, Oryza sativa
aggcgcgtccacggtggaagcctcgcgcgccacacggttggctgcgttgcgtcgcttctcgcgggcttctttccgttttctctagggcccaaaccaagacgaggcgggccgcatcgttgccgtgggccagcgcacgcgcgtcttcccgttgttgggccgcgtgcatgcgcgaattgagattggaaaaagtacaccgaaggtccctcaacttgtcaccaggatacaaaagcgtcctgaaccgcaaaatcagatatgcgaggtccctaaactacacaaaaccggtcacctgaggtctttggtggttttgactccggtagtcagcgtgggacccacatgtcagcgtgccacgtctatgtggcgttctcttctttttagttatctttgctgcgggggagtagcatcgggcggcgccgcgcggggctgagcggcggccggcggaggcggcgtgcgatgggcggctggcagagagcagatgggcgcggcgggcgtgggcagcggccggcgagggaggagctaccaccggcggcggcggcgtcaccgcgatcccacaccttacccctccacctccacctccgccgctgatgtagcaaacatgcgcacgccgcactccccccatacacaccccgaacgcggcgcccgacgccgccgaagacgacgcatgctgacgccgctgctgctgaagacgacgacgactatggcgacgggttcgaggaggaggaggacacgcacctccgttatggggatcgctggtatcaagcagcaagcatccatcgtcggcgagccaccgtccgtcggtcttgtcatcccatcagctctcccgtcagcaacaagcgcatcttcatcagcaagcagcgagcatatccagatccacaggcaagccgcaagatccaacgccaagctgttaaatccacagacaagaagcaagctagcagcaacaagtagcaagtgttagcttcagctataatcctgtgccatattatcggttactgtaacgcgtctagcgttgtcgtttcttcagtttcgtcagagtctgtttctctgttttttttctcatgtaagccgagtcttccgggtcgtgcgtcgtgtgcgagtcatccgggtttcagcgtcgtggtcgcgtcatcgtgaatgatggcgtagtggtgttaatttgagtctgtacaaattggctatatatatgagcatcagaaaagtcacagcgagtaagcggcaccaaaaactctgttcgtgttcatcgttcttccgagaccagtgaattcgcgtgagagagagatagtgagtttacacaaatcttgggcttggctttcatttggtatcaaagccatgtccgctcccaccggcggcacgtctcgtactccccggcgaacaggccatcggctctcgccgtctcctccacggccacgcaggcgacagctcgtcgtgcagcggatcgttaaggaaggcggctcggtctcctatccaacgctcacacgctcaaattactctgattgggcggtgttga

SEQ ID NO: 2880 - DNA, 1501 bp, Oryza sativa
ggttcctttacacaaaccaaaatcagttggtgtgtatctccagcagttgacatattgtgtgacacagttcatagaaaaggatcccaagcttgctagctcagtaattattggtttgctaagatattggccaataacaaatagtcagaaggaggtgatgtttctgagtgagattgaagagatcttggagacaatcagcacggcggaattccagaaatgtatggtacctttgtttaggcggattgctcaatgcatcaagagctctcacttccaggtaacttgcccaaataaatataacctatcgatgtttattttctgtttttgccactatgcatttccctcacctaagaaaaataatatataggtggtaaaaataatatatcggagtactacatatgaaagtagttgtggccctgtttgattgatcaattgccacgctgatgaattactatactagtcgctaactctaccgcttcacctagacattttattatataggtggtaaaattttatgtaaacatcactcagttgaaatggatcatgatcgtaaagctcacatggtatatagggtttttttggttgcatcatttatgtaaggtatgaaagcattacctgttgacttgccaaatggatgagataatagatgtctgatggtccgaaataaatgtggacaacaatagtgggccattatgttatcaactaatcatgctttgggcatggggttgctctgtactgttaatatcacaaatgtgagatatttggaccagcattaagaattgaagacatttgtctgccatgacagactaatgctttttatccaagtaattgcctcaacgagatgggttttttcaggttgctgaacgggcgcttttcatatggaacaacgataacgttattagcttgattgcacaaaaccgccaaatgatcatgcctatcattgttccagcattggaacataatagccagaatcattggaaccaagctgtcctgaatctcacagataatgtaaagaagatgttttctgagatggatgacgtgctcttttcggcgtgcctggtcaagtacaaggaggacgaagaaaggcaagcttcactggaatcaaagaggaggttaacatgggagaagctagaatcagctgcttctttccagccagtgacgggccatacagccgtcctggtaggccgccaaccctcagcaaatttgattgccacccttatttagcatgtgttcagtggaggtgaaaaattagcatgtgttcagtgaaggtgaaaatggggttcttcactttctggtgatgctcaccaactgaacgacttcagacttcactattttccccttatttcttttttatgtctgtattagtaagcagtgctgtaagttgtaactattttcgtatgtttatgctctgaaggcaaagcatgtatcgagtgcttaaactccttacctgtatctttgcctgtttatttatgagcaatttcctacgcctaaactcactcttcttctg

SEQ ID NO: 2881 - DNA, 221 bp, Oryza sativa
acagttagaacttagacgccacagcttacctagttacctgctgtggcttgcttgttcatccggattgctcttgggattaatcggtggggggaactggcaacactctcttgtctccgaccaataaaggaatcggacctcgcagtttcgtgcaggtggatgcctgcatattttttgggagaggtcggcggccaaatgggccagagggccagaccgacctggca

SEQ ID NO: 2882 - DNA, 1501 bp, Oryza sativa
gatattttcatatataatatttccacatgattgacatgtgcatgtgagactaatgttttgtttgagtcttatctcttatttagtctatttacattgagaacgtggagatgatgaatgtatgtttttattttaatgactatatttgagaaatgccttctattcttgtataggataagctctcaatgtgtcatatcttgttatgcatactcttgcttcacacaaatattccatatgcatacatttagggggagcaaatcctacaccttagttatgcatgtatttgatccaagttattcactttcatttaattgggatctttacatttgagcatatatttgagtatatgacacttgtggtgttgattaatactcatcatttattcatatccttttatacatgtgattggttagtcaacatgtggaggttgacaactggatcattgagactaataatttcactaagttaattgagaaaaataggttccaaggattgaaaaggtgttgacgctcaagtgatatgattacacctaaaataccaagaataacaaagcgaagatattgaatatgtgggatacgaagtggctactatggcaagacggtgaagggcaagcgatgctcggtcgcgatggaccatgcggaggtgaagggcaagcaaggggcttggcgccgaagaaccaaatccagtggtgaagggcgagtgacggctttgtcatgatggaccgtgtgagaccatttgaagctacaaataaccgcatcaatcatttgaaaaatatatggtgaaacggttttggcgttggcgtcccttaagataaaggaaggaaatggaaacaaggcattcctattggtataattctcttcctatttatatttgagtataggaatgatgtactatttagagggatgcaacgtcgatgcgtttgtgtatgtctcggtgctcaaagtgacctatcatactactaccttgagagaaacccaagctttaacctatcctttgagtggttttagaccttgttcttggttgagttgggtagtcctctaagtgagctttccatagagtccaagatcataaaaaacggactcccaagcaaaaagttatgattgttttactctgtgcttttcggaagttccgaaaaattatcggaagttccgaaaatcatcagaagttccgaaaatggctgcgaaactgagttttgcttttgtaaattttcggaagttccaaaaactcctatctttgcctctgtaggatcgagatgtcgactagaggggcgggtgaataggcgatttaaaactaaataacacctaatcaaatctaacctaagttgctaggcttggtaagggtgaactctaactaatcaactaagttatgttttgcaaacctagggtgatagtggctcaattatatctctaagaaagtaaatcacactcctatgtcaatgttttgcaatcctagggtgatatgatctcaagtatgtctctagaaatgtaaattgcacaaatgtaaa

SEQ ID NO: 2883 - DNA, 1501 bp, Oryza sativa
tgcaaggacaaggagttcctcggccaccgctccccgtcgccctaatcctgctggaactccacctccatcgcacaccggtgagcacccgctgtttttctttctttcggccggtgattcacgccgccgggagtcttctcgtgccctcctaatcctgccatccccttccccaggtcctgctggccctcggccgtacctccgccgcggtcgggagtcgtcggagcgccgtccccgaccccaacccgagaagcgccgccgccaatcctcgtcgtcggccgccttcccgccttcgcctcgccgtccccgccctctcagtgagcccctctcccatccctgccgcctcccgtgtgtgccaccgcatccagcgctgctgccgcccgcagccggcgaccatcgggtcgagcgccgccgctttccggtcggccgccgccgccctgctcgcccgcggccgcccgacccctttgccgcgccgcgcctgcccgtggccgcccgatcggccgccctagccgatctaggccgtccacgtggcctccctgtgccgccccgcgtgggtgccctcgtggtgccacgtgtctgccacgtggtgcgcccgcggaccagcgcgtgcgtggacttggtccacggtgcacccgcctcccgtgaatcaccgacgggtggggcccgcttgtcggcgccaccccttcctctcggctgatgccataaaggatttaattgtgcaataaatcgataataattctagaaattcattaaaatggctcaaaacttctaaaatccatatctaattcattcgaactccaaattgagccattcaacttgcaaaattcatctaaaattgagctctacatgtttgtttactttttatgtactgtttccttggtttttattagagtttttcctcattttgcgtgccagcgtgtagaatccgtcgtttcggaagatcgcggtcgcaaggataagagttcggaagattgtttgaagaagcaaggcaagtcacacattccccttgggcatgttgatccaaatttataaatgttttattgtttgcaaataaatatgcatcgttttgctaattacatgggaataggatttacctatctgcttgcttgtgccatgttatttgatatatgtcctttgtcaaccttgggtgaaaattgactagcttgtgttactttgatgacctagctagaactatatgcttagccatgcttaattaccactagctcagtagatgggataattgcagtattagacatgttagtatcatgatgagctgcgtgctcgagacatccggccatgtttcatggtcgtaattatccaactaaaatacgactgaatggtgggctgtgggtgcatggttttgctggtcgcacccatggcaagtaaggaccggtttgcgggatgcactggaagacatacagcgcttgccacaagcagaaatgggtaactgcctgacttgaagtatagcttttctctggctgatgcatccaggcaagagtgggcgtga

SEQ ID NO: 2884 - DNA, 1501 bp, Oryza sativa
tgctcacccctctctctctctagtttctctctctctctctagatggccaccaacccttcctcaacggcgatggccatccatttactttgcttcttttgtgcaaagtggtggctgctgccactgctgcttttggatcacaccctctcctcctcctctcttcctacttcttggggtgtgtgggctaacttgggtaagattcccagacgaatcgagccgtgtaattaccaaattagtcatgctgccgccgctggtagctactatcttcttttatctttttttacctatatatagctcctgccattggtgtagcagtacacctctactgatctcattctcgtctcatttcctctcgtggaaaaggtgtaagggcgaatcagatgatcagctatccctctctctgcattgtcactgcacggtaggattcaccttttcgatcgaaatttgtcaaaattcgatataaatcgttgtatcggcgagggtcgttatcctgccgtccatcggaaaggtaaaccggtaaaccctgttgcacggtcatcggctgcgacctttttctccttttctgttttcttagtgttttgttaatttcttcttcctcggaaaatccctaatgggttgatctcgagcatggaatttgttttgataatttgtgcttgtcactattaattaagcaaaaataagaacctcttgttctatcgtacatcgacataggcgagaattatacctcctttacaacggaggaatcttgcgggaactgaaataactccaattaaattcccatgttttaaaggatcaattaatacatgggaaaaatgtgtttacggggatagtgagattaagagcacccgcaatggtaaagtaaggtgctatctataaaagatgtacatctcaacaatagactagattaatagtaaaccacttcaatggtatgtctacatgggtatctatagctctctaatcaattgcctcgtttttctctatagactatctccaggttagtagatagctttgctctctctcttcatttaatttcttccaagtagaaaaatatgcttatatggatctcttgtagagaacctataaataactattgtgggtgcccttaatagtagcacaattaatggtgaagagaattgtcaacgtttagctccctacgagatgtctttgtcatatttcttttggatgactcgtcgtcttacttttatataatttgcggatatacgtcttctaactaatttgatgctacaatgagaaattgtcttattgtccggtactctaggtacagttaggcattgagcatatgaacctacttgggaaagtaaccctctagaattgcacggcatcaaatatattcttattccaagatgacaatgaaaaatgccttgtgcactatagccgtcttgtgcattggaacaacataaacattcgtagcattcagtactccctccttccaaaaacgtggaaagttttagagtttaaattttgtctcatatatggcaaccca

SEQ ID NO: 2885 - DNA, 1501 bp, Oryza sativa
caacataatataccattaaatatatatgaccgtaagatgatatgtatgaccgccaaaagtcacaaagaagatattaagaacaattgaaacaaaagatgtaaaaataccaacttttaaaatcataagaggacaaaagtaccaattgggttcggtttcaaaaaaaaaaaaaggtaccgattgggttactgttttcatgaaaacctatacattttttactatgcgatgcaagaaattgcctattttatgactttgtgcgagacacattaaattattaaaagtttatctgcatttgtacgatgcaaatcactacatgaactacattgacgtccataattgttctacatggcacttgtgcaggttgctgttggaactgagtcgaagcatgagcacatgacaccggcaggagagagttaacatgcatggtacttatcgtgtgtcatatgggtccatgtgtttctgatcggttaaggtggtgtttagatccagggacttaactttagtccctgtctttagacactaatttagagtattaaatatagactacttacaaaactaattacataaataaaagctaattcacgagacaaattttttaagcctaattaatctataattagagaatgtttactgtagcatcacacaggctaatcatggattaattaggctcattagattcgtctcgcaaattagtccaagattatggatgggttttattaatagtctacgtttaatatttataattaattttcaaacatccgatgtgatagggacttaaaagttttagtactatctaaacatggcctaagactcgtcgttgccatgggacttgggctagcaggcctacagatggcatgcaacaagcatgaccagaccatgcaagcccacagatggtatgcaaggagcaccactaggccaagagcctatgtgttctagcgaacaacaaacccgccgtgttgtacccgctacccaatttccatacaaaaaatgaaagaaaaatactccgtgtcagaaaaagatcaacgaaaggggaacttttataagacgaacgacgaatagaaatgtttcgaattttttaagtagtagagatagagatcgtagggatagagataattctgacttaaagaaaaagtgaaaatccatacgcaccatctcaacggtaaaaaaactcaatgataaaggaatctggcaacggcgcacggaacggcacgtgcctcaatgcccgggcccagcaacaaacagcccatctcgagcccagtcgaacacgaaatacgcgttcgctatacaggttacgtactctctgctccctacattagcactggcgcatcgacctaaccaaaccctctttctctcctcccactccgctagctccggccaccaactttgacccgtcctcctcctccgcatcccccatcccctcctccccggcggcggcggcggcgcggaggcggcggcacgggagcggctagtggtttcgtcggcggaggcggaggcggggccaaga

SEQ ID NO: 2886 - DNA, 1501 bp, Oryza sativa
agcaaggcctcatctaccttgttatgtttagcatatgcgcccattatcatgttaaagatatgatgaccaagttgcatacctttcttcatcatcaaatccaaaagatcatgcatctcaacaagagctccttcagtagcatagccatgaagcagagtaccataggtagtgctatcaggcttgtgtcccctcttgaccaaagaatcaaaaatctttctagcttctgtgcttttcccattcttgcatagatagtccatcagcgcagtataagtaacgacatcgggttcaacaccatgtctgcacatctttttgaaaatcccaatggcctctttgggctttcctgaagagcaatatccatgcacaagactagtatacatgatgcaatcaggcataacaccgttcttaaccatcctagtaaagacttgtgtggccttgtccattgcttgagtcttggatagggcactgataatcgagctgtaagtcacaacatctggtgatggccctcgatccagcattgcatcaaacagggaataagctttgtccagctgaccctccctaagcaagccattgatgacagtggtatacgccaccacatcgagtgggcagcgccctttatgatcagccatgatatggagcaagtcgagagcttgttgacttgtcttgtcatcacagagacccttgagaagaatggtgtaggagaagagatctggcttgcaacctagctcgggcattcgtcgcagcacaatgtccatcgcatcgctcgtcctcctgcggtcacagaggcccttgagaagaggactgaagaggattgggctcatcctcaaccccgtcgtgatgacacggccgacggtggcgaaagcgaggtccaagcggccgaggcggcggcagcagccaatgacgatgccgtaggtggcgatattgggagccgcactggtggcgccggctctgggcatgcggttgaagagggagatggcgacggcggggctggcacgcgcgacgtcggagagggcgcggttgaggtcgaagatggaggcacggtcgcctcgcttgagcaatctgtcgaacacctggtgtgcgtccccgggctcggtcgctctctgcctccctccttgcttcgtgcgcttggccccaccccgtcctccttgcttcgtgcgcttggagctggaggccccagcccgtcccagcgcgcttccaccgccgcggactcccatggccagcctctccaactccggcgacgccgctcggccgccgccgccgcgtcgtccagagagagaggagagttctgagctggtgggctgagaaactggaatgtggggcccgcacgtcagttcccgaggagatgacccaaatgtgggcctagtgttgggccgcacagatcaccatttccggcccaattaaaggcggcccaagtaaggggagacacatctcagcacaagcaagagggaggctgcggcgccggcggaggcggaggtgagcattgcaatggcgacggtggccggcgacg

SEQ ID NO: 2887 - DNA, 978 bp, Oryza sativa
  unsure (1)..(978): unsure at all n locations
agggcaagcggagattatatagattccttatccgggttgaaactaaaacagtataggttacgattataaagcggagtcgcccagtttttaatgaaggtgtgatgctattaaggcccagtttggaatagacgatgtagacccaaacttacaatgcatagagggtaaagctaggataaatgcgccaggtctgcataaatgagagaatgaaggatctggggattgtgtaagcgcaagtggtagttcagnnagcccgcattagttcggggagataattcgtactttttccttatttttataagcgataaaaaaaatcctacctctataaaaatgcagcatgtggtcctaaggtcacaaaccacctgtgtaaattaatattatagagatttttgcaagtgtttcattaaaagaaaacgcctatgaaaacatgttcatttttacaagcgggaccgcatgcaaaattcatttagatgtataaaataaatcaattgagtcagtcaagggtggcctctttctccctcgttctctctttctccatcacctcaccctctcccttagagctatctctttgtccatcaactcactctctccctcacctcagatcctccctccctcacctcaaatccacggcaggtgcttggcagcagctgtgaatgggaggggctgtagtgctcggagcaagtgttccaataaatttgagtatttgaaatattggttccacctttcatatagtatatgtttatcctttacatgttacaacactcacacaaatatgttgacaaaaggtaatcgccatcaatattaagttattaactagaaaggaaatattaatataccttttttattgtgtagaaatgtgtacctatcattttgctatagggaatattcaccttaatttgatattatatgtggctatccatttagagattcgatagatttttaatactgagaagttcaaggggttatttgtaaaattaggag

SEQ ID NO: 2888 - DNA, 1186 bp, Oryza sativa
ccctcccccaccccccctctctttcttctcaagaaggtgacagcgagattcccccgctccgccgtcttccccgtctccggcagctccccgtcgctggatccgccaccaccggccgccgcctcctaatctcatgcttgctttgcccccgccgccgacgccggcccaccaccctcctacatccccacagcttcggcggtgccgccgccgcctcgccacccgctggattccaccgcccactgccggtcctccgccggccacggccatccctctaagcgccgaggaaacccccccctaccctaaccccaaccccaaaccctaacgcgtatgctcactgtcggagttgggggtgtcgccagcgccgaagaaaaaggggagcccgctgaagttagaggagagatgccgatgcacgaatcttggcatggatccaatggttcaaaatctttaagatttcatccccaaatttcattcaaatgacatatagcaattccataattaatgcttaattgttcatgagccgatagattaatatattaattgttggcgaatcgcaacaattaaccggcgcatcacatttggcaacgtacgtacttgagtgcgtgtcacttgtcagaagcggagtctcgccaaattctttcatttcattgcactattatataagcatacgaatgcagaagtataatattaaattctgcattattaagcactaatgctagagccttgagcataaaatcattttaccggacgtacgtatatatagtgcatgtggtaatcaactgcatgcaagaattattagtttagcaccatccgttgaatggtaattgattggtcgatcgcgcaatgccaatatcaatatatatgccatgtcagtgtcaccagtacgagaataagaacgatagatacatcatatcttccaaattaaacagaactaaaatttaatggaggatgatgtgtcgatgcctgccttctccctctaaacataggagtaaataatgcatggcattataaaagataaacacagtaatgatgcatgcatggcgagcttgctcaactcattataaaagaagcaattaaggaatgccttcctcaactcattccattcatcaaatttgaaggtagctagctctagcgagcttgctctgccttggaagctaggccactaatacgtagaacgtagcaatggcacaaa

SEQ ID NO: 2889 - DNA, 1501 bp, Oryza sativa
gtaatggaacacataaccaactcgaattgtcttgtatattaacctatgttccgttatctttttttcgccatcctgcatggcaataatatgttaatacttgtttactcaatacatcaccgattaagaacaatctagatgtacgactagctataatctctttgactctataagttatctctgtcaccacctctattatctccttttactcacttaagctatataccagcctaactctaagatttacatgtaacatgaaaaagaagaatctcaagggctatgtaggctctatttggggagcttctagctgctacaacttctcccagaatcagaagctcccccaaatagcccagcttttggtccagattctgataagctgtagttatagaatccagaaaatgaactagaagccaaaagctagcttttccagattctcagaagttggctatcaactagctgcttgtaagaatcttaagctcctcaaatagacccataattttactcgtagatgtgtatggtggaaacattggagtattggaggtttggtggagcgagcaaacacaagggcccacaggatgaggatgggttgtcttgtgtccagcccaaccccgtttcagtttccattcccgttccgttataataagaggagagagagagagattttgggtttgtctccggctccgctcgccgcctccaaatcccgctcctccgctgctgctcctctctgccgcggcgaggcgagagatccgaatccaccgccacccgcgcccaccccgcccgcacaaaccctagtttttccggggttttgcttcccctccgcagctccgctccgctccgtccgtcgtctcctcccggcggctcggcttgctgtccatgctgtagccgccccccgcaggtggctgatgggctcccagaaccgccccccaccaccgcgcaagaggcagccgccgccgccggaggaccacctcgtcacctacaagcgccgccgctccaaagaaacacaggtaaccaaccaaccaactccctgcctcttcttcttcttctttctccagatttcctttcgatttctacaagattcgtactctcgcttcttgcctcctcttacaatctctcattacatctacttgttgtgctttcttttcttgcagcctttgccactcatggccaacggcgccaattctaagaaagacgccaaggcccaacattggattagctggagggacactctccacggcttcctccaatcccctgctattagccagggtggaggaattcagacctgcatccgtcatgctctccaacacaatccttgcttgctcaccaatggtgttgttgttcacactgaattcaaagtaacacacaccacctttgtttgcatctaccctatatatatttatgcaatgataattttcctaacacatgacttctttctcattaccagggtaacccagctcattcccaaggagaggaagcaaaagtgcagcaccctaatggtgctgctgga

SEQ ID NO: 2890 - DNA, 1501 bp, Oryza sativa
gagatcaatagaagctttgctggtgagggcattgccaccgggtatgggttcaggtatcctggctcaaagcccggatcgctctttgtcctcctggatggccggcttgcatttgtttggagagagaacaaagctgttctcaccttgcaaaggctggacctggaggatatgataaggagaggggagcgtgtgccttcattgccgccgatacccaacttcgcctacctcacaaagtcttactccaatgtctttgctgtggcacctggcagcacgagcttcccagcttctccaaggtatgcgtatcactagtgttactgcacctgcacatgatacctgttatgaattccagtccctggtgtattatcatgttgtataggtttatctattttggtaattcagttgtgagcaaaatcagacgctttatgctaaactttagatagtgagctcttgttgccaatgctaaactttagactgagctcttgctggttgataggtcattggaggattcagccagttttctttgactgcagccacttcttatcgacaggattaaagtgtcaagcctaaatgtagtgatcttagttctgttccatgcacgatttagttcttctttgaatgtaaattttaaggtgtcagtattcatggtgatggatagaaatacatgccccatcattctatactgctgtacagctgaaggctgtgccctcagtacacggcaaaatacatcagtgccttttctctgtacatggaaaaaatacacgagtaactggtaatttgcatttgttctgaaacagtagtcagcagtactaaatgactataaaacaagtgatcactggtaataaaaacttaatgtactagtttttatgtggttcttgttacactactgctttattgtagatttataattatatactagctagcctgtgctgtactgctgttaatcacgtataaactgagtaaggtccataggatgatccatgaatctctgaggattctgcttaccccatgcaaaataagactgtctgcatgaagttctattatcatattatacagttacctctttgtgaccagcctggagtgtaatctggacgaccatgtagagctcttccatttttctacgacttatgtgtgtgatttacagattctcagatatttgacctgtacccctgtaaaaacatggcagcttccttctaagttgtaacaaacagttttgtgaatatttgatcaaaatttctttatttttgcttccaaatgctttgtcttgtatagtctagcatcctatctatttagtgattatacttccattgatcaactcatttgacaagatgaaaccccttctgttaggtaaaagatggcttgggaaccgttatgatggtatcacctgatacagaggcaacagcgacagatctttgcgggatcatgttctactgtgcttccttgccatacgtcttgtactgaagatctgaatcccacatttttcaccctgaacctgaaggttggccat

SEQ ID NO: 2891 - DNA, 1501 bp, Oryza sativa
ttttctgtcacatgatatatatatacagcccccttaaatttatattgcttcctgaatcagatagatatacttacaactgcatcgccgtctacaactgtgggcgtcaaggatgccgccgccggcttccctgtcgtcgacttctcccgcgcctccgccctccccgccgcctgccaagagcctagagagaagagtgagagagagagtgataagaggaagggagagaagaggggaaagaaagaggaggctgacatgtggggcccatgtaggtcttacgctgactcagcagtcacgtaggataaaaccgggatcaaaaccgtcgagggacctattgtgactagttttgcataattaagggaccccgcatatctggttttgtggttggaggacgattttgtatcccgatgaaaagttgagggacctttggtgtactttttccatttgataatcgcggaatatgggcaggaatttaattaggtccactaggaaaactcacttcaaggtagtatcgctaccacctactagtgacttcattcattttcttcacgataatgaagtgtggtggtaataggatgatggaatggccaacgttttctagaatctaaccaaatatatggagttccttttcaacagcatgagtatgttgggtaagtagaactattttaaaaaatcattttcgacaccatcaacccatcaccactttattttataggcagtaaaaaaatcctacctatataaaaatgcagcatgtggtcctaaggttacagaccacttgtgaaaattaatatttcgatattttcacacgtgtttcattaagagaaaatggctatgaaaacatgtctatttttacaagcgttcctcctaataggaccgcctgcgaaaatcatataaaataaatcaatcgaatcagtcaagggtgaccggtttctccctcgttctctctttctccttcacctctccctctcccttagagctatctctttacccatcaactctcccttccctctccctcacctcagattctcctcccctcacctcaaatccacggcggtgcttggcagcagcggtgaaggggaggggctgtagcgctcagtgcaagtattccaataaatttgagtatttgaaatattggttccacctttcatatatatagtatatgtttatgctttacatgttacaacactcacacaagtatgtacgttgacaaaaggtaagcaccatacaatattaagttattagctagaaaggcaatattaatctacccttttttattgtttagaaatgtgtacctatcattttgctatagggaatatttcaccttaatttgacattatatgtggctatccatttagatctgattgatttttaatattgagaagttcaagaggttatttgcaaaattatgagtaggtggagtggtatagatacattatacatacaagttacaacaaagccctccttagaaggaaaagataaaaatagttacatcgtacaagcccactac

SEQ ID NO: 2892 - DNA, 1501 bp, Oryza sativa
tagacggacatgtttcatgtctacttgtcgacgttagctaatttatgcacgccactatataattctatgatcgagttaagtactgtaacaagaccaaatgaacattgcattttactaagacatgacttgtatctttgagaaccttattcttgaggaatgaggaaaacgatattttgatatcagttcaattggaccaatatattttgtttttggagagtaagtatcagccaaataagaccacgtgggaggtatcatttttatgcttctaagagtgccacataaataacaaggcatttaattcattatattaaaatagttcgtacaatacatagtgttatttttgttgtttcataagtagtgcatgcaagagataaattgtattagaaacagtgtagacatagttccatctacatgaaacttatttctctcacgtcattaattccctgccacatcataaaaaaatggtgacatgccaccctatttaatgagtatgaaactctcattgggaatggcctaatgcaaatttgatcggtcactgttgactattgaaaatcaagaaacaatattgcaaagttaattaacaaattgaaaatctcaccacacatcttacgttttttagaccgttaaatatgctttgaaattcgtacaacccctgaactttaactctccgtcacccttcgattcctcgctatctctccgtcacccttcgattcctcgctatggccaacacttctccgtccatccttcaccccgatcccccacctcctttgtcacctagtcttgccagtgttgaaagcagccagcgaggcccgccagacctccttccttcttgtctctccacccccatcaagctagcagtagccttgtccatacagtcttccttatcttcgacagcttaccatcgccggagacatcagcgttacccacctcctaactactcgctccactttgcttccaccgccaacaccggtttatagcacgctgcaaatcttgtggcttaatgcatgcatgtgctagctactactataaataaataatttgtctaatgtgatgcacgcacgaacaaagatcgagatgatatgataaaaaatattagtgtgtgttggataatgttatttaatgcacaaataaaatgaggtgatcaggacgtgcaggcttacttcctagcttgtgaatgatgatatgttgcatgtattttattttattggaataatatatattaaatccacatattctaccaaatattgcaattttattccgtacacactattctgaatttccttgaggatggatacttctcaccaataagtgcttgtccatttcataaaggtacaatcttcaaattttaatggatcctttgcaacaaagggtttgaaggtttggagggattcaattccatggatttttttttcttatgtggtcctttgtattaaaggactgaaaaaatcctatgaaattctattgaaccgactgaaaaaataggtattttggataaatattc

SEQ ID NO: 2893 - DNA, 1501 bp, Oryza sativa
ttaccagccgtccatcacagaacctgatccaggagaccaggctcattaccagccgtccatccggtcttcttgtcccagtacctgttccagaccatgatgcccccatagttgggcagcttgttgatgaactgcagcacgtcgtagtagagatccttgtgcgacacgtagccgtccctgtcagcctccggcgacgcgacgacgccgacgaggacgcggctctgcgggtacgccgccatccacttctccagctcctccctcctcgacgcgcaccgcccgtcgccgaacaccttgacgtggatccgcgagaagagccccgtggacagcgccgcctgcagccgctggtccgggaacacgcacctcgccgtcgccgtcagcatcaccccgagcctccccttgtagtccttgttgtgcgcgtacagccgccgcgccagctcgtcgtagtgctccgtggcgccctggtcgatgaagaagtcgatgccgtcgacgacggcgtcgccgaaggggcgggcgacgccggggcggccgccgccgaggaaggcgttccagaggtagtcctcgaggtcgacggccgcctgggaggtcggcagggagtactcgccgccctggccgccgatggcgaggaggacgaggatgcccctggactggcagtgcttgatgtcggggccgacggcggagacggtgtggccggagatgtccagcttgtaggtgcccgggatgtagccgaaggcgctgaggaaggagatgatgacggtggtgtagaggccggtgtcgcacgcctcacggagggacccctcgagctggtccgtgttccggccccagaacacgacggtgtcgccggtgctctggccggcggcgaggctggacgagagcagtaggaccagcagcggggcaaggcgtcgggacgccattgatcttgactactatacactacgggtcttagctagatggagtagttagctacctatcgattgtgatgcggagaatggggaggggtgtgtatgggtatatatagggatgtcgcgcgtgttctcagctggatcgtcgatgtttggacgtctcttcctagcttctcgcgcgccgccggcgacgtggcagcttgcgtggcgatcagacgatgagcagggaaggaaaccagcttcaccaggaagcaggatgggtggggagtggggacagctagcgctgtcgcgcgcgtgcaactacagttcgaatcaatggaaattaagcatttccaagattactaccgccatattattttaatatattattttaacatggggaaaactgcaaaaacctctcctaagtcacttgaagtttgacattccaccctataagttattttgttgcaaatatccacccacctattcaattttgttgcaaaaaccactctagtaaacacatgtttaatcgaatcaacgtgtttttataaaataggagtcatcaatatgttctttaccaaaactatatacttctagagtattcttgacactttttttaatgagat

SEQ ID NO: 2894 - DNA, 958 bp, Oryza sativa
tatacagcagaatagaagagcagggtgattttcttttaacccctgccttctattgaatggacatgagttaacatcacaacaaaatatagaatttgttgttgaatcccccagaatatggaatatcttcaaacaaatatactagtatcacttatgggatggcctggaccatcctacgttcgcgccccgtctggtgcatgggttttctcgctgttattcttctctatcaatgagtaggtgctaagtttctcttagcatcccacgttctattttcaaaagaatgtcacttatttgtgattggactgtacgtgttgcactgaaaactgtttcagatggatattggtcgtgtgcaaaatgtgatgtttatcccttctcctacttaattgaatagcagagctcctaattttatcgctcagaaatgtgatgtttagagcaatccaatggtagtgtttaagggtgatgtcctggggtggggtggagacagtattcctgaatttcgtacaaacagccagattataactgtttctaaaaagttaagtttggaagttgaactgatatatctgatgattcaactaaagcttggtgagcagaggttcgtcctcatcatagtagaaatacataattcataatttgcgccctagtagtacatggtggctggcaatgagtcccaaacatttagggactgttggaagaagagaaaattgaaatgcaaagtatccgacaagcaagcacatgagtaaacaaaaacacaacagcaagcgttgttatgtccgatgggttatgctcggctggcagatgccacgttaaattactagaaattaaccaaacggttggttaatttctagtactaagggtgtgggtatggtatggaactatggatagctaacactatatcagtcgagttcatccagcatggactgaatggaatcgatatctttacgcatttcattaatatagtagc

SEQ ID NO: 2895 - DNA, 1501 bp, Oryza sativa
gttttagtagttaattcaaagtattttaatttatttccattttccttctttgtatgaattttacaataagtctactaaatttctaattcaatattgaagcttttatgtttttatagaattgcaaatttcatatcaaattaaggaaacattgatgctttccttgttactgtataataatttcctttgatagaatttatatagcaataaatggtgttgtgcaagtcagccttcgccttttatattttagtcctcaaattctgtagatctatatatagatccaaaatttacactaaacacccttaaaatcagaaactattataaaatagcacctttgaccaaatccaaaatcccccacttcacctcaccactggcgactctccttcctcctctcgttgccggtggctcatcacctcctccgacgagatggtgaccacccacagcatcctcctttggttagctctcttcattctcctcccagctgctcactcatccctcgcggctagtgagcttcgggctggtccgacggtgagctcgtaacggacctggcgacgtcagcgtcccactcctctcccctatctggtctcccctcctcgagttagcgagcttctccggtggaaatcgagcgatgcgacagcgggtcgaagcggcaacaaactcagcaccgtgtgcgcgtggatggccatgagctcggggcggatctggcgacatcagcacctcctcctcgccagcatgggaaaggagctcaatgcaaagctggcggcgtcgacagcgatggtgcaggcgacgagctcagggcagatctagcagctcagcatcgatggtgcctcctcctcgccggcgggggagactggagacgggttctgcacctgccgctaccaacgtcgcttcctcgccagtgctggcgttgccctgtcgtcctcatcgatgccggcaagcccctcccctctccggcagtgtcttcctctctctccccccactcttcgagttccactctctgcgcgcttttttctgacaaaactgatgagactctttgtacctggagaggacgcgactatgtgagaaccccatgaaaacatggtccccaccctcttctctcctccacgcaagccattcgcctatgtggattgacgaggccaaacgccatgtagttacattgtgaaggccctaacaaaaactataaagaaaaaatatatatttgtcggaattttgtttttatttttatggtgaaaacataacaaattttctagatgagactttgcatatatgtgtaatgcaattttcagatttttttggtaaaatttattatttaatatttatggagcgtgaacaagtttgtgtgtataagacacaatcttttagtatggaaggttttgtgtgttttatgttacggaagtacggaaccaagactgcaagttcttattgagaaaggaagaaaggaggatgcaaaacgtccccacaaatacccccgccgaccggtttcctcctcccctgccaagcaacg

SEQ ID NO: 2896 - DNA, 1099 bp, Oryza sativa
ggtaggttccatttcatgctatgatcttattggtggttaatttcaatgctgagtgccattatcatagtatggaaatgtctaatacaaaccctattgcagaggtacgaggtctgcagtcaaacttgactttagcagagatcaagtcaaaggaagctaaattgcaaagagaagtatgtgcataaacgtgttccgttatgtatatatgcgattttttttatcttttatggtttcaatgtcttccttgtattaacttttaagaatggctgtcttgtatttttgcaggtccaggaaatggaagagaaactaaataaattgaggaatggtgttatcttggtgaaacctgaggacaagaagattattgaagagagcttctctgagaaagttaaccagtggagaaagcgaaagaggatgttcaaggagctatgggataatatcactgagaatagccctaaagaccagaaggaatttaaggttttgatgcacttctttcttttacatttacctgcacttagtagttaatacacactagatgcttctcttaatacaacaggaaagataatttttagttgtcagattttctcatttctgccctgcaaaaaaagattgaaaagttaccaattgctagcatccagcacggtcatcattttaatgaataatatgtatctgtgcaggaagagcttggtctcgagtatgatgaagatgtcggtgttaacttgcagtcttacagtgacatgctgacgagtctcagtaaaagaaggaaagtatcccgctgatcatccagcatgggagtttctcaaatcaaatgtaggttacatgagagaagttttaccagctacaggcctacagttcatgaatactcgtagtccagacccggtcatatctgctgttgaaatttctagttaatgcatataagttagtagtatcgctgcattagtttatttccccagaggtaacgagattagaggaatattttggtcccagttgttgtaatataaaatcaatccatcctctaatatatctacaatcaatgatgaaacctgccatcaactacaatgctgacttttgctccctcctactaaccgatgaacaaaatctgaat

SEQ ID NO: 2897 - DNA, 1501 bp, Oryza sativa
gggtctccagggcagtctagtgggtcgtggctaagctgaaactcacggtcatgcgcgagggctagcctggctcacgcttccagcgcggcaaaaaatggctcgtgtttggctgggttgtgggtcccgaattagaggtggggagtggagaccaacataagaagtatgtcccatggagttgcctatcttaccaaataaactagttgaaaccccacgcattgctgcgagattttgtatcaatacttgggagaaatgaaaataccatattaaaagagaaagaatgatatgatggttgatacttacaaatattgagcaaacacttgttagtaaaacttcagccgaaccaatatagtcgaaaaataaaatagggcatgcaacattaggaactgaattgcagcgtcttcgttattctccaaaagaaatagtcatatagttatttaatcctaaaaaaatgttgcatatttacttcgttaagtgttgtgcttgttctgaactcctttttaagtaccgtacataacataatcttgctaccaactgcaatgattacttgattagtgaaaggagcattgacgacttcataaataaaagtatgagcagatagttccagaccatagaggtaacggatattgtgtaattagcagatcatattcaactctgacatgaaaaacatatacaattgtgtttccaacataagaatgtgaaattaccctaaaactctgaaatgtcacttagtctatgtttggacactctcattggctgaacatgtagctgaatatttcccatcagagcttgtatttgaaaaaagaaaaaactaaagaatacatcataattaatgtcatggaggttagatgaaagtagaagaaaagaacttgagaaaagaacaaaatgaagataaagtcctcaagccatacctaaaattgggggaagacatctacaaccaggaatcggccgcaggacgaagaaatcgatttgcagaaacacaaaattgtcatagacctcaagccataccaaaaattggggaaagatgtctatggccaggaatcagccacaggatgaagaaattgatttgcagaaacacaaaaatgtcatctccttctatgagaatcctttgcttcgaaggtaatccaatggtatgacaattttatccgctgctatgtcaatcctcaggttttcccataagtacaggagccaatatcctagatagcactaataagaatgggtcaaacaatataagcttttcatgagaaactaaagcaatagacaatgcattatggaattaccgcaatagctgttctttttctaagttagcagaaacaattcatcaaaaactcccaccttgttcgtgcgagagcaaattcataggctatgctcaataaataaacagaagcaaatacatatagaattggtaaacaaactgaaataaaatcgttgaaccataaactttagttacgtgaagtatactaaactttcatacttcgattctagccatctggctctagccttt

SEQ ID NO: 2898 - DNA, 1501 bp, Oryza sativa
ctaattaccccttagaacacctatatcctaccatgttctagtatactaagccctaaccgaagctctgcgtcgagttttacctcgccgcgccaagccgagcaccgctgcccccgtgctgctctgttcttcgccgccgagaagtttttccggccgtaatccgccatttcaaccgatctcggtgagttcttccgtttcaaccatctacatactacctagattccattttagcaatccctttgcactatcttgccaccctctgggctgccgacgtgaacacggccgccgcctatggaggcgctcgtcggcaactattctccgcgtcttgccaaaggatggcaagctgccggaatccctctagacacctcgtagatgctctagaacccctcccctagccatgtctaactcatatcaccttgatcaccattacggcctaaccgtgccaccgccgccctagccgctaacccatccacatatcaaattaacccctccgccgccactcgccgtcaccagagaaccctagctccctcccctcttcggccacaaccactttccccctccatcgccgccgtaatcccaaaccctagcaccgccggtccgatttggggaatggccggaggtagaagaagaggagagagagagactgacaggtgggacccgcacatagtgccatttcacatttatttgattttcaaactttagaagcccatatcttttaaaatatagatccaattccagtgaaacttggaccaatattctactaaaatcattctctatcttttgagcccctttttgctatttttgcattttattttattttctccatttttcatatttttggattttatttgatttccttttaaatttgaattttatatatgtctaaccctaggtcttgaggattcttttgactcaatagataatatcaatcaatctcaagacatcgagcaaggcaagttaccatatacctgttgatcatttaagcctatattttataaattatttatttatagccttctattcaatattctattttctatgcataaatcaatcatagaaacccatataatttagtattgcttactttgcttacaatctggttaaaataccttatacttagattgggacagtacgtaagatttggttgatttccgggtggctagtactgtctcaatcgatataagttttaccaggtacttatgtcgaacgaacgagtacgaccgcagtttctagaatggggacagaccttgttattatgttaattagcaatatggcacctctgtatagtggttcttatttttaagtcctcgcgcaggaggcaactatagccgcgaagggcaactttaaccattaccatgtacaggtaaatggtttgtgatactcgagtataaactatatggtatatttctaaaccctgatcgagatgacatggtgtcatacgatcagttccccttaaatatctcgggaacgccagaactcctcttgctgctattaacaatacgtt

SEQ ID NO: 2899 - DNA, 161 bp, Oryza sativa
agccccgcgcgccaccccgagccccgcaccgccatcacgtcgccgcccgtcacgtcaccgccatcgtgtcgccgccccgagcccccgcgccgctgtcgcatcaggccggccacccgtccccctctctttcttccccctctcccctataaatactccacacc

SEQ ID NO: 2900 - DNA, 1501 bp, Oryza sativa
tcaccctcgaaccaaacgacgaacgacgacggccggcgacggggtctagcggcggcgcggcttcggtcgacggcggcgacggggctccggtgatcagcggcttcgggggtcaggcggccgggcttctccaccctcccgcgcaccttacggcggtgacagcgaccggcggcgacgacggaggcgacggcgcgacgcggatggagctcggccggcgacgacggcggggtggagcacgtggcggcggcgctacgaggcacggaagatcacgggagagggggcaaacgaaagaggaggactagggggtcctttttatagccttggattgaagagatcggactcctcccgcaagaaatcgatccgggaaatcaaaaactcggttttggagataaactcgaaaacgagttcgattcggatgagatactcaacgattagctccgattttttgggggtaaagatagaggaggataagaggaatatttcccctcaactaattttagaaaaacacaaggggaaaggtcagatttggaggagaaaaaccgagccaaatcggtctcagttcggctgctagaggtagaagataaacagtgtcgagggacgcaaattagacttttcgtcttgggctggctgaaaacaaagcaaagaaagaaagagaagggggaaactcggctgggccgactagggctgcacggccgtgcacacaaaagagggagatcggccggaaagggcccaagactaggaagaggattattattacttttccaattaaaataatcacttaaatgatctttgaattgttaaaaatacttccaatgctcaaataatttcaagaaaaatcctgaaaatacttggacactcaaagtacttaaaaaaattataattagagcatttaatgattaatttaatatgtgggtaattactgaaatgctctttgtatgattaaaattaggaattgagctccgaaaaatctgagaaaattccagagagtataattaaccatggataatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacatatttcagctatgaactcgtgtgtaccagactacttgatccagggaaatggtactgtttacacgattgattcctgttataaaaacgggggtccacagagctggtatcagagccatacgactgtaggaaaagaccaaaaggcgccccaccccttttctaagttggcgaagggagaaattcccatttagtaatactttcaaaaataaaaacgctatgcttacaaaactttgtatgattttcatcttactcttaactattttcttcacaaaacgagttttactcttagttgaccttgggttttttaaaattagatggcagatcaggattcacccgctacctgggaga

SEQ ID NO: 2901 - DNA, 364 bp, Oryza sativa
tttcgtgtgtgtgcatttggtatttcagctatgaactcgtgtgtaacagactacttgatccagggaaatggtactgtttacacgattgattcctgttataaaaacaggggtccacagagctggtatcagagccatacgactgtaggaaaagaccaaaaggcgccccaccccttttctaagttggccaagggagaaattcccatttagtaatactttcaaaaataaaaacgctatgtttacaaaactttgtacgattttcatcttactcttaactattttcttcacaaaacgagttttactcttagctgaccttgggttttttaaaattagatggcagatcaggattcatccgctacctgggaga

SEQ ID NO: 2902 - DNA, 1501 bp, Oryza sativa
cctattcattaattaacttaaagatccatttactaagcatacacttattttgagtctctaagtcctggattcctagccccccacatttctttggcttgcagagcacactccacctagccaatctatattttttttatactcatcgcattgccaaatacgttatatatctataagataaatacgttatgattctacgtacgtatatatgtgtgtacagttctatagactggtatatatacatatgtatcgatgatggcatgatccatgatgtgcttgctatatacagtatctttctcattgatgatttgtagtattagtttccgctagaggagtactccctccgtcccatgaaaaaccaacctagaaccggattatgggacggagggagtatgatgtttcagcatttgtttagcgcgttgtatatatggatatatatgtacgtatggtggtgtatattgtactgctttgtttctttgatagatcggtgtaccggacctacttatgtatgtttatttggatgagtatagtttgcatctaagtacttccctaaacatctatcatagcttaattgtttgtcccacaaagaaaggtgtgttggcgaatatgatatttgtcttatgtatacggcggacatggattctaataattcgaggggatatcccgttgttcttacatgttattaaataactattaatatatatatatattttttaaaaataataagatatattgatatgagatatataacttcatacacaaattcgatctccataaattgtaacaaaatagcatatgtgtgatcacagccatgtttgatttttgttttttattatgcaattatgcaatttgtcataattatgcttgcatatttatggagtaatatatgtttattattatttttaaataaatatttaactgaatctaatttcaaacgtcaatatatataatcagaagaagtgaaaggttactggcaaatgacaaatgggataagagaaaacaaatttcaaatccttttacggcctatgccaggagaaagagaagggagatgtggagaaattagagatggagaagaggggcgagaaagatgttagaggaagaagataggagccttacatgtgggggctcaagcctactcagctatgttgactacaatcaactctccacgtcaacaaaaactagccatatatatatatatatagtaccataagacttaatttaacctagttttacaagttaggagatcaagatttctgatattgcggttcagggagctagccccgttcgaatatgatggaaggatgaagattaagtgcgcacgtaaaataagacaagtcattagcatatgattatttgagttttaattattaaaaacttgaaaaatggatttatttgattttttatagcaacttctatgtagaaagttttcacacataacataccgtttaatagtttgaaaagcatgttaacggaaaccggggaaaaatctgtaattttttgcagt

SEQ ID NO: 2903 - DNA, 583 bp, Oryza sativa
gcccgtaggtgtagtacaccaaagaaaaatgtcaaagtgcgtgtttaattggtgatatgtcaagattgaggagtgggtgacaacgtggagtagctttgaagtggatcatacagtatactattcaacatggtacggatcgtgcaaatgtccccatctcttcattttataatctgtcaaagatcgcagctacttgttggcacgacgttgatgaaacttccaaagtttacatatttagtatttcattactcatttcaagaggtatatataaggtgtgtccagacttcagacttcagacttcagactgctcgagtcgttgctaaatcgctattaattatgggttgactcgtacgtcagtgggtaatgcagattgcaaccctgcaccaatcaccacagttatgatagtctagtctatcggtgtcctttgcattgagtagcaaagaaaggatcacttgaactgaagtttcatctgaatttgcaccaaatggcacacctatcactttgtcaaccatctcatatcttggtttctgatcgatcatagtggttctaacctggtcggattaattttttggcaaatgcttcaagg

SEQ ID NO: 2904 - DNA, 1501 bp, Oryza sativa
tttctggtattgcggttgagggatacgatttagattcggtggtcaattgagggagtcaaggtgatcttattccggtgtatgacgacgtcgtggtttgggaaaaagtctactttacatccctcatcgttctaaactgcaaaaaattacagatttttccccggtttccgttaacatgcttttcaaactattaaacggtatgttatgtgtgaaaactttctacatagaagttgctataaaaaatcaaataaatccatttttcaagtttttaataattaaaactcaaataatcatatgctaatgacttgtcttattttacgtgcgcacttaatcttcatccttccatcatattcgaacggggctagctccctgaaccgcaatatcagaaatcttgatctcctaacttgtaaaactaggttaaattaagtcttatggtactatatatatatatatatggctagtttttgttgacgtggagagttgattgtagtcaacatagctgagtaggcttgagcccccacatgtaaggctcctatcttcttcctctaacatctttctcgcccctcttctccatctctaatttctccacatctcccttctctttctcctggcataggccgtaaaaggatttgaaatttgttttctcttatcccatttgtcatttgccagtaacctttcacttcttctgattatatatattgacgtttgaaattagattcagttaaatatttatttaaaaataataataaacatatattactccataaatatgcaagcataattatgacaaattgcataattgcataataaaaaacaaaaatcaaacatggctgtgatcacacatatgctattttgttacaatttatggagatcgaatttgtgtatgaagttatatatctcatatcaatatatcttattatttttaaaaaatatatatatatattaatagttatttaataacatgtaagaacaacgggatatcccctcgaattattagaatccatgtccgccgtatacataagacaaatatcatattcgccaacacacctttctttgtgggacaaacaattaagctatgatagatgtttagggaagtacttagatgcaaactatactcatccaaataaacatacataagtaggtccggtacaccgatctatcaaagaaacaaagcagtacaatatacaccaccatacgtacatatatatccatatatacaacgcgctaaacaaatgctgaaacatcatactccctccgtcccataatccggttctaggttggtttttcatgggacggagggagtactcctctagcggaaactaatactacaaatcatcaatgagaaagatactgtatatagcaagcacatcatggatcatgccatcatcgatacatatgtatatataccagtctatagaactgtacacacatatatacgtacgtagaatcataacgtatttatcttatagatatataacgtatttggcaatgcgatgagtataaa

SEQ ID NO: 2905 - DNA, 1501 bp, Oryza sativa
attttcataatgtatcatccttttacgtatttgtcgttttttttaaaaagaagatacgaatggtcaaagttgaaatatgaataataactgatgacaagtacttgggaacggataggaagtacacaacatcagccatcagccagctgaatctctgaatacaacaacgagagtacgaaactctgaaacatcacgatcctactatatcacatcacaccagccggggctcaccacgaacaagatcacacgcaaaacgtcctacacttcgcacacccacgcgaatttgattcagatcactgactgccacacgcctgcacggggtgtaatctgatcgtcatttttcatggcttggcctccggctccgggaagtggaactcgggcttcggcggcaactcgaacttgggcaatggcggcagctcagccttgggaatctccggcacctccggcttgggcagctccggcacggcgaggtgcggcacctcggggatcttcggcagctccggtttcggcaactccggcacgacggggtgaggcagctcaggcaccttgggcagctccggcagttcaggctttggtatctccggcacggcggggtgtgccgggtgctcctcctcctccgccgccgccgccgccggcgcagcctcctccagatacctcgccgcgccgccgatggagctgcacgagagcagcagcagcgctgccgcaaggaggagaatggatggcttggtatggctggaagccatgtcgaacggtttgcacttaacttagctgatgaactctgggtgagtgtgtcagtgagaggttactaggcactagctgatgatcacttgatcagtctgtgtgaagatggctgggtgagaaactaagaagacgatgctggcatttatagtgatgaatgggagcttagatgcatcatcaatttgcaggagtctctgatctttggtggctggcagcagtggcaggtgatctgtattttggtggttgtttactatggtctgtgtctctgatctctgatgatttcagtttcatgtactatggtttagttggttgggattattgagaccctgaatcgtttggttggtgaaaatgcaagaccatctatgtctagtttaggagtgtatatacacctgcactaaggacctcaggactacagctgggaatgaagcaatgctgacaacatgtttgattgtttggttttggttgttctgaagtgttgaaaatggacagtgtcatagatatttttgcaaggcttcctttttaatgctcattcaacaaatttccaaatgaagtagatagttaacacttcaattaaatgctgatatgagtatgttcagtagcaagcaagtttagcttacatacaatccagttttataaatttggatatgagtaatgctactaatatttaggttgaacactttctttgaaaaaaaaaagattcaggctgaagatttgaagattatatgtgtttatttgtattgaaaatactagcttaacaaatcttgct

SEQ ID NO: 2906 - DNA, 1501 bp, Oryza sativa
ctctaaccaaacagaatccaaaataagatcaacccaactgtttcatgtcatctcaacctaaaggttgacagattttgtttgtttattgtaatatttttgtataacaagaccataaattaaagagattcattgttcattttttgtttatttaactcagtattcaacaacgatttgttaacgtgattaatatttcacttattacaaacccaacaacttatataaaggatgtataccttgggcttataaaaggatttcttcatgcaaacaatcctcaccgcctcgaagtaggccactgtgttgatgttgaaccagaagtcatccactcttccctgactggttttcgatgtcggcgatgcggggggggggggggggcggtaggaggctctgcactggcaggcggcagcagatcttgtcctcgtcgacaaagcagacttggacgaggaaaaaaattcttgcagcagtgtcgcaccatgcctcatgtgcgacaccgcgtagacagctgacgcatgcatccaagccttctttagagttgagccgatgtgttgaaagactcaaaacaacaaaccaagccgaaaacttggggagccgctgaccccccccccctgtctagggatacatcgagccatcctcttcccgtcgcacagccgccggcgggggcaccatcatctctccaccctgagatccactgccgcctccatgcgtatagcttttgcacttctctccacagcctaaaatccaatccatcgattccaatttcacgcctccaacagaagggaagaagaccatgaaagggagaagatgccagatctgttgaagcagatctgttgaagcgaccttgaagggtgattcatggcttgtctttgcaatgtatcttcttgaaactagatttggaattgacgttctcaacagtctagcacatatataattcgcagaaggggcgctgtcgatatatccacattactcactatcttaaccttctccaactattttggccactcgggagatggtgttgtttctgaatttctggtgtgaataaagctctttggaaattttagtggtaatttgctgagtgttgctgaaaatggtgacttgttacacaacttttttattatgcaggaaaagagaaaggaaagctagcagcggccagcggcaattgaggagctggagactctgatagtctgtccagtccaggtaggtggccgcacggcccgatcaccagttcaccaaccactccaagggctccgtgcacaccccgctgcatctcgtcgcagtatgggcctgggccgtaatgtgccgcagctaaacttgccagcccagcccgttctgatgagcgcgagacactccagcctatcgagcggtcactactcactagcagttggaatttggacagcagcagcagcggtgagcgcggcggcggcggcggcggcgacttgctctcctcctccccacagtccagttcttacaggagacgaacgccggcgagccgcctccgccgcagcta

SEQ ID NO: 2907 - DNA, 1501 bp, Oryza sativa
aagttggtagcctggttgtaggagtatttttcttatattgtattaatttcgtattataatacaccaggtggatactaccttagtccatgccaaaaaaatgcctagtacatgtcgctatcgccataaaccagagagatggaagagatgcatcagcaataaacattgggccgtacgatcttgcctgccatttacttttactctatttaatttaacaagctgtagttaaacaaactcataaatatcctgaggtggcccccgctcgacctcatctcgccgactactagtcgccgactggcccaggggtaatctcgtaatccctgagtcctctgcctcgctattccactaataaatgtttgtattttcaatatctggagtttaagcaattattaattttggcatttgaaacgaattaattttggagtagtatttattcctgtctagcactggtgggaggaaagatggatttagacatgaatttttaaattttaatcgaacaaataaaagaaaaaaatgatataaacacaaaaagaatctcataaacttttacaaaacaatgttactacatttcaattttccataagaaccaagtgaataaatcaaatataaatatttgtttgaagcactccctccatcataaacaaatctttaacatcgagtatatgatttgataaattttatattaaaataaattaataaaatatactcctaagtttgtaatattatgtacctcttttcgaggcaagtctacctaaaaccatttatttgttattattttttaaacaaaatattaatatgtggaattttgtggtaccaaacataaaacaaattttgattggagggattgatatttataagaatttttaattactctctctttcaaaaatataaacctaagattgaatgtgacatagcacctgtttgaattgatgctctacaaaaatattgatagcgccaaatcttgatcaaattttgatactaccaaaactttgatagggtaaagttaaaaatgaactggtttgaaacaaaaatatgctcataagagacaagttcatgggcaaagatagtgtttaatagagatgtttgctttgctactctcttggtagggcaaattttggtaaagtagcaatccaaactactttatccgttgccattcaaattttgtctaacaatacttgtcactctaaaatactacttatcctatcactcacatcttatttaaattctttttcttctacccctcaacgacctttccattttcaacaataaattatttgataaagacattatagtattttatttttttcaaatcttaatatgttaaacaactagaaatatagatatagccctgctctaaacaaagtgaggaaaatggcgatgaccaaaatgcccccgttccccttccatctgtcgtctccttcccctctctctatctcccctcgcctcgcttcctctctcccccggcggtggctcggctggttcctccccgctccgcctctcctcc

SEQ ID NO: 2908 - DNA, 1501 bp, Oryza sativa
aagggtctgcaaccacctaagaagccagtaatttgagcatcaaatgacaagaacaacctttgaaacctaggccttatttctggctcaggtgatacttcgcacttaacaaaaacattgcttcccggattagcagatagcacagcatgagcataatcttgaattcttttaaactgcaaatcatgatcgcccataactttcttgtaggcctccctccttgccctatatgccttacttatgctgacttctatattggtatctcgcctgacacaatcttgaaaggcatgtgcatcccatttcttctcagatctaaagaattccatgtattcattagtaagccatctccagtcaagctgtgctatattgtgtgatttcccacagctatgttttgaaacatacttctttattttaaaggtgtcttcaccaggcaattttgaagcatatatgtaccaaggacaattatctgccttacacttgacagaaacttgattcctatcattcttgcccttgaacacctccctcccctcgttgatgatcatattcttcaaagcagctctgaaaagatcaacattactgaacaacatgccaacttgcatgtgtggacgccgtagggtggactcatcaaaaatgatgtcttcaattcctcttgatctgtgcacatagataggtgcttcgtcattgaaatctattgtgtcatcattgggctcatctgacaaataatccacctcagctgattggcctatatccttctcttttctcttgttagtttttttccctactagttctttttcctgtgtagtttttcccggatgtggttctgcttggttaacctctgcatctatctgactagtaccatataggtcctcagtatcagagtctccttggaagaacattactggctccttgccaatagcaggttccttgccttttttcttttccctcaactgttgctgtacatactcttcatgcaatgtcaaatcatctttatcaaaatcacctgggacactgttatgatgtccgattaatgggatactacttgggcttacaaaccttgatgtgcttccattatcagtcactaattcctgcggccttgcaaaaatgtacagtgagcactctgtttccgtcttatgatcatccaacatcatcttgattttttcatcatttagaatcagtacaagaccttgtggagggacataagaaggcttcaagtagtatacaccatctcctttttgatatccatgtataagcaatgactcctccaaatcgatgaatttcagagaatccctgtctaaaagatagatcgatgaacaattcctttccccaccagatttcctagggcttccactagttgtacaaccagtatgaacaatgaaggaaatactagttcgacccatctgcagagattataccaatttattggtttgcaacctaaatcaaagagcaaatattcgattatctgaatctagtaatacaacaattacatgcataaaacatgatccgacca

SEQ ID NO: 2909 - DNA, 1501 bp, Oryza sativa
tagcagttaagaagtgcaccatagggtttttctgtcttatctttatctggcaggttgttgaagtaagtctcggctgcactgcttccatgaatttcaccaatcaaatccaggtgaacagcgtgatcctttggcagaaattttacatgtcccttggcattcatccattcagagacctgcgcaaagtaaaaggttacagagaaatcaaattaaacatgccaactaggaagtgcacttgattattaaaataagaagccccaatggtgataagctcttgaggtctggagtgtaaattatagatatgaatcagtgttgcaaccataattgataagcacattatattagtgcttttaactattgatcaggtttcatttcttggggaaaaaaacatacaatcccatcacagaaactaaaccaaatacattaaccgatggaacacttagcaatcagtcaaatcctctaattggatgaacactcccaactcccaattgacaacaaactgtcatgcaagcctcctcatgatgttcagttgtacacagccaatcgccagttcttcataacgcccaaactatattaacacgacgctactacatctctcttcttgttcatggtgcagcattacatcatacacctcacatgcatgaagagggccaacaatttggcgagtgcaactcaagaaaccaaacagcggttgaggccgcaacggcatcgaacgccccataatagtctactgatgatgagctgagctgaggtacgggccacgggggggggggggggggggggggaaaggtggagttacctcgagggcctggcggtggcggcgtcgcttgcggagctccttgacgatgcgctcgagctcgacgtggcggaggcggttgcctggcttggccgcccaccgctcgatctccggcaccaggagcgtgcccgggtggcccagcggccacagcgtggactgcaggctcgggggccgcgccggcttcctccccccgctgtggccgcgaggagaggcgggggaggaggcggcggcggcggctcgaatgagggcaggggtggagccatgggatcgcgcgtggccggcggggaggagcctgccgcagccgaggcggatcaggcggcggccggcggcgaggaaggaagaggaggcggccatgggggttaactggggttttcctcccttttgggcctcttgggttgaaggaggtgatatgaacttgtgaaggttgctcaatttgcggaaaaagtacaccgaaaggtccctcaacttgtcatcgaattacaaaatcgtccttgaaccgtaaaaccggatataaagcatcccatcttataaaaccagtacaaactaggtctcttggtctcttgatggttttaactccggttttgtctgatgtggcagctgactcagcgtgggacccacgcgtcagcctcttcttccccctcccctctccacctctcttcctctctcctctcttcttcacgggcaccggcgggggagcagctgcacggt

SEQ ID NO: 2910 - DNA, 1501 bp, Oryza sativa
agatgatgagtcacctcactggctgatgctgatgctggcgtgtatccaacggatctctctcttgcttaaccgtctttttagctgaggtaggacagtgcctttgattccttggtcgagctaactgatggatcaatgacagctattagcaaaggctgtttggattgtaatttaagcaatgagaggcaagagaccaaaaaacagtactaccattattactactgctcgttcttgaagaacgatttaaattttagttttgctgttaggggttgttaatttgtatctcaggttttgttaaagctggtttaccttaatcatgttttagatcaaatcttgtttgtttggcataagagaattgtggatatatataaaaaaacataagttctctcaaagtaaaaaaaaatgttttattcccttcgctcttctgccttttctcttgtgggccaaacagaggatttggattttacataaatctacggtaacagaataataaccttaaacctaataattcgtataaaacttgtttttacttttcccatccaaacaaccactaaagacgtctgattagctcagtacttaaaatacagaaccttatgggattttatcttttttctttttgaaaaaaaaactactccctctatccttctctaaaagatcttatttttatctatacgtttggagtatcttttactccctccgtttcacaatgtaagactttctagcagcatctatatgaatatgggcaatgctagaaagtcttacattatgaaacggagaaagtaatacgtatctaaacaagtatttgcctagatgtataaccagaaataatgtcttttaggatagagttaatgtgcagttaattactccctccattccaataaatacatgaatatatccaaaatttatttaaacattgatttttttaggcgaagtgagtattaattaggggtaatctctaatacatgagtcattaatctctactgtttttaataaagaatcattaaagatgtccccttaaatctctataagggttcttctgcgcaataatagcatgtcctttaccatttgaaattacccctcaattgctgaccagatatttttaatggctcgtttaattgttaaggatcacagtggtgaaccattagatattaggctctgagtagaagtacgtgacttgaagatttgtgcgaacctttcaacatgttgaaattaatccactaggtaagggatttattggggtgccggacattaacagagggggagacgaccaataaccgatggtgcattaattggtgtggacggtagaaagagcattcacgtacgctgccactcggtaatgcttgaaggagggcaatgcatgggtctattccctcggtcgaaaaaaatgaacaaacatttgtattagaatatgacatatcctaatacaataaatctagacatactttatatttaaatttggtgtatcatatcctaatacttgattgatttattttacaccactaga

SEQ ID NO: 2911 - DNA, 1213 bp, Oryza sativa
gtaatcttgtttggcctaattttacttgtcaaattttccaatatacatctgctactgggtcaagcggtggatttactatatttctttatttctttatcactaaatattgtttttgttcatgcacaaatgcttataggtcatctcaagtatgaggataatgatgacagaagactcgaataacgcagtgagcagttctttcttgctggacgatgattcaaggtttattcccttacaccaaacttcaacaaaagtcaatcacacctgaaaaagttgttctctaacgttggccatggtacttctgattgcagcattccgttttcggtggatgatatctcaaagtcaatgaaagaaattgaggtaacagatgttgacatgccgcctttgatcagggagaactctggctttaccttcctacactaaagaaaggactatcaagagtggtgatcctttcaatgcaaaacatcttcctattctccttttgtccaactcatctccaacttgtgcataactcatgtacatactactcgtgcccttttgcccttttaccaaaatcacatggtctagtctggtcagtaatcgttaggcctatttgttatttattatttaggacttcggtttgatttgattggtctttgtccaattttctcccctttttttctgggggatcaaatttatattgtaatgggaggggccggatgcccctccctggtcaggtccccgagctttgttattggaaaagctcgtgttcctcttagcgtctggaaaaggttttccgcatctgtgtcgggtctccggtgtcgttcatttcaatcttcaccgtattgtaaattgcaaagaagatcatagttgaaaaaaaaatcacattggaaaactgaagcttttggtgtattgtgtgattctgtctgccccaattttcatccatttctagatctctttgatcagggatgcaacttagacccaaaaaaactagatgtctcgttccatccgagaatcccatcaagagatttctcaaatatataaatcacccacaggaaacatcaaccccaaagaaaagaaatgccgaaatgaacaaatgatcccaaatgtaatgttggcgtaccaggtccttgtcgccggcaaggcaatgtttcccgtcaatgaattccttggtgtgcatgtcgttacctctgccaccgcgcaagagaggttgggagacttgggagttggagggaga

SEQ ID NO: 2912 - DNA, 659 bp, Oryza sativa
gcatatctcatgaagcattcaaaaatgacaatgacattgaaattgaagtagagtttcctaaatagtttagaaaagtagaaatgagtgtgtagcggggacgtgcaatcagttgttcttttcttgactttaatcgatcgccagtgtgcataataacagtcgttcatactgaacaagacgtacttatctgctagtcctggcctcctggcatcgactcgaacaaggagcaaagttaataacaacctccaatttcggggcatacgtgatccgaatcaaaaacctacaggatgctgatgcataactcatcttctgtttgaagtgtctccgtacaaccaagatcatatcaccgatgaaattattcacacgactctaattaagattcgacttatgtattttagttttttttccggtgatgaaaagttgtcatttgaatgtgtaccagtaccaaatcagtcctctaaacattagcatatactccctccttcccaaaatataacaatttatccaccaatattctcttcccaaccaatcacaatcctccaccattcactttttccacctatcttcactactcattcaatcacaatcttccaccactcacttctacctattttttttaataattgggtataaccctaaaacttcttttatattcgggtagg

SEQ ID NO: 2913 - DNA, 906 bp, Oryza sativa
cgccgccgccatcaccggatatggacgagaaggggaggggggacggccgcagtccaccgctgccaacacgcatgcggcccccagcgccacccaagccgtcgccccatctggatctgacttagctcacgatggtccactgtcagctacttatctatttccctccatcctcagctaagttcacagtgctgaccacggtcaaggtgccacgtcatcgaataccgcccacaatactaccataggagtcgatttgtaccggttctagtaattgggggaatcgtcctacccggttttctagttaagggtcacgaattagattcggtgaacaattaagggagtcaaagtggactttttcctagcggcgccgtcgacaggctgacatgttccatgggatgggccgccgactcacccaaccgcgcgcatccccgcggcccaaaccaaccaactgcctactcgcgcgctggagctcacacaccgcccccgcggccgcgcgcgtccgtccctcttcccttccccttatccgctccgctccacagcctcgccccgattcccccctcgtgatttcccccttccgctcgctcgcgccgctccctaccggccaccaccgcgcgcgggacaagcaacctagctgctccggctgccaagccatcgccatggctccgtgccccgccgcgaccacgtacgtccgctgcacccagcactcctcctcctctctgacatttatcaccttatcaccttttgcttctctccctctctcgatcgtcagaactcgcattggggcgccgccgttcgccgcgacgacggctcgccgacccgcccggggcgcgacgacgacgacgaaggcgcgggcgtccgggctgcggcaggtggagggccccgtgtcggagagggcgtactcgtcctcctcgc

SEQ ID NO: 2914 - DNA, 1136 bp, Oryza sativa
ttattggtgttcagattcatcacatcgtttgctgttttcacatctggcacgtttgttttgatctattaagcgtgataaactctctttacttaggagtacgtgtgattgatatcttaattggtatcaactgctatgctgaccctatcattaaagtgcccttcattaccgtactaatactggagtagtataaatcttgtgccaccacctccagtttttaaatacagtatatggcaatattgtcaactgttatacatgatattcaatcattcgttttactattaattttttatataaatatcatccattcagttatgatcttattaccattaaatatattttaagtatgaattatagtttttaatattacattaaattgttgaacatgatgaatattaaaacatcgtgtcaaaaatcatcgcatatttaaaaactgaactagtactgttatatacttgaattgcacctttatcccaaaatagttatatagaacgaaggttgtacgcaccgttggatggtatgtacagccattttttattatgtacaaattctaaccaagataatcctctcttatatgcaaaggtaccatattatcatccactaacaattactattacatttaagtatcgtacatgtattgctgtaatatttataatttaataatttattaaattttagagacttaaaatgtaagcatgtcaaatcattccacataattcatataatattttaatatatctcttcatcgttttttctatattatctcctatacctatcaagttcatccccacttagttcatgttacttatatttttctctcattaagtcatatctcatcaattgtttttaatttttaatccttatatgattattaatctttggttcaaattatacctcttcttttcttctctcattaagccatataatctcaatttttttagccgttagatgtatgatctaaattatcttccttcttttgttttctcataagccacatcatcttacttttacatttgaatcatcattctatatagtaattaaatttaaatcacatcaacttatgtttatgtaagctcatattgtttaagccatcttatacattaattttacttattattatcgtattaaactctcacagg

SEQ ID NO: 2915 - DNA, 1501 bp, Oryza sativa
tttcaatacggttttcagatttttattttattctatgatcctaataaatatgaaattagtatcacatgaaagtgcttcaatgtatgaatctagtgatatagcatgcataatacttagtatagatatagttagtatgattattagtcaaaagctacccagtttgattttccttaaaaaagggcgtcctataatttgggagtaatgtttttaaaattttgacaggatttcctatatatttattaaaatttgaaaaaaaaaactaaatggatgcgcaaatttagcaactctaccaaaagtgatatgatttaaagtggcatcattctgaacaagcccataggttttgtatgtctgttgaaaagccgcagctaattttcaacctttttttaaaaaaaacaaaatttagcgtgtttatggtttttacccttgctttttaaaatatagaataaaaattttagattatttgttttcatcggatctaattttctacttcctccatctcagaatgtaaccatttttttaggtacgcacgtgtattaagaaagtaggtagaaatgattggaagagggttgtgattggtggagaagagaaagtagacgaagagaatggttgtgatgggttgagaggagagggtaggtgaagaaatagctttattttaggacaagttactatgctagaaatagctatattttggacggggtagtatatatttccaatcagtctggcccaccaatcatgaatcactcgagtcatcttgggtgtgctctttcacaggtttaaccttatgatgtgaccattgtcagggttatggatactacatacctaatattagttgattaaatttcgacagaatccaccacataccatgtcttatacagatacaatcctcggatataggaggagttccggataaggaaagacaaccagagttctatatgaaaacgacaatgactactcggattgtatccatattgatttctctagttctacttagacaaggaggcatctatggatataaatacaaggccccctaggaggagaggggacacaatcaacatacacgaaacaatagatcaagatagaagatcaacatagaagccaacatacaccaagataagacaccggatatcgacttcagagataggcatggctagtccccgacggtgtctccggatactgataggagagacattgcgatgtctctgatctcgccggcacgaactcgaggaggaagactaccctgttgtcgactacgagtcagacctttagactgccatgtcaacaacagttagataggctaccccaaatattgtactggtgtgattatggtgaataagagcaataccggcttcggccaacaggatgtagggttattaactaacaattcaggggcccgaacctgtataaaaatcctcgtcactgtctcttttacctcagtctcgtatatatcctagtaccaacgatccccatactatgaaaatacccaaatcgcgacatcaaacgt

SEQ ID NO: 2916 - DNA, 1501 bp, Oryza sativa
ttaccaacagctagctttcaaaacgaccttaacctcctaacaattttattttttggaaaaaaaatgtagtactatgctatcacgcattcgtctacatcatgagcaattgagcatgtatagctcaacatcaagaatactgccccttaacctgaaaggtctaacctgagtgccctcctacacctacaaccgataatgaaaaccgaaatcttacattatccttttattaggggataagcaaacatcaaatcaaaggaacaaaaaacagttattttgaattcgcaagtcgcagaatcggaagaaaccatagatagtaaaaaccccacttcaagctcccaaattgtcgaaaacacaagctaaagaacacatggtaccttacatcacatcacatcaaagaacagggtgatcgaattctacatctcctagagtctgcttgccacaacattaagctgcgtttacccacttaaaaccaatcaatccatcacattgcgctcgaagaaccgaaaaccctaacggggcccaaaatcacaagctacggaggcgaagcattagatagatacgcaggaagagagaatgctcggggcgacaaggggggaggagacttgcctgagcttccttggtaggcgcgagcggctcccactgcccgccggtgtcgctctcgttgatggccgcgatggagaactgcgagcgccgcggagacgcgcgcgcgagagagaggaagcgagtaaggaataagccgaccggaacatggagcgaggcgcgcagccacacgcagagagagaggtggagctcaccatggccaactccggcaggggaggtggccgcgcgggcttcgccggcgacgagggctccctccagccgaggagcggtggtcgccgccgtcttgcggcgaagtgatgcttcctgcgaataattacgggtttgccacggcttttttttttaccttttgatgttccatcttctcgtgggattgggcctatgggggaaaacctacccacagcccacggatcaaagcccaaggcccatcgccgcctccgctcgtcgccgcgccgccgccatcttcgctccgcctcgacccgtcgccgcaccgtctccgctccgcctccgctcgtcgccgccgtctccgctccgcctctgcccgtcgccgcgccgcctcctccaagcgtcctcacctgcgggtgcagcggggccccggaggggccggggccggggatcgatttcgacccgccctccactcctgggccgggggcggggccgttccagaccaacccggccccgacccgccccattgccatcctactacacgagtgacactaggcgggagaagccgagaagtccagaaccctagtctgccccagcccggctcgtcgcaggcaagcatcgcggcggcgcgggcacacctccgccgacacaggcgccgctcctcctcctcccttctcccctctcgtttcttgcggccgaggagtcgcccccaactcaggtgaagtcacgatgagcatctcgg

SEQ ID NO: 2917 - DNA, 1501 bp, Oryza sativa
aaatcatctaaatgcagttgcaccaaacgagattaccataatgcacctgaatgccaaatggagcataagataaacagtaaaacaggcaaaaagcataatactaaaacagaagtgcactcaaaataagttttccggatactaataaaacagaagtgcactcaagagaagtgatccagattgtagctttgcttaagagaaccaccaagacaccaacatcaacaaagcaaatgtcaaactacgccccatgtaactccaacaattatataggcagtataacagcataatagtaacacagaaatgcatccaaaataagtgttccagcttatgtagcccccaatctattgcccatgattgtaattctgcttaagagtcgaactcatgatattctacagaattccaacagtattggagaggaaaatgttatattctacaaagcatattgagccttagcatgcaacatacccatcccatcgtcatcctcatcatcatcccggtcagggagatctgaaaaacacaaccaataatagtaagcaccaagcaaagcagaaaacagatagatggatagtactactactagtagtaatacaaaccttcctcgtcgatgggtatctcgtgtatgatgtcctcctcattgatgaacacctcctctccatcagagccttcgccggcggggacctcgcccgagatgctcatcgtgacttcacctgagttgggggcgactcctcggccgcaagaaacgagaggggagaagggaggaggaggagcggcgcctgtgtcggcggaggtgtgcccgcgccgccgcgatgcttgcctgcgacgagccgggctggggcagactagggttctggacttctcggcttctcccgcctagtgtcactcgtgtagtaggatggcaatggggcgggtcggggccgggttggtctggaacggccccgcccccggcccaggagtggagggcgggtcgaaatcgatccccggccccggcccctccggggccccgctgcacccgcaggtgaggacgcttggaggaggcggcgcggcgacgggcagaggcggagcggagacggcggcgacgagcggaggcggagcggagacggtgcggcgacgggtcgaggcggagcgaagatggcggcggcgcggcgacgagcggaggcggcgatgggccttgggctttgatccgtgggctgtgggtaggttttcccccataggcccaatcccacgagaagatggaacatcaaaaggtaaaaaaaaaagccgtggcaaacccgtaattattcgcaggaagcatcacttcgccgcaagacggcggcgaccaccgctcctcggctggagggagccctcgtcgccggcgaagcccgcgcggccacctcccctgccggagttggccatggtgagctccacctctctctctgcgtgtggctgcgcgcctcgctccatgttccggtcggcttattccttactcgcttcctctctctcgcgcgcgcgtctccgcggcgctcgc

SEQ ID NO: 2918 - DNA, 1501 bp, Oryza sativa
ctcgaatccgacgtgtcgagctggagcaccggtccacggtgttgcactgtgaaaggccttagtactgcatctacagtagcagtggctgataggtggacccaatcccacatatcagcggttgctactgaacgtgtagtactgcagacaatactcactgctatggtataaatcgaacttaccctgtattagtaagaaccccagtgttctgacactttaccaatttcaccacaattttacaaacatcaactcaaccattttttttggttacctttgacaattgttcatcatcaaggctaaatcaacaaattgatttcacagaagcaagatgatcgattccatgactaccagggatggatcctgatagaaatagtagagggatgaataaattagataaagcttcagcatctttcatacatgtatatgaaaaaaagatcaggtgagatatatatatgtagtcatgtatagatagagtgggcgattgagggagcataggagtgcttcacacctttagttttagctttaggttgttgtggtggtgcgtgcgtccatcagtgcacgtccttgtcttgcctctatcttttagctcattccatatttcgatgtatctaggccttgtttagttccaaattttttctttaaacttttaacttttctatcacatcaaaacttttctatacacataaacttctaactttttcatcacatcgttccaatttcaaccaaacttttaattttggtgtgatctaaacacacccctaaccgtggtgcctggcctctgcctctgcaatctgcatgcatatggccactcaagctggagtaccaaggacgcacagcctaccaacgagaacggttaggaatttggttgttgctgctagaaatgaatgaatgatcaatatcggtcgcatttttctcccaaggtagtagtgcatatcgagttaatttaatagggaaaagtatagtaatatatatgcatagttcaaatccaacgatcagaaatggtctattatatgtgttattactcaattaggacttctttgaaatacatatatataaatagaaaaacgtaggatgatttttttttctagctaagaggttaaagttcatgttagaatcccttcaaaaaaattatggtttaagccaatccaaatgtatatattcttataagttttagatagccattcctttaatctaaatgattatataggaaaaaactttatattaaatttcttcgaaaattccaagattacttgttccaaagagcccttaaatgggctgggcgttcggtggtgtacagcagcaagttctatcttattgcgagagacagaagaacagacaaggctctcctacactttatagctgccaactttcttgtgtgtgtctgtacacttttttttttcatcgcctgtactgattgcaatgcagcatatagcaacaaatatatgctaaagtacatatatatatatatatatatatatatatatatatatatatatatatatat

SEQ ID NO: 2919 - DNA, 1501 bp, Oryza sativa
tctattaaaagacagaggcagtaagatataccgaacatgaccatatactgaaatcagatcactgtatttttttaaagtagtgtcaagaaggctaattgacacattttctttcaatatatgtttatcctttatgatccaagcaattaggctattattttacatacgatgatagcagcatgtggagactggagagttgttgtgcatgcatgtccaactgatcaagcgtttgattcattccaggaaaaaaagaagcttctgtcacccaagaccggggaagaacctgatgcgtgcacgcgatgctacttatattattggtgctatctacagataatattggcacaaatcattatgatcgttataataacttcgttatagctatgcttaactacccagaattgacgtctccaatatatatatatatatatatatatatatatatatatatatatatatatatatatatatatgtactttagcatatatttgttgctatatgctgcattgcaatcagtacaggcgatgaaaaaaaaaagtgtacagacacacacaagaaagttggcagctataaagtgtaggagagccttgtctgttcttctgtctctcgcaataagatagaacttgctgctgtacaccaccgaacgcccagcccatttaagggctctttggaacaagtaatcttggaattttcgaagaaatttaatataaagttttttcctatataatcatttagattaaaggaatggctatctaaaacttataagaatatatacatttggattggcttaaaccataatttttttgaagggattctaacatgaactttaacctcttagctagaaaaaaaaatcatcctacgtttttctatttatatatatgtatttcaaagaagtcctaattgagtaataacacatataatagaccatttctgatcgttggatttgaactatgcatatatattactatacttttccctattaaattaactcgatatgcactactaccttgggagaaaaatgcgaccgatattgatcattcattcatttctagcagcaacaaccaaattcctaaccgttctcgttggtaggctgtgcgtccttggtactccagcttgagtggccatatgcatgcagattgcagaggcagaggccaggcaccacggttaggggtgtgtttagatcacaccaaaattaaaagtttggttgaaattggaacgatgtgatgaaaaagttagaagtttatgtgtatagaaaagttttgatgtgatagaaaagttaaaagtttaaagaaaaaatttggaactaaacaaggcctagatacatcgaaatatggaatgagctaaaagatagaggcaagacaaggacgtgcactgatggacgcacgcaccaccacaacaacctaaagctaaaactaaaggtgtgaagcactcctatgctccctcaatcgcccactctatctatacatgactacatatatatatctcacctgatctttttttcatata

SEQ ID NO: 2920 - DNA, 1501 bp, Oryza sativa
tacggcaggtgctccgccgccacgcgcgcctcaccgctctcccacctgctcgacacggtctccccgactggccttagccgcagggcttgggtcagcaccatcgacagtgttgccacgccacgcctcatcgcctcctcgccggtggcaccggcgtcgtaggaggacagtgccccgatggcgcgcagcgaggccgccctcctgagcggcaggccggggatgttctcgaggccgccaataaggtcgcggtaggtgttgcggaacgggagacgcctggcgttgtcggggaggacgtcctcattaccggggaagacgtgccaatggccgcttcggttggcgaagccagcgaaggagtagtcgtgtttgtgcacggccaggtgcacggtgcaccacgtcgccgtcggcgcctttcatgctgacaccgtacttctccaccaccaggtggtggtctcgcccggccacggccgagaggaggaagaagaggaggaggagagcggcatggaagctcgccgccatggtgaaccaggacgccgagcaaaaacaaagctacgtgcaatgcaagaatattagtggtggatctagcatttaggatatgggtggtccgacctaatttttttttctaaacacagtaaatctaacgatactaatatatacaatgcaagtatagataatagaatagaccaaattgtaaaaaaattaccatgatatatcacaatgcataagagtttaataagattttaaaactaaaaattgaaaaacgtatacacatagaaaacctaaaattgttgccttgttggcgcgggcggctgatcagctcgacgacggctcctcgcggcggcacacgcacagcaggtcagcaccaatgtagtgccagccagacgcagcacagcagcggccaaggcggcagagtgcgggactcgcgcgtggcggcgtggccgtgggggcgccgggcgcgggcgctggccgctgggtcgcgcgtgccggcgtgggctggccgctggcgccgtggccctgccctgtgattggttgtctggctgctgatcgcgtcgcgtcacgtctgacgtggagtgatcagatgagatcgcggcgaagggcgaggaggactcgcgtcgcgtgatcgcgtgtgggcctgtgggcgccgcgagtcgggactcgggaacgacgggaggaagaggattagatcgctttttttccttttcaaaaatcgctattttcatttttcttaatatatacgggtccatcgccgtttttccccggaccaccctctatatccgcctacgatgaatatgaaacttcgcactgtcttgtgtgtggtcgttaaaaaaaaaaagctatgtgcagcgtgatattatagtgaaactgtccaacgaggagattatttcggcggcgccatgaaaaaagagcgtgtcctccctaccgccgacgagaaaagctgacaagagattttgtgtgaataacctgatgtttcatatgcatattagtacagatcatcacaatgaatttg

SEQ ID NO: 2921 - DNA, 1501 bp, Oryza sativa
atagcatgttttgcttgtgtgctttgtttgtcgcgtaggtttcggccgtttcgttgatccgcggtttctcgaagacgttgctgaggtctcatcagttcgagagcaaggcaagtcatgcaatacgtttgatcatattgtacccaatttaccaacatcctgcatttctattaaatgttgcattcttttacaatgtaatgtgggatgggtcctattcctcagccacatattggttaccttatgccattgataacttgggtatactacagctgttttactgctttcaactactgctttgaaatgcctgctttatgcaaaagaacccctagcttcctttggttatatcctgcatcatacctcatcttccggtatgacttgctgagtacagtgggtagtactcagtcttgctctcttttcccccacaccagagttgaagttcttctcagttggagccgtctcagagaggttggtttcgttgctgccgtcaaggtttgcctgtggagtggagtcgcccgctgctgaagtcaagcttcccggtttagctcgctttaatctttcccgctgcatttgtaatcttttatatttttgtaagacgtgggtctgtatgtcaacaattgtcgtttgtgtgccttggctggtcctggacagggatttaatgcacattcagcttagaaattctggttcgagaatttctgggtgtgacaagttggtatcagagccgaccttgaccgtaggacaagccaactggaaacctaagagccctctgaaccctttttttttcttatgcatatgcccttttgcacttggattttgtttcgggaaaattttggggtttgttcttttgatttgtgggaaaaatcttggtcgcttatttaattggatttctcgacttgggacagtctagggatttagtaaaagtttattcggaatttattcggcagtcggtcgggaattgtcgggtgatatgcattaggtcgtgtctatgttcaggtggggtaagtttatgcgtatcagtatgactatgcatctatttcatgcattaagttattgtttagtcagttgcattagtgtcttttgtctcggttcgtgaaaaatgttgttctatgcataaaatcatcatgctcggttatttatttgagtcttcttttgctttgtttaatttggatttgagcatgaattggttcctatcccttgtctactttagatgtcagtcctatccctcgtttgcaagcgccgccccgagcttcagagtcgccgcccttagctttatcgccttcttagtctgtttgcttgctagttttcgtgtttaggtttgttgcttgtgggttagtcggcggtcgatatcatgtgtcagtggtatgactgcctcaattaggagttgtgtgcctctttttcagtgttttaatcaagattaagataattgcacttaaattcataagaaagattagtttctgagccccctgtttttcttccttttctcatatttctacctatctccttcaga

SEQ ID NO: 2922 - DNA, 1501 bp, Oryza sativa
ggagagtggaatagctagtctgttggagctcgtttttttttttcaaaattaccaaattttagcttggagagtgagatagctatactgttggagatgctctcatgagacgagaaagacaacggtgtgggggctcctcatcgcggccggatcaagggggcgtgcggtggcgatggaggagagggccacactaaggggaaaaggaaaagagaatgaaggtattattacttgtgattatcaatcaaaaattgaattgtcaatcttaaacttagagttgattttgaggttttttttatcgaagtttattttttaacctttgatttaaatcgttaagaacacatatatagaagttttattcacaagttacatatcagttacatattgttgttacatgcaagtttatattacactatagttatactatatttacatttgattcttttttttaaggaaatctgtcgataaaatatcgcaaaatctatttcgagaggcatctcgatttaggcttaacgagcgacgcggacaattacgtgagaagtactaatagcgctacagacatgcatgcaagtagtttttgctattaggttatacattttttttcttcttatgaaattttctcttaaattacttatccgatctatgatccgattacaccgttgtgttcgtaacaattaaatctttacaacaagatctcacatgattatattttgatgaaaaatcacaaattacttttataacatgtctaaattacttttagattccactaagttacttcttagacatacaaaagtaaattcagtaaaggctaaaaataatttacatatattatagaagtaacttagaacaaaacaaatgtaactttggcatgtcatttgaaataaatccgttgtagagataaaaacatgactctatctagaaattaaattaatcagcacaaattataaaattaactaaaaacaataatgaaagtaatcacctcagagcattatgaatgtataggaagtattttaatcaaatctaaaagtaacttatatatgataattatatatatgataatttgttcaatgaaaaaatgtattaattaaatttactttctttttgttataagttaactctataatatatgtgaattacttttaagctttactgaatttacttttgtatgtctaagaagtaacttagtgaaatctaaaagtaattaagacatatcataaaagtaatttgtgatttttcatcaaaatataatcatgtgagatcttgttgtaaagatttaattattacgaacacaacggtgtaattggatcgtagattggatgagtagtttaagagaaaattgtgtttgaagtatagctaccattagctgtgtagtgatgtctatgaaatatgtagtaaaattttaaccggtgcttgccggtaggtgttggcctgttgggtgcgtaacaaaaagtgcgtgactgatcaacgaaccaatcacattcgttcttctccacccagtgctacaaca

SEQ ID NO: 2923 - DNA, 1501 bp, Oryza sativa
gagacagcgcggtgaaaagaccggcagctgcctcacgcgcggcgcaccgggatatttaactttttgctacactttcataatagagtaaactatacccacaatacataatttggtagctgtgtgtaatttggtgcaagaacatgagaaatgagctagtgccttttataatagagtaaattgcacccacggtacatagcttggtaggtttgtacaatttggtgaaaaacatgacaatgagcgttttagtgcaacgactcgacagatgggtataatttagtataagaagtttataagtgatcgtataaatacaacaactttcaaggtagatacgattttgatacaataagttaagaatttatatgataacttaattatttggtgtattttttatacatgtttaatttttaagtacttattttgacaatttactagtgtggatttgtttaagcatatttatatttttatcgtaacaactaataactgaaagtcaatataagtggatgtagaaattattatatatatttcggttgagatttaaaaaggtgaaggaaacaaacattattaaaggtaatgggatgtaaattggatgtgcaacgtaatttttaaagactaaaatcaatattatgatgtaatatccgtaggattgctgtgtaatggtatattgatatcgtgaaaaaaaaactcacctaagatatacttaactaatacttaactaagttgatgcaccaaaatactaataacttatcaagttcttgtactagaatacacctgcttttcaagttgttgcacttggacgttcaattctcaagttttgcactatatcacgcacacctgccaagttattgaatcgtatgtgcaatttatactctaataggtcctcatatgtgtgtggatctaatggtaaatttttaatggaagtagctatatttatggcgccatatttttcaccaaaagttagtcggcatgtatttatattgtaaggcactaaattacatatgtaattttagtgtatttacaatgtaagtcccaaaattacatatgtaagtactaaaattacatatgtaagtcacaaaattacatactaattacatatgtaagtagtgtgtaaatagggtgtaactactgtctaaatatactactaatatatactaattacatatttatactttaattacatatgtgtttcgctggtcggtacaaatactcatacttgatcgagtgcatgcagtgaagaaaaaaatagtagcaaagttctccagtagaccgctaattagcaacctgtaacctatgaagcacaactagttacgcgtaattaagtatgcgagcacgaatcctatgaccgatccaatggctcaacaagcgactgtaatcaaccagaaaatgtgtcgccaaaaatttagcaaaaccgtttttaattaccacgttaataaaaagtttaattattcccggcgcgcttgcctccgggctccggcgccgctcacctgccaagccactggaccgc

SEQ ID NO: 2924 - DNA, 1501 bp, Oryza sativa
cttttgtgccacaattccctcgggaacctgtgctttattgaaactatgacaaaactctgtccaagtaacttctgccccagttggacgggtcaccatgtagttgtcccaccaaatagaagcgggaccttgcagctggtgtgtagcaaaagcaaccttctcttgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgctgctgtgcttgctgctgcacctgctgcaacacctgatggtactgttgctgcatctgttgcatcatcattgtcatcatctgagtctgattgtccaacacctgagcaattgttgggttctcgggcggtggggacggactgttgtcagatgcactgttggcacgtgctccattgatcggctcttcgctgccactggcgttgttcgagtcgcgtgaaccattccttatctccatctgaaggagataggtagaaatatgagaaaaggaagaaaaacagggggctcagaaactaatctttcttatgaatttaagtgcaattatcttaatcttgattaaaacactgaaaaagaggcacacaactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgattttatgcatagaacaacatttttcacgaaccgagacaaaagacactaatgcaactgactaaacaataacttaatgcatgaaatagatgcatagtcatactgatacgcataaacttaccccacctgaacatagacacgacctaatgcatatcacccgacaattcccgaccgactgccgaataaattccgaataaacttttactaaatccctagactgtcccaagtcgagaaatccaattaaataagcgaccaagatttttcccacaaatcaaaagaacaaaccccaaaattttcccgaaacaaaatccaagtgcaaaagggcatatgcataagaaaaaaaaagggttcagagggctcttaggtttccagttggcttgtcctacggtcaaggtcggctctgataccaacttgtcacacccagaaattctcgaaccagaatttctaagctgaatgtgcattaaatccctgtccaggaccagccaaggcacacaaacgacaattgttgacatacagacccacgtcttacaaaaatataaaagattacaaatgcagcggg

SEQ ID NO: 2925 - DNA, 1501 bp, Oryza sativa
tgcactgttggcacgtgctccattgatcggctcttcgctgccactggcgttgttcgagtcgcgtgaaccattccttatctccatctgaaggagataggtagaaatatgagaaaaggaagaaaaacagggggctcagaaactaatctttcttatgaatttaagtgcaattatcttaatcttgattaaaacactgaaaaagaggcacacaactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgattttatgcatagaacaacatttttcacgaaccgagacaaaagacactaatgcaactgactaaacaataacttaatgcatgaaatagatgcatagtcatactgatacgcataaacttaccccacctgaacatagacacgacctaatgcatatcacccgacaattcccgaccgactgccgaataaattccgaataaacttttactaaatccctagactgtcccaagtcgagaaatccaattaaataagcgaccaagatttttcccacaaatcaaaagaacaaaccccaaaattttcccgaaacaaaatccaagtgcaaaagggcatatgcataagaaaaaaaaagggttcagagggctcttaggtttccagttggcttgtcctacggtcaaggtcggctctgataccaacttgtcacacccagaaattctcgaaccagaatttctaagctgaatgtgcattaaatccctgtccaggaccagccaaggcacacaaacgacaattgttgacatacagacccacgtcttacaaaaatataaaagattacaaatgcagcgggaaagattaaagcgagctaaaccgggaagcttgacttcagcagcgggcgactccactccacaggcaaaccttgacggcagcaacgaaaccaacctctctgagacggctccaactgagaagaacttcaactctggtgtgggggaaaagagagcaagactgagtactacccactgtactcagcaagtcataccggaagatgaggtatgatgcaggatataaccaaaggaagctaggggttcttttgcataaagcaggcatttcaaagcagtagttgaaagcagtaaaacagctgtagtatacccaagttatcaatggcataaggtaaccaatatgtggctgaggaataggacccatcccacattacattgtaaaagaatgcaacatttaatagaaatgcaggatgttggtaaattgggtacaatatgatcaaacgtattgcatgacttgccttgctctcgaactgatgagacct

SEQ ID NO: 2926 - DNA, 1501 bp, Oryza sativa
acctcaccttcatcctgtgagcaacgccatcgtttctcgtggtcaccaggatccggctccccggggcgccatggctaagcgggaccctgagcagctcgttccacgccgcgtcgctccacacgtcatccatcaccagcaggaccttcctgtgcgtcaccgcgcgctgcagggcgcgctccagcaggtccttgtccccggcgacggcgaggccctcgcagctggccgccccggcggcatgggcgatggcgctgcgcagcatcgtgacctcgtcggcgtcccggccgacgaacagccagatcctggcgtcgaagctctcttggaccgtggcgtcgccgaagaccatcctggcgagggtggtcttgcctatgccgccggcgccggtgacggcaatggtggggatgagattgcagccgccgccggcgtcgtccaggtccgtcgtcttactgacaaggatgtcggcgagcatcctcgtgtcttccgcgatcttctccccgacgacgtcggatcggatgaggcccagcgcggtgcggcggccgtcgcctgaatctgcgcgccgagagcagcaaggggagggagacgaggagatgatcctagtctgggagacgaagccgaagcgggagctcctcctctcgatgccgtccagcctccggttgagcgccctgaccctcttcccgatctcgcgtgcccggacggggtcgcggaagcaggagagggcagggacgcggacgccgcggaagcagcagcagcagcccgccatggcaacgggcgtcgcggcctcgccccccgcggcggcctggcactcgtcgaggatgtcgtcggcgtcgtacatggcgtccctgagctcccgcacccaccggtccacggccgcgtcgcggtcgcgcgccctctccgcgtcggagaggacggcgcgcaggtcgccgagcgtcgcctcgagcctggagatctcgccgggcacgcccagcagcgcctcgacctcctccttcgccgtctccgccagaatgcgtgcgaggctcgacgcgaaggcgtccagcatcgccgccatgatcgccgccgacacactgtgctgggaaaaaaaaaggaagagacggagagttgaagttgcttgcgccgacagatactcacatagtcaaaactccaaacctctgcgactgctccacgtccatgatcacgagtccacccaaaccaatttccatcgtgtttagttccaaattattcttcaatctttcaacttttctatcaaatccaaacttttctgaatacacagacttgtcacactttttccagtgttggcgtcgatttgtgggacccatactgctgcatttgccgatctatcagccaaccgttcctttctccattctattctccccgtgataaacacttgtttaatcagctgagttcgactcattttggggcgtcgattttcggtctgacacatagcagccgactccggagggtataagagcaagtttaatagcatatctcactactaactccaaatcat

SEQ ID NO: 2927 - DNA, 1501 bp, Oryza sativa
ataaattctcttctgggtagaattgtgttaatctaactttcttccccttcaaatgcagatagctacattgatagctgtttatgctaactgggcattcacttcaatcaaaggcattggatggggctgggccggtatcgtgtggctctacaatctcgttttctacttcccgctcgatatcatcaagttcctcatccgatatgctctgagtgggaaagcatgggatcttgtcattgagcagagagtaatgctaatgcaccctgcatagttgtcttggctccttacctatttcgactgaatttccatgcatttgtgactaatggcccatcgatttcgacagattgcgtttacaaggaagaaggattttggcaaggaagagagggaactcaagtgggcacatgcacataggacactccatggcctgcagccaccggatgcgaagcccttcccagagaagaccggctacagtgagctgaatcagatggcggaagaggcgaaacggagggccgagattgcaaggtaggacctaaatctgcagtagacacttgtataattcttttccatgatctgtcaccttaagaatcatatagaagcaccatgtcctttatattgcatcaattctcagttgcttttgccatgttccttccaagatcaagaagcatctccctttctagctgcacaatgccaatttgcatccccctggaacacgtggcgtgaaaacgatgtaaagctaactaactatgtgcttgttcttgctgttgatgctacacttgcaggctcagggagcttcatacgctgaaggggcatgtggagtcagttgtgaagctgaagggcctggacattgataccattcaccagtcctacacagtgtgatagactcttatctaacaagagtaatatggttgctgcagaggaactgtttcgtttcatctaattagtagtttttatctcctctcagctaacataaatgtaatcaaccaacagttcatacaatctataaatcaaatcatcaaaggggattgttgagattatccgtttttgtcggtgttttcctatatgtattgtcccttaaattggaggcctcccatgtgtgataccattgtgttatggtttatattttcgtacgtctgaccgcgaattcatggaatgggttgtttccattccacttttcccctgaacgaatataaaatagcttgttcagtaggaagcttcaaaatgtcacaccttaaaaagtgaaagttgtctcatctcctttcttgaaaggaaatggatgcatgaataaacttttcttttaatttttatcctgggggttaggtatgtgcaaattgttcactgaacgatcttttttttaaaaaaaagcaaaattgcagttgcgcatgcattttccattggaagctctctgttttctgcatgtaaagcatttcagatggagctggtgaaattcgataagctgactgctgaagcttcagaatcagcctgattgcagtaaacagaacgtgcaaat

SEQ ID NO: 2928 - DNA, 1501 bp, Oryza sativa
ggaacagataaagtccttataggacactaaacacatttttctaaagataaaaggaaactaacaaactatttctatttaatagataacttgccatgccgcattctttttaaactcggtcacttatggataagcttccgttagtagattgatttccttagccgaatatagcaggaatttgactattggcgacttgataactcccatcggctgatcccgagatgctgcagccgataatgactctaagccgatgacgtctttgctgattaccaaatttcactgttaacagacttacattgtgaaacggaggaagtactaagatattgacctggagtcctggaaaccatatacctcgaaaaaatattgacctgaaaaccatagatctcgaaaaaaaaatgcaagctcttttcttgaatagttgtgcaaaaaatagtttgtgcttcgataaattggtaacctgtgaatggccaaacaacgcatacccaccacacactagatatgtgcttccacctcctagcgaaatgcatggttggccaaacaacacataccgcgtgctttatcaccacacactagatatgtcctttaacttattagtgaaatatagatacacgagaaaaactgagatatcttatctaattagacgacctacgaacatctcaaatcgtcgaaatggagtgtaaccacaatggtttatgaatgatggacagcactagcaatcggtaagggacaaacgaaaaaaaaggagtctgcaccctcttcctcctcacgacatggaaagcttgaaagtagagatggatcttggaaagtattttctacatatggatgctatcatatctaggagtatgcatgtggtttaaatagttactacctcattccctaaatgtttgacgccgttgacttttttaaacatgtttgatcgttcgtcttattcaagaacttttgtgaaatatgtaaaactatatgtatacataaaagtatatttaacaataaatcaaatggtagaaaaagaattaataattgcttaaattttttgaataagacgaacggtcaaatatattttaaaaagtcaacggcgtcaaacatttaggggatggagggagtatataaaaaaaataaaattcatactgaaccagcggagtcatacaattagtttctcccaacagtgcccggggtcctggccccacctgtcatcccctttctccggagaggtagagaggacacgctcttttgacgtgctaaaagcgatcgagctaatatctctctcgtatttatattccagtatcacacttgctcagaacgaagctatagctagagagattgggagaagtaggggtgcaagctgatcgattgatcgatttggccatgcatttccaagccgccttcttcctctacttcctcctcgacctcggcggctaccgcagcgacgtcctctccgtctccgacctcgagccgccctccgacggcctcttcgtcgtcggcctcaccggaggcctcgacgccgacg

SEQ ID NO: 2929 - DNA, 1501 bp, Oryza sativa
gtatatttaacaataaatcaaatggtagaaaaagaattaataattgcttaaattttttgaataagacgaacggtcaaatatattttaaaaagtcaacggcgtcaaacatttaggggatggagggagtatataaaaaaaataaaattcatactgaaccagcggagtcatacaattagtttctcccaacagtgcccggggtcctggccccacctgtcatcccctttctccggagaggtagagaggacacgctcttttgacgtgctaaaagcgatcgagctaatatctctctcgtatttatattccagtatcacacttgctcagaacgaagctatagctagagagattgggagaagtaggggtgcaagctgatcgattgatcgatttggccatgcatttccaagccgccttcttcctctacttcctcctcgacctcggcggctaccgcagcgacgtcctctccgtctccgacctcgagccgccctccgacggcctcttcgtcgtcggcctcaccggaggcctcgacgccgacgagctagccgccgtggcgctccagggccacgacctctccctcgccggcttcgccaaccggacgcgccactggcacgccttccgcggccgcgagggcctcgtcccgtccgcggccagcgtcctccccttcggcggcgacacctaccgcgacctcatcggcggcatccagaacctccccggcgtccccctcggccgcgacgccatggtgcgcgccgcccgcgtgctctcctcctacgacccggcggcgttcgccgccgaggggaacgaggtggaggagctcgggcgggcgctggcggcggtgacggtgatgatcagcgaggcggcgcgggtgaagccgatcaacgagaccgtgtcgagcgggtggggggggggggggggaggcccgcgtcgccgccgagcacctgccgtacatcgagcactgggacaccatgtcgttcgagctcctccgcttgaggcgcaccgggaggtgggacggcccgttcaccgagctgctgaggaaggacgccggcatcggcggcgcggaggaggcgggcgccgtcgccggcgtgctgatcgatcgcgacctggaggagctgcagcttgctcacggcatctgatcactgcagcttgcagtgcttgcttgcttcatcgtctcacgcgcggctgctcgctgaataaaaatattgttgtgtgttgtgatgttgtgttttgtgttttcagatcaaagtgtttagaacttaatttggtgagccgcctctgacgattattatgcagtaaatgttttgtgcctcagtgctgtttactgatgggagttccgtttcatacagattggtattgtgatggttaatccaaattaaattcagcatcaaaatttcatgaatctaactgcacctttgagagtgttgacacatcacatctacagcaaattaacagctgcaagcattgttgaacatactgtcaaaaaaaagaatatggctcctacgaaaaaaaagaa

SEQ ID NO: 2930 - DNA, 1501 bp, Oryza sativa
ggcttcgtggttgagcggtggagttgggctcgcctcaacggggattaggaaaccggagagtttccgaacctcggtgaaaaattccttgtctcttgtctcatttatttgttgcatttacatttgtgctattttacattcatagagacatatttgagcccatatcacttaggtttgcaaaacttaacttagttgcttagttaaccttgcacctcaccttgcctagcaacttaggttagttttgtttaagtgccattaagttttaaaaccgcctattcaccccccctctagtcggcctccttgatcctacagcggccggtgaagggcgggggtgggcggtgccggcatcggggatacggcggcgaggaaggcacgaggaagcggctggggggaggtggcggcggtcggcgcaggcggggagagagagggggcggatggggctaaggtcgtcggggtaggcggcgcggacatcctaaagtggagaggccaggtcattcctctcgagcgacggtggagagagggggccaccgccgttgtcgccaccaccaccgccgccgtcgccacaactccgcccggccttcgcgccagtcttctccatcgccgccgccatcaccggatatggacgagaaggggaggggggacggccgcagtccaccgctgccaacacgcatgcggcccccagcgccacccaagccgtcgccccatctggatctgacttagctcacgatggtccactgtcagctacttatctatttccctccatcctcagctaagttcacagtgctgaccacggtcaaggtgccacgtcatcgaataccgcccacaatactaccataggagtcgatttgtaccggttctagtaattgggggaatcgtcctacccggttttctagttaagggtcacgaattagattcggtgaacaattaagggagtcaaagtggactttttcctagcggcgccgtcgacaggctgacatgttccatgggatgggccgccgactcacccaaccgcgcgcatccccgcggcccaaaccaaccaactgcctactcgcgcgctggagctcacacaccgcccccgcggccgcgcgcgtccgtccctcttcccttccccttatccgctccgctccacagcctcgccccgattcccccctcgtgatttcccccttccgctcgctcgcgccgctccctaccggccaccaccgcgcgcgggacaagcaacctagctgctccggctgccaagccatcgccatggctccgtgccccgccgcgaccacgtacgtccgctgcacccagcactcctcctcctctctgacatttatcaccttatcaccttttgcttctctccctctctcgatcgtcagaactcgcattggggcgccgccgttcgccgcgacgacggctcgccgacccgcccggggcgcgacgacgacgacgaaggcgcgggcgtccgggctgcggcaggtggagggccccgtgtcggagagggcgtactcgtcctcctcgc

SEQ ID NO: 2931 - DNA, 1501 bp, Oryza sativa
gctgcttgagacggcatcgaaggtgtgtgtgtattgattaacctgtgggacgacgaactcgtggacgacacctctctggcggtcgtggacggtgaccttgtgggtgggagcgggcgaggaggacgagtacgccctctccgacacggggccctccacctgccgcagcccggacgcccgcgccttcgtcgtcgtcgtcgcgccccgggcgggtcggcgagccgtcgtcgcggcgaacggcggcgccccaatgcgagttctgacgatcgagagagggagagaagcaaaaggtgataaggtgataaatgtcagagaggaggaggagtgctgggtgcagcggacgtacgtggtcgcggcggggcacggagccatggcgatggcttggcagccggagcagctaggttgcttgtcccgcgcgcggtggtggccggtagggagcggcgcgagcgagcggaagggggaaatcacgaggggggaatcggggcgaggctgtggagcggagcggataaggggaagggaagagggacggacgcgcgcggccgcgggggcggtgtgtgagctccagcgcgcgagtaggcagttggttggtttgggccgcggggatgcgcgcggttgggtgagtcggcggcccatcccatggaacatgtcagcctgtcgacggcgccgctaggaaaaagtccactttgactcccttaattgttcaccgaatctaattcgtgacccttaactagaaaaccgggtaggacgattcccccaattactagaaccggtacaaatcgactcctatggtagtattgtgggcggtattcgatgacgtggcaccttgaccgtggtcagcactgtgaacttagctgaggatggagggaaatagataagtagctgacagtggaccatcgtgagctaagtcagatccagatggggcgacggcttgggtggcgctgggggccgcatgcgtgttggcagcggtggactgcggccgtcccccctccccttctcgtccatatccggtgatggcggcggcgatggagaagactggcgcgaaggccgggcggagttgtggcgacggcggcggtggtggtggcgacaacggcggtggccccctctctccaccgtcgctcgagaggaatgacctggcctctccactttaggatgtccgcgccgcctaccccgacgaccttagccccatccgccccctctctctccccgcctgcgccgaccgccgccacctccccccagccgcttcctcgtgccttcctcgccgccgtatccccgatgccggcaccgcccacccccgcccttcaccggccgctgtaggatcaaggaggccgactagagggggggtgaataggcggttttaaaacttaatggcacttaaacaaaactaacctaagttgctaggcaaggtgaggtgcaaggttaactaagcaactaagttaagttttgcaaacctaagtgatatgggctcaaatatgtctctatgaatgtaaaatagcacaaatgtaaa

SEQ ID NO: 2932 - DNA, 1501 bp, Oryza sativa
tgtagttgagcaatacatgacggtcacggcgataacgttgcagcagctcaacaacattttctctggttaagttgatatatagaaaaagcttagctcacaattgaacatgcatatactgatctataatacctattctgaaacgatcattactcgtccatatcgtgtgcaggggagacagcaatctgagttcagaaacactgttggaagcaccccaagtcgctttcagccagcatcgctctcctgcaaaacaaaaggggttaactacatgaaaaagtgctggggtgcgtaaatcggttggggctgaacagtttatgttgaaaatagctagtgaatcatgaatctgatcctacaatcggtccattttgcctgtacaaattcacaaactctcgctattaaaaaggaaatggaaatgacagccatgcagtggccaactgatgattcattcaagaatgcacaaactgagatgatccatgcctcctctcagaccggccaactcaacctccctactaaatcacatccgacatccaccagtgacagaactgagatcgcattggcccgcagctcccagatcatacatacccgatccatccatccaaaccgaattcgccacaccacagcgcccccgcatttcaaacaccgcaaaaaccacaccaccgcaacccaaaaacaagtcgagccgaaacgaagaggaagcgcatatccaagcagctccgcccaccaccaccaccaccaccatccaaggccggagggcgagggcgagggcgagcggctcgggggctgggtggatctgggcccgaggcggaggcggaggcgggggtgggtggctcgtcgagctagttacctgcgcgcgcgcggagagggagatctccgccggctaccgacgacgacgatgccgctggtcactcgccgcggcgcttggggagtcgggcaaggtggtagctggcggtggtgggcgcgactcgctttcctggtggtggtggtaagtggaggcgaggagaagacggccgcggccggggatccgtgcgcgcaggctgtggacgcgcacgaggtggcgaggccacgagggcctatttttcttgggctacaagggtttctttggcccatctcacctgccctgggcctttgggcctaattttctacgaccccagtcgccaagctttccttgtcagaataagtccactttgactccttaaagttacccgaatctagtccgtaacccacaagaatgactcctgaactattcaaaccagtgcaatttgactccctcagtggttttggataacggttttgctgacgtggcgatgttgacttggtctgtggtattgacgtggcgcttaggtggcattagaattaaaaactcagtgcgccccattcgccattcacacaaaaaaaaaattgtgggaccatatgttatccctatctatcccttcttcctcctccctctctcccttctctgtctgtttctgcgcaggatctggagcgacggctgcaccggcgccgg

SEQ ID NO: 2933 - DNA, 1501 bp, Oryza sativa
tctgttctgttgcacagaggggcataggttcgcaatttcgcataccccaatgagcacgtactacgtactacatacacatacgatgctatcgcgaattggcaaatcatgcatgctgcagaatacttgcaggaacacgcacgaaaagaaacaaatgtggcagctagcgtgcatgcatgcagcgctcacgcaagcaaaaggaccaaaaacgcagcagggcgagctatagctagctaagctatggcgcagcacagcttcactgagaatctgtggcctcgccacggcaagcttatagccggccggacaaacgcgagagaatattttgctcgctagctcgccggccgcgcacggcgcgcgcacctgctgctcgctctggagcgcgcatgtgcgtctacctaaagctaagctagctgctgctacattggcacagaatgaaaaaaaaggaaaaaaaaactggcatgtcacgccgcgcgcgcctgatctgtgcatgcatgcgcgagcgcagccgcgcgggggcgcgggcggtgaacagtacgtacgttttgctgcgttcctgagaccgatcaccgatcacaactgtggccgcgcgcgccagccgtgtcgcgcgcacacgtcccataacattttttgggcggagctaggttgcacgtacacgtacgcgcgaatcgcgacggtgaggcggtggcggtgcacggtggagttcctcgccgttgctgatcatgtgggtggctgcagtggcggcgtcgtcgcacggtggctcctcgatgttgctgggtggtagtgctggtggaggcggcgacgtacgtacgtgggtggcggcgatgacgtgcctccaacaacgatgtgtgttaggtggaataatcctgcgcctgtcaaaaaatcatacgtggcactgtagcgtagcttgtcattttaatcatgcatggcactgtagcatatcttgtcattgttttggtttgttgcatgagcgcgccggcttgttcgcggcgtgagcgtcgtgtgtgagttcttggccatgatggtctggaacgcatctttagcgtgcataccgcgctagtgcttcaacgtgggatcgcgcacgtcattagggagtactggcgcgcatagcggaggccacttcggcacttcctttttcttctcgtttttcagttagcatgtaatcttctttatatatgaagtaaacagaaaacactgtaagttgttgcgcagcaccaaaaaacccgtatcgaacacttggcgatttcactattcatcgtcttcaacctccgatcacgagaggattctgcagtgtagtgagggttgccgctgacatttggtatcagagccatgtcggctcctgtgggtgatcggtcccgcccgccacactggcgtgggcgacggctctcgccgtcccctccgtgcaaccgcggccggcagctcgtcgtgcaacaggttgtcaaggaagggggctctgtcacctaccccacgctcactcgttccaattactctgattgggcggtgttga

SEQ ID NO: 2934 - DNA, 1501 bp, Oryza sativa
gcgcggccacactctgttaccattttacagtactttatttactgcgaggatgatgtattctctcgcttgtgtttttgcggccagagagagccagccggccattccctctggttggccatacacgaggaacgggttaggagaaggattttaatcacatgaatctacgtctactcattttcttgacatatattttgtaaaatgatatattttctctgttttatattataagttattttaatttttttttaagtttgattaagtttatagataaatttaacaacatttacaacaccaaattagtttcatttaaactaacatttaatatattttcataacatgtttgtcttatgtaaaaaatattgctatattttatatttaattgattcaacttaaaatgatttgatagaaaaaaagtcaaaacgacttatattacggaacgaagagagtatgacatattaatttatcttttaagttttttaaaaaggaatttataatcaattacttggcatatgtactactataaacgattagccgggtgtacgctccagaacgggctggtccgtgcgttgtccgtagcagcagcaacacgccgcgcgcgcggtcgcgtttcccaatggcccgcgcctacgtcgcgatcgatcgtctcatcgtcgcggaccctcttggagatgtgccacgcgccgtgccgccatcccgaccaaatcatggcctaatcacgcgaaaacccgcgctttcccacgccccccccccccccctgttcaccttgacctgtgtgtatataattactactagtcgcctccgaaagctacctctgcctttttcaccctcctccatccattcccagctgctccatgctgctgccgccctctcgtcctcttcccttcttcacgtgtagtctcaccttcctcgccatcgccatcatcggagctcggtctgcccatggagatgacctagctagctagctagctagctatagcctctctctagacatctctctcttgtgtgtgggtggtttggtttcttgattggagcatggcgttggaggcggtggtgttctcggaaggatactacttcggatgcggcggtgccatggcggcggaagcagctgcaggaggagcttggagctggagccacgggtatggcggtggcgttgatcaggggaagggggcgatggagttagtggtggacgacggggtggtgaacgccttctgggacggcggcggaggcggcgcaagctcttccccggtgatggccgccgtctcggggtttattgaggagccggacggcggtaattcctccgtcgcagacgcagcgccgccgccggagcacggaggtgcgtctgtcgtcggacgggatggctccgcggcggcgccggcggcggccgcagggaggaggaagcggcggagggcgaggaccgtcaagaacagggaggaggtggagagccagcgcatgacccacatcgccgtcgagcgcaaccgccggaagcagatgaacgagtacc

SEQ ID NO: 2935 - DNA, 1501 bp, Oryza sativa
gttggacacgagctcgatggctcccgccgtccctggatgtgctccatggccgctgcccacaccagcaccgacgcccccgccgttgccacccccaccccccacccctcggctgccagatctgagtcctaacagcgacgtgcgtccaggcgtcgctggcgtccgctggtcctcctcgcatcactggcatcatccggccaaccaactcgcgtcgtcgccgccgtccggtctgccatcctcacgccgtcgtccgctcgtcctcttcgcatcgccgccgctgtcctgttgtcctcctcgcgtcgtcgccgccgtccgtaaccattctcacgctgtcggtgtctgcccatcttcctcgagtcaccggcaccatctagccatcctcattgtgtcgccgccaccgtacgctcgccatcctcacgccaccatgttcttctcttcctcctcgcgtcgtgtcctctgctcgtcctcctcggcaggcgggcggggcgcgaaggagcgcctagaggcatggtttaggccggaggaggaggagcttcggtggaggcccaggcctcactaggcgtgagggagagaggagagagaagaggggagaaggaagaaagggaggagggagcaaaaagacgagggtaaaatggtcaaaataatttttataaatacactgaagaggtaagtagtggtatatcttaaactgttgtaaaattataatatcatcgttacaaatatatgaattataacggcatattttcaaactgaagaatttataatgtcatggatccaattaaccctcgcataaagggagtttggttgtggttggtggtaacgtttgtgtagctaggatcatcatcaggcaaaattggcatcatttctatccctgaaccaatcgctgattcgctgcacggtgcacgctacgacgactgcgtgtagccgtgtaggatacactttgaagtcgcatcctgtttggatccataatcggaaattcggaagtctcaacggaacattcaataggttatatctttatgagcctcagttttcaacggaacattcaaacgtttaatatgatagggtgtaaaatttttacgtgggaagtaaacatagcctcagtttgtacgagggaggtcagacactgctaattgtacatggtcccacaagatcgatgtaagtgccgaaccaaagtaaaggtttgctttcgtgcacggccggtaggcctatagggacgatccactgatttggtcatcgacatcttgaggaataagttcatctgaggtcccttaacttgtcaacgaattcgacttttgtccctcaaccgaaaaaccagacacaacgggtccctcaactatcaaaaccggtgtaaattaagtccctcgatggtttgagggtggttttggctgacatggcgcctacgtggctaatttgacttggtcttcatctgacgtggtgcttacgtggcaattcgatctagaaaaaaataataaaacccatgggacccacatgtcagtttcacaca

SEQ ID NO: 2936 - DNA, 1501 bp, Oryza sativa
taaaaataaaataaatttaaaaaaacatccatatttaaaaataaaatgaatttgaaaaacatgtgagatttttaaatagaacatcaaaagatgcttgtacttagatggaaaaacttgcgtggctaaggattgaacccattacttcacaagttctcccccaagctatcttgtctttgtgtgcaatggaagcttgtagataactaatatttgtaaattgaacagagatctttggtgctgacctcggatgacgtgtaaaatccgtgacacctcggatgacatctcagcgccaataatagtggcgccgagatgttatatctcagcgccaatctctatggcgctgagaaaacggtctatttttgaaattagtttttggcatagttcaatttcgaaataagttttttaaaagaatcaatttatcaaaattacgggtttctccccgtattttattatagcttagccaagtctttagtggaacatgtaaacgatgaaagggtattatagtggcatcacacatcaggtgattaaggatcgtgctatcaagaagtcaacattaactggacgtctggaataccagagtgcatggcacgctaggcgtatttacgagctgatgcatccagagaccaaagaccttggctgtggtcttaccccaagttttccaactatctcccttgtttttcaggcacacacttttcaaactactaaacggtgtgttttttataaaaaaaattatacgaaagttgcttaaaaatcatattgatttatttttgaaaaaaaatagctaatactccatccgtcctataatataagataagaagttttagaattggacacggttattaagaaagtactatatccgtttcacaatgtaagactttctaacattgcttatatttatttagatgttaataaatctggacatatatatttgtttagatttattaacatatatatatatatatatatatatatatatatatatatatatatatatatatatgaacaatgttataaagtcttacattgtgaaatggatggaataggtagaagtgagtgatggagggttgtgattggatgagtagtgaagataggtggaaaaagtgaatagttgagggttgtgattggtttggaagagaatgttggtgaagaagtggttatattttaggacaaatcctaagggctaaaagttattatatttttgaacgaagggaatacttaattaatcacgcgctaatgaaccgttccatttttcgtgtgcactgctctggttgtgacaaccttgctccagcgaacacttcagtgcaaatttgcagccgtatgaacagctcagaaatcagcgtatttactactcgatccgtctacgtatccagatatagctacatatccgacaaatatgtccagatttataggtgaaagatgttatatttttataatggagataatccaagataatgatacgtaaatgaaaggggaagacgaccaggcaatgtagaccggacagtag

SEQ ID NO: 2937 - DNA, 1501 bp, Oryza sativa
tctatttgatatatctttgcaaatgaagagactgattgtatttgaaagtacacagggtaagaatgatctaaaaaaattgaaaatctttccgcgaacacgcaaaatgattgcatgccaatatattagaaggaaaagagttttttttgttatgcaaggcactcgtccagacaagcctatgccaggaggtagaaaaaggaaaaaacaaaagctgcagcgaggtaaaaaaaactttacaaatctgatcaacaattaattaattaatcttgttgaatttcctgtgcagttacgcagatttatatatatagacttaggttcatttggaggtatagttttgagtaatatttaactaatctaatagaatttcccacgcagttgcacagaggtaagatcaaagtacatttgcattgaaataataattgcaattaatatacacctccttgtgtccttctgtttgtaatgtgatatatagatttatatatatgcatacatttgtagtgtaaaattttatcaacagatgaatattttaaatttgcgtgccatatatatatgttgatcactgaccatacatttcatcttatatatatatatatatatatatatatatatatatatatatatatatatatatatatatatatatatatataaaataagaaaatctgatgcgtagaaatgtttctttcagacatattaccaatgatcattacttatacatgtccacggagagacgatttcgttttctccctatatgcacaaagacgtaaacaacacacgagcatggttagataacatctttaattaatttgttgttaattaacaatatttcgatgatgatgtctcctgctgcatgcatagagagagaatattgttggagaagttagagaggaagtacaaggcagaagtaatcaagggattggtttgtgtttgatgggagctgtgagagcagtggtcttcagcgaatagccaaacaggtaatccaagttggtgagagcgatatatatagatatacttaattaacaacacacacacacatacatacacttatatatagaatgtagattagaaagaaagagatataggtagtgccatacaattatatgctagttattttgattagggtgcaattaagctgcccaaaccttcttgtcatgctaaactaaactaaagagggacctatcatccaaaccctaactagctaccccaaacatgtgtgtgtctctctcttgtatatatatatgggtatgggtatcctaacactacccataccccttctccctcactcaatctcccatttcccctctaattctacttacttaagctagctaataattagcccaagaaaaatcccctctctcctcctctcctctcacttatcaagagaaaatcattttgggatctgaaaaacaaagatagatatgcaagatagctagctagcaagttatagtcaagttttgcttgatttctactcgatcgattcgatctctagctaggtgaaggatca

SEQ ID NO: 2938 - DNA, 1501 bp, Oryza sativa
gaacagacttttggttgtggctcattacttagcctaaacagcttcctgtttttggttgcatataaacatgtgcatgcctctctaaaactaaacaaagtgacaagaattattatgaggacatctgtttgggaatcaagtatggaatcccatgatatagatcaatcagttaccaccttggatgacaatgttgagaacagctgcagacaaattaaatgcaaattatacaaagagggcatgctcaagcaattaaataacctcaaaatgaccctatattaagctcataaaaatgaaattaaatggtatatcttttgtgcagtacatatgttattatatacttattttttaaaaaaattatagagagattttatgaaaccacgagaaagggtatatatacacgatatatatatatagacacacacatgtagttacatgtgtacatcaagctcatcaattacaatgcagccagtgcataaatatacacatatatcacactgccaactaactgctctctgatcacatcccttgtacatgcatgtgttgctccaaatctcccaaacacaatgaacagagcagcatggaagattgaatgcatcccttgtttctgcggtgcatcccatgctgaaaagactgcaaatttgggcttttcgatcgatcaggatatgtatatgcagccaagccaaccacccctctgtgtacgctgcctcattggccattactagggtttctgcttctgttgggtggctgtaatggcagagctcgaacggtttacctcctgtgggaatgtatgggctcatagatgttgaccataacaaacttttgcgacgaattcaagagatgatcatcgatttgcatttgcagtatatatacaatgcaataagcatgtttttttttgacatggacaataagcatgtatttagagctttacaagttgtgtgagagtaccaacaattaatcgaacataggttgtcgcaatccgtcccgcacaatttaatcgtggagagctaattgaagttcatttgaaagtatataggtcttgtttctatttgatatatctttgcaaatgaagagactgattgtatttgaaagtacacagggtaagaatgatctaaaaaaattgaaaatctttccgcgaacacgcaaaatgattgcatgccaatatattagaaggaaaagagttttttttgttatgcaaggcactcgtccagacaagcctatgccaggaggtagaaaaaggaaaaaacaaaagctgcagcgaggtaaaaaaaactttacaaatctgatcaacaattaattaattaatcttgttgaatttcctgtgcagttacgcagatttatatatatagacttaggttcatttggaggtatagttttgagtaatatttaactaatctaatagaatttcccacgcagttgcacagaggtaagatcaaagtacatttgcattgaaataataattgcaattaatatacacctccttgtgtccttctgtttgtaatgtgat

SEQ ID NO: 2939 - DNA, 1501 bp, Oryza sativa
gacaaattatccctaccaagttctccacataaacaattttgtcaaatttgaattggtcctagttgttgactagcatttaagtagctttaaacataaataattccaaaaagatagttcaaattcccgccaaaacaaagataataattcacattaaaaacacgtcgacggagaaaaaaattcctactatcctattaaataaacaaactgtttaaccccaacaaaaatgatctaatcacagaaccgcaaaatagctacttctgaatcattatcatcctcgtcagcatcagtgagctagagctgctaagaggaacatgaggacatgcatgaactcatacgcattggccaccccatagcatggagcacgcactcgttttgacttattttttaattaatttattattaatcaatcaattaaaacttcataccacacacaaacagaaaacattaccccaaaaaacccataaaaattaaaccgaaaaacgcccaaaccaaaaagataaaaaaaaaacccaacgccccctctctaatcaacccctcccctaaccttaccaccacccaaagccctacccgccccactcacacccacgtgggccccaccacccctggccccacgtgtcagcgagtggcagcgcccgtcacccccgcgttcgctgtgccttcccccttaatcaaatccagcggatatttttgacgtccgcaaggacaaagtctcgccattttctcctccgttttgttttttttttcgttttcttttttcttcctcgctttctctctctctctctcctcctctccctcttcttcttcttctctgccaaatcccatcgcgaaggcgagagagagagagagagagaagaaaaagtgaggggattaacaaactcgcgagtttttcttttttttttttgtttattgtgtgaatttggcccacgtcggcggcggcggcggaggagctaaaccctagccggaggtgaggtggtggtggtggtggtcgggaagtggcggcgccggtggtggggcgggggggcgatttggcgcgcgcggccgagctccggatcgccggatttgtgcgtgagcgcgtggagtttgtggcggtgtgctcgtgttgctgttggtggtgaggtgtgaggtgaggtggggtggtgtggcttctgctgctgctgctactgctgctgctggtgcttaattttgctcgggttcgtggggttgggaagcgagggatgcgatctgggaggtgttcgggagctcggtgttgcttaattccggtgctggtttgcggtggtgcgcgcgcggcttcttctcggggtggatttggtggtggttttttttgttgccctcgttgttgcgggtggatttcggggggagggagagtttgagggatgactgctcgttcttgctcaattccggtggatcttacggtggaaggatggcgagctgagtaaaggcgcgcgatatcttgctgcggtttgtgcggagcttcggagcactttgtcattgctggcaagga

SEQ ID NO: 2940 - DNA, 1501 bp, Oryza sativa
caaattggtgtgcctaaaatgcaggaacttcaaaggaaacaattttctttcatattaaaaaaatataacagatacaaaaaaaaaaccaccatgaatttgtgatgatttagtcggaaatggttctcagtcggtcgaaaattttccatatttaattaattattcagtgacgactataaaacctcaccgacaaaaaatagaaaaatcagattttgtatttggctaaaatcggaaacggtgccaccaccgtttcatctctacatgattggtttgcactcactagaacatctgtggagcctgtgctcagccagggtcagtgctaagtcagttggagatttggaatgaaatgcataagcatgaggtctttgccttgttggatgccggagcatggacagtggtccatccatggtcagagtctgtgccgttggcccgggagaaacggctgcacgcctttgacaatatgaggtgaccaattctccggtttgtgtggatcagatgatcaagtgatggtatatatactggagtataattcaattggcttgactatattcgaagtaacagattgataatgttatagattgatactccctccggtcatctttattagacgctgagagagctataagtataacttttccgtcgtcaaataaaagtgactgaaaggagtatagaactttttttagaaaaaaaaatttgtagattggcattgtaatcatatgagtggatgcaaatggagcaaaggaaggatgatgcagtgaattatgaagaataataataataataagacaaaagtagataagtaaatatgatatatttgaccagttgatcgatgcaagcagtaagcattttaattagttcatattttttttattaaagaagatcatatgtaggccccctccaaaggcaaacttctctagcatatctacagggtggcaaacaaaatcagatcctaaaatgtcaatttaaatgattgcaaatgaccagtttttcctactaaatgtatatactaactactagtcaatttggtcaaatttttgaaagtttgagtacacatatatggtttacatggatgggatatacaaagttctcatgggcagagacttgccttaaaaaacaacaaaatataatggcaaaatttgctataggacaaccaaaaaaacgtgtaattagctaggagacaccacaagaacgcgtttttgctatagggcaccgtaaaaaaactggtaattagctactggacaccctcgggattattttattataggaaaaagtacgaattacacccccgaactatcgtggtcgtccgaattacccccctgaaccacaaaactagacattcttcaccccctaactatgcaaaccggacgaattacccccctcggttcaatccacggtggttttggtctacgcggcgtaagcgtggcagtccagtcaacattgtatttataaaaaaaattgcgggacccacgtgtcatactcttcatccctctcttctctctctgta

SEQ ID NO: 2941 - DNA, 1501 bp, Oryza sativa
accaaattttattcggtcaattcggttagtctcctcgggtagccgaatagaccgaaaagaccgaattatcaaaaaatgactaaatgcaacctacaatccactatgtttaataggattaaactttaattttcacatccctacttcttctaggcatgcaacctaataagagtctttactcataagtgcttatgaattctttttgtgattttgtgttgaaaatttccattatttctttgcatatatgaaaatgttgttgaatttcggtcaggactgagaccgagaccgaatttgtcggtcctgacatttttcgcgctgaaattcggacttcacttttcaaagaccgaaaagatcgaaagaccaaagaccgagaccgtaattttcggttagaccgaatgcccacccctagataacagtgaagagtagaagtgatttagcttagaaggttaacttggaggtgaattgataggaaaccttagtgtaaactgatttaattcagttttacctagactcggtgactatttcggtagtgctatcaggtggttaggctagatttagttcgaacaatgctcccaactaatgaaatcattgtcatgattaatatttgtgatgaataattggctgcgcaaatgatttaataaataattggtttaaatagatgtgtggatgttggtgtgagtacatgtgactaatgtgggtcaggttgtgatatctgtgcctagaaacggttgttttgtctgattatatgcatgtgacttgaggtcagccttggtcaatggtgaagaccgcgactatgctcagggaggagcagaggtctagtgcggtcaggatatcatgtgagaaggtgactagagtcaggattcttggaggttaacttcggtcaatggtcgggatcgggactagatttagggaggagttgaggtccaaacggtcaaaaataccgagtgacgaagttggatatgagatggcatacggtggatgaacatcatgtggaagagatcttcgcaacgggatttacgaggtgtgtgtgcaagtgttggtgttcacgaaggagattggattaaatttgaggagaaaaagggatgcatggtgaagcgtgtatgtgtgcatgatcggttgcaccgagcagcggcagagcggctcggtgggcttcggtggcagctggctggaggccgagttggtccaggagtaggaggcccagctggcccatgcggcaggaaggacgtgcgcacgaggagtccgagtgcgtacgggacacgcgtcgacagcggagaggagtccgtttcgatgcggttttggattttatgtggccggtgcggttttggaaattaaggtatttcgggtattgagtcctattggaaatagaagttttacacctattttgagtagtgttttttggtataaatagagagggaatgtgatgtctcccggtatcgctttgagagcaattgagctgctagtttagctagggttttgagtttagtcgagattttttgtaaggggt

SEQ ID NO: 2942 - DNA, 1139 bp, Oryza sativa
tgcgcaaataagaaagtgatggttttctcccaatccatatctcatatggtgttttgtccttatttctgttaggaactctgtttaacacatgattcgaggtcaacaatgcctccccccaccatgccttaggtagtcccgcggtgtccaacatggcattcaccaagtcagtcattgtgcggttcttactttcagcaatcccattagactcaggagaatagggaggtgtcctctcatgtatgatgccatgttcctcaaagaataagtcaaactcatttgagaaaaactctccaccacgatcagacataagcctttttatctttctgtcaagttgattttcaacttctgccttataaattttaaaatagtctagagtctcgtctttcgttttcaacaagtacacatagcaaaatatagtagcatcatcaatcaacgtcatgaaatatcgttttccacccttcatcaacacccccattcatttcacaaagatctgaatgtaggagttctagtggtgccaagtttctctcctcggcagccttgtgaggcttgcgaggttgcttcgattgtacacaactatggcacttaaaacctttgacaatggaaaacttaggaattaaacacatgctggaaagccgagacatcaagccaaaattaatatgacataaacgtgagtgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatctgtctctactcagacgggagccactaacaagattcctgtcgatagaagggacatgctgcacgttcttcagctgcacgatctttcccgaagtaaacttcagatataccgtgtcaacaccatgaacagaagcatgtgacccattccccattaggacggtggaaccccgtgcgacctgataagaagaaaacaatgagatgtcagcacaaacatgtacattggtcccagtatcaacccaccaattagtagactgattaactgaaaaaacagtaggtaaattaccatacccgcttccatctccagt

SEQ ID NO: 2943 - DNA, 1501 bp, Oryza sativa
cgaacaggttgcgggcgtcgccgcggcgcccccactggcgtagcaagaaccgctcgggcgacacgaggagcgccaaatcctagcgtgaacgagcaggagagagggctgtgctgttcgggtaagcagctcacatcgccgccggaagctttcccccggccaccggagaccaaagagaagagagtggaacgcgcggcagcaaggatacgcacgccgacggcgcgacactcgctagcccgacgaacggtcaggtcgcgcggggggtgggggagagaattccggcggggcgaggcggatggagaagcagcgctgcgatgagcggaggaatcgccggatcggagtggagatggagaagacgacggggtcacagactcagagtctcacggaggagatgaaagttttttttttcttctgtttttttttttgacgggaaggagatgaagggatatggctgggtttccagattttttacttatttttaaaaaaagatttaacaaataaattttcaattttaaagttttacagaactatactctttccaccctatcacacggcgggacataaatcgtcatacagtagggcaatccatgtgacgtggcaccccgtaggagaggcgcaccaacggagagcttggcagcggcgcaaggtgggcggcgagctcggcggcttcctgcggtctgtggcgacgagggtggcaatggacggcggcagcggcctcttcctagcgacgacggcgtcttcgagtcccttccacaggtgaggttcttcgttcaaccaccccccccctcctcccctccccttctctctccatagaccaccttctctctccctttttttcccaaaccacccgtgcttccgcaaatcacactaatatgtttgaaccgctgccttttgtatttccttttattttgaatctaacgtggagcttgagaccgctgtccatgatggtacattgaacatgatcttagtagtagtaccctttgcagtggtcaatgtacctttataagaaatcctcctgagcaaaagatagcatagcggtaaaagccatcaccttttttcatgcttctgcaccaaccatttcttcaagctgaacaagagcattgtagcatgcttaaaggccaactccgcgcttcagtaaccaaaatctcacgttcttatatttataggtcaaattttaaattcaaaacttaattttggaggtaattttgtggttcttttcattgtggtttatatttacagaatttgcttttgaatcgctaaggacatgtatctaaaagttttacttataaattattttttgttgccaataacccatatggataagtataagcgaaatgttagcttatatttctacgcaggggcggaattagagtatattagggggtgcccaggaaacctgattaagaaaattttttagctatatctcacttttttttcaccatgtgtgcacccccgtccatacaaacttagacaccaacatcaatttaaactcgatttaatgtag

SEQ ID NO: 2944 - DNA, 1501 bp, Oryza sativa
atgtttcaggcattatcttatcacatattccatatgcttatattatcatcctttttttggcataaatgcttgtaccatattaccagtagacatctgctagcccactagaatctcttgatggagacgttaaaaccgccatggatgatcatttagttgtctgtttctgcttctgccgacataaagaaaatcacaagttcactaaacatctcccacctgtggtgactgagaaataggagctcaactgcacctgcttcaggtggtcggctttcctccatgggacatggacagagctatcatccacaatgtagaaaaaaaattaatattagctgggttagctgaaggacaaggccaactaaatttcattaatattttaggagagtggttacaaagattattacaccaacaatagggtgtcaaaaccgggtagaaaaaacaagggatcaaaacagccggaatcggtactgtctctacggaaatggccctcggtcagttggtaacaggccatatttatcaattaaactattgtttatatgtagctaaaaaggacaacggtcaaaaaggtaccaatgatatgaaacgacactcagtcggcagggaatttccgtggccattttcatccctagaaaaaaaccgacctacaagtgtcaaagccctcaaggaaatttaaaggtcatatcatgtaatatgcaacaatgcaacataactaaaatgggagggagggagggagggagggggttgttaaaaccaacttttttaccacaaaaaggtttcaaatttggatctgcatatgaaatttagttgacacgaatttttttgacaggttttgtttgctcgttgtgtgatcattgttgcagcagtacatgccatccatctgataaattaccttgaatgtctcaatgttgaccacttaacattagcaatttgcttctttagattcttattgcactccgaaaatttcactatatgctcaattctattgttcctatatctaaaagcagtatcatctctaaatgattatccacttaaagcagtaccatctctaatgctattgttgctatctctaaaatgttgtgagtggaacactctgaattgcttgtgaggagcaggtaaatggttgttgtagttaacctaaactgcaaccgttttttagtgtttttatcaatgaatgattctcctattttagtgccactaaggctaaagctatttggtagagagcttggtaaaaagactacttcctccaatcaacagtatttgatattgggagtaataagttagtactcctgatgtcaaatattattgctaggagtgaattcaaaaagttagtactccctacaatcaatagtgttattgtcaaatattattctcgtgtaatgcattagagatcacaattctttgcttagtagtcatttaccatgattttttttcattttctggcaaagttgaaaaattaagcgaccatgctcttatttgcagcagtttcatggatgcagagctattggaa

SEQ ID NO: 2945 - DNA, 1501 bp, Oryza sativa
tatatttgttctacatataactgagatgcacacaattaaaaaaaaagattactaacgagtacgtacgtatacatgcgtacgaacatggacacacatggttttattttgatcgtacgtatgaatattatcttgaatgaatggtatttgtacttgtcaatgtcaaacatacgacgattgaattaaacgtgaccgcggctcgctcgctagctcaaaaaaaccgcgtttttccgcgaggcgaggatgacaataaaaaaaggcttaaaagtagcgccttttacatagcgccgacgaatagacccggtcccttttgtacgttacgttgcacaccaaactctcttccctcgctctctatatatagccagcccatcctgtctctcttccaacaaaccgcactatacactagctactaccttctccaattcatccattttcacgtagtaatatatacgcagcaaaattaagaggatttaattcttgtctgccatatctctgaaacaaattaaatctagtagttagtacacagtagtaattaactgcagctgaattcgatcatggcgtcgtcgtcggcgatggtggtgagggtggtggtggtgggcgtgctgctgatgcaatgctgcaacgcgatcatggcggcgaggctgctggaaggcgacttgtttggcagcagctggctgcagggcgaggacggcgtcgccgccggcgagctcatcttgcaggtgctcaaggtagtgccatcgggaccaccaggcaatgattgccaccaaggtggcgccggctccggaggccagtgctaccagccgcctaagtagccgcgccggccaccggcgcaccggccggcgccgccatggacgatatggatcgtggcccggttttgctcgtagagtagatcgatcgatcaactgttcatttgatacgatttatttgttctatatatacgcctgcacacgtagagctagttagcttccatgcatatgcagaaaatggagctttgcaaagctgttcatagttgtagttaggttagtcaatttaggcgtattgatttgtgtaatagcgtactagtccgtgacatatagctagctaggttgatcctcaatgtatatatgaatcatacacacttgtcaatacaagaagagatttacacagtgatcgtttcacacatgctgattaatttataaataaactatataagctgcaaattactcatcaacaacccaaaaaacaatttgtcaataaaaacttttgtatatgtgttcttaagcaatttagaagcaaaggctaaaaaataaactataataaaagaaccctttaatcaactccaaaattaagttttcaaattcaaatttgtgttgctgcttataagctggaatgtaccttactttccttttggttttcccttttaacacaatatatatatatatatatatatatatatatatatatatatatatatatatattgtggtattgttggaagaaatgctatcttgacatggtactaaggg

SEQ ID NO: 2946 - DNA, 1501 bp, Oryza sativa
gtaagaggatatcctcttgagagatgaaaatccatatccttttgttcttctccttgctgttacattctgtttgcaatcactttgtaaattgttttttaaataaatatataaatacgtatcaaagtatatatatatatatatatatatatatatatatatatatatatatatatattacgtcctacacaatacatatatgtactttcattcattgtagtctaacaatttaataattattagtgttcaaagttgaaacggtcaactaatataaatgcatatatagatcatcatcaaataccaaaattaattgaattaatccaaataaaactatatatctttatcatctggcgaaaactactttacacaatttaattacaattgtctgactattttctctcctatatactccctccgttttttaatatatgatccgttaattttttaagatagattgatcatttgttttattaaaaaattatgtaattattatttattttatcgtgatttgatttatcatccgatgttctttatatttgtacaaaattattaaataagatgaatagttaagtgtatatcaagaagccaatggagtcttatatttaaaaacagagatactacttgcatgcatgatatgctctaattattgactactacactgattatgaataatatgaactatatatacatcattcgacttcttccaacgtacactccatctttacatatatggaagctcctaattactgcatatatcattaaaaaccaaataatgaatgaaacaatctctacagatcatctagtatatatttacatgcatacatgtcgacatctacatacaactaaacagagaagcagccggtgtcagatcgccgcatgcagcagatggcgatcgagtagtataattaagctagctagccgctgccgtggcatggtgcgccgttgccgccggtctcgccttgtttgcacccattgcctaccggcgtggttggggtgctggtcttcagtatctgcatgacgaacatctcgccgccaccgcctccgccaccgccggcggcggcgacgacgtcgcccttcaacggcctcgccgcgaggagcacgccgcagcactgcagcaacacggccgccaccatcaccgccctcaccatcgtcttcgccgacgctgacgccattaattatatgatttcttgatgaattcttaattaagctagctagctaggtgctcggcaatggtgtaaagctcagtgagacgacgagtgaattgaatatagcagacagaaagtgcgtttgctgtacgtcgaatgggtagctagcttgattaaagaaaagagtaatagcttgtttaatttgttggaggaaatcagacaacctggcttccttttatagtagtacagttcatatatgttcgtgacttgaccacacgttgaactgcatgtactagtaaaaatcttaacagatgaacgggtctaatcgtacgagtttaccagtagtactactaattaat

SEQ ID NO: 2947 - DNA, 1501 bp, Oryza sativa
tggcacgcttttcaagctgctaaacggtacgtttcgtgcgaaaacattctatatgaaagctgctctaaaatatcatattaatctattttttaagtttgtaataatttaaacttaatcaattatacgttaatactatatctcgttttgcgtaaaaaaacttaatctttatcttcagaagaaaagaacaccacgccttagtgtaaaatcgtcgtatgtgctaaatctgatgcaaagggacataagatactcgctaagataaaggagaaagtgaaaacctggacatgagcggaagtgaaaagactcatgaaaatgttaccatagcttttttaaaacatttgtatagctttttttttattatttctgaagtctttgtaaatacttttactcctactctacattgaaattggcactatcttgtgtcagattgttaaagaaaaaggagctctttacatggtgcaaaacgcaattaacattgaaataaaaaaaatccttgattctactccgtacgtagtccatatattttctttcagccttcttgaggttatcggcttactgcacgggcatttcgtagcatgagccgtcaaggttgagagaacttgttggtcaactaaaagcacgcacaggaactgagcattagggcatgtgcacatttctgcagtggccgaacgtgatggtggtgccagatagactgccactgccagccagctgctagatctcgtttctgaacccattatataacaataatactattaaattcctaccaaataaaaaatcatactacctccatattagaatataaaaagttttagagttagacacggttattacagaaatagataaaatttaatggagagatgttgtaattggttgaaaagtggagatagatgagaaaagtaaatggtagtggggttgtgattggttgaagagaatgttggtaaaaaagtaattatattttgggacaaatcatatatgctataaattattatattttaggacggagggagtactacaaaactaagcgccattttcacacacgccattgcgaagggagcataactcaactgattagttacttctggtggaaccaatccgtctaggtataaatcctagggcctgttcactttgatgtcattttcaaccttaccaaattttagtaaagttgcaaaaaaaaaggctacatttagttcgctgccaaattttggtaactatataagaaatcatgctaaaattttggcaagttgccaaaaaagtggcaagttttttttggcatcatagtgaacatgcccctagattttacacgggtgctaatatttacgactaattattatttcagtggtaggcgatgtacccgttggcagcgagacgtttgtagtaactttgtcaatctcaagatatatcgacccagtctttcggaagtgcttatagagataaggtgtacgtgtgtatccataagagtgagtatgtgcgcgttatgtacgcttgcatttatattgtgtttcta

SEQ ID NO: 2948 - DNA, 1501 bp, Oryza sativa
ccatgtacagactacaaaccaaattgcaagttcagattgagcgttggatgatccagggatactgcaatagttgcattcagtcaatctcgtccgttcaatttcctgctgcatgttcgactgctacagccgatgaaaattccagtgaatccacgagttgaaacctaagtgagaaaatgagggagcggggaaagagatagagaagaataatcgaaaggaaacagacaaaatggtggtggggtttctttaggatttgtagggagatagtgttaggcagcgccttattggtggcagccgtatattattgctcaaggaaagagtgaggagttagaacaactctagtgtagcctacagagtgaaaccaaaagagagaaggaaaaaaaataacaaaaaggagtagatgcagttttagttcttattattctaatcttctctcttgttgcaatttctttttagaatccttgggatcatctctgtccccgttctgggtggtttctgtcatactccaggaactgtcttgttctagctctttgcttggtctgaaagtcgatttctgcacaggtatatagccttatcctatcaggtttaacgttgttctttggttgcatcagtttgtctttgagtttgatctgagaaaaccaaaaggaattatctttttgggcttgattggtgttcatatgaattcttggtattgtcttctgccttcttgcttgttgaactttccgtttcttgttagctcctttgtggttggttggtgtgccaactgaaaagattgcttcttgttacgtagattattgttgagattgttttctgaatttctcaagcagcggtgagtttttgttgaaattgagctgaatttctctgaaaccaactatttctggatgcattcgtttttgtagcttgctgagaaattcagactcctttttttccttttcatgatttcacaagtactggtttgaactgctattttgttcgcattagatgctgaatttatcaaattgcaggtactgcgaaagctttgggaatagtattgcagaaagcgcagcaatctgaagcttactgtccaaggtagacagctgacataagcagtttagcacttgagctatgttggattcacttcctcgtcttcctgacatattccagtttttcctctcttctttcaagaatcggaattacttcagttgtactaggaattctgaacttcgtttgtagttgctgtctgaatttgtggctactgtttactactggactcatcgtcacgtctctgacaaaactcagtacaccatgttgatgcacgagatgtttttgctcctattaaatcttctgtggttttttctctgaaacgtctgactcaagtatgaatgttactagaaagcaacaacctaaaatcagattgcagcaatccagcagtctgaatttactacctgaaatcatctcaaagacgaattggtactactagttttgaatcctcactcgttttttttgttctcttttgcagccagtt

SEQ ID NO: 2949 - DNA, 1501 bp, Oryza sativa
acgctggttcaacattgtgtcaaacagttgcagcgccttgtctagtttaccctctatgcaatacccgtgaatcaaagttgtgaaggtacataaatctggtggaacccctctctccctcatctcattcaaaagcccttctgcatctaacaacctgcgctctttacagagcccattcaacaaagtattgtaagttaccacatctggcaaacatccacagccaaccatctcatccctaactctcagagcatctgacattaacccagccctacaaaatccgcctattaccattgtgtaaatcacaccatcgggtaccaatccaaagcacctcatctccctcaagtacgccatcgcatggtccatcttccccctccttgcaaacaatccaattaagcaactaaagctcaccaaatctggtttaataccacggtgccgcatctccttgtaaatcttcaacgcctcctcaatctccccaactctacaaaatcccccaatcaaaatggtaaaactccgaacatcaggcgcaacaccaaaatcatccatttctttgaacacttcccatgctttatcccacatcccactcctacataaccctttcagaaccgaattatacgtcacaatcccaggctttagccctttactaaccattgagtcaaccaacgccattgctgcctccgcgtccccagcgcgaaatctagcatcaaccatcacattatgtgtaaccacatcaggaaagacacatctcttctccatctcggagatgacagcgtcaaccttgtcgaactccagggctttgcagtagttgtggaccattatgttaagcgtgtacgtgtttacctcggagttggaggagaagacaaggcggtaggcgtccgcggcgagatggggccatccggcgcgggagagggcggcgagcagggcgttggaggcggcggcggggatggggacgcggtggtcgaggatgaggcggaatgcctcgaaggcctcgcggggcttgcgggactgggtgtaggtgcggattaggaggtcaaacacccgcggctgcggggtgggggaggagccgaggagggaggagacgatctcgcgacggcaggcgccgcggcggcgcgacatgcggaggaggagggactggcattcggaggcgcgaccggcggccgccgcggccgtcgcggcagcggccaggtcggctgttgcgggcttccctccgcttccaccgagggcggcggcgagacctgccgccgagcgtttggtggtttcggcggccgcggcggcggcgaggcgacggggaatcgccattggtgactcgaggagtcgaggtgttcgtcccaattggtgagtgttactaactaaagccgtgttcaaacaaggaatacgtattccgtagaaatcaaaatagagccaccctaaacgtaatcacaaaatacgctttcgttcgcggcttccgtgtgccaagctggaatccgactcggagcatagcgagatcaactcggtttcgacatggctt

SEQ ID NO: 2950 - DNA, 1501 bp, Oryza sativa
tttgacttaaccagatatagtttaatttatctttttataacttgcaaaagttaaattttaacttgtatgttgtagagtgataacatgttaacacttcttctatttttctactatttttttataactatttgagtacaataaaacaacgaaaggacatcttccagagagtttaaaatccactctctctgcgttagattaagatctcgatatgtgcaacgtagagagtttaaaatccactctctctgcgtttgattaagatctcgatatgtgcaacgtagcaggctagctaattcagtttttttagatcgatcgatcaattgagtcggtggtgaattggtgatgagtctgcagcaggtgactcatcgatcgatcgatgcgcgtaaaataaacctgcccatgaaaccaaaccaatactaatataatcaaaatcaccgccactttctcggaagtcataaggactaatttagagcagatacaatagcaggctctaagctatttataaacatattttaaaaagataaaggaagagagaagagaagtgggctacagatctatagctagctgcagcatggactccaaaacgtaatatgtatatgacaggtgggaccaagtattaatagtatagtaagcaactattgtataaattggctattacattggctatagatgatttggagcgagcagtagactatattattaaacttgctcggcaaggcagccagcaagtctgatagagcaacatggactgacgacagcggccgggctagcttgcttcaccattcatatagtcatgcatatgcatgcaccaagtaagttcgctcgtaactgcgtacatagctagtaattaatactgtagattatgtaaagtactacgtagtaatcagtcagtcagttatttggtcatattatatcgcgatatccacggtagactagctcgtcgaatacgactagtagctaactagttcatctcttcatcgatcgatcgtacgtgtcgtctcggcaaaattgtgtgtagttacgagatcgacgtaagttatatgcaagccgggaagtatacggccggggtcgatcggtggattggtccaacaacgagagctatagctcgcgcaggcaaagttactattttattaaactcattaaattacatctagatgatatatttgttctacatataactgagatgcacacaattaaaaaaaaagattactaacgagtacgtacgtatacatgcgtacgaacatggacacacatggttttattttgatcgtacgtatgaatattatcttgaatgaatggtatttgtacttgtcaatgtcaaacatacgacgattgaattaaacgtgaccgcggctcgctcgctagctcaaaaaaaccgcgtttttccgcgaggcgaggatgacaataaaaaaaggcttaaaagtagcgccttttacatagcgccgacgaatagacccggtcccttttgtacgttacgttgcacaccaaactctcttccctcgct

SEQ ID NO: 2951 - DNA, 1501 bp, Oryza sativa
tattaaactcattaaattacatctagatgatatatttgttctacatataactgagatgcacacaattaaaaaaaaagattactaacgagtacgtacgtatacatgcgtacgaacatggacacacatggttttattttgatcgtacgtatgaatattatcttgaatgaatggtatttgtacttgtcaatgtcaaacatacgacgattgaattaaacgtgaccgcggctcgctcgctagctcaaaaaaaccgcgtttttccgcgaggcgaggatgacaataaaaaaaggcttaaaagtagcgccttttacatagcgccgacgaatagacccggtcccttttgtacgttacgttgcacaccaaactctcttccctcgctctctatatatagccagcccatcctgtctctcttccaacaaaccgcactatacactagctactaccttctccaattcatccattttcacgtagtaatatatacgcagcaaaattaagaggatttaattcttgtctgccatatctctgaaacaaattaaatctagtagttagtacacagtagtaattaactgcagctgaattcgatcatggcgtcgtcgtcggcgatggtggtgagggtggtggtggtgggcgtgctgctgatgcaatgctgcaacgcgatcatggcggcgaggctgctggaaggcgacttgtttggcagcagctggctgcagggcgaggacggcgtcgccgccggcgagctcatcttgcaggtgctcaaggtagtgccatcgggaccaccaggcaatgattgccaccaaggtggcgccggctccggaggccagtgctaccagccgcctaagtagccgcgccggccaccggcgcaccggccggcgccgccatggacgatatggatcgtggcccggttttgctcgtagagtagatcgatcgatcaactgttcatttgatacgatttatttgttctatatatacgcctgcacacgtagagctagttagcttccatgcatatgcagaaaatggagctttgcaaagctgttcatagttgtagttaggttagtcaatttaggcgtattgatttgtgtaatagcgtactagtccgtgacatatagctagctaggttgatcctcaatgtatatatgaatcatacacacttgtcaatacaagaagagatttacacagtgatcgtttcacacatgctgattaatttataaataaactatataagctgcaaattactcatcaacaacccaaaaaacaatttgtcaataaaaacttttgtatatgtgttcttaagcaatttagaagcaaaggctaaaaaataaactataataaaagaaccctttaatcaactccaaaattaagttttcaaattcaaatttgtgttgctgcttataagctggaatgtaccttactttccttttggttttcccttttaacacaatatatatatatatatatatattgtggtattgttggaagaaatgctatcttgacatggtactaaggg

SEQ ID NO: 2952 - DNA, 1501 bp, Oryza sativa
ttcctgttggtctccaacacactactactccacatgcatacacccaggcagatttactgccactatcaatataattaccaatgtatgcatttatgccatattacagatgaacagatttaatttgcaatcaaaagtaatatttatatccaaaactcataagcattatcttaaaaatttcttcgaacatttcctgatatgatggaaatcattgaggataatatcaatatcaatctcatctaataatttctttttattaaaaacatttatcaatttctcgaaagttataaattaacgacctataggcgcttcatgtaggttggcggttggccaaacgcactgcaatggggaaggggggggggtgctgacaaaccctgataacgtgtgaaccgggactaaagatgatcatctttagtcccggttggtgttaccaatcggcactaataattaaatagtgatgttgctcttataaatttggatttaaaaattatttttagtcccggtttttaataatggtttctccagtagtgagcagacagaccggcaacggcaggcatgaactaacctgaagtacagttctagctaactctagctcacaatataattcaagtatatgtagcagctagccagctaactctatatcgattggatgatcagtgatgagattgtgtgcgtaattatttaacttcgtcgtatacaacagctagctagatcagtcagtccagttcggctgactatagctctcgttgaatacccccctctcttgctcatcgatcgattgaaatcgtctcgatcagccaaaacgtgtagttagttactccctccgtttcgaaatgtttgacgccgttgactttttagcacatgtttgaccgtttgtcttattcaaaaaatttaagtaattattaattattttcttatcatttgattcattgttaaatatatttttatgtaggcatataattttatatatttcacaaaagtaagtttttgaataggatgaacggtcaaatatgtgctaaaaagtcaacggtgttaaatattttgaaacggagggagtacatgcaagtcgggaagtacgggtcgaacgtacgccggtcggttggtccgacaacgaacgggagctgacgcaggcaaggaggttaaacaatcgagttcatgatgatactattttaactaactactccttcatgagaatgtagttagcaaacgaacaacgtactgtaacctggctttgttggttgatcgtatctcaaaatcccttgaaatggccatacgtacagtacttgtagtcaatgtcaaacgtaggaaattgaattaaacgagaccgcggcccgctcgcacgctagctcaaaaaaaccgcgtttttctttttgttccgcgaggcgaaactgacaaatcaaaagcttaataatagtagtattagttcgttgttttacatggcgccgaagaaatgaagaatagacccggtcacttttgttgcacaccgcctttttaccaccaaact

SEQ ID NO: 2953 - DNA, 787 bp, Oryza sativa
  unsure (1)..(787): unsure at all n locations
ccactaataaagtaggagttatataccatgaagataagtgtataacgccaacttagagagcgtttgaaaagagaggaaatgagaaaatcgataagatacactaaacaaggtgataaattagcgtgttaaatattaattattttgaaattgaaaatagattaatatgattttttaaaataactttttatagatttttaaagagtattttcaaatttatattaatatcactattaggcaggacacgggaggtgatgacaaccgtctcgcgtgaacgggagaggttacgcctcctgcattgcactttgctctcccaattccttattcaattccctccgccctaaaataaatttatctttaccttattttatttatttaataagttcacttttaatcatcactacatcaaaatgtgtgtaaaggtaaggaataattgtcttagagcaagttttatagtagatgtgactaccacctctaatcttaaccatgtcatctacttaataattaagaggcaacatgtataatacattacctctaatacacaaccctaataattattttgttggttcactatgacatatctcactatctctttatacatctcatcttctcaaccaatcataatactccccatttaattccattaactttctttcaatcttaaaactcctgacattttgagacgaccacgtagagctagccgggtgcattcgtcactacacttttctaatttctactcctcatttttcacgctaacgttttccaaacaactaataatgggntttcttaa

SEQ ID NO: 2954 - DNA, 1501 bp, Oryza sativa
tgttgaaattgagtatatacccaattcaaatgagtataaaactttttcaattacttaggtattaacattaactactttactaactagtttaaagcaagtttgaattgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttaaaatatttgaaaaatttgagtgattttgtgcattagataccatggtgccatatatatatatatatatatatatatatatatatatatatatatatatatatatatatatatatatgttcgatacccaattaaagttaatttagttaagtggaagctaattaattaagtatctatgtaatttaacagtgaaataattaattgtgataccgccaatcaaagataaacagtaaattaattaatgctctagaaaaaaatcgtgtgattattatttacaaatgaagcagtcgtcacatttgttgtttgcaggtgacgtaacgtggatgtctctataagaattgacttgtcaaatttgtaagaaccacctgacacctgtctagcaacctgcatatcgtcgtggtcgtagtctaactacgcttgggcctagtgtatacatgtagggagatggattttcatcctcgggaggtgatatcatctcgttttcttatatgctatttataggttatgaaaaattattaacataattaatataaaatatatcatttcacaaaaatacaagacaaatacatttttttacaagttaaaaggaataaaataaattgaaaatagttaacacatatttataattatttttcttacaatatatgtatattatatccgtattaatagactattatttatatccgtattaataaactgaaaatagttaaatacatttagtggttaaatgtatttatttattaattaattgaaatattattgattaaaaattaatattaaaaattttggggaaaaaatatattttagcgcgaatatttttccaggtagctagactagcattttcgtaggcggcacatcatgctctcgttcacctaggaaaattgatcttcccaatcggatcggccggctgctgattgttttcgcatgtctttgcctacaggtggactggccgtccgcctaggaagaccgttttcatcagtgtagaaaaatggtgtcaaattttttgaaagaaaaatattgataaatgcatacgcagtccctatatggctatatatatggtggtaaactggcatgtacacatgctgttgtgagtagtgattagctaggcggctattagcagcagcaaccagttctttttgcgtatgatagatgatgcagagtgcagctggagcaatggagctgctggtggcgtcgcaagaagcaggcggcgttgtggtggtgggcatga

SEQ ID NO: 2955 - DNA, 1501 bp, Oryza sativa
tctcttttttcgtatgcacactttccgagctgctaaacggtgtgtgctttacaaaaattatttatagaaaagttgctttaaaaaatcatattaatcaatttttcaagtttgaaataattaatactcaattaatcatgtgttaatgactcacctcgtttggtgtatcttttcaatcttctcctttcctttcctctcaaacacaggttggttatgtttagctttcacatgcgagatattagtggcaacttgctgatagtgatataacatgctctcctgttttgctacgacggctaaattgcctatgatttgcatgttataggttggaaagttaaaatctttgtgcgagagcttctttaaactgaaggacgttaaactgagactgtatcttgaggaagaggtatggattatttgtgctgtgtatgatcattgctcatgtattaaaatgttgtcgagaaaggaaaaaaaaaagaaaagaagaggcagaaagctaggtagggtaaaatacttgcatgctggaacggctgggatctgatcgatttgcattttgacagggttgccctatgccgcaattcttcgaggaagacacggtttctctcatggagcttgggatcggcacgggatcgaccattatcgtggacgaagaaagctagcctaatctagtttactggcattctttgtgtgcgttttaatttgatttatttgagtaaatttggtgtgttgagctggagaaaacaaagtccctgtaacatggtacaaatgctcaagtaacttacactcggcagcttaacgccatcaaatgtgtgtgcatgtacgtgctctcgagtctcgactcgaccacattatgagtcatgacagaaagacaatcattcttgctgtttagtaccttttgagcataatggctggttatagcaacttatcttgctgtttatcttttaatcataatggcgggctggttatagtaacttttagatgtaaatctaggcatatttttttatcaagatatataattaaaagttattatattgtaagacggatggagtactattttttttcttgtttgcacaagaaaaaaaaaactggatgtagcatatgattctccaagccttttctatctgccgcgtcgctctccatccagcgatggtgaattcgtcaaatctaccccatagttcaacaaatgatttcagtcatcactcattctttcggttctcacgcaacggtctagatcgcatctacggaattgacattgtgctatcttcaggattgggtttcactagaatgccatcctaaaatatggcttcgctaaaacaccattttcaaaccagtacaacttgctggaatgccatttcttcctctcttttttttaatcaaattacatgaattttaccttgtttttcttgatgagctgaccaaaataccccctctagatttcatcccctctttcgttgctttgttcccatcaccggtgagccaccgccaccattctccttggctccttctcgtg

SEQ ID NO: 2956 - DNA, 1501 bp, Oryza sativa
aaggaggatcacaagaagaaggcaaccttggaaactaaccaaggaagcaaagcgaacaaaaaggttgcttcttttcttggtgcggtcgcatccgttttatcaggccataaacccaagtcaggaactcccaactcacaacaaagtgggttcggtttgccggctaaaaaggaatttttaagagtcaaaaaggactgggagcttttcattgacaggtgactaagcacagtcaatttcttcccttcagagtccaaattaaagttaggctgtcttgatttgtgactcaaaattactatatttatcttttttttatgtccatattcatgtatatttattttaggacggagaaaatactagtacaaacttgcatgatacagtatattgtgaaattttgtatgataatgtaaagtggtttggttgtggtagatcttttttacttattgctaccaatggtgtattattattagttaaagattgtaaagctggtgaaagcttgacatataaaggttttgttttcatctagtacagtagtagagtatttttttttcttttttgattgatggtgataaaaaaatcatctctcccagttgcaacttccaaatttggccggataaggccagcccacagcccaaaatagtgaagcgatggggctaaatgggccaaagaaatgaacggcaactcccaattcacttcacttcgtagtagtagtagtaggagacgacatccatggccgccgtcgccttccgcttgggacagcgcgtgcacgccgccggcgaccccgcccgcgtcggcaccgtgcgttacctcggccctgtcgacggccaccccggagactggctgggcgtcgactgggacgccggcgccggcggccgccatgacgggtcgctcgccggccgccgctacttcgttgccgccggggaacgctccgcctccttcgcgcgccccaccgcgctcagcgccgggatcacgctccccgacgccatacgcaaccgctaccgtgtcgaggaattcaccaaggaggaacaaggtccgcatccctcgattcctcggcttccaaatccaaatcttgctgctcttcattccaccagctagcttctttttcttttttttttcccattccacttattaattttttgctaaaattcatcctagtacatactttctaccttctatgcgttgtaaatagcattcgagaaatcggctacacattttttttgttgcattatacaacttaggctcaagcatccatgttggcatgtgtatatgtactagttcttgaatttgacagttgctcattgcttgagagcatgtatgggacacctcgtgttaaaatttcaaaatcatgtgctattggtgggttggcgtaagattttccagctactctgttttcttttccctgtttcaagggcagaagattttccgttgcttgtaaaagcaatatgcatacacctttttacatttataatgatacccgatataaacattttgttgtgtccagatgaaa

SEQ ID NO: 2957 - DNA, 1501 bp, Oryza sativa
attgctacaaaatagaagtggctaacaatcagaagaaagaagaaacacggtaaagaaataaataccttcgggtagtcacaggaccatcattgcatgcccaaccctgaatcaggtcaatctggatatacatttgaattgaactgtcagaagagactaaccagttatgataatgcactcaacaaataataataagctaattttagttggaactgcaatcgttttcctcaaaattagtgtgcactcatcaggaattggtactttggtagtgcagacatatcatggtatcaatatcagaattagccataagttcgtatcagtatttttcaggaaagtcagggaaaagcagacaatcaataggcacactacttactccgttgaaagaaatttcagcattgttatcacaatatgacattctagttatcctgagaagctatatttataatttttgcattgcaaattattgaactgtaatgctatcttttccactcataagcagtgaaaagatatatatccaatcagcttggttaaaattctcatctcacctatatatacagaagaaaatccatcaggtttctttaaataattgtaaaataaacaaaaaacaatcatatattactacgatatcaagttgcaaattgctagagcccctgctagaatttaactgtctcaagaaacccaggacacggaggtaggggatcggcaggattgaataccaaagaggttctgcagctgctccttggcgctgaagttgcagtgcttgacgtcacacgtcaggctggaggtaattcaaccagtgcagccgacctggtcgatcatgatcccctccttctcggccatccaggtggtgaggaactgtgaatacggtcaggacgccacagtgccacacccgtcggcgcggggtgacggcagcgagacagacgccgatgcccggttataatcctatcggcaaggatgacggcgcgcgaggcgagagaggatgacggcgtcgattggccgaagcggaggcgtcgggagtcggccgtaatgcgtacgggagggcggaggatcgatcgcatgcgagaggagattaggagttgcgcgatcagcgccctacgagccgggtggggtagcgttttgcacgatgctgatagggaacagagggaggtgcgcgatttctaatcgatcggagccgtcggatcaacttcatctgttggttttggatcgttggatgtgtcacacgatgaatgagtaaaacaacttgttgaactatagggtagatgtgatatgtaagaattgccgtgaaggcaagcaaggagcacgaatcgcgaaggggaaggaacggtggagacaggtggttgattcggctgggaagtcatctaggagtgagtctcccactagactagagtgagctggctttattgagagttgagttgttgttgttgaggaggaagtgaagaagaggcagtagaaagaagtagcagtagcagaagagaagggaggaagggaattggatagatggcgg

SEQ ID NO: 2958 - DNA, 1501 bp, Oryza sativa
tccagtgacccaaccaaaatatatacattgtgttccctctaaggaaggtaacgtttccaatatataagatcaggaagcttgacatgtatcgctgggttgcaaaacaatcaaataaaagagatgatttaaggattaaaggatagtaagtacttggaaccaaattctttagttcatctcctggcccaattgagcttactcccatgtaggatacagatgcactggtcagatcattgaggtttttcagcttttcctcaactttgttcttgccaaccaattccactgacacgcgcttctgacttgatgagaagacatacatttcatctggacacaacaaaatgtttatatcgggtatcattataaatgtaaaaaggtgtatgcatattgcttttacaagcaacggaaaatcttctgcccttgaaacagggaaaagaaaacagagtagctggaaaatcttacgccaacccaccaatagcacatgattttgaaattttaacacgaggtgtcccatacatgctctcaagcaatgagcaactgtcaaattcaagaactagtacatatacacatgccaacatggatgcttgagcctaagttgtataatgcaacaaaaaaaatgtgtagccgatttctcgaatgctatttacaacgcatagaaggtagaaagtatgtactaggatgaattttagcaaaaaattaataagtggaatgggaaaaaaaaaagaaaaagaagctagctggtggaatgaagagcagcaagatttggatttggaagccgaggaatcgagggatgcggaccttgttcctccttggtgaattcctcgacacggtagcggttgcgtatggcgtcggggagcgtgatcccggcgctgagcgcggtggggcgcgcgaaggaggcggagcgttccccggcggcaacgaagtagcggcggccggcgagcgacccgtcatggcggccgccggcgccggcgtcccagtcgacgcccagccagtctccggggtggccgtcgacagggccgaggtaacgcacggtgccgacgcgggcggggtcgccggcggcgtgcacgcgctgtcccaagcggaaggcgacggcggccatggatgtcgtctcctactactactactacgaagtgaagtgaattgggagttgccgttcatttctttggcccatttagccccatcgcttcactattttgggctgtgggctggccttatccggccaaatttggaagttgcaactgggagagatgatttttttatcaccatcaatcaaaaaagaaaaaaaaatactctactactgtactagatgaaaacaaaacctttatatgtcaagctttcaccagctttacaatctttaactaataataatacaccattggtagcaataagtaaaaaagatctaccacaaccaaaccactttacattatcatacaaaatttcacaatatactgtatcatgcaagtttgtactagtattttctccgtcctaaaataaatatacatgaata

SEQ ID NO: 2959 - DNA, 1501 bp, Oryza sativa
aagctcacgttttttttagcaggagaaaaaagcagaatgcgacagagaggggattgcagattggatccctgatctggatttgtcaaaataaaaaagaattgctggttgaagagaaagatcggatctaaggtagaggaggggttgcttgcagaaaatggtagatcgcgcgaggagaaagaggaattgaattgattgagaaaggaattacgaagcagctagggtagctagagctagtggtaagtacagtaagcaggaaggaaggagatgaaagatggacatacatggagggtgcgggtggcgaactcgacgccgatggtggacttggactcgaggcagaactcgttgcgggtgaaacgggagaggaggttggacttgccgacgccggagtcgccgatgagaaccaccttgaacaggtagtcgtactcctcctccgcacgccgcgtccccgccatctatccaattcccttcctcccttctcttctgctactgctacttctttctactgcctcttcttcacttcctcctcaacaacaacaactcaactctcaataaagccagctcactctagtctagtgggagactcactcctagatgacttcccagccgaatcaaccacctgtctccaccgttccttccccttcgcgattcgtgctccttgcttgccttcacggcaattcttacatatcacatctaccctatagttcaacaagttgttttactcattcatcgtgtgacacatccaacgatccaaaaccaacagatgaagttgatccgacggctccgatcgattagaaatcgcgcacctccctctgttccctatcagcatcgtgcaaaacgctaccccacccggctcgtagggcgctgatcgcgcaactcctaatctcctctcgcatgcgatcgatcctccgccctcccgtacgcattacggccgactcccgacgcctccgcttcggccaatcgacgccgtcatcctctctcgcctcgcgcgccgtcatccttgccgataggattataaccgggcatcggcgtctgtctcgctgccgtcaccccgcgccgacgggtgtggcactgtggcgtcctgaccgtattcacagttcctcaccacctggatggccgagaaggaggggatcatgatcgaccaggtcggctgcactggttgaattacctccagcctgacgtgtgacgtcaagcactgcaacttcagcgccaaggagcagctgcagaacctctttggtattcaatcctgccgatcccctacctccgtgtcctgggtttcttgagacagttaaattctagcaggggctctagcaatttgcaacttgatatcgtagtaatatatgattgttttttgtttattttacaattatttaaagaaacctgatggattttcttctgtatatataggtgagatgagaattttaaccaagctgattggatatatatcttttcactgcttatgagtggaaaagatagcattacagttcaataatttgcaatgcaa

SEQ ID NO: 2960 - DNA, 1501 bp, Oryza sativa
ccccagcagaagaactcacgactcgtctggagtgactccgccgctacctcatcggcccctcccctattttcatctcctcgcgtcctcattggagacaaggagggatgaagatgtcccccatctggttgcatataaatgcatccgccctacccaaacagaaggaactcacaactcgactgttaggagtgactccgccgccacctcgtcccctcccctccatgtcatctccgtgcgttatcgccggagataaggaggaagagaacaagttcctcgttcgtcttcggtaggttttcaataaatcttgtacgaggttagatcgattagatgttgatgggactttggcttctctaaagtcttttgctttttatccctttggtggtgggtattccattcgtaaggctatatatggaaaatttgggaagacttctctattaggtcgtcgataattatatttgcggtgttgacttaggaccttggtttccgatttattcgataacatcgggtcaatgttgtatgggaagaataaaaatgttgacgggtgtttgttcatatgttttttgctgtgttgagattggttagctaccatgacagtggctgtatgcatgtttatcttgtgtcgttcaaagatgtagagcctcttatgctatattttgattgtttctatattttaaaagcaaagtttataaccatgggccagaaaaaggaaaactatatattggtttatatggtccggtttagcttttgttaaaagaagactttagaaaacgtgagggtgagggatattctttttaggtgtaaagggcggtttaatctattattataaaaaaatgtgaggagttgatggatggatgtttgtttgcggaagttgtgacagagaggagagagagagagggggggtggagtagtgttgtgacggtgggtcacgccgctgaagggggaaagacgtgggtggtggggtgtggacaactggcaaatggagagactagagaggaaggtggggggcatattggtcatttcaacctgccgcgcgttttccttccttcctttcttgcttgtttgatttccccttccttcccaatttccatcggcgggcgcgggagcgggcgggtgcgggggcgcgcgcgcttctcccagttcccatccaaaaaaagaagggatccttttcatttcattttggtagcgtggcgtggcgtgtggggtccggttggcagtgagtgcggggcgggggacgcgttcacaccaagccacggcagctgacgcgtggggtccatcatcgtctccctccggcgatccacagatagatagagacgcctgggctggggctggggggctacaaatagcaaggacgagtgaagaggaggagaccaccccactccgctgtcgggttgggttttgagatcgaaaatttttgagatttcaaaacctcctccattccctcccttcctcgcccccaaaaaccctagccgccgccgccgccatgcctgatctcccctgcgacggc

SEQ ID NO: 2961 - DNA, 1501 bp, Oryza sativa
ccaacacttcttcagttgcggcatcaggcgcctcttgctctccatgcttggtccagcatgtatatttcttcatgaatccattcgttatcaaatgagaatgcgcttctgaactatcaaggttcatcttttcattcttatagtccctacatggacacaatatgtacatgctcatcctactttttctgtcattctctgcaaatgtgacaaattcagtgaccccctctctatactctgtagacgaacgatgaacatggtacatccaactacaatccatctgaaatcaacaacataggaagaaaaatatatgatgatcgatcgagaatgaatggagaataatgtgggttttaccttcaattttagcaaaaattcgccccctgccctcccaacgatttgtgaacagtgaacttgtcgggatggaaagcagttgacggtttagggggtatttatagacccaacacacctcaaacaggttaggtaaaaaaacccgtcaaaggtgttggtcataactttgacgggcttcaattgagtttcccgtcgaaggtatcgacctacctgtgatgggccggaaaacaaatccgtcacaggtggcggcccatcacctgtgacggcttataatgccgcggcccgtcacaggtgaggggataccagtgacgggttggaaaacccatcactgtctcacctgtgacggctttgcctttcagcccgtcacaggtgaggggatacccgtgacgggccgcggccggatgcctcactgatgacggcatcccgtatgacccgtcaaaggtgatggtcatcagtgaccaaatcatttgcccgtcacaggtatcccgtcagagctgtgaggatctggcgtagtgccaccacatgcgtcgttgcaacaaatcacccacatattacgataacgctttattaaggaaatccgtttcattttttttccaccaacaatgtttcagcaagtatactcatgatatttcactatatatatagattaaatgttgtagtgaaaggtcctttcgctatttgctgaaacattgttttatatatgttgaaagagcttcaaaaaccattgtttcatacgttttagcaaaatgtttcatgaggtgatttggttgcgtttcagctttttaaacgattgaaacattttttatctacttagtgaaacaattccgatctacttggtaggcgcctcgggttaattttggtcctttttgctagctggtttttttccaaactgaatctgttgcacttttttttgtttctatctgtttttatgtccttggtttttcccgatccaaattgatgcacctcgcgtctccccgccgccgcccgggccgaacctaaaaaaatacgcagcttggtttttttttgccactggttttttccgatcctaaccgatctgttgcaactttttttacttctatctgttttttcccgatcaaccgatctgttgcaccacgcgccttcccgccgcggttgtatcaatcgtgcgtttcctcctcca

SEQ ID NO: 2962 - DNA, 1501 bp, Oryza sativa
aaggcaaataaatgtgtgtactatcgccatggtgggggtgagggagttattttgtgcttgtaagttgacgacatactgatatttgggacaaaccttgaggtgataaatgaggttaaatcattcttgtctcaaaattttgatatgaaagatttgggagtagctgatgttatcttaaacattaagctaattagaggtgagaatgggattacgctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgtggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatatgagttatactatggtggtaacccagtctatgtgatcggagatcccgtgaattagatcctgagaagaacaaaccattagtaaactagaggagagtatcaatatatataccctctccaagtgaagatgcatgtactctcgtgagctgcaaggcaggttggctatgccttaatgagttctgttgactttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgtaattcaaggcgtagtccattgttcaagttgtgagtaagtgtagcttggaattctaggtggatgttcaaccttaattggtctccatcgaacc

SEQ ID NO: 2963 - DNA, 1501 bp, Oryza sativa
cccaccatggacctgcaccagctgccggaggaggaagcagcggcccccccgcttcggtcgtcttccaccatgaccggtaccaggaggccacaattgtaaggacgagtagaagaagcacaaccacccaccatgctcctgctgccagggactccatattcatcgatcgatcgatcggtatacgactagctagctaggttgctgagcttgttcatcttccaccgcgcgctccaactacacaaacagctgatcgagccctgccccttaattgggccttgatgataaattctactccgatatcatcaatcatcatgataagcctagctacaaggccactccatgcccaccgttacaacgcactcactcaatcccttgtcaacacatctactctagctactatagctactatagtagtactcccaccgtttctaaatatttagctactatagtagaacatatttgactgctcgtcttattcaaaaaattttatgaaatatgttattggaattaatgaatgggtcttagcccactcgaagattaattctttggaaaatcacaaaagcccacctcatgggatggcatgcatgtggagtttagtaccaccttgcttattctaggagagggggaccttattaaaagggaggatgccctcctagtcacttgaagcatgtgtggtggagagaagaggggaaacacacgcgcgcactcgctcgcctggcctggcctggcctggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcagcacacgcaaaatcaatctagggtttgcctcctactctgtactgcgccgtcgctcgtagactactccatcccgctcgccggcgtgcaccagcgatcgggagagcaggtctccggaacctctgtctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcaccttggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttacta

SEQ ID NO: 2964 - DNA, 1501 bp, Oryza sativa
atacgatgctggagctgatcttccccgtcaaatccggccgaatgtttctcgatatccaaaattaattgagggcttttgatccaccgatcatttctttcccttttccaaaaaatagagcgtaaaactcggaagaccgggaagatcatggagattaaatccgacgaattaaagccgaatcgaaagggaaaatcatgtagaaaatgatggaaaatcatgtagaaaatgatgagcgagtaatgagaaatcgatttttgtaatcaactggaggaggaaacgcacgattgatacaaccgcggcgggaaggcgcgtggtgcaacagatcggttgatcgggaaaaaacagatagaagtaaaaaaagttgcaacagatcggttaggatcggaaaaaaccagtggcaaaaaaaaaccaagctgcgtatttttttaggttcggcccgggcggcggcggggagacgcgaggtgcatcaatttggatcgggaaaaaccaaggacataaaaacagatagaaacaaaaaaaagtgcaacagattcagtttggaaaaaaaccagctagcaaaaaggaccaaaattaacccgaggcgcctaccaagtagatcggaattgtttcactaagtagataaaaaatgtttcaatcgtttaaaaagctgaaacgcaaccaaatcacctcatgaaacattttgctaaaacgtatgaaacaatggtttttgaagctctttcaacatatataaaacaatgtttcagcaaatagcgaaaggacctttcactacaacatttaatctatatatatagtgaaatatcatgagtatacttgctgaaacattgttggtggaaaaaaaatgaaacggatttccttaataaagcgttatcgtaatatgtgggtgatttgttgcaacgacgcatgtggtggcactacgccagatcctcacagctctgacgggatacctgtgacgggcaaatgatttggtcactgatgaccatcacctttgacgggtcatacgggatgccgtcatcagtgaggcatccggccgcggcccgtcacgggtatcccctcacctgtgacgggctgaaaggcaaagccgtcacaggtgagacagtgatgggttttccaacccgtcactggtatcccctcacctgtgacgggccgcggcattataagccgtcacaggtgatgggccgccacctgtgacggatttgttttccggcccatcacaggtaggtcgataccttcgacgggaaactcaattgaagcccgtcaaagttatgaccaacacctttgacgggtttttttacctaacctgtttgaggtgtgttgggtctataaataccccctaaaccgtcaactgctttccatcccgacaagttcactgttcacaaatcgttgggagggcagggggcgaatttttgctaaaattgaaggtaaaacccacattattctccattcattctcgatcgatcatcatatatttttcttcctatgttgttgatttcagatggattgtagt

SEQ ID NO: 2965 - DNA, 1501 bp, Oryza sativa
actatgttctcacacaattctcctacagcaacgagcgaggtacccatctagttcattctaattttttgaattgttaaatatattgcgcaaaatataattaagactccaaattgacgcagtcttatatatattatttatttattaaaataataagaaaaatagtccagtttacacatatatatatatatagtaaatttgtttggtgctccatggtgcccggacaccattgttgaaattgagtatatacccaattcaaatgagtataaaactttttcaattacttaggtattaacattaactactttactaactagtttaaagcaagtttgaattgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttaaaatatttgaaaaatttgagtgattttgtgcattagataccatggtgccatatatatatatatatatatatgttcgatacccaattaaagttaatttagttaagtggaagctaattaattaagtatctatgtaatttaacagtgaaataattaattgtgataccgccaatcaaagataaacagtaaattaattaatgctctagaaaaaaatcgtgtgattattatttacaaatgaagcagtcgtcacatttgttgtttgcaggtgacgtaacgtggatgtctctataagaattgacttgtcaaatttgtaagaaccacctgacacctgtctagcaacctgcatatcgtcgtggtcgtagtctaactacgcttgggcctagtgtatacatgtagggagatggattttcatcctcgggaggtgatatcatctcgttttcttatatgctatttataggttatgaaaaattattaacataattaatataaaatatatcatttcacaaaaatacaagacaaatacatttttttacaagttaaaaggaataaaataaattgaaaatagttaacacatatttataattatttttcttacaatatatgtatattatatccgtattaatagactattatttatatccgtattaataaactgaaaatagttaaatacatttagtggttaaatgtatttatttattaattaattgaaatattattgattaaaaattaatattaaaaattttggggaaaaaatatattttagcgcgaatatttttccaggtagctagactagcattttcgtaggcggcacatcatgctctcgttcacctaggaaaattgatcttcccaatcggatcggccggctgctgattgttttcgcatgtctttgcctacaggtggactggccgtccgcctaggaagaccgttttcatcagtgtagaaaaatggtgtcaaattttttgaaagaaaaatattgataaatgcatacgcagtccctatat

SEQ ID NO: 2966 - DNA, 1501 bp, Oryza sativa
aagttttgaattttgatatcaaagtttttatttttgagatgaaaattttgaattttgatttggaagttttcaaattttgagttgaatgtttcaacagtgagttgaaagctttaaattttgagatgaaatttttgaattttgagttggaagttttcaaatttttagtttaatgtttttcaaccgcaagttcaaagtttttaattttgagatgaaaattttgaattttgagttggaagttttcaaaatttaagttgaatatttttcaaccgaagttgaaagtttttaatttttgagttaaatgtttttaaatttcaggttaacaattttattttttttgggtatgacttctttttctagagagttttaaattttatgtatagatttttcaaatttgtagttgaaaaggaaataacctttatgtgaaaaagaaaaaagaatgattcagatcgtgattatcaaaatctaattacgctagacatgatcttatctgatatcatgcgtacgtgcgcgtgtttctaccttcccggtgttgcgtggtaggccgggccgaaacagctgtgtgaggtcgtaggccacaaaacgcgcgtgacttagcttgctaacgcgtttgcacgacacagcgacatctattgcggcaaaaaatcaagttcgaaatcaaacaacactttgagaaaaaaaagagaaactaacatttatttaaaaaaaatcataattatttgggtggtatttcaataaattaacgaggatcagaatagttccccttcctatcagttgttgtttttccttttaccttttgtcaaagtgtatactttatccgttataaatattacttatatttaaaaaaacatatataggaataatgaaatattactatgaaatccgtcattaaataacaggttcgtataattaaaggaggctctatccccgatatggaataagttcatctgaggtcccttaacttgttaacgaatctgattttcgtccttcaaccaataaaccagatacaacgggtccctcaactgtcaaaaccagtgcagattaggtctctcggcggttttggctgacatgacgtttatgtggataatttgactcagtcttcatctgacgtggcattaacgtggcgcttacgcgccaatttgatattgaaaaataataaaccccgtgggacccacatgtcagtttcacacataaattaattaaaaatgatggggcccacgtgggccccacatgtcattcccactcctcttcttcttcctcctctctccccatcccctctcctcgcatgacggagagtcagctactggggtgaatcggcaccaccaccaccacgcggctgcgagaaagcggcggcggcggcggcgctggtattcccgtgcggcggcgtcggcgacgagcccaacgtgtcgcggcgaggcccaccaagcgtcgcaccacgggaataccagccgacgcgcccctcgcgcccgcgcccccgggacggcagcctccgagcgcgcgccac

SEQ ID NO: 2967 - DNA, 1501 bp, Oryza sativa
cattacagatgaaaactagcatgaacgcatcattagatctacacatgtaaactacacagtataacatgaacagatcaaatatgcgcaacatattgaacacgtaccaaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaagacagaggttccggagacctgctctcccgatcgctggtgcacgccggcgagcgggatggagtagtctacgagcgacggcgcagtacagagtaggaggcaaaccctagattgattttgcgtgtgctgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggccaggccaggccaggcgagcgagtgcgcgcgtgtgtttcccctcttctctccaccacacatgcttcaagtgactaggagggcatcctcccttttaataaggtccccctctcctagaataagcaaggtggtactaaactccacatgcatgccatcccatgaggtgggcttttgtgattttccaaagaattaatcttcgagtgggctaagacccattcattaattccaataacatatttcataaaattttttgaataagacgagcagtcaaatatgttctactatagtagctaaatatttagaaacggtgggagtactactatagtagctatagtagctagagtagatgtgttgacaagggattgagtgagtgcgttgtaacggtgggcatggagtggccttgtagctaggcttatcatgatgattgatgatatcggagtagaatttatcatcaaggcccaattaaggggcagggctcgatcagctgtttgtgtagttggagcgcgcggtggaagatgaacaagctcagcaacctagctagctagtcgtataccgatcgatcgatcgatgaatatggagtccctggcagcaggagcatggtgggtggttgtgcttcttctactcgtccttacaattgtggcctcctggtaccggtcatggtggaagacgaccgaagcgggggggccgctgcttcctcctccggcagctggtgcaggtccatggtgggtgtgggtgtggcagtggcgggagacggcggccttcctggcctcccatggcagcgggcggggattctaccacttcgtgcaggagcgctaca

SEQ ID NO: 2968 - DNA, 1501 bp, Oryza sativa
tgcagatattaggggcggcctgtctgtccaagcgatggaggaataccttgcgctcgggtacgtgatcgccggtgacggagcgtggggctcctcaccgagagaccgcgcgggccccccttgccggttcggccgggggcgctaggtgaggttctaagcactcgatctgtggaatgtttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagaaaccctcttcctctttctctcctctacgagctcaggtcttctcccccctctttccccagctcccccgttcttaagtgggcaaggtcctccttttatatctcaaggggatcccacctgcaccacttctacctactcttcttttgggtggggactcaccctatcttcccaaaaaagaaaaaactggcttgcgccttcgcctggaagctaaatcacagcttgtctttgagtgaggcccagcgtcatcactcgcctgacaccggggatctccctattactccctcattaatgggcggagatttgccatggctgttgtccgaatgaccctctgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagtcagcacgccggctccggctagggacgagtgcatagaggctctcatcattccgacgggacggggcgaggcgtgcgaaaggccgcctgttgccacctaacccgcgatctgaccggtatgtgaccggtcacacactgtgacctgtcacggaccgaacgagtgtgctgcgctgcattaaatgcggcgtggggcgctcgtccaacccgcaataaacgcggttaggtgagcgccgctgtgctcacctaacccacacacgtggcgccaaacccacagggggtcggggcgccccagccctcggggccgaaacgggagcggcccgacccctcggggagacagagggaggggcggccacatcaccctcgggcccgacccccccgagggggtcaggccacgtgggtgactgcagctgccccaaacctctagtcaagatacccccggtcccatgtcaccgacagtagcccccggcgttatgccagggcgatcgccctcctcgaggaaagcgctcgggcgtgacgccacttcttaggcctggtgacaggtggggccggtctctacaggcgggcaggaatccagtggtcgcaaatcgcgcgcatcggcaagggaaaaaccgaccgataataa

SEQ ID NO: 2969 - DNA, 1501 bp, Oryza sativa
gaagccctgctgctggatgttcccgatgatggagacgccgccgtcggtgccggcgaacgcgaagcagaaggtgcccctcgagtccaccgggatcaggtagttctccggcggcagcgcggcctcggcgccgccggcgaagtgcatcgacacggtgggcaccttcaccaccttgagcccgctcaggtcgtagcacgtgtcgaacagggagaacccgcccggggagaggcggaggcccgcggccgccgcgcggaacgcgtcgcgcagggcggcgtacgccggccgggccaggcgggtgacggacgtgccggagtccacgatgacgccgccgcggcctgtggacgggtccaggcggaggtcggacacgggcacgcccgggacgcgcgcgccgccgacgctgatgcccatgagctgcacgtagtagaacgtctccatcctggggttcttcaccatcggggtgaaggacgcggcggccgagggccccacggcgccggagccgaacgtgacggtggaggaccgggaggtggcgctggccgacgaggaggtgcggtccacgaggcagtacgagaagctccgcccgaagcggcgggagatctgggaggggaaggagaggctgccgcggccgagcccgaggagccccgccgccgcgacgaagagaccctcgttgtcgtggccgcagccgagggcgacgcgcggcacgcgggccccgctggcgaaggtgagggtctccgtggcgaagtccccggcggtgacggagccgtcgccgtaggcgacctggtagaggcaggccttgcggcgcaggtcgcagccgccggagtcgagcctgcggcagagcggcgcggcgcagtcgacggcgccgtacgagtgcgaggcgcgcgggtcgaacatctggccggactggtcgtagcaccggcggcagggcgcgcactggagccacacgacgtcgctgccggtgtccagcaccatgagcgccggcgtcacgggcgtccccaccccgatcttggtgaagtactccccgctcccctgcgccagcccggacaccaccggcgccacgaacccactcccgccgccgccgccgccgacacgcgtcccgttagccgccgcagcaccccccgcggccgcggagatccgcgacgccctcctcttgtcccgccgcaaccggtgcgcgagcagctcggccgcggtggcgttcaccgcgaagtcgtcgcggtggaccacgcgtagccccaccgtcgacgcggcggcgccgccctcgtccgcggcgaggctcccctggaacagaccgtcatcctccacggcggtggcggtgtacgggtgcggcgagagcggggtggcgacgagggtctggtacctgacggcctcggcgacggcggcggcatttggcccgccggcgatggcgaggagcaggaggagaagcgcggtggcgagcaaagacggaggaggcgccatgagcagcagcagcagcagcaagaggtgtgaagtgggctgggcgggtatggacggc

SEQ ID NO: 2970 - DNA, 1501 bp, Oryza sativa
aaaattgatggtttttcacctgtaaggttgtttccagacagatggattccttcgagggctgtcatgtttatactagattgctatattttgaaacaaagggatcggagtagtagcacctgttcactgccatgattacctctcttaatttagctttagctttctctagatgacacaagcatcatggcaaagatgttctttttaacggaaatcaatcgacctctacatcaagatgtatccagctaatcacgtcatggatgtggtacgattgttacatgatactgttatcttttgtatgaaatacttgagatcaaattgatgaaatacaacatctaagccatgtgaagttgctacgaaattactgtgagccttcaactgtgattaccctcacttccattgatggccttgaaaaactgttcacttgtcatgcaaagccgcacccaacaccttccatggctgtactatatctaacacaaagggggaaaaaggctttcttgtgaaagcttactgtgtgctgtacaggtgtgagtgttggaattaatgaatgggccttagcccactcgaagattaattctttggaaaatcacaaaagcccacctcatgggatgtcatgcatgtggagtttagtaccaccttgcttattctaggagagggggacctccttaaaagggatgatgccctcctagtcgcttgaagcatgtgtggtggagagaagaggggaaacacacgcgcgcgctcgcctagcctcgcctcgcctggcagggcaggcagcgcgcgtgcacgacgtacgcgtcgaatggtccgaaaaattggctcctcacccttgcgcagatgcagcctccttttgcagttttgttttgttgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacatgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttacta

SEQ ID NO: 2971 - DNA, 1501 bp, Oryza sativa
atttgcatcctttgcgcagtaccacctgaaaacgtttggtgcaagagcactgatgtcttttcacaatatctggatcgatgagtgctggagtgaaggggtaaccctagcaattagtcctaattgagccgccgcatcgcaagggcttctccgccggcgatgtacaccgcttaaggggaatggtggctgcttcagcgactcagacgacggcaactgctacggccgcagttgcttccggcaatgtgatttggggcggcagatgcttccggcggcgatgtgatttggggcggcagatgcttccggtggcgatgtgatttggggcggcagatgcttccggcggcgatgtgatttcgggcggcgacgtcggcgagatttggggcgcgatttagaaggtggacatttgttcggcggctagggtttatgatgtctggtcagcgggtctcacgtctgattcgggagagaagtcgcgcaaaatcaaaggatggagcggtgccttgcttctttgcctgttcctatcctacccccgtaaaatcaacggctggatgggttttggtaccacgctgtacatgtaccatgcggtacaaaatgcaggacgggagcagtgctcttgtggttaacatgggctttaaagtgcaagactttaacttgcattgtttgtataaggtcaaggatctttcaaaggaaatatatgttacatttctgaataattacatttgttggataactaatgtgttatgtgtcgaaattctcactaaatttggtcagtgtatatattagggtctcgtgagattttaaactttttgctctgtcatgcatgcataaatatacacgaaatgaaacagttaaaaattcctagttaccaaagctgtcctaatacactacttagtactaaagtgtagatgtgctttcttctcaagctctctcagttgtgttacaaggatcgatgtatttggagtagctacagctaattccaacattttcgatttatattaccagggattattttagagaagtaggttgaacaaatgccaacactttctgttcccaacatgtattattagaacaccaaaaatgcaaaaccatagcagtgaaaacctcaattatgtgtagtgccttacacaagaaagacatatatatagcccgattataaaattctcattgttcttgaagtggaaccaataataagagaccaaaagggtttaggcaggtcagtttagcatggcaaggcattatgagacatcagatagtggtaactgatacacaagacaaaagcagcctctaaatcaagcagtagagaatatcaggtacacccaaagcaactccatgcatgttcctttttcttaccacaacttagctagtggagtggatgaaatggaatgttgcagctgaaacaacatgagttctataacattttgagagttcttgagttctataaatacgaagtgaaattgcgagaactaatcaaaccacagattcacagcatctcactctccagaagctatca

SEQ ID NO: 2972 - DNA, 1501 bp, Oryza sativa
cgaagcttctccatggactccacggcgtgcgccatttcaccgcggggaagcgacccgcccgacgtcgacgaggaggaggaggaggagccgtccgcgctgggagtggtcgcaggcgtagcacgagcgcttgtaggacgaggtagcggcggcggaggaggagcgcggccgccgtcgtcgacgctggtggcgtggggagattcgcgcgcctccgacgaggtagcacgaccgccgcttggtgccgatgacggtggcggcgtgagcgtcccgttcgtaggaggaggcggcggcggcggcggcggcgacggtggcgtcggaggaggggtacggtcgacggcggtggcggaagattcccgcgcctccgacgacatcgcctcgccctcaaccctcccaaaaaccagcgaacgctgcagtggagcgagcgtaggaggcagcagcggcgtcggcagcgggggcgtcggaggaggggtccggtcgccgtcgccgtcaccgtcgccgtggccggcagtggcggaggatttccacgcctccgacgagaaggccatgaaccctccctaaaccccgcggacgctgcagtggcgtggcgtggcgtggcgttgctttttgtttgttgattcgtcttcctctcgcttccggcacgaggccccgtggaccgtggtcgtggtctacgggttccgcacacggggagaaaggggcggggagcacactggtcttgtggaccgagaccacggaacatggagggtggtgtcaggctgtcacctcacctgtcgcttcttttttttttacctttttttctcgaagcggtggaaatggggatggagttggactatggttaaaggaaaaaaagaattcaccctttgttttgtttttgtttagggctctgcttgattgatttttgcttgggcagaacaaaatgcatctcgtgtggaatcaaatggaaccagccggaattctctcgcaaattgtaatactgcgtctagatggctagatgattagaagttagaactgtgattggaacgaccttcccagtactgcaatacatggatggattctgttttcttctaaacaaaatgaaattgcgccctaattttgaatttcatttttcgaactgggccgaattctacccatctggaaagagctaggcttcaaacaaggaataagttcactttgggtccctctatttgttgtccagtctgattttcgtcgctcggtcgcaaaaccggataagacaggtcccctaacttacgaaaccgtttaaataagatccttcggcagtatttgactccggttttgcttgtcccaaaagatcaagaaactcgaagaaattgagttttggaatcggggcaattcatgtgcccatcacaccaaggtgagatcagtagagagaagaaaaaaaagagatagaacattgagcttttcgtcatctgtttatatgttcttgtgtgtcagttcattttgccatcaataatggtgagaaattctggtttgtattggaacacagcca

SEQ ID NO: 2973 - DNA, 1501 bp, Oryza sativa
catatataccccaaccaacatcagataacctaaacagcaacagattgaaagagaaggggggcaagggccaagagaaacattgataggatcagcaaaagaaaaaaaaaagggaattctctcggcggcggcggcggcgggagggggccggggatcgatggcgtcagcggcctcacgcgcggcgatgagatcgtcggacttccagacggcggcggtggggatcggcttcgcgctctcgtgcggcgtgctgctcgtggtgatgagcctcgtcctccccttgccgagggtgtaccaggccgtgatgtcggactgggccctgatcctcttcttcgctgccggcgtccaagcccataagcgaccaataatctggtatcctctagccgatctcatcctcaaaccgaacaacaagcccaaaccacccgctgcctactagattcactacagattcagcctgtccgttactagttcagatctgtctatgaatacgtgtttcttttatatgaataattcagatgcatgttttctttctttttactaaatttagtgcagctacatggtgtacgccactgtcaatcaaaacacatatggtacatatacgagatatacggcacagtcatgctagtgtagtcttgtagcatatatggataccatgaaccacaaaaaaacgcattaagaacatgcggcgaaattaaccacaaaaacgaagtaagaacacgtatgttgttgttttatagttgcatcatgagagtatgtgaaatagatggccatgcatatgtagtattagcatctggcttagagcatgcccagcaactcatctaaattcggtactccatatctcagttttcggtactccatatctcagtttggatggccatctaaaaagattctctctctatatttattcctactccaacaaatcatccatattacatcctccatatcacctttcatatattttaataatatcttctaaccaactttgttatgtatatgttttttaagcctgaattagttaaaaaataatgttatttgctaaacatgcttcacatagttactaattaatctctcacgtatattgaggttgattaacaacagtctaccaagtttactgtgagagcaaagaaaaaaaaatataaacatcaacgttcccaggaccaaaccccaaccccagcatccattttctccagccgaacagaaccgatacgcccgagcgggcggagcgaagcggcatggtgtggaggtggagcggcggtggatggcgcgcgtgaaaggcagcgggtgcggaggcagcggtggcggcagatgggcgcggaggcggcggcggcggccggtgggcgtggtggagacaggcgatagccgaggggtggaggtaggcgacgggcatggaggggcggaagggagcatggataccacggcgacgttatcttctagatctggtatgcccctccctctccttccagccggtgacgacgagtcgacgacggaggggaaggtgatgtgacca

SEQ ID NO: 2974 - DNA, 1501 bp, Oryza sativa
gccccgccgaagcaggtggcgcaggcgatggagcggctggggcgggcggggcggctcatcgcggacatccggctgggcgcggaccgtctgctcgaggcgctcttcgtcgccggcgacgcgcccccgcacagcgccccgcagcacgttgagaagaccgcgctcgccgtcgcccaggaggaggccgccatgcaccgccacttcgacgacctccgcgcgctcgggaggtaaacccatctccgccccgtgcccccacactctccgattcagaagtttttcatcgattccttaacctttgactgttacgtcgcaaaatacaactaattccctccgagaagaaccattcccgtcatgattccacggttgcagtctcaaaatgaaaaaggaacattcccgtcatgataccacggttgcagtctcaaaatgaaaaagaaatattcccgtcatgataccacggttgcagtctcaagaagaaaaaggaaaacccttgtctagataatttctggaaattggtggctgggatattgatttaacttctttggattgtatgattggactttttttaaagtaataatctccttcccagtttaggcatggcagcacattttttttccactaaattgttctgtaataatggttaatcaccataaactgatgccacactcttctttggtgttatccaattgcttgtatcttgtgaaacccttctacctatgaaaccttgctacgagagatgcacggacaggcttaactgctcaactttggtatatgaactttagcattctagaatattggctgggtgcctgggtctatcagattgggatgcatttctggaactcgtgttccttggcttgtaatagagcaatatttaaccttaattgaacagcttcagcttgaacttgttttggggctgtttggatcagggactaaaattttagtcccggtcacatcagatgtttaacactaattagaagtattaaacgtagattaatgaaaaaatccatttcataaccttgaattaattcgcgagacaaatctattgagcctaattaatccatgattagcctatgtgatgctacagtacacatgtgctaattatggattaattaggtttaaaaaaattgtctcgcgaattagctctcatttatgcaattaattttattattagtctacgttaaatacttctaattagtatccaaacatgcgatgtgacagggactaaaatttagtccctggatccaaacaccaccttagtgccactcagggctcgaactagttttagtatcactcgtggatggtaaggatgtagggtaggtgctcactctataatattgtctcagcagagcagttatgtgttgggtacaattgtttacatgtgaccacttgaccagtcgtttgttgaagaagtctgcaggcatttggaaaatccatgtttcatggcaacatggtactattctgtctgatgaataaaatgtccaagcaatatgaactgcttgttaaacga

SEQ ID NO: 2975 - DNA, 1501 bp, Oryza sativa
ttccgccatgttgttggttgcccgaaaatctaggcgaaccagatacttgaggatgtcgccggtcggtgagttcaaagtgaccccggcaccggcgccctgcaaggtgagggagccattgaagttcatcacccagtgcatggtcgattggctatgactgggggcatctccgagctcgggggcggaaggcccgagcgttgggtcgggattgaccgatggggtccattctgccatgaagtcggcgagggcctggctcttgattgtgtagcgtagctcaaagtggagatcgaactccgaaagctcgatggcccacttgaccaccccgccccgtaccctctcggttgcgcagtatctgaccgagagggtaggacgtcaccactctgacccgatgcgcctggaagtagtgacgcaatttcctcgacgtcgctagaactgcgtacaacatcttctgggcttgagaataacgggcctggaggttagtgtagtcgatgcacatcctgagcttgtcattggccttagggacgacgtccgggttcaccagccactctggatggaccacctcccggatgaaactggccttcaggagatgcgccacctcttcgcggatgaaggcctggcgctccgaggcctgccgccgcaccttctgccggacgggcctcgcgtctggtcgtacggcaaggcggtgctcgatccccttcctagggaccccaggcatatccgatggcttccgtgcaaaacacattggcatttgcccgcaggaacgagacgagcatgtcttactatttgacgtccaagttaccactaatcttggcggtcttggacgagtcgttgccaagctagacttacttgatgggcacctcatcgctcgaagtcctctgtttcttcgggacgcgtgaggttgaggcctcgtgccttccgccgccgtcctcgacttcgaaggctgctcgcgtgcaactccacgcaagccagcgcgatcttgacatcgccgtggacggtgatggggcagcccaggcccagcatcttcaactgaagataggcatagtgggccgccaccataaacttcaccaacgcgggcctcccgagcaccgcgttgtagggcagattgagatccgccacatcgaagtcgatccgctcagtgcggaaattggagggcccaccaaaggtgacggggagcgagatgtgccccagcggctaggtgtggcatctgacattgcatatggtgggtgaaagcaccagagctagttgaccccccctggcggcgcttgcggggtggtcgatttggtcgaaggtgagcttcacctccgaccagcgcgaccaccgtgcagcctcgtgggtggggacagtggccagaagctcgtgcttcatggccttgaagcttcgacgggaggcgtgggcacatgcccctccgtcgatggtggtgatgacgtgttgcggctcctggaagccgaggtctgcgtcatcgggttcctcgataggggccttttccttggcctcactttgccgg

SEQ ID NO: 2976 - DNA, 1501 bp, Oryza sativa
caccccacatgggccccacctgagccggggtcccaaatgaagttacaagcccataggcccattataggtgatgcaacaccttgttcctgtgattctggccacacgagatagaattcagagaagaggctggatccgttagaaagagggctccgagagctttccatcaagtactcacgggccgaaaacggaggtcgtatgcagattcggtggccgtttgaagtcagcagtgtagtaggtggccgaatcggattccagcacttggagtacttgatctcgatatcttcttgttcatccatgatgtgagcaatggttgcatccgtggtagccatggtcacatcaccttcccctccgtcgtcgactcgtcgtcaccggctggaaggagagggaggggcataccagatctagaagataacgtcgccgtggtatccatgctcccttccgcccctccatgcccgtcgcctacctccacccctcggctatcgcctgtctccaccacgcccaccggccgccgccgccgcctccgcgcccatctgccgccaccgctgcctccgcacccgctgcctttcacgcgcgccatccaccgccgctccacctccacaccatgccgcttcgctccgcccgctcgggcgtatcggttctgttcggctggagaaaatggatgctggggttggggtttggtcctgggaacgttgatgtttatatttttttttctttgctctcacagtaaacttggtagactgttgttaatcaacctcaatatacgtgagagattaattagtaactatgtgaagcatgtttagcaaataacattattttttaactaattcaggcttaaaaaacatatacataacaaagttggttagaagatattattaaaatatatgaaaggtgatatggaggatgtaatatggatgatttgttggagtaggaataaatatagagagagaatctttttagatggccatccaaactgagatatggagtaccgaaaactgagatatggagtaccgaatttagatgagttgctgggcatgctctaagccagatgctaatactacatatgcatggccatctatttcacatactctcatgatgcaactataaaacaacaacatacgtgttcttacttcgtttttgtggttaatttcgccgcatgttcttaatgcgtttttttgtggttcatggtatccatatatgctacaagactacactagcatgactgtgccgtatatctcgtatatgtaccatatgtgttttgattgacagtggcgtacaccatgtagctgcactaaatttagtaaaaagaaagaaaacatgcatctgaattattcatataaaagaaacacgtattcatagacagatctgaactagtaacggacaggctgaatctgtagtgaatctagtaggcagcgggtggtttgggcttgttgttcggtttgaggatgagatcggctagaggataccagattattggtcgcttatgggcttggacgccggcagc

SEQ ID NO: 2977 - DNA, 1501 bp, Oryza sativa
cttaaggaaaattttctatctagcttgtttgaagcataggaaaattcctttgaattgtaatcctatactccaattcctaggaattttgcacatgagctctcctacctcattttaacattgctttgagaagtccaatgcttcctctatttctctctcttctctctctaaaatccatccaaatccccaagtttttactatgagctatctaaacacattgtcttgcaaattcctgtgttttgtatttcatgggatttgcttacatatggcatctcatttctatttttttttttctattcatgtgtcccaaagaagcctttaatggaagacgttgacatctttttcaatgtgatactaatttatctgagattttctaaaaaaaactactctctccgtctaaaaaaactcaacttaggaggcaatgtgatccctcctaatacaataaatctggacaaattatatgtttatatttatcatactaggagagatcgtatctctttctaggttgatttttttttgacggagtgagtaactctttatacgacgaataggagtagtagtatattgagagggaagctagacacaaggcagcgtggcgtcaccgttaaatcagagtgagtcacatgcaggactgatccccttcttcgtcgtcgtcttcgatcgatgtgaattaagatgtccgaggcagggcaatttagcgagcaagcaaatgcctaaaccatattattggttcttgatcagtggcaacgaacattgaatccaagcggggacgggacaaattaaatcgtcgacggagacggcgtacgccttcccaagcaaaacacccgcgattttgatagggaacgtatgatctatcgttgcatattttgcgtaacctcttctcggcgaccgtccgacgatggaactcaccggctctgtttcaactttcacggcttcacgcggtatacaaactgaattgcccgtccttagaggctataaaccaactgtggagaaaagagaatttaaaaaataaagagggttggctctcatcaatagctagctattcatatatttcaagataaatacattaaatacataggtaagagatagaaagaggaggagaaaaaaaagagataatcttatagctcatttattattaaacttgctctttgttttccctcatcagatcagacatagagccttattggttggtctaataaaccaaagaaaaagctaaaatttaactttttgaatgatttttaaatattttaaatgtaatttacttttagtgttagcttttaagtcgctacgaacaaatatatagaagttgtacttataaattaacttttattgtttaataagccgttttggtttattcgaaaatatatgtgcgacagaagaggttagtagttttttatcaatcggttgttacgttacgtccctcttttttaggaagaaaaaaaagatctggctgctacacagtagtagtacgtacaactcagtacgccacagtaccaaacggcga

SEQ ID NO: 2978 - DNA, 1501 bp, Oryza sativa
ttaatagtaaatcaccttaatagtatgtctatatgggtatctatatctctctaatctattgcatcgtttttttctatagactatctccaggttagtagatagttttactctctctcttcatttaatctctttcaaataggaaaatatgctgacttggatatcttgtagagagcctatagataaccattgcggatgctctgagaggtggctgcatatctctttcatctcttctctcctccacctcactattttagcttatgtgacacctatgagactatgctttatgctcatagtacttgtcctaagagtggtaatatctcgttgggtggtgcactccattccagtccacactccgcgctcccgtgatcgcgcatcatacttaaccacccccaccccgaccccgcgcttgacccggcatctttggccggtcatacacgcggggggcctttgcctttggcacccggcgcgcgtcccgtctcccacgcccgcacccgcaccaccgcccaccaccaccacgccacggcagccgcaccgcaccgcaccgcaccaccatccttcctaggaaaaccccacccaccctcaccctccagttccaccgtcgtctccactctcgccctcctcacgtcacccccacccccaccaccaccactctcccacctcggccggcgccacctccccaccccagccctcgccgtcgtgcccaggcggcgggccctgatccgcgagcctccccggttgttgggggctgggggtgcatcgatccaggttggttttcttctactcggccaaagatcggatttctctactacctaatctttgatgtgaggagcattaggtatacggcggcgatctgtgactgttcgtgctcgaattgcgggtgttcgttctgtgttgtgtcgtgctactaggattgaagatgtagtagtagcaattgccaccgggattgtttgcgttgacgtgatcttgactcggctacttgtcttgtaaaatctgcaagaaacttagcgttgccggatctggctcatacggtatatggtgatgctactttaacttagtgacatcttggatggtcaatttaacttaagaaatcagtttcgggtcgcaattttgtcttctgtggaactgaatcggctggtttttcagaagcacggccttctgaattctgtgaaatgcttctcatttaggatactgctcttccagccacgtatgaattacatgcggtagcagctagctaaccatgtactgatatcagtttaaagtagcatttgttgttactttctgttatcttttgtatgaaactgaatttttgttaacggcaagtttttttctcgcacctgcctcataagctgttattctgttgtttagttcagatggttgccttcatacaaggaagctgaacagaaagtagttcgtgcatatttagtactcttcagatgtctgatgatatttattgcttttcagttccgtatctagtggacccttctctgtcgaggtactaaaa

SEQ ID NO: 2979 - DNA, 1501 bp, Oryza sativa
aaaattctaagaaacaactggttggtagtcaacttatgagaattttagttcattttctggattctacaattacaaattcttgaaatctaaatgaaaatctagactatttgggacagctgggagaagttagaagctccctcaattttaaaatggtttaaaaaatgaaacttagagaaagcgtcggttgcacgttgaagcttcaaatgagaagcaccgctctctcctgcacccgtctcacgtgcaccgcactctacctagaccaccaccaccaccagtccaccacacccggctcacgtagaccgcgtccacccaccgcggcggctcgaagcctccctccgctgcaaccaccgcgcgtcgaggcgtcgtctcctttttcttcggctcgacgaggtggggaggagatgagagaggccacgcgcgcgcacgagatcgatctccagcaaggttggtacgcccaactcctttccctctctcctctcctctccgatctccgcctcgccctcggggcattgctggggagggatgcggtggcgctggcgctggcggcgaatcggcgatgctgctgctgctgcccaggcccagatccgtggagtggaggcgtagatctgtgtagccgagtgagttcgtagcgtgtggtgcgtaaacttccaatggcgtcgcgcgtgtgtagatctcgttcggttcgatccagaattttttttcctcgagaaaatggcgtggtgctgtgtgttgtgttccgttgcgtagatccttgggaggcctctacaagtccgcggaattcgttcgtgcgtggggtgcggaattgttagtccgtagatgagcttctggtcggcgatccgttgtttgctttggctgaggtgatcgcctatccgtttccattgccgaccccttttcacgtgttagacttgtatattgttcattttaattccagtggcatcgtgttgcgttgcgttgcattgcatagatccttcgcacagcagactggtctgtgaattttgtttactcgtgggatgtgaaatcatagtctgtagatgctgttttctttgcattgcctgagggatcacggtgccgtttcaaataatacctcaggtttttatgtataacgcacgctcttgacttttcgcataacgtcttatttaaaaatttagtataaatatgtaaaagtactaagttaatattatagtttttttatgataaaacaagttacaacaaaattatggtatttatataatttttttagtaagatgtcaaacgtcatgttaaaagacaacggcatgacgggagtacttcttaatgtcgatatccttatatacttttctcgtttgcaaaagatctggttcgtttgaatgaattgtgatttaactaactgaactatggagcccattttggttttggtcttacattatctgagctgagatttaagaactttgctgcatgtgcttttgtatcatatctcatattgattcttgattgtttaaggtcttgcacaactgcggcaaga

SEQ ID NO: 2980 - DNA, 1501 bp, Oryza sativa
ttcaagtgcaactacacattataattatagactctccatatactctagggagtagctatatttatgacgccatatttttttataaaaaaatagccggcatgtatttatattataaatttctaatatgtaattttagtgtatttacaatgtaagtcccaaaattatatatgtaagttctaaaattatatatgtaaatcctaaaattatattaattacatatgtaagtggtgtgtaagtgatatgtaactacaatagaatcacactataattacatatgtaactgcagtttaaaaacagacattgacgtgagctctctatcttccttggcttctccttttcttgtccttttgcctaccatctgtgcatggcatcttggattttactccgtaatgattagatattagtatgtcctggatagtgtatatcgatgtatagtatcaacaatagtagtaatgatggtgttagcagttttggacatgcacaaatcgctgaactaattgtacggtaaaagatcgactgtaaactaattgctataaatatgacgccatatttatagcaattccgtaactctatacgttcttttttatggttttatgtgaaattcatgcaaacaagtgaacaactaaacactgtactaagtcctaactaccgacaacacaatcaagtacagtagatatctatttccatatatacatttcctattgtatgccctaaatgcatatccaatcagccatcgccgtggtccgtggtaccaaacccaacacataaacagcgacataatgcagtcccattcacgcgacaggttttttttaaaaaagaaaacacacacacacactctctctctctgtgaagtcctcaaaatcattatagaatatttattttggttaggcacggaaatgtatatattgagttaaattgtaagtaacttgcatataaatttattaagaaaaggagagaaaatacttcacctacatcattaatcattaatatattaaacccctagagctaccctttttctccctttttggattttttttggctcctcagtagttgtcctatgtaatttgcaggtgcagaagctcctcgattgggtgacatgattttttttgcgccgtttcctccaccggttgtgccagtctcgtcctgcatgtgtgtcacgcagaacctttcttgtagtaaatgacgcatggtggtgtttataaaaaaaaagactcctcgtgtttggacggaatagcgcgcacgtacttccaccgactgacaccatgttccgttttatacagtacacccctagcttttaaagaaatgcgacacgaagaagagaaaattctgctcttaggggcagcactgtaaacatgaaaaacacaaggtttttttttttccgaaaaacaaccaaatctatccccttccctcctatccccaaactctatccatctacttccttccctgcccgtcccatctcttccccacgccgcgagagcgctgtcgtccctccctcaccaca

SEQ ID NO: 2981 - DNA, 1501 bp, Oryza sativa
cttaaaatagatataacctaccattataaatctggattatatattataaatctggattatatagaggagggagtatttactatatttatttcttaaaatatttaatttattctataatcaaatacataattcatttgaataatccactcattaacctacattaaacatgacctaacccgtagcaaattttgcccctgcttcattctctatgctaaactatggtgtggctaacaaattaggccttatttagttgggaatagttgtcacattagatatacggacatacatttgaagtattaaatatagtctaataacaaaacaaattatagatttcgttaagaaattgtgagacgaatttattaaacctaattaatttgtcattaacaaatgtttattgtagcaccacattgtcaaatcatggcgcaattaggctcaaaagatttttctcgcaatttacacgcaaactgtataattagtttttttccacatttaatattctatgcatgtgtctaaacatttaatgtgatgggtgaaaagttttttttttcaactaaacaaggccttagtgaatatagatttggtaaatttttgcacaagaatgtgtatgcaggtcgaaggataaaaaaactgtggcaagccaccacgtgacaacgaaataagcaactgtgtcataaagtataaagtgtgataaagtttaatagtctaagggtgtgtttgaggagaagagatagaggagattggtaggttacacaaaaacaaaacgaggtgagccattaacacatgatgattaattaactattaagtattttaaacttcaaaaatggattaatatgattttttaaagcaactttcctatataattttttttaaaaaaaacatagtagttcgggaagcgtgcacgcggaaaacgaaacaaaactcactcacaatcacccagatcaaccaggaaagaacacagcctaagtctggaccaggctagtgaaacttacaagtacagtagtaatttatactcctataaataaatccccaatcttatactatttgacacgcgaaattcataacaagaagaaaaacggcttaacaaggagagagactgatttttcttttttaacaaccgagagaaatgattcggaataattaattatttgtcactcctatctattagtggtgataaaagaattgtcactgaacccacatatcatatacatataaggacccacatgtcatatacaataagtataaataattaattagcacatgttaaaagtggcaagttaaatgtccattcggtttgctcttcgattcctaacttaactgattttttttttaaaaaaaactcctgaaccgacccgatctctgggccggaaaaagatagagagagagagaagggaaggggaggggagggcgggacgccggccggagcacgcaaaaatctcgctcacctcgtgaagagctgagatcaaggggggagagatcggaggcggccgtagcgtggcggaga

SEQ ID NO: 2982 - DNA, 1501 bp, Oryza sativa
ggtcggtggtcaagatggagtaggtgagtagataggtattgcttaacgaagactatgacgttggtgtggatttcatgcttgttcaactgaatgtggtgaaccaagtctacatgttatagcatttaatggtttaaggtttccaaaggttaatttctctcaatattcatatgatgtactccagcttgatctagcaagacagatgttctactgccaccgtccaagttctctcttgattaaggttggttggatttagggaacatctttctcgacgttttctatgcaacggtaaccatgcagggttcattgttcgggttgagtatagactgcttgtgcacccttggtccaagcggttgcgattagtgctcttcagatttaacgatgaacaccacaccacgcaacatcaacaacaaacctctaatgcgtgtacattctgtggaggcaacagaaggaaattacctgtatgtcaagcggattgcacgttaacgaaggcctaaggacgcaatcattgcgacaaatgacacaataccctatcgatctgctcctatgctactcttcagtttcattagaaagtttgtttctttaattcagttagcctcttttatgataagacggttcaatactttccgtgtatctcttcgtcgatgtacttgggttgggtgggttctcctgaacttaatcataggccttgtttagttcgcgtaaagaaaatttttgggtgtcacatcggacgtttgaccagatgtcggaagagggtttttggacacgaatgaaaaaactaatttcataacccgcctggaaactgcgagacgaatttattaagcctaattaatccatcattagcacatgtgggttaatgtagtacttatggctaatcatggactaattaggcttaaaagattcgtctcgcgatttccatgcaaactgtgcaattaatttttcattttatctatatttaatgctctatgcatgtgtccaaagattcgatgtgacgttttttggaattttttttgagaactaagaccctgtttagatggcactaaaactttttagtccctatcacatcggatgtttggacactaattataaatattaaacgtagactattagtaaaacccattctataaccctggactaattcgagagacgaatctattgagcctaattaatccatgattagcctatgtgatgctacaataaacatgcgctaattatggattaattaggcttaaaaaatttatcacgtgaattaactctcatttatgtaattagttttataagtagtctatgtttaatactccaaattcatccatatgacagggaccaaagtttagtccctgattcaaacaccaccattaaaaaaggccttattcgaatttttttttagttttctaaaaaaacaataataaaaaaaagcatattatgccttacaaatacaaatcgcaccaagtgaggcaaaggaaacggaagtgccgagacggggcggggcccacaatctgacaga

SEQ ID NO: 2983 - DNA, 407 bp, Oryza sativa
gtgtgatagtgcattgtgcatataattctagtttttgccaaaatatagacgttcttgatttactattcccatcaggacttacttcgttagaggatttctacatagtccagttggtgtttacagaatcaccatcatatttcatagtggctataacttaaaaaggttcagcaacgcctttttgtgtttttctcttttttcagagtgtttctttgtgaagcgctctgctgtacatattttctcttcttcttaatgaaatgaaacgcgtggctcttgcattttcgagaaaaaaaaaacttgaaaaggtgttatggaacttacaactcaaccaatcatctatactcaaaactcatctctttcagaaattcaacaaaacatgttgtaaatatctgatttggtcaagtttcagg

SEQ ID NO: 2984 - DNA, 1501 bp, Oryza sativa
  unsure (1)..(1501): unsure at all n locations
gcaagttcatatatccaagagaaattagaaacaattatgttaagaagtcagaccgcacatagaaacaacatgttaaagcatatgcgaactggcagtactttgtgtctaactcatcaacacatgaagcaccagcatggcagcatctgatatcatattaaaaacatctaaacgaacaaacatcatgaagccataagtaaaacttaatggcatgccactgcctatttctgaaaaccattgttaccctcatttctgaaccatacaagaagcatcatgaattcaggacacagtgagtatgttacagtgtattataagtatattggaacaaattatggctttccctcagatagcaaccacgaattggtagtggtgaaacacatcagtttcatgactcacaggttcttttttaaagaaaaatgctccatgcctcacgaaagcctttttcatgatatgtttcccagaatagttttcaaatttctaaaacgtaattttgagattgtgtgttaatttttagtaaaccacgagtttcattgttccatatcagttcacatacaaccgcaagaccagaatactgcatatttgtagtggagagaagagtaccccattgttatgttcaacaccacacacacagacagaactcggttcgttctaacttatccctgatgtattcggaagctgcacttatgaattcagggaatttatcatgcaattgcaaatgacaggtactaaaatagacagggttgggatcaactccatggctagatggaaggcattttatagcaacaacagattgacattgttgtcatgaaaatcgcagacgatagtattaacattactaaaatagacagtgttgcatcagctccatggctacagaaaagccattctatagcaacaacagaattacacactcttaccaacttagaaatttatagcaaactgaagagaagaggtggaggacatcatcagagttacctcgaggaatccgatccctttcttggtgctctcccccaccacccgcacgctgtgcgtctacaaagaagaagagcaggaaatgcagtgggttacagaccacgcacccacaggccaccccacagcaaggagagggagagaaatcagaaacccccgggacgggaggggcggggtcatggtgtgccctacctgcatgaggagcttgacgcggtcgagcggcgcggtgatcgtcttggcgacggcccccgcggccgcccccgccgcgaagagcgcgacggcgttgggcaccagcgccagcatcgccagcgggtgcctcaccagcacccccgccgccggcagctgctgctgcttccccttcccntcccccacctccccctcctcccctccccctcccccctcccgcacggtgagcgacgcgaacgccgggccacccccacccccacccacgcggagggcgagcgcgcggcgggcgtggggaggcggcggcgtgggtgggggcctccatgagtcgcacgccgccgcatccactcgccgg

SEQ ID NO: 2985 - DNA, 1501 bp, Oryza sativa
gtatagccataagtaactattaattatcccacaaaatgtaacgttgagacaattttctgtataacagcaatagacttatgccactttttttttataaaaaaattgtagcattataagcacccaaggaactatgtataatttacttaacaatataaatattttgcaaagatacacaaattatgagttaaaaaaacatgtgcttttgcgattttgctatatatttgtcgacaaattttctcccaaaaatttaacagatgtaattacagtacaatcgtagtgtaattacactgtaacttgcatgtaattacactgtaactatagtgtaacttatatgtaacttgcaaaaatctctacgtgatatgttatttcggtaaaatagaagttgtgggaacaaatccttacacatatgtgtgtgccgtgattttatttttcttcctcaccaaaacaaatcttttaatagatctaaagattcaaaattacatgaaacttatatacaagttacaccgtagttacgtgcaagttacagtataattacatataagttacagtgtaattacactataattgtactataattacatctttcaaatttttgaaagaaaatttatcaataaatgtataggtggtcccgtgcttttgtattgtgtttgcgtgaaaaaaggacacggtaaaacaagacgttggaaacccagtcacccacggccacagcccaacaagcccacacaggccacaggagggtccaaccgtccaagggacagacgacgacgagcacgagccccagcgaaaacaccgcggcagcaccgcagcagccgccacccgtgcatccctacccgctgctggccccacccgtcatatacaccctcatccagccggtatttcctccccacggtcggggccccacatgccagccagcgctttgcctttcccacatcccctcctaaacacaaaagtccccataggtcatctccccctcctctctctcttacctcacgcgctccacgcacgcagagtcgagacgcgcacgccaccctgtcgctctctctctctcgctctcgccctcgcctctcccctccccatcaccacccaaaaccctagttacccccaccctctcaaaaccctaaccccacctcaccaccctccccggcggcggcggcccttgtggctgtgcacccatcactccaccggataagctctagctatctatcatccaaagcagcttactagtctgtgctctctctgtgtcggaaggcggcggcggcggcgcggcggctggtggtggtgggcgggggaggcggcggtagagcggtggtatctgggcgttttgtggcgggggcggctcgggcgtcggcgatggaggagccgaatgtgggcggaggggcggcggcggtggtggcgcctgagggggcggatccggctggcggcggcggcggtggaccgggcgcccccgcgtctccctggaggaagaccacgccgccgcctgtggcgggtgaggcggtggtca

SEQ ID NO: 2986 - DNA, 1501 bp, Oryza sativa
gggagagagagagggaggaggaagaagggaaggagaaagagaggatgacgtgtgggtcccacaatatttcttttgtgaatgacaaatgggtctcacatattttttttaattctaatactccattcgttcaaaaatataacaatttttagcattcaaagtttgtccaaaagtatataactttttcacctacattcattctcaaccaatcataacctttcaccattcaaattcttcacatactttctcttctcaactaatcacaaccctcttccatttaatcaaacctacttttttaatgctcgtgcccaagcctaaaacttcttatattttaggacggaggtagtatcacataagcgtcacgtcaacgtcacgtaagatgaagaccaagtcaatgccgctacgtagtcaccacgtcaaggaaaccaccctccaaccgccgacagagtcaaattgcaccggttttaatagttaggacttaggagggtcaacatatctgatattgtggtttaaggatacgaatcagattatgccactaggtaagggaataaagtgaacttatttccttactctactatgcatgtgggccgtcaggtagccacggttcaagcgagaatgttgttcggcgatcgatcgccctggggatggggcagcgatcgatcccctcccccctccctccctccacccctccacctggtttccttttttggcaccgcattacttttctattttagtaaatttatacacctaaagtttatacacctcaagtttacacatataaagtttagagaccaaaagtttataagtcaaaagtttatatatccgattcaaatttgaatttgaattcaaatatttttttatatatagtatttctatacatctaaagtttatacacctaaagtttatagacctaaagtttataagtcaaaagtttatatacccgattcaaatttgaatttgaattatatccgattcaaatttgaatttgaattcaaatattttctatatatagtatttctatacatctaaagtttatacacctaaagtttatagacccaaagtttataagttaaaagtttacatacccgattcaaatttgaatttgaattcaaatttttttatatagtatttctatatataaatttttctaacttttgtttttttaaaaaaattgtgtggtgcactgcagtggaaagagaagaaggggaggaggaagggaacaagagggaggagtatagggggaggggggaaaccgatcactgggcaatcgccctggcgatcgatcgcccattagcctcccccggttcaagtggcctccatgagtttttttttatgaaatctgcttcacaaggaaattagtaaaatactatactcctgcgttaaatatgattcaaatctataatttcatgtttgctgtaaatgagtactaagtctgattttccaataatgctatatgggttttctccccctgaacttataaatgtcactcttgcacgatgcgtgg

SEQ ID NO: 2987 - DNA, 1501 bp, Oryza sativa
tagtacgtgcctacgtgctctcctgcctgctccccacgcatcgtgcaagagtgacatttataagttcagggggagaaaacccatatagcattattggaaaatcagacttagtactcatttacagcaaacatgaaattatagatttgaatcatatttaacgcaggagtatagtattttactaatttccttgtgaagcagatttcataaaaaaaaactcatggaggccacttgaaccgggggaggctaatgggcgatcgatcgccagggcgattgcccagtgatcggtttcccccctccccctatactcctccctcttgttcccttcctcctccccttcttctctttccactgcagtgcaccacacaatttttttaaaaaaacaaaagttagaaaaatttatatatagaaatactatataaaaaaatttgaattcaaattcaaatttgaatcgggtatgtaaacttttaacttataaactttgggtctataaactttaggtgtataaactttagatgtatagaaatactatatatagaaaatatttgaattcaaattcaaatttgaatcggatataattcaaattcaaatttgaatcgggtatataaacttttgacttataaactttaggtctataaactttaggtgtataaactttagatgtatagaaatactatatataaaaaaatatttgaattcaaattcaaatttgaatcggatatataaacttttgacttataaacttttggtctctaaactttatatgtgtaaacttgaggtgtataaactttaggtgtataaatttactaaaatagaaaagtaatgcggtgccaaaaaaggaaaccaggtggaggggtggagggagggaggggggaggggatcgatcgctgccccatccccagggcgatcgatcgccgaacaacattctcgcttgaaccgtggctacctgacggcccacatgcatagtagagtaaggaaataagttcactttattcccttacctagtggcataatctgattcgtatccttaaaccacaatatcagatatgttgaccctcctaagtcctaactattaaaaccggtgcaatttgactctgtcggcggttggagggtggtttccttgacgtggtgactacgtagcggcattgacttggtcttcatcttacgtgacgttgacgtgacgcttatgtgatactacctccgtcctaaaatataagaagttttaggcttgggcacgagcattaaaaaagtaggtttgattaaatggaagagggttgtgattagttgagaagagaaagtatgtgaagaatttgaatggtgaaaggttatgattggttgagaatgaatgtaggtgaaaaagttatatacttttggacaaactttgaatgctaaaaattgttatatttttgaacgaatggagtattagaattaaaaaaaatatgtgagacccatttgtcattcacaaaagaaatattgtgggacccacacgtcatcctctctttct

SEQ ID NO: 2988 - DNA, 1501 bp, Oryza sativa
cttttcgttttttatattttgcacaaatttttttaataagatgagtggtcaaatagtgcaagcaaaatatcaaaatcccttatattaagggacggagagggagtagttattattttcagtttttcaccctgataaataaaaaatgcagaatcatgatgggcaataatgcataatgcacatctcatgcaaacactgcggttgtcacaaaactaaaccacaattaacaccagtacacacacatgtacactaacccatatatttatcgatgcggttcgttagccatatgattcccctcgtaactagtaccacatgatcgactagtatgcagaatttaagtatatatatatatatataaataacgatgtcttgcttaattttgacacatagtagaatttaagtatgcagagtatagctagctagcacttagggcgctccctttgacatatactatgcaggaatggtaaaacacataaatagaaaaaaaacacaacattttgggacgaatgcatatgcaaaacggatgaatacacaaaacatatatatagaaacacggaaatgggcgtaaggtgtttgatagactcttccaattagaaaaacatatgatttagattagagagatatatagactcaatagaaatcggaaaactccaattcgtttcttaaaagattaggtaagaatactctataggattaaatcttaaaaaatttcttcacataccatttgtctcgagggaggtcttaaaagatgtttctgctgggtgctggttaagagagacagtttacacttttacagccgcctgccatctctgccatagtagttcaaaggcattgatcagataaggaagagtactcgtatatatatgcggctatatacgcgcgctgcccaggcaggcagcacgccaaatatgcccgtacctcactattactacacagtgaaaccagacgttgcagagcctgaagaaagccccccacttctctgactatctgaacatcacccatgcataagctcatcatcgccctcgctctcacagtcacatgcatgcatgtatgtgtgtacgtatatctgcagttatgcaatgtgtaactggcccatgcatatgtactatcagccagggagaacaggctcgatcttttaatgctactttaatttcattattttttttatatactgttgctatgtggatatatattgtacacatacctgtatcaatatatgcatcagtgcatgtgttccctccgtacgttttagttgcaaaaagaatagccaaagattaacattttgttttatattccaagtttcccatatttctcttctagatccctccaccatcctccatctttaattacaattttatacacacacacacacacacctatcattaactcattatgtatgcatgagatgatgagatattattgaggaatgctttgctagattatctaaattgaaagtacagttgtcttggtatatgcatttttaaatggcaaaatttgccacagg

SEQ ID NO: 2989 - DNA, 481 bp, Oryza sativa
catgcaccgttgcatctaccttccttgcaaacaacccctccccccatgtcaattttcgcaccccggatttaattcctcagccttttaaaaaaatttccatccatcgatctgcacgtgatggcgattgattctgcacactatagcagcaagtttacctgtagatgtgtagagccatctggagaaggatgcataaactaatcatcaacggcgacaaaagtatacaattcgctggtggcattgggggttaagctagcctcgaatgtatacttcacctgatctagagacagatacagatatatcatctggttccctgcaagactagacgacgcgttcgatcgtgggcacgcgattccggtttggaaatgcgtggcctcgtcgtcaaacccaacgcaaatgcgaccgaaatgtcaatcacaccaaacccacacaaacgcaacacaccacaccactactactcctatactaatctctttttgtcaga

SEQ ID NO: 2990 - DNA, 636 bp, Oryza sativa
ttttgttctaagttaaacatttctaattttgactatcaatttataaaaaatcaataatagtttagcaacatatgaactatatattctgaaaacatttctcatggtgaatctggaaacatagtattatgttgttaaactatataaatttttaaaaattgctagtcaaagttagtaatttttgacaaagagagaatagtaaaaggctcacgaccaagagataaggaagtttacctcctttatcccgagagcagctctggtggcattgtcgtttgcccagaagtaagacaggtagtatcggtatgcctaaaagcaaaatttggcaatcgtttgtaaagaaaactcaatggaaatgtaggtgctttctcctcattcgaattacatttgcaagaaattaaaaatccaaaacacaataaatagtgacttacagcaaaacaactgaaaggaggttcaacaggtgggtcacctaaccaatagtgctcctcggttagagacttcctattggaagcatctcttcctggcattggccatggccagtcaaagggacatgctggttccaatacttctgacatgagctgtggagaaggtatatatatagatgacaaagctagctagacggtaagttcagacaataagggc

SEQ ID NO: 2991 - DNA, 1501 bp, Oryza sativa
caatgtcggtttgggaaccgacttagggcgggcaaaggagagggctagcgctcggcggtcgcggccaaagcggcgacagggaggagggaggaggatgacgccggcgggaggaaaaaggggaaaagagggagaggaaagagggcttgtcccttgcctcttcgggaaaaggacgagggagcggaggcgacgcggcagagggaggaggagctctgcctctgtcctttggcagcttgcgcgcggagtggcggggccgagacgatgacgacggcgatgacggcggggcggtgtggagcggagcggcgacacgggcgacaggcgcgggcaggcgcggcagaggctgacggcggcggcgaccaggcggtcggccaccacggcacgcgcgcgcggaaagcaacgggcggcgctgcggtttgagcggcgcggctcgggcacgcgcgctggcttgcggggccgagcagctgcgcggctgcaggtgcggcagggcagcggggccgggtgacgcggacggcgcaggcgcggcacgggcggcaaccacgcgggcgcgcgcgcgaacaacggcgcgcgggggccgacttcgcgggcggggagctcgccagggatggagacggggagagggagagcgagggggaggcgctcggcgcggcgcagctcacgcgcacgcgcgcgcggcgcgcgggcggagcggaagagggagggagacgagagagagagatagccgggcagggagggggagatgggccgagagagattcggcccatcgaacccgggggaggcaaaatagacttttgcggaggaattgatttgggaagggtttggattcgggattgaactcgacgatagatcggggatttgagatctgagatggcacggacactagacaacaagcaaagaaacaaatttcgcaattatggtttttaagagataattttcccgctaggcgccacgacggaacgggcgctacacataccctctacaatactatctatccaccatactcttagccacctactttctgtctaccagaacctacacataaaatatagagtctagccgatatgctacccaaaaatactaaaccctaggtatgatcctaccaaaacctaccatcagccgatacttgctatatatctgttcaactagttcaatcatccagtatacttcccatcctcctactaatcaaacccacacatgaaatataagcaagagtagttgcttaatcccctctagcctccaaccctctagaacctccgcataaaatatcaacacagtaatccatataccctataaaagagatagactataccctaaaccttagcccacataaccgtttatctctttcttactattttatggattttattgaaattggttcttcatctttcttagtagagtctattttattttggatggtaacctgtggtatttcgaggatcggataatcaggttgcctatctcggatttatttgcgttggagcaaggcaagttattattccttcccttt

SEQ ID NO: 2992 - DNA, 1501 bp, Oryza sativa
tacgagtacttaattgacggtagctcgtatgattcagccgatgagtcagatggaatcgatcgcctaatcttgagttcttgacccctcttcgacgccgacgatcgatcgaggcatggaactgactcctcacatggctagctagcttaattacgacgaaactgaaacgatattatttgatgctactgctaattttctctctcgatgcaaattaatgctggcagttgaagatgtactctctcttgccggcatgagagcgacgtcgccagccgtcgtcgtctcgccgtcgcgtcgccgggggctacgtgctggcacgggattagatccatgaatccatccgtgccgcccacgccatcagatagccgcgcgcacgcatggttagaaacgcgcgcggctgcgccgagaggtggagctcgccgccggcggctgctgtcgcgtcgctggccaccaccgctgaaccttcccgtgacccagtgagccgtggcgcctggaggctagagagaggaggggagagatatggagagaggggagatggaaagggaggaagaagatgagggggtgagtatgacatgtggggcccacgtgagtcccactattttttaaaaaaattttatgtgtgaaaatgacatgtgggtcccacgggctttattatttttcgattcgatttgccacgtaagcgccacgtcagtgccaagtcagatgaagaccgagtcaaattagccacgtaggcgccacatcagccaaaaccactatcaaaaccgccgagggaccatgtttgcccggttttcgtaagttgggggacgggtcatatccgattttgtggtcaagggacgaaaatcggacttgacgacaaatagagggacccatagtgaacttattccccaaaaaaacgtcataaactaacaaagcccaacatgacgttcatgggcctacacgggctaagatacccagcccgtcataaacggagtatgaattctaaacattttgggcttggctagttgattctaaaaactattactccctctgtctcagaatataaaaagtttagaattatatacggttgttaagaaattaggtagaagtgggtggtgtagagttgtgattggatgaatagtggaggtaggtgggaaagttaatggtggagggttgtgattggttgggaagagaatgttggtggtatattttgggacaaatcctgaaggctaaaagttattatattttagaacggagggagtatctacatacatacgtaaaaaaaattacagcatttagaattcaatatttctgattctctctgagaaaaacatatatggttaagaagcaagaacaatctccttcaaaagcaaaactcaagaagaaatattgatgaaatgaaatttcggcacgcatgcccttgtccatcccggtcaccgttctgatgaactgaactgctgcaccgcgcaattctatagtatgggatcagtggatcacgcatgttcagaccaggtcattaaactacaaaaca

SEQ ID NO: 2993 - DNA, 529 bp, Oryza sativa
gcctgcaaatgggcggcgagggggcatggaattttgcaggcggcccccttgccgccctgggggagggcgatttttgcctcccccctataaagcccagcccctcccctatgaaatttcattatattcactaaaaatccaaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaa

SEQ ID NO: 2994 - DNA, 1501 bp, Oryza sativa
gaatcatatttaacgcaggagtatagtattttactaatttccttgtgaagcagatttcataaaaaaaaactcatggaggccacttgaaccgggggaggctaatgggcgatcgatcgccagggcgattgcccagtgatcggtttcccccctccccctatactcctccctcttgttcccttcctcctccccttcttctctttccactgcagtgcaccacacaatttttttaaaaaaacaaaagttagaaaaatttatatatagaaatactatataaaaaaatttgaattcaaattcaaatttgaatcgggtatgtaaacttttaacttataaactttgggtctataaactttaggtgtataaactttagatgtatagaaatactatatatagaaaatatttgaattcaaattcaaatttgaatcggatataattcaaattcaaatttgaatcgggtatgtaaacttttgacttataaattttggatctataaactttaggtgtataaactttagatgtatagaaatactatatatagaaaatatttgaattcaaatttaaatttgaatcagatataattcaaattcaaatttgaacgggtatataaacttttgacttataaactttaggtctataaactttaggtgtataaactttagatgtatagaaatactatatataaaaaaatatttgaattcaaattcaaatttgaatcggatatataaacttttgacttataaacttttggtctctaaactttatatgtgtaaacttgaggtgtataaactttaggtgtataaatttactaaaatagaaaagtaatgcggtgccaaaaaaggaaaccaggtggaggggtggagggagggaggggggaggggatcgatcgctgccccatccccagggcgatcgatcgccgaacaacattctcgcttgaaccgtggctacctgacggcccacatgcatagtagagtaaggaaataagttcactttgattcccttacctagtggcataatctgattcgtatccttaaaccacaatatcagatatgttgaccctcctaagtcctaactattaaaaccggtgcaatttgactctgtcggcggttggagggtggtttccttgacgtggtgactacgtagcggcattgacttggtcttcatcttacgtgacgttgacgtgacgcttatgtgatactacctccgtcctaaaatataagaagttttaggcttgggcacgagcattaaaaaagtaggtttgattaaatggaagagggttgtgattagttgagaagagaaagtatgtgaagaatttgaatggtgaaaggttatgattggttgagaatgaatgtaggtgaaaaagttatatacttttggacaaactttgaatgctaaaaattgttatatttttgaacgaatggagtattagaattaaaaaaaatatgtgagacccatttgtcattcacaaaagaaatattgtgggacccacacgtcatcctctctttct

SEQ ID NO: 2995 - DNA, 1501 bp, Oryza sativa
cgatgattaatagacagtatcaatccatggttgccggtgtcgatggcggcggcgagagggacgcagcgacggcgagggcgatggtcgccagcttcgcgaactcggcgtcctccggggccagcggcgacgcgtcgtcggcctcgccgaacgcgtcctcgcacgtccctggcgcgtccagcgccgcgctgagctgcgtcaccgcgtcctgggtggcctcgtccccgcccctggcgatgtcctcggcggtctccccgagctggtccacggcgtccgagtacacctccgcgcacacgccgaggcggtccttcctcctcgcgtccttctccgcggctctcagcgcggcgatgcgcgcggacgtggcgttggcggccttctccgcgatcctggccgcgatggcggcgaggccgcgcgcgtcggccgcggtggcgctggcgctgtcggcctggaaggccttgatgcagtcgttgtaggtgacgtacttgtggccggcggcgacggacttgcatgtgtcctgcaacacggaggactcgcaggtagacaatccgagcatgaggaggagcaccgggacgagcagacgcctcatggtcgctgggattgggtcgacggccggcgatggtgagcttgcgtaggttgggagcttgggattgtgttgtggcggcggcgtacgttctcgcggcttgtcgcgtagacgtcgactgcgtgtagacggtttcgatcagaagctagcgtgcgagacctgggcattttaatacgcgggcaagatttgataataccataatagttgtcttaataatttataagtttgctaaaataaaataatgttgtaccagaccctacttgtcatcgtcaagacattatggtattttgagaagtttgattcgatcttgtctacctttttatgatctgtgcttcctttttttgggacacaaatgttatcttaaaaaaaaagtatctgtttacatatatgggttattattgaagtagaagattttagcaaaccggattaaacgtactatggatatagataataaacttatgtctagacccgtaatactagtctactataatatataatatgtgttgtctgtctaaatccatactactagccaattaggatatgtgcttcctatccatattctacatgttcagattatagtattatgttatatctaatccgattttagattactagtatatattttatgagaatgtagtaatacaatatggaactacacgtgtactttgcttggaagttggaacttgggatcacagtttcaacctgggaaaatatgtagtgcaaaccatatatatagtggaaacttgaaaactatcgttggatcgagaaatggatgttcgagattcgtccacgtcaccatgagttaaattttaactcccagtgaaattttaactcatgagtgaatctgcgagttaaattttaactcatggtgacgtggacgaaactctgacgtcgtttctcgatccaacggtagtttctaagttt

SEQ ID NO: 2996 - DNA, 1501 bp, Oryza sativa
cccagatccggcgcgtcctcgggtgggaacggggtggttggagtccggtcgtcgtgcaggtggtgtgaatatcgcaggtatcctcggtgtgcaggtgacatttggtggctcctgtcgtggatgctatggttgatgggtgctccaaggcgaaagtcttgctccgctctcggtgctagcaacggcgacacccttggacgccgttcaccttcttgaaggcgttgctactggagccctcgttcaactccacttcaagagttttctccgggtgaaaacctagattcgttaggatcggacgatgtcgtcgttgtcggcgtaaccttcttaaaggcttcgttttaggagtttatctcttgttggacggctgtacttaggttcggtttgtcaatgtcggggtttttgctggttttcctttaattaaccgtgttgttgtaaggtttttgggtccggtttcccttataaactggatcaactctcttcttctatagtgaattgcaggagctccctgtctgtcccctcgaaaaaaaaagatttgggacaggggaccataagcttagagggggctcagagaaggtgagggatcgacaggcttgcagcattgcagagtgcaaagagagcccgtaattagcagttttatgaaaacgcaaacccccaaatgaaaggcaattccaactaatctgaaaattctgatgaacctgaggatactcgtctcagtgtgtctgtgtgcgctctaatcttttctcctttttattttcaaaaaaaatcttttcctacatctgggccggcccgtcctcaggacgtacacgttctgccgtttgcgatcggtgtctgccgtttgcacgaatgaagcaggcctaacattcttcttccgagagacgtggaattatgaaggaataagttcatctgaagtctcttaacttgtcaacgaatccgattttcgtcctccaaccgaaaaatcagatacaacaagtccctcaactgtcaaaaccagtgcagataaggttcctcagcggttttagctgacgtgacgcctacgtggctaatctgactcggtctccatttgatgtgacactgacgtggcgtttacgtggcaatttgatctaagaaaaacaataaacctcgtgggacccacatgtcagtttcacacataaattaataaaaatggtggggcccatgtgggccccaggtgtcattctcacccatcctcttcttcctcctctttccctatctcccctctcttcctgtctctcctctctctctctcaggcgtgacggagagggagcggcgcgcgccggcgccgacgggagaggatgccgtcgccgcccatggcgaggatgccgtcgaggtcggagggcggcgtggaggacggtggaaacgggggcgggggccgcgatggtgagggcacgacggattcgggccaccacgcctgtcccctccggccaccacggcggcggcacgcccttctcaagcagaaagcggcgctgcggcgggtcgcagtgctgca

SEQ ID NO: 2997 - DNA, 1501 bp, Oryza sativa
aggaggagctctgcctccatcccttggaagctagcgcgcggagtagcggggccgggtcgatgacgacggcgatgacggtggggcggtttggaagggcgcggctacagggcggcagacgcgggctcaggcgcagcaggcgctgatggcggcggcgacttgccggtcggccaccttggcgcgcgcgcgcgggaagcaacgggtggcgcggcgatttgagcggcatcggcgggaagtggcaacgagagcagagagggagggagaagtgaaagagagagagagagtctctctctcgctcagcgcccgagcggcgcacgtgcctcacatgtgcgggcaaggatggaggggagaggagagttgggctgaggaggaaatgggccggggagaagagattggcccacgaactcgagggaggcaaaatagacttttcgagaggatttgatttgggacggatttgagattagggtttggatttcgacaatggattggggaattgagatctggaatggcacggacactggacaacaaacaaggagaaaattttcgcatttaggatttttaagagatagttttcccactaggcgccacgacgaaacgggcgctacaacttaacatggtggacccatcgtttcacaccattagatccatcttatatcaaggaaaaaaaatctcaaaacccattcgtatccgctccatcacgtacatacaccaaactatgtacgtacgcttgtaaaaaaaaaccacgtacgtacgtcccccaccttctctcttttttctccatttatttataggtagcaaattttttatattaaaatattaatattaaataattataatttcttataatatatttgatttcaattatgccatgtgttggtgtgtatatacatataagaaatagaccatttggatataaactcatatcctttatatgataactaaatactaatacatatcatgccattgtaaatgatctaccctctctccttactcactttattatccatattttctagctagcagcttagtatataaataattactatataatgcttattatattataaagattcattaagcagatccccataaaatatcatacagatctatccattatataataatggtccattatacatcctttatagtgtttctagctcatcacatggcacatctaataaattataaaaagtactacaaatactgcggaagaaacatttaatcaatgatttctatttaaatcgataaacctattatttttaacattaaatctatctctattaaacttttaaataaaaaaacatcttttccccttcctccccattcctctcatccacattattctagaaacattcatatgtaaattaaaactacaatgtcaaacaaaaattagaaactcgactattaaatagtgttttgtcaagagacaacatccctactttttttacatgtcatctaaattgacttaataaaatatgaaataattaaaaaaaatcacatatac

SEQ ID NO: 2998 - DNA, 1501 bp, Oryza sativa
aatggatgccacatatggtctgtctttgtcctattaagcttacgtaccatcgatactactgctgttggacaactaaaggctaaagccatcttgccactttgatgcggttctaggcttctagctaaaaagtactaacataatgattaatgaacacatgccgttgctcgttgtgcgtttagtttgtttgataatcaaatttttgtaatgggctttagggcaaagctcatacacattttaagatatatcctttaaatataagagagcagtactccacaagtacgagcagtccactccactatacgagcaacagcggaagaacaagatgggaacgccacgcgcgcaaggtaaatcgaaacacacatttgtagtagtagccgcacagcccgcactatccaagtaaaatccgtagcaggtggactgcacaaacccgcgtggcgcaggcgggaattaatggcaccattgtttggtttatacatgaataaacaaaataacatactccctccgttccaaaataaatacggttttacactattcacgtttaccgtttgtcttatttaaattttttttatgattagtatttttattgctattagatgataaaatatgaatagtattttatgtttgactaaatatttttaaatttttcataaattttttaaataagacggacggtcaaatgttgggcacggatattcacggctgcacttattttgggacggaggtagtatttacaaaagaaaattaaaaataatttatgaataaacatttacgtattgttcttaagaatctaaaagcaaaaaatttagaaagtaaatttcgataaaataaccttaaattggttaaaaaaaaattttaactgataggagtactaagcattagcttaggttaaaaagatgtggctgtaaagcgtgtggccctcctccgtttcccccaatcacaagcaacgcccactcgctactactactccactccgctagcctatagcctcagccgcacgcagcagcatcgcgtcgcgtgtggcctccgatgcgcccgcgcgcgcgggaacacacgtatacgcatgtggaggccttatccactctctccccctccccccgttctccggaaaaagaaaaaaaaaacggagagcaagaattcgaacgccgaacccagcggataaaaaacccaaaagaaaagcgataacgccgaatctattttttagtttttactccttcccttccctaccgcgccgcacacgcgataaacaaataaacgaccggtgttttttttcttcttttatctcatccgctcgcctcgcgtacgctctccgctactacttcagttctcgctcgttcttatcctcctctgccagcagtgactcacctcgccaccacggccacggtctcctcctcctcctccacacctttataatttgtaccagctgccttctttccaccagtcgacgacgacacggctcggttgttgctttgatcgatctgagctgcgttcgcttgccttgatc

SEQ ID NO: 2999 - DNA, 1501 bp, Oryza sativa
gggcttgtggcaatttatttgccttcagctaacagtagcaacaccaaccaagcatggtaaatacgtacgttttgactgccatttcccacaaacaaatcagcacgaaatcacattagcattcaagaaccaatcgccaattcgaaactttgttgtgttttttttctgcagcatagttcgaacttcgtatacagagatactaccactattctgttgcttttagatgattctctcaactactgtacgtgcttcaacaacagcttaccccttgttgcaaattcagatcagcattcacatctcaaatcacagcagcaacgggatcagaaatgcaggaaacaaataattttgctacgattgaaatcgtaatgtcattacatctatggaaatgagcaaatcacaaccaggagttgggatactactaatcctactactaaaaacccacccgtggcacatccgggtctctctacaccagcaaagcaaaaggacacaacaagagctaaaacaccagcaacagccagtccaggaggcggcggcggcagaggcggccagcgcgagggcgagggaggaccggagggctcagccgccgaagccgtagagggtgcggccctggcgcttgagcgcgtagacgacgtccatggcggtgacggtcttgcggcgggcgtgctccgtgtaggtgacggcgtcgcggatgacgttctcgaggaagatcttgagcacgccgcgggtctcctcgtagatgagcccggagatgcgcttcacgccccccctcctcgccagcctccggatcgccggcttggtgatcccctggatgttgtcgcggagcaccttgcggtggcgcttcgccccgcccttgcccagccccttgcctcccttgccgcgcccagacatcgccggagaccgagacgagaccgagacgaatccgagatggaagaagagagaagtctactacttggggagatctgaaatcgctgtggctcttggtgagatggatttggatttgggggtggttttatagaattttggggggattttgagtttgtgtttgggcgggagaatttttggggatagatttgcgcttttggtgggtgggtttgggacgttggattggtggtggacgggcgcgatgggttggggtgtgtttccgtggattgatgacgtggtgggaggcgcggggatggatccgtgggtggggggaggattgccgttggattgaatcggatggtggggaagctcgtcgttgcgagtggagcggatcggtgacgtggcaatggttctgtggccaggcgaggaacgtgggctgggccgggccgccggttttagctcggtctcctgatcagtcacgaggcccgtagcgtcaagtcaccggcccaccaccaccgtccggcgaataaacccgccgcctctcgtttcgccgccgccgccgtcgtcgccgtcgccgtcgccatctccaggtgggtgctatagcgataggctatggctttcgcgccgtccgcgcggagggtct

SEQ ID NO: 3000 - DNA, 1501 bp, Oryza sativa
acaatgtgatgctacagtaaacatttgctaatgacgaattaattaggcttaataaattcgtctcgtagtttataggcggaatctataatttattttgttattagtctacgtttaatactttaaatgtgtgtccgtatacttaaaaaaaattgaccaaacaactaaacacgacctaagcataggggcaggggtcatagggtctgttcctgcgttttcaccttcccatccgctctctcgcatcacatgcaaggaaaaattttaaagggtactacaacactgctcaaaccaaccaagccatgggaaacaaactgtttgcaaccagagagtcagtggttgtctttgaggcaagcctaatctattgaatctagcggagtttaatatactgaactacaattaaaattttgtttcgcttgacatagggaagtggaaggcaagtagtagtaggttttaactttaactgatatttggacccacgtgacagcacttggtcaatagggttgaaatggattgagtgcttttacaccactaatagaccacaagaaacatgagcctagaaatttcaagacatcaactatttctaatttataaggtctactgaacacttctactttcaagttaatgtccttaaatacttaaaaccagctgtacaaacaatctatagtaaacttctttttttagaacttaatttgagctgcagcaaattttaaaacttaatttgaatcaatttagggggcttgtttagttgttttttattttccagacttggcttttagagctaaggatataagtataaaggtcttacctaaaaacacctctactgcctcatgtgtaatttgggtggttcttcaatacctgatttagtatctgaagtagatggagtgcaatccttaataaagtgaggtagatatttttctttccaaatcaaaattaccaagaatggttggatgtattattaattgttagaacaaaaacgatgaatgacttgaatcaattgccaatatgaagaaatgatagattggtccaatcaccaatcaaccatcactccatcagcaagcaagcgatataaggccttgtttagttcctaatttttttcccaaaaacgtcacatcaaatttttagacacatgcatggagtattaaatatagataaaataaaaactaattgcacggtttgcatggaaatcgcgagatgaatcttttgagcctaattagtccatgattagccataagtgctacagtaacctacatgtgctaatgacggattaattaggctcaaaagatccgtctcgcggtttccagacgagttatgaaattagttttttcattcatgtccgaaaacccctttcgacatccggtcaaacatctgatgtgacacccaaatattttcttttcgcgaattaaacatgccctaaacaaacaatccttgattgcgcctacgataaggtacctttttttttacctcgaagaaaaggaatactttcacatattactccctcggaaag

SEQ ID NO: 3001 - DNA, 1501 bp, Oryza sativa
ggtagggctccaaactccaactcctaactctaaactccaactccagtgagagctagctccggttgaagttgaaaactcgttaaaagtgtttggctatactttcagttctagatctgaaaaaaaaaatgaaaaaatgaaaaaaaacgaaaccaatcggccccagccgcgccgccggccgccggccacgcgcgccgcccgtcctcgtcccgcagcccccggccgccgcagcccttcgccgccgccggcctccgcccgcgcgtcgtcgtcacgccccgtcgccgtggccccctaccgccgacgctaccgtagcccgccgccgccggcctccacccgctcgtcatcgtcacgctgcgccgcctgtcgccgcctgtcgtcatcccgccgctgccgcagcccgccaccgccgccggcgcccgctcgggattgggaggggaggagagagaacgggaggaaaggaggattgtaggggtagttgagtggcattttcgtgtagatactctaaaaaattagagggtagtgggtcttttgggatagagtggagctgtggagcagcaaaaacccagctccaccccgtagttcattttttaggagtagctctgccaactccactccaaaaaaaggtggatctggatcgtttggcacaactccggctcctgataagttggagtgggagctagagctatgccaaacggggcctaaacccagctccacaactctagtacattttgtgagagagcttcacccaactccactctcaattttggtggagctgaaactgtttggctgaactccagctctaggaggggtggagttagagctggagctgtgccaaacaggcccaaagtaacagtgccaccgtgaaggaacagcagtgaattgtaaatagtagaaacaaaacagtactaggcagggaaaatgaagtattattagcactagtatgcgtatcaatcaacagtcggcaatgcacagaagcattgatcagtcactcttgcagaagaaaaaacatgagtggtcagtaacagtcgcgttctcttgttacattggccagaaaaatgtgaaacgatgaaacacaggcgtacatgatagaacaatactgcatctgtaggcgacctcttattctttagtatcgtgtcactatccccccgtgcatgtcctatcatcaacggagacttgtcgtgctaaaccaactcgtcccaatgcaactcatcccctcgaagagtctgcagtctccgtctcaagaaccacgacagcctgccatgcatctatcgagcgcgagcagacggccgattcatcctgacgcttacaccgttgccgccatctgcctgccggccacgccatcctcctcctccccgtcgctccggtcgacgtccaccgtgccactcctgtaccggctcgcgcacacgaggtacacggcgaagtccgcgacggccagcacggcgagcaggaagaagaacttgtcgaggtggccctcgttaaggtcggcggggatccagccggggcg

SEQ ID NO: 3002 - DNA, 1501 bp, Oryza sativa
cactgcacaacacacacaaaataaaaaggtgtcaaggccttcaagaataattctaaacaaacataaaacgatgcacacatgcaaacagtgcgccgcttaactcccccatgaaagcagcaataaagccaaactgtggtagggcgatatcgtactccacataccctacagatcgatcgatcatttgatcgctatgcatggttgctacatcgtggataccatgtccgatgtctcctacggagatcctaatgtggcgctagtaatgcgtgcgcccgaatcccccgtggcgaggaaccctccagttgtgggcgttgcatggccgatgtcacctcgtcatgcagcattccgcgtaaagacccggcgcctaccgccactttaagcctcaacgtcgagtcacctcagaccgacttgcactgttgcgaaaacacttcactggaaagcccagtcatcgactttgtctccattttttgctggcccgtctcagccgggaaggagatggtgaaatcagcagagttcagcacaaagtacttacgaagaataaggccgccggcgagccatccgccggacttgcccttcaccgccggtgagcccttgatatccacggagccatcgagggtgtactcgcagcatacatccttcggggcgttactcgtctcatcgccttccacgacgatcaccctcatcttcatgtctccgtcgttgccagactgcaaccatcaagttacatgctgtcagttagtttccagtttcatgtgctgccatgtatacgcatggtgtttcatcactgaacatggagacaaaactgaatcttggctacagaccaacaagctacagaaacaagctgaaaccgtgtagctttgctaacatatatgccaagaacgatcaaatcatgagcacgtactaaccatttcttgctcctcctcgggctctcctcaccggtggcctccgtcggctaatgcaacgagaagctctgtgtgaggaagccgagcaggaggaagaagaggaggggatctatggaagtggttgtgtctgagcagagaggtctgggatttatagagctcagctgcagctggctagctggctctgcgactgtgagtaggatgtgcagatcacaaaagggaggtggaggagcgtgcgtgtcttgctcgcatgatgtcacaaacaggtattcttaggtatgtgcatcacaccgagacgtcgcgctcgacgatgactgtcgccgtttttccacctctctttttttttttttatcccgttctcatagcccggccatcgtagcacgcaagagcagccttttcccaagaaaaattcagatcgttcctggcaatctcaagtgtgccttttactcttatttgtggtcggttggtgtggctgctcgtgttctgtttcagtaacttatgtgactttacctggttagataattggcaaacgacgaaaaacttagtgccgagtccagcaatttgtctggttttaatcagggtttatctgcacaggaatactacat

SEQ ID NO: 3003 - DNA, 1501 bp, Oryza sativa
tgatggtacatttctttaatctttgttctgaagcaataggtcaattgtgaatagtttcttttctatgctgcaaaaggtgtaccagacttctttaccttctttaacaatgttgtagttctccaaaaggcccatatttctaaacattttcaatcttttagtccatcggtaccccagtccagcgatagacctggcatacccttaccttattctatttacctgtgttggacttgaggaaatatattagtgttgcaatcttttagccctactcccatgttgttttattctactttaatctatggttatcttaatgcagggagactaatcaagtccaagattcctttttcacggatggatggtcccagttgagtggaccttttggtgggaagcggacaaactaaagcaggttcccacttgacaccttaattttcttcaaaacaactttcttcacaagatctcttgccaattaaattgagacccagaggtaaaattaccacataatcgtcactccgaaaaaaatgtcactaacatcgatagttagtcaaaaaaaaacatcgatagttcaatatggctgacatgctaattcacaatctttgtttgcaacccatcattttaattcaactatatatatatttctctttccgagggagtaatatgtgaaagtattccttttcttcgaggtaaaaaaaaaggtaccttatcgtaggcgcaatcaaggattgtttgtttagggcatgtttaattcgcgaaaagaaaatatttgggtgtcacatcagatgtttgaccggatgtcgaaaggggttttcggacatgaatgaaaaaactaatttcataactcgtctggaaaccgcgagacggatcttttgagcctaattaatccgtcattagcacatgtaggttactgtagcacttatggctaatcatggactaattaggctcaaaagattcatctcgcgatttccatgcaaaccgtgcaattagtttttattttatctatatttaatactccatgcatgtgtctaaaaatttgatgtgacgtttttgggaaaaaaattaggaactaaacaaggccttatatcgcttgcttgctgatggagtgatggttgattggtgattggaccaatctatcatttcttcatattggcaattgattcaagtcattcatcgtttttgttctaacaattaataatacatccaaccattcttggtaattttgatttggaaagaaaaatatctacctcactttattaaggattgcactccatctacttcagatactaaatcaggtattgaagaaccacccaaattacacatgaggcagtagaggtgtttttaggtaagacctttatacttatatccttagctctaaaagccaagtctggaaaataaaaaacaactaaacaagccccctaaattgattcaaattaagttttaaaatttgctgcagctcaaattaagttctaaaaaaagaagtttactatagattgtttgtacagctggtttt

SEQ ID NO: 3004 - DNA, 1501 bp, Oryza sativa
attttgatttccgcaaactatgcattaactaggttacacttggcacttggcctcggtttgcaatacaaccggcaggccctacccatttgctgcattcaccttccttgatatttgaataccctaacacccttgacacccgtcaggtgaaatctcggtattcgcacctcgcgtacgaatatcgagactcccctcaaactctaaaattgatcacctgggtaaaacttgagtttacaaaatgcttggaaaacccgacacttgggttggtgccttgaaaataaagtgagtttctaaaactcgcggtacggaagacgtactggaggtacggtctgtccgttctcgctctaaggaccgattccttgggaattacatccgagcatatgtcaagtacgaccacatgggtgatatgggacgcccctggctgagtaattagctaggccagggaaatcttgctgccaagggacaagtggattcgctggggtggtgtcggggaggacccctgggcttcctggcacagtatggtctgggacctaacctggtgttggtccgtgggacccctccagttggcataagatgaccctgagtcggctttcgaaatgccttgtcgtgaaagcctcaaggtcgccagacgtgaccgagagtcgcgggctgggtgattcggggttagtaacgtcgtgtgggtaaagtgtaccccttctgcagaggttaataactattcgaacagccgtgcccacggtcatgggaggatgtgaggtgattccttagcgtagttttagtgaacactttggaaattgctgttggtgtgtgagtttttcccttttgtgattggtttgaggctgttggagcagccggtgtcggtgaacgattggcagggagcctctcgttccgacgtgtttgattcgaggctgttggagcagccggtgtcggtgaacgattggcagggagcctcttgttccgacgtgtttgattcgtggctgttggtgcaccggtgctggtgagcgattggcagggagcctctcgcgtgtggctgttggagcagccgggtcggtaaacgattggctgggagcctctcgtgccgacaagaatcaatcgacacattttcactgctccggccggatgagacgcactttctcgtccgcgccgttgagaagcactcacttagatgtttctgaaagtcttaaactaaaatcaattgtgaaaaacaactggctttcccttgaagcttgcattaaacacttaattcccctgacttgctgagtactcccatactcacccttgctctatataattaaacccccccagttcttgaagacgaagaggtggacccggctgatgaagagttcttccaggagcaagcagacttcgagcagtagtagggtttcggcctttccccaaggctttgcttgtggcttagggctagtctccgctttccgcttccgcctttttgtaatgttgttgcgaactcgggttctgtccgcagttccaaccttggttgtaatcctac

SEQ ID NO: 3005 - DNA, 1501 bp, Oryza sativa
cgagcgggatggagtagtctacgagcgacggcgcagtacagagtaggaggcaaaccctagattgattttgcatatatactgcgtgaagacggcgggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggccaggcgaggcgagcgagcgcgcgcgtgtgtttcccctcttctctccaccacacatgcttcaagcgactaggagggcatcatcccttttaaggaggtccccctctcctagaataagcaaggtggtactaaactccacatgcatgccatcccatgaggtgggcttttatgattttccaaagaattaatcttcgagtgggctaaggcccattcattaattccaacaatcccccaccaaatctcaaaatcccactgagatttgccttttccaatgtactgtttatataccagtggttcgatggagaccaattaaggttgaacatccacctagaactccaagctacacttactcacaacttgaacaatggactacgccttgaattgtaagtcttgtgcaagcaagtttcacttaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagccaacagaactcattaaggcatagccaacctgccttgcagctcatgagagttgtcggtgacatgggaccgggagtatcatgacttagagacttgaggcagacacgatcacccacgcggcctaaccccctcggggggggggggggggggtcgggcccgagggtgatacggccgcccttctctttgtctccccgaggggtcggaccgctcccgtctcagccccgagggtcgaggcgccccgaccccttgtgggttttgcgccgcgtatatgtggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggtgacaggcggtctgacgcacgcctcgccccatcccgtcaggatgagagcctccaatcactcgtccctagccggagccggcgtgttagctcctggagatggcacgttggtcccggtcagatata

SEQ ID NO: 3006 - DNA, 1501 bp, Oryza sativa
aattttccatataagaacccaatacgagattaatcaaaatttgaaataaaaataaaataaaatctaaaattagaaaaggaaaggagagtccaaatagaaatacaatttaaaaatagctgaaattcggaattaaaaataaggaatattgaaataagtttccatataagaacctaataaggaattaatcaaaattcaaaacaaaaataaaataaaatccaaaattaaaaaagaaaatgagagtccaagtagaaatacaatttaaaaatagttgaaattcggaattaaaaataaggaataataaaagaagagtccatataagaacccaatacgagattaactaaaattcgaaataaaaataaataaatctgaaattagcaaaagaaaataaaagaagagttcatgtaggaataaaatttaaaatttgctgaaattcgaaattaaaaatatgcaatattgaaagaagaatccatataagaacctaatacgatattaattaaaattgagaataaaaataaaataatacctaaaattagaaaaattaaaagaaagttcatgtagaaatacaattttaaaacaactgaaattgaaaataaaaaacaaaaacattcaaagaatacaatatgatattaactaatttttttaaaaaaattctgaaatttaaaaaagaaaaataagatatcaattaggaatacaatttataaataactaaaatttgtgataaaataaagattattgaaagaaaagaccatctaaaacacatgacaaaagttcatgtaggaatacaattttaaaacaactgaaattgaaaataaaaaataaaaacattcaaagaatacaatatgatattaactaaaatttttttaaaaaaattctgaaattaaaaaaagaaaaataagatatcaattaggaatacaatttttaaataactaaaatttgtgataaaataaagattattgaaagaaaagaccatctaaaacatatgacgagataaattaagtaacatgcctataaaggagtagagtggtggcggttgatacgagatataaaaattgttaataaaacaccaaatagaatcctaatgacaattaaaaggagggacgttaggcaggccgtgaagcaaattagtaatgcggttgccgggaattctagaaagtaaaaaaaaaactcattgataatcatattcaatttttaaaatctcaatgacaataaaaaggagaagcagcgggggtgtataagagtatagttgcagagccgccgaaggttgacgggacttctagaaaataaaaaaatgaattccaacaatagttatgttcgatttttagaatcataataacaataaagagttggcggcggacgggctatagaggggcatagtggcatcgtttgatgggacttctaaaagttataaaaagtgaaactacaagtccatttttaaaggtttggaacttctaaaaaaataaaaaaaaaacaatgataataatgtttgattttaaaatctcaa

SEQ ID NO: 3007 - DNA, 1501 bp, Oryza sativa
tgcacgcgggaacggccggaggcggcgggattcgcggcggcggcggcgctaggcgcgggcgaggcggcgggagcggcgggaggaaggagatgacgggtgggccccacccgtcagcgagggtggcaggcggacccgcccgtcagcagcgcacgcggggaggggccgtgtgggccgcgagggaagaggagagagggggagggaagtgggccgagccggcccaagagagggaagggggatttttagggtttttttttataaaacctttttaactttgtttatttcttaacaattattatttgtgctatgaaaattccactaaaatttatttacatattttaggcttttaggaaatatacaaaaatcctctaagccttatttgacttttactttgcacattttaatttttggaggctttcacacggattttaattattctaggcataatttagagaatgtattttagggtcgttttgggacgtgacagtaaagggtaagcctaacccgtaaccctaacaaatacggcatataaaaattgttaataaaacaccaaatagaatcctaatgacgattaaaaggagggacgtcaagcaggccataaagcaaacaagtaaagcggttgccgggacttctagaaagtataaagaaaaaaaatccacattgataatcattttcgatttttaaaatctcaatgacaataaaaaggagaagcagcgagcggggtgtataagagtatagttgcagagcctccgacggttgacgggacttctagaaaataaaaaatgaattgcaacgatagttatgttcgatttttaaaattacaatggcaataaagagtaggcggcggacgggctgcagaggggcatagtggcatcgtttgatgagacttttaaaaattataaaaaatgaaactacaagtctaatttttaaaggttcggaacttctaaaaagtaaaaaataccaatgataatcatgttcaattttgaaatctcaatgacaataaagaagggaggcatcgggcgagccgtagaggagtacaatggcaaaaccgctgatggtttggcgggacttctggaaagtaaaaatgaacccaaactataattatgttcgatttttaaaatctcaatgacaataaaaagaagagatagtggacgagatgtatatgagtataacgacaacgtttgacgggacatctagaaattataaaaacgaaacccaacgtgacaataaactctaaaaactataaaatccaatttttaaaggtccaagaatgaatagaaaaagtgatagatcgagcaaacaaataaagaatgagatgacataaggggtagcaactggtgtgatttttaaaactatataattagaaacatgaggatgaggatgataaggtttggtctttcaaagtgttaacaatgagatagctatttaataaatttcaaggaaatcatacttaaaaaaatatatgatttttttgctagccgcgcaattgcgcgggccacccagc

SEQ ID NO: 3008 - DNA, 1501 bp, Oryza sativa
ggcggtccacggctcaccctaggtcgacggcgacgacgaaaaaggcggccggagcggaggaaggcggcggcgcggcttgggtcgacggggacggcggcgctccggcggtcggcgagcctgacgagggggtggacggggacggtgacggtgcggcgaagccggagaaggcgacgccgaggcgggagacggtcccggcgagcggagagggccggccggaggtcgtctgcgacggaggagagagagggcgatggcgcgagctcgattccggcagggagacggtgcggcaaggggcagaaacaggcgagggaggcgcggggagggtttaaatagggttggaagggggagagggcggccgggagaggaaggaaaccggccgggaggtccggccgccatcaatggcgccggcgagatttgcgggagcaaatccgcccgtttgtatgcgagagagagagagggaaaaatggggggaaagggggaggggatcacggggaatatttccccccactttattgcacgcgggaacggccggaggcggcgggattcgcggcggcggcggcgctaggcgcgggcgaggcggcgggagcggcgggaggaaggagatgacgggtgggccccacccgtcagcgagggtggcaggcggacccgcccgtcagcagcgcacgcggggaggggccgtgtgggccgcgagggaagaggagagagggggagggaagtgggccgagccggcccaagagagggaagggggatttttagggtttttttttataaaacctttttaactttgtttatttcttaacaattattatttgtgctatgaaaattccactaaaatttatttacatattttaggcttttaggaaatatacaaaaatcctctaagccttatttgacttttactttgcacattttaatttttggaggctttcacacggattttaattattctaggcataatttagagaatgtattttagggtcgttttgggacgtgacagtaaagggtaagcctaacccgtaaccctaacaaatacggcatataaaaattgttaataaaacaccaaatagaatcctaatgacgattaaaaggagggacgtcaagcaggccataaagcaaacaagtaaagcggttgccgggacttctagaaagtataaagaaaaaaaatccacattgataatcattttcgatttttaaaatctcaatgacaataaaaaggagaagcagcgagcggggtgtataagagtatagttgcagagcctccgacggttgacgggacttctagaaaataaaaaatgaattgcaacgatagttatgttcgatttttaaaattacaatggcaataaagagtaggcggcggacgggctgcagaggggcatagtggcatcgtttgatgagacttttaaaaattataaaaaatgaaactacaagtctaatttttaaaggttcggaacttctaaaaagtaaaaaataccaatgataatcatgttcaattttgaaatctcaa

SEQ ID NO: 3009 - DNA, 1501 bp, Oryza sativa
taagatgagggacccccaatgaacttattcgtttggagcgagacaagtttgttccgggcctggaaaatcaccttccttttgtattcggccaacaattaacatacggttcgtactggccctactatccttattttagattagtactggtcatagtttcgccttttttttcttcgtcatgtgtttacgctgctagagacaggttcctcggccccgttcctttcggggaaaaacagagcagctcaggtacagggagacattaggtcccatgcatgctcgggggagcctcggaagagaagataatcaaaagtaccaaacccatgaaacgtacgttgagatcagtttacgaatgtgtcgccttcgcccctgaaacagaagaacccaaaagataacagctgccaaccagtgaagagcagccggaaccaccgcttgaatcgttcgtcctgtcctgccgctaccgatggtgatgccgctcaacgattgggcacttctccagcaacacggctcctaacccggtctagtacgtgtaagcttagccagccaagatacgcacgcacaccatacgtgttggaattaatgaatgggccttagcccactcgaagattaattctttggaaaatcacaaaagcccacctcatgggatggcatgcatgtggagtttagtaccaccttgcttattctaggagagggggacctccttaaaagggatgatgccctcctagtcgcttgaagcatgtgtggtggagagaagaggggaaacacacgcgtgcgctcgctcgcctcgcctggcagggcaggcggcgcgcgtgcacgacgtacgcgtcgaatggtccgaaaaattggctcctcacccttgcgcagatgtgttccgaaaaatctggtgcgtgcaaacggcgtggagtccggataagttatgcgcgacttatccggttcggttacgcgcagtagagatcgtgcgagcgccctgatcaagcgacccttctctatataaaccgacccgccgtcttcacgcagtatatacgcaaaatcaatctagggtttgcctcctactctgtactgcgctgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcaccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttacta

SEQ ID NO: 3010 - DNA, 1501 bp, Oryza sativa
ggtgccgcgccgcgtgcgcgtgagccgcgccgagccgagccctccctctccgctccctcgctgccgcttcccgcgcgccgttgttcgcgtgcgcgcgcccgcgtggacatcgcccgtgccgcgcctgcgccgtctgcgccgcccggccccgctgccctgccgcgcagctgctcggccccgcaagccagcacgcgtgcccaagccgtgccgctcaaatcgccgcgccgcccgttgcttcccgcgcgcgcgtgccgtggtggccgaccgcctggtcgccgccgccgtcagcctctgccgcgcctgccgcccgtgtcgtcgccccgctccaaaccaccccgccgtcatcgccgtcgtcatcgcccggcccccgccactccgcgcgcaagctgccaagggacggaggcagagctccttctccctctgccgcgtcgcccccgctccctcctccttttcccgaagaggcaagggggcaagcccccttttctctccctcttttcccctttttcctcctgccggcgtcatcctcctccctcctccctgtcgccgctttggccacgaccgccgagcgctagccctctcctttgaccgccctaagtcggttcccaaaccgacattgccatcctataaacccaagcttccccctttcctttcctctcccattcgcctccacgccattgccgccgcctcccgtgctctgttcgccgtcgccgttcgtcgttgcgcttgtcggaggagccggcacgagcaaggacgcggaaggggactccgagcgcgccctctccttcctcttccccggcccgaggccggagagattactcccgcgccgtcggcctctcgtcactgcgcccgcccgcacggtagagcatctccccgttctccctcctcgctccatctcctccccttagactcgggtagtagcacgagtagcctccccgtagctagccggcgccgccccgaccgttgccgccgctcgccgtgtgctcgccgccgtcgccgcccgagctcggaagcgccgctcgtcgccggcctcgctcggcgcagctccgcccaatccaacgctagcatcggattcccgtagccgcgtagatgctctcgccgccgggaatcggcccctcgtgacctcgtcgccgtttcccccttctcccgccgccggttgccgccgccgcaattcgccgccgtcgggcatcctccggcgaatccgagccgttggctcgtctccccttgtcctgtgcaaccacccggtgtgctcgctttcgcctgtatcgccgtggttcgctccaccgctcgccgctgtcgtccgccgtccgttccggccggcgtcgtcgtctacctcccgccggcccgcgtggcagccacgtaggcgccacgtcggcgtcagctcggccaaaaccgggtcgagtcgaccccggttagccgctccctccccgtgcgcgcggtccaccgcgagccatgaggctgcgcgtgggcccgccgcatccgcgtcctccgcgaaccgcgcgca

SEQ ID NO: 3011 - DNA, 1501 bp, Oryza sativa
tttgccaccgttgtttagcaaaagcaatttctctttcttttttctgtttatgagcaagtctaaaacaaaacccaaccaaatgtccatcttttccaaaaaaagaacaagtatacttctcacgacaagaaatttttgcagtagatggttttgaaattgatggttttgcaaaagactttttctcttgaatcattgaagaaagagaagccaaaatttcaccgaatttaaaaatcgttttcttttgttcgggttttgtcaaaacagcacctttttcagttatgctcaaaacagcaggttggtgatttgtaaaataggcattagtattaaaacctacaccacgattgaaagtgctcacttttgattgatccaaaatcatgttaagtttctttttaccatctgaaaacttttccaaagaacttttcaaataaaaaacttcttttttcaaattaacgcaattttcacaatcaaccaaaacacctttatttttgcgacacttagaacaagaaagtacttcatcttgttttacaatatttttgtcacgccccaaactagccccgagcagaggccagtataaggcgatccaaattaacctgtatgcctgtaccagtcccaggaaatagcgctggtacaacaggaagacagaatatcacaacaacagcggtctctttattaagagtaggattacaaccaaggttggaactgcggacagaacccgagttcgcaacaacattacaaaaaggcggaagcggaaagcggagactagccctaagccacaagcaaagccttggggaaaggccgaaaccctactactgctcgaagtctgcttgctcctggaagaactcttcatcagccgggtccacctcttcgtcttcaagaactgggggggtttaattatatagagcaagggtgagtatgggagtactcagcaagtcaggggaattaagtgtttaatgcaagcttcaagggaaagccagttgtttttcacaattgattttagtttaagactttcagaaacatctaagtgagtgcttctcaacggcgcggacgagaaagtgcgtctcatccggccggagcagtgaaaatgtgtcgattgattcttgtcggcacgagaggctcccagccaatcgtttaccgacccggctgctccaacagccacacgcgagaggctccctgccaatcgctcaccagcaccggtgcaccaacagccacgaatcaaacacgtcggaacaagaggctccctgccaatcgttcaccgacaccggctgctccaacagcctcgaatcaaacacgtcggaacgagaggctccctgccaatcgttcaccgacaccggctgctccaacagcctcaaaccaatcacaaaagggaaaaactcacacaccaacagcaatttccaaagtgttcactaaaactacgctaaggaatcacctcacatcctcccatgaccgtgggcacggctgttcgaatagttattaacctctgcagaaggggtacactttacccaca

SEQ ID NO: 3012 - DNA, 1501 bp, Oryza sativa
aacacaagaggacatgcgtctagagagcgcgcttgcaccaaaagtctgggagaaaagtctgggaggattcagccagggctgtctagacgacgtcaaggaatttttctttaatgtgatagcttttgtgcaagttattgtgcgcttgtacccttggaaaagaagctatgaaaatagtccccctctccccaaaaaagattaaacaataataattttagctcgaactgaatcaaaggtcaatctatacacatattataattggtaaggaaaagcataaatatcgtgatttctcatgaaaagaaaatatcaaaatcgagctggtaattaaggaaaatgagacattctaaattctaaaaagtcacactgcatgaaactcgaattcatagttgactatgcattccttttcgatacttgtattcttcatgctgatttaggctctgtttagttcccaaacaaaaacttttcatcccgtcacattgaatgtttggacaaatgcatggagtattaaatatagaaaaaaactaattacacagattgcgtgtaaattatgagacaaatttttaaagcctaattgcgtcatgatttgacaatgtggtgctacagtaaatatttgctaatgacggattaattaagcttaataaattcgtctcgcagtttacaggcgaaatctgtaatttattttgttattagactacgtttaatacttcaaatatatgtctgtatatctgatgtgacatgcaaaaacttttcactcctgacctaaacatggcctcgtttgtagcaatcggtgtattcccaatcttatctacctacctacatatttatttgcgaagcctacactaattaaaacaacccctagaaaaaaaatcaagttaattggggaagaataaatacagccatcttatataggttgcatcaaataataatggttgaaattttgcaaaacacccgcagaattgctgtcatcctaaccatcaataaattccttagtagaaaaaaaaacatcgactctaccaggtaatggatttcataccaaaagtagaatgcatttcagcttttccaacccctaatgaaccaggttatccttagccagaattcttttaccgactcctactcgtatattgtaagggttgggccaattagttgccacccctaaccccttctcttcaaaaaggagtcatcaccacccctttatgtctataaatatattttgcacgtttttggaaatagcgatgctcagatgctctctacctgttatactactagtattattaggatagattagcaatttactaacacgatgactagaggttactttgtcatttatgttttttcccggttaattccatctatgaccatttattgcgccaacatcactcatatttcatcgaaaaagctaaaaaggaggaaaaaagtatactcactgttaaatggcgattatacccacctattatttttgacaataatgtccctccacgtttgtactaccgttaactggggtagt

SEQ ID NO: 3013 - DNA, 1501 bp, Oryza sativa
ggcctccgcaatcagcagacgagcgaagcagcagctcgtccatgcggattggggggcggagagacgccgggtttgccttcccagttgtgccacggaaacccggagagagcaaaggatttcgtaggccgtgtgacgatgggcattgtgcggattttgggaagccgaaatctctgtagatgggccagaatcttaagatctaacgggaaggatcaggccggcccatcctagtagcagcagccatcgaacattcgatccaccaacaacgacaggctgagcaaccactagtttttcacaacctttacgttgatggcttcaccaaaccacggtcaaagccgtgacccccccccctctactccttacataccgatcgtcctacagccaaatgtgctttgctttcgacgacggcacatgtagatcaacagaagcagatactgccactagcgcatattacacgcgtgcagatgtacgcctacgtggggctcgtgggcggcgcagctgcgctcgtgctgctgctgctgctgcggcaccaggcgcgcaggtggaggaaccctcgctgcggcggccaactcccgccgggctccatgggcctcccgctcgttggcgagacgttccagttcttctcctccgacgcctccttggacatccctcccttcatccggcacaggctggctaggtacgcctttgttaatgggccagagaacgggctgggtttcttttgctgtttttttactagtttgggctgcaagttcagatatgggccgatattcaagaccagcctggtggggcacccggtggtggtgtcggccgacgaggagctgaaccacatggtgttccagcaggaggggcagctgttccagagctggtacccggactcgttcgtggagatcctggggaaggacaacgtcggggagcagcagggcgccatgttcaggtacctcaagaacatggtgctcaggtacttcggccccgagagcctcaaggaaggcatcatccgcgacgtcgagcgcgccgtctccagctccctctgcacctggtccaccttgccggccgtcgagctcaaagaagccgtctccactgtacgtacgcggtttctacccagattttagaatgttggtttcttgtactgtctcattgtgatgtatgttccgttcgagtgcatgcacttgcgcagatggtgttcgatcttgctgcaagcaagctgctcggcctggagccgtcgaggtcaaagattttgcggaagagcttcttcgacttcgttcgagggctcatctccttcccgctgtatctgccagggacagcttactactcatgcatgcaggtaaaacttatgtcgtcacgatattgcactaattagtcgttcttcgcaaagtttcagacatggtctcttggttttgagactcttgtcaggggcggaggcgcgcgatggtggtgctagagcaagttctggaggagaggaagcaatcgacaggattgcagcgaggaggagaagcgcagcagcacg

SEQ ID NO: 3014 - DNA, 1501 bp, Oryza sativa
tctgcagctgatgggatcagctaggcccgggtggccgtttgaaagttgttggcccgggtggccgttgaaagctgttggccgggtgccaatcttgatcaattttaaagactgatacattgcacatactccaaccggacgagacgcactgtctcaaccgtgtcgtttgagaagcactcacttagttgttttcagaaaagagttcaaataaaatcaattgcaaaaacaacagcctttccttgaagcctgcattaaacacttatttcccatggcttgctaagtactcctatactcacccttgctctatataaataatcccccccagttgctgaagaagatgtagcggatcccgctgacgaggagttcttccaggagcaagccggctacgatgagttttagggtttcggcctagttcccaagtcgcgcctgtgttgtttggtccaagtcctggcttccgcttcccttttgtaatgcagttgtgagctcgggatctgtctgcagcccgacttgattgtactcctactctataataaagagacctctgttgctgtgatattctgtcttcctgtgataccagcactgtttcctggtactggtatcgattaacaggttaatttggagcgtcacgggctagttccggtcggtactagttcggggcgtgacaaccgttgatctcatttgatcgaagggttcagatctatttatactactaccccagttaacggtagtacaaacgtggagggacattattgtcaaaaataataggtgggtataatcgccatttaacagtgagtatacttttttcctcctttttagctttttcgatgaaatatgagtgatgttggcgcaataaatggtcatagatggaattaaccgggaaaaaacataaatgacaaagtaacctctagtcatcgtgttagtaaattgctaatctatcctaataatactagtagtataacaggtagagagcatctgagcatcgctatttccaaaaacgtgcaaaatatatttatagacataaaggggtggtgatgactcctttttgaagagaaggggttaggggtggcaactaattggcccaacccttacaatatacgagtaggagtcggtaaaagaattctggctaaggataacctggttcattaggggttggaaaagctgaaatgcattctacttttggtatgaaatccattacctggtagagtcgatgtttttttttctactaaggaatttattgatggttaggatgacagcaattctgcgggtgttttgcaaaatttcaaccattattatttgatgcaacctatataagatggctgtatttattcttccccaattaacttgattttttttctaggggttgttttaattagtgtaggcttcgcaaataaatatgtaggtaggtagataagattgggaatacaccgattgctacaaacgaggccatgtttaggtcaggagtgaaaagtttttgcatgtcacatcagatatacagacatatatt

SEQ ID NO: 3015 - DNA, 1501 bp, Oryza sativa
actggactaaacaaaagattgccacaaagttatacttcaaatctaaggagcactaacatcaatcttgttgactaaggttgcataagcggttggcgctcaacccgaatagagaccatgtcatggttactactctctccgttacaggttataagatgttttgattttggttaaagtcaaactgcttcaagtttgaccaagtttatagaaaaaaatagtaatattttcgaccaagataaatttattttaaaaatatatttaattattaatttaataaaactaatttggtaatgtaaatattactatatttcactataaatttagttaaatttgaaacagtttggctttgaccaaagtcaaaacatcttaaaacctgaaacggagggagtattatgaaagaaggaaatagaagacaccctccaaatctagtatacattaatcgtcaaaggatccagatggtggcgatgcatttaacatgtataaatgacggtggacaacatggaaagcagcaatcaacatgttggcaacagtgaccttcagatagcagtagttgagagccaagccatcttgaagggtttgccagtaaactagcccttcggctctccagtttagttgtttgccgacgctggatccttgagactccattggtacatttatgtcacgccccgaactagtaccgaccggaactggcccgtgacgctccaaattaacctgttaatcgataccagtcctaggaaacagtgctggtatcacaggaagacagaatatcacagcaacagaggtctctttattatagagtaggagtacagtcatgttgggctgcggacagatcccgagctcacaactgcattacaaaaggaaagcggaagccaagacttgggccaaacaacacaggcacgacttgagaactaggccgaaaccctaaaactcatcgtagccggcttgctcctggaagaactcctcatcagcaggatccgcttcatcttcttcagcaactggggggggggggttatttatatagagcaagggtgagtacgggagtactcagcaagccatgggaaataagtgtttaatgcaggcttcaaggaaaggctgttgttgttgcaattgattttatttgaactcttttctgaaaacaactaagtgagtgcttctcaaacgacacggttgagacagtgcgtctcgtccggtcggagtatgtgcaatgtatcagtctttaaaattgatcaagattggcacccggccaacagctttcaaacggccacccggaccaacaactttcaaacggccacccgggcctacaactttcaaacggccacccgggcctagctgatcccatcagctgcagattttccaaacatcgatcccctttccacaacagcaatttcacaaacagtaggcaaacaaaactacgctaggaatctcctcacatccacccatgaccgtgggcacggctgttcgaacagtttgttaacctctgcagagggggtacactttacccaca

SEQ ID NO: 3016 - DNA, 1501 bp, Oryza sativa
cattagcggtaggccctgatcgagctagattctctgccagtttggcctccatttgtgcttctatgaactatgatcagccgagccgaaagccggaataggagtatatgtgggcgcaaggaaggaggaggaatgcaaaattaattgcgtgttggtgccttgccgtcctccgggggccatgcatccatccgttcccgacggaatggcgactatttttggcattgaaaggagcaaatacagcgacgaaacgtcgcctcaccggcgcggcatgcacgcccaccgacacaactgcaccacccatctcggaacgccaagcacaaaacccccctccctgctcgcctcccaaaacgctcgcaaaggcttcgaaaccatactctactcggctaattccaggtggtgacagtttggaattttggcggtgtcatttcgtcatcgacacgcagttgatagtacctgtggctgcggttaacgatgacttgaatttgcttaagcaagtttcccttttcacggagcatctcgtaattgtgcaatggaccaatggttaatggttatcgtttactaagagcatccgcaatggttatttataggctctatacaagagatccatgtcagcatatttttctacttgaaagagattaaatgaagagagagagcaaagctatctactaacctgaagatagtctatagagaaaaacgaggcaatggattagagagctatagatatccatgtagacatactattgatgtggattactattaatttagtttattactgagatgtatatgttttatatagagtatcttattttaccattgcaggtgctctaatacaccggtggttagtacgggccaaaggcaactgattgcaccagcctatcacaggcgtgaacagatccaatggctagaggacagctacggccattaaaacaagtctcacagctcaccaggtaggtccgaggcttggacaaacatgccaaatggaccaccaatggacaatgcaggctacctttcgctaatatgcagacgaaatggtgaataggatgatcagcttgtggtactaaccatcatttttcttaccatggcatgtagaagtactagcgatgagcaacgcaccaaattgcccaatcatattgcacccacggccagaggcgacagtagctacagcatacagaacagtgtgcacttgcgcgccgacagttatagtactaattctagctatagtagtaaatcaattcatgggtccagttgtagccagcagatttctagagcaagaaatgggtaattagctgctgatctcctatgccgtaattagtgggctaatatgtatggattcattcacccgcttctgctctcgtgtgttgtttagcttgcaagatgcattatcgctaatcaatacaacgaggtcagattaaaacccgtgcaggagtatcagagcgtacggagtacggagtagatcgacaccctgtcaccataggagtattaccgaagcacaagactggaattg

SEQ ID NO: 3017 - DNA, 1501 bp, Oryza sativa
agggtacgtaagagaagagaagggttcattctattataaaagtggagaagggttcattctattacaaaaattagtcgatgtagcagaacgatgactaacattctccatcgttttaatcattgatccctcaaaacatgctagataatgacataggaacaaacgatatctatctatctatctatctatctattatattattaaaacagttttgaaagaaggcaccacgttcgctgtggaggctagaaattctcacattaatcggagaaaaagaaaaagagagtccaagtagaaatacaatttaaaaatagctgaaattcggaattaaaataagcaatattgaaagaagagtccatgtaagaacccaattcgagattaatcaaaattcggaataaaaataaaataaaattcaaaattagaaaagaaaaggagagtccaagtaggaatacaatttaaaaataattgaaatttggaattaaaaataaggaatattgagagaagagtccatataagaatcaatacgagattaattaatattcggaataaaaataaaaataaagtctgaaattagaaaaagaaaataagagttcaagtaggaatacaatttaaaattaactaaaattcgtaattgaaaataagcaatattgaaagaagaatccatataagaactcaatacgagattaattaaaatttgtaataaattataaaataatatctaaaattagaaaaactaaaagaaagttcaagtaggaatacaattttgaaacaacttaaattcaaaaaaaaaaaataaaaatatcaaaaaacactatacggtattaattaaaatttcattttttcccctaaaattagaaaagaaaaaaagatttcaattaggagtacaatttataaataactaaaattggtgataaaaaataaagattgttaaaagaaaaggccatctaaaacacatgacgagataaattaagtaacatgcctataaaaggagtagaatggcgacggttgatacgatatataaaaattgttaataaaacaccaaatagaatcctaatgacgattaaaaggagggacggcaggcgggccgtgaagcaaacgggcaaggcggttgccgggacttctaaaaagtaaaaaataaaccccattgataatcatattttatttttaaaatatcaatgacaacaaaaatgagaagcagcgagcggggtatataggagtatagttgcagagccgccgacgattcgcgagacttctacaaaacaaaaaatgaattccaacgatagttatgtttcatttttagaatcccaatgacaataaaatgtaggcggtggatggaccgtagaggagtatagtggcattgtttgacgggacttctaaatattataaaaaatgaaacccaacaagacaataaactctaaaaactacaaggtccaatttttaaagatttggaacttctgcaaagtaaaaaaaaccccaatgataatcatgttcgattttaaaatctcaa

SEQ ID NO: 3018 - DNA, 1501 bp, Oryza sativa
gtgagggagagatattgggtttaaatatctaatgccacacatggagtggtggcaatagttatctattgcaacgatgtgaagtgttgtaatatttttttttccacatccattttatggcaatatcaaaattttttgcaactaaataaaaatcattgcaataacctattaccacactatttattaccacggctagcaacgattttaaaaatgttgttataagctttaactatttataaccctagaaacaggggcggaggtagagtatgggaggggtgcccaggaacttggtcaagaaaaatttttaagttataactcacatattttcatcatgtgtgcacccccctcaatacaaacttaggcacacgcatcaatttacacttgatctaaagtagagtaaattaagcaagatgtacgtccttcatttcgttctagctccgccactacgttgaaagtatatgatttataaataacaagtgtttattaatattaatatactctagataaatcttttgagctagcttagccagtttgttgatcgagtggctttttgattggtactagttcaattagaccgatacccacatcaagttagtggctactcggttattgtattttgcagcaaagttttacatgtcgtgtgactacataatttgaaggcatttttagaactagttaaatatatataaatagtcacacgtgtagattattcttagagaatattaatccatccatactttaatatgttagctaggcaggctatgtgatttgtaaaatggaaagtaatatatacttcgggcttgttaatattgataccatttcaaaccatattattttttagcagaattgctaaatatgtgcatccttttagtttattgtcaaactttagtaaatacataagaaatcctatcaaaattttaccaaattaccaaaatttagtaagatttattttgtttacaatctgaacaggtcctttcgttccaaaatataaatatttttaactatatatatggataattgtgtgtctaaattaatgcatgcagctaagagttactatattttagcggaggtactacgtgtttatcatcaaatacaggtgcagtgtggatgtgggcagcccgatcggcttcatcactacttgcccgattggggaggcctccatcatccacgctcgcctgacggctgctgccactgccagcccgccccgccgcccattaatgccctgcagctaccgacccacagcgaggccggccggcgatcgataaaaaggcgcaccggccagctagctaagctcatcctcctcttcctcctcctcctgctgctgctgtgtgcatgtctcccgcggagaaggcgaagaggagagccaagatgtggaggacggcggcgacggcggccgccgtgctgctcctggtggcggtgggcgccgcgcccgctgcctccggcgtggcggccggcggcgcgggccgcgccacggcggcggcggcggcggcggcggcggcggcga

SEQ ID NO: 3019 - DNA, 1501 bp, Oryza sativa
aaatggtctacatgaccttggtcgttctgtacgtgaggtatgcactgaattggttaatgttgtcaagtttagcacattactaggtaacctgatgagagacagttcctggttttgttcagctgtaattttaatcatttattgatgttgtgctaatatatttattaagattgactttttttttcttttggaactccctaaatctttcttgttagtatatcaacaatgttagtacttagtactatcattcaaatgaacaggattcctttcctattaaactgtactgaatctgtcattgacattatcgacttgcatcatatgaacctagaactgtctttgtgcgagtgataaacttttctgacatcgttggttttttgctgttgcagcttcaaattgatgaccagcgtttcgaggatgctgaggaagaagacgagatccaagaaaatggacattagaagcagaatgttcattttacttgttccgttccttgaggggactatgtcattggttcgtctgtagattaccactgatgctgcttggttcgcaatacttgcttcttctacttcctttccctctttcttgttctataggatcaacatctctagggagcatcgatggtaacttttgtgagaaaaaggtcttgctgctggtcaagaatgtaacttgtagagcatgatggtgaatcgagtgaaattagttcgatacttttgatctgacagataggaggggaaatcgggaaaagaaatatgttctcttttcccttgtatatcatggcactgttgtgttatcatttaggatttaaagatttaaatgccaaactggatggaattgggacatatttctacctttccctatctttacaatctgaaaacaccgaacgacacccatgtcaattgtcatgtgaagtcgttgcttattagttgtcccgaattattaacctggccccaaatttctgagcatgtaaatagcacgtcccgccaatagaacttgtaacaaaattgttgacggacgacgagatgaaaatgtgcaggcctctatatagtgcttgagaacacactagcataatacggattatgattcaacttctcttcagactaacaaatcaattatgtactctttgtgcgatgaaacaaatcaattatcaattatgtactctttctgcgatgttgtgaaaaagaagatatgcgttatgcgatagcatttcctttcgcgacttgcgagttgtggctaaaaaaaatagtatctcaagatgaaccaatcatcaatgaacaagtatgaaaaggaaagagaattttctaaagcgagaagggaaacatgctgggctggtccaaaactgcagagcctggctgcagttgggccgagacgagccgagccactagtcgcatgtaaatactcgaaccaaacgccgaaaccctaatcgaagccaccgacgcctcgagcacgagcagccgaccgagacccttccgcaagagcaacatggctgcggcggcggtgtacggcggca

SEQ ID NO: 3020 - DNA, 1501 bp, Oryza sativa
actacagactcatggatgcatgctctgactcatagactcgcagagaactagtagagattatgacagtgatttgttttagagtggaggagacttgcattgaggggtgccctgctcagagctcactggtcacagctcccaaagagatctggattaggacctaagggaactccaatccagaaataaacaagcaggggcacatgctttttgatgcaaacattctaaggaactgaaggaaggatatataaaagagtaaaatgatcgatgaagtgcgttggagaagtgaaattctacctattgtttacagtctgtcattatgatggtacacgcttgaatttgacagggaaagggtcaacacggagttgcacacagatttttgcttgttcattgattagcttgagggcttagtataatcatagctagttacttccgtaggcatgagggttgacgtttacattctcccagagaagtacaagcaagtttttataatgctcatttacctctcttataaacatgtaatgccagcaaattaaagtgaatgcggaggagtacaagcaagtttttataatacccagttacctcttttaagtatgcatgcaatgtcagcgaagtgaatgaatggtactcactctgttccaaaatacatgttcagatttataactagaaattgttatattttgtaatagagggaataatagattcatgtaatcggaaagatcatgctaaaatgggggaacagtgtaaacagtgaaccataaacttgattccagagtttatgcagttgctgacacgcaagaattctaattaattccattgctttccttcatatcctacatacagtagcagacagcatcacagcaagagaacggtcatggatcacgtaccattccattcatcctcgagttctgatccaataggaagtgccctttccgtggcagataggagtagaattgatacctgatgaagacttcacagctgaaacctacgaaggcggcaggtcacctgatcataccaacatggcgtcagctttcagtatgtacatacttctcgtcaagtcatgacacttcagtatcgacgaatataatgtatgacgtccacctgatcatacagactctgtcagagtgattatgcgccaataagcagaaatttatagcacaaggcaaggtggaacataatacaaaacgtaagatttaaaggtagatgtccttggaatcaaagtatagtgtcaataccaaactcgtgttgcacatttggcgtaagaaggcaaatctcctccaactaaaaaaaaaactgtgctacgtatttaggggtacatgttgggacagatatcaaaatataatttctatatttaaaaaatggaaatctgaagatggcgtgtcacatactcacatggctccattgaacagtccaaagtccactgcctactttcaacactaatgaaaaacgtaccagatactttccatggaatgctagtaaacattagctctgaacccgttcaaaatct

SEQ ID NO: 3021 - DNA, 633 bp, Oryza sativa
ctattgcccatacctgtaaaagcagtgcaatgtattttcaaaatgagcatttctgttgcttgctcagctggattggtgcaattctattaaaagatccttttgaaagataaagattttgaacgggttcagagctaatgtttactagcattccatggaaagtatctggtacgtttttcattagtgttgaaagtaggcagtggactttggactgttcaatggagccatgtgagtatgtgacacgccatcttcagatttccattttttaaatatagaaattatattttgatatctgtcccaacatgtacccctaaatacgtagcacagttttttttttagttggaggagatttgccttcttacgccaaatgtgcaacacgagtttggtattgacactatactttgattccaaggacatctacctttaaatcttacgttttgtattatgttccaccttgccttgtgctataaatttctgcttattggcgcataatcactctgacagagtctgtatgatcaggtggacgtcatacattatattcgtcgatactgaagtgtcatgacttgacgagaagtatgtacatactgaaagctgacgccatgttggtatgatcaggtgacctgccgccttcgtagg

SEQ ID NO: 3022 - DNA, 1501 bp, Oryza sativa
ccacccgccacgggcgccgccgcccgaagccccgccgcccgccgttgcagcgcgcggcccagccgccggccggcccgccggatgggaaggggaagccggccaggaaggggagagaaggggaggagaggaggaaggggaggagttggagaagagagttagagaggatagatttgaggagaggtgtgagattcgatctgtctaagttgtaactgtggaggagagaataaggtatagggattatatactacgtgtttaattttagtcccgattggtagttggtgatctttagtcccggttattgacatcaaccgggactaaagatcctcggccctctgacatacatctgacagtggatgaaccggaactaaagatcatcttttgtccctaaagatcaaaatttttataaccgggactaaaaataatctttagtcccggttcttcttggatgtggaactatcgtggattttgccggaccgaccaaagatgatttctctaccagtgagtagctcagaattactatatataccttaatttatatgatgttcacaccttttcttttacaaaataggataattaaacctaacctctacgtccaaccgatgtacacagccaatgcgatgttcacataactactagtagtaattatttatgctggcgtgcagttgtcttcttctgttctttggtcatatagtagtttatgctgtgtattccatagttaattactgtacgtatatatatatctgaccagcaacctcctgccgcaagccctggcctgtcaattgacgcaacgacatgtatcattctccacgtacgcatgcctctcttgcgtgttatcgaaaaaggctaggttagtgaagaaacattgcgtgctttcgcgcacctggtgttatttattcatatcactgtagatcattccatgggtcttaaacatatgatgctacacatggcgaatactaattttccgtggccacgaagcgctcaatattcgccatgtgagccatccatgtcaaccattgcaaaagtttgcagctgaactggacctggttctactggtcccaatttatgatggcccattagtcacccaacttaggtacagcccaaagaccatagcccatgaaagcctccgcattgactcctcggcccctattgcgtcactgggcgtcgcctcccctttctcgatcacccgcgtattattatccccttattaatagccgcaacccccagtaatctcccactgacattacgggcccacaagtacgcgtccccaccagccatagactgctcctagacccgtcgcaccgaagctcccctgccaaatctacgcacgcgacgcggccatctctctcccttctcccccaacctccattagccgatccaaaccacctcaaagccccggaccgcatcactctccttctccccccccacgcccagatccagatccacccggcgcggcggcggatccgtcgaggaataatggcttccccggcggcggcgccgccgc

SEQ ID NO: 3023 - DNA, 1501 bp, Oryza sativa
tacttatttttttctataaacttggttaaatatgaataaaaagtagtttgactttaacaaaaatcaaaacatcttataacctgaaacgaacgagggagtagtcaatttgctaattgtttttgtaaggacgaaatctgctgtgaatgatgagagaggctaaattgtgaatcatctgcgaagtggcttcaagccttcgatttcaacagattaaaattaacgtgccatctgcaccaacccaaccaaaatatatagcagtacgacgaaacgaagagacaacaaatccgttccccaaatggcaatattagtgttagtcaatttttaattagttagcctcatccggaaatccaccgcgccggcaagcccaagccccatggcccccaggtcccagttacttggcgtcgttggcgaccagcacaacgcgaggccacgcgcgcgcagcagcagccgcccacgcgaagcaaagcaaagccaaacccatggataaacgaaacgaataaacacgatcccccgtccagtacgattccattctgtccccgatcccgtcacgtctcctggaaacaccccacccgcttctcgtctcctcgtctcctcgttcgtctctcgcctcgtcttccccgtcctccgcgcgattccccaaccctccccgaagccgcagtccaccgcaagtcgcctgcctcctccgccccgcgccccctccccccgtgcgccggcgatcgccggtgcccgccaggtcggtggagtctattgctctctctctctctctctctccccccattccttccgcgccgctttcgtgctgattttttttagctttggatgaacgagttttcgttttggtgttaggcgttattgggatgagaaatctagggtttggaacggcggtgtgcggaggtgggttgggtgttggtggggagaggtttggctagaagttagctcaactggttgttaagtagatagccgtgaggtccgtgcgggacaccgaattgctttccgtggaggcgacacagacgatgtgaatggtgatatgtactgcgcgattacgtttcggctgcagttgattgatcaattcgtcaacatttctgagcaaaatccgtttcatcattaggaatgaattcatttggcatcacattgctgctgcctctggaaatggaggcactaccctggttggcatctagtgcatgtataggataagttcgtttttagccttattatccatggtgccttttcggtttacctgcgttaagcttgttcataattttgtttaggctcagattgtatgaaaaaggtagctgtatatagacgtacaagtaagagcgttagctcagtttcttcttagctcccatacttgtgagtttttacacacatacattttgttgtacttgctggaaattgctggtatgcaaagtgtgattcattgaattccttttggttttggtgacaggttatttcttgtggcatggcaaggatacatattggtcttggcttgttctttcatgaatga

SEQ ID NO: 3024 - DNA, 1501 bp, Oryza sativa
aagttgggaattaaaccatacattagcctacgtttaatactttaaatatatatccgtatatgtaatgtggcatgaaaaaaaaaattgttcccgaactaaacaggctctcatttacggctaattattctttcagtggtaggcgacgtacccgtcgacagcgaggcgtctgtggtgacttcatcaatttcaagatatgccagcccagtcttccggaggtgcttatagggatagggtatacatgtgtgagttcataggggtgagtgtgcgcacgttatgagcataagtcggtgattcaccatccaggcagtggcttggatggcaagcaagaaggcaagcggtggaactgggccatcactgacacagtgacgcgccttaaccggtaacgcggcccccacggttcggtgggagcggaccagtcgcgtggatcggccatcatcatcctgatatcgctcgcgtgcgtgcaagctgtgcgtggcaggtgtgaatcagatccccgcgtgttgtattccgtctccacctagaagcgtacgtacgcggtgtgtgtataacgcgagcggccagtcggtggtgctgcctttgcctgcgtattttgcgatcgtttcgtgaaggccgcggcttttctctttaatcggttactgccgagttggggttgcagccacaagaagtagaaacgaacgtgtacctgttcagctatacaaagtaaacgataacaaaattctaatttgctacttacaaggatgtgctatttagggtttgtatttatggtcatgttagcttaaggtaataaacaagaggaagagagcataatagcagaacctctattttccctacttatatctataaattacatgtaaacactccactggtttggcaaacaaggtagcagctgaacacaagaaagaacaatctgaaaagggaaaagtgggtgacaggtggccaccagggatgggccagtgaagctgtctctcttccccaatcgagccgctttcccctgtccgaacgctacaaaaactttccacacgccaccctctcccataccaccacatctcccaaagaattccccgttccaggcagccgagttcggtccaaagtccaaccccgcgactgcatacaattccactcgcccagtcctctcccgcgaccgccatttgactcgcagggagccaacgccgaaaccgcgccaatcttttgcccccattttagacgggcgctgactgagccaaacccaacccaacccaacccccccgcccggcgcggccacctcacaagggagcatcggcacagccaaccgcagcgcagcggcagccaaaaacccaccgtttccaattcctcgcccgattttgaaccgctctccgcccgaccgaacctgttccactccgccgagcggaaaaaaaaaacttcttcgccgtctcgaaggaaatttattgggaagaaaccgttgcgggaggcgggcaaactgaagcggcagcggcagcggcagaggcgatggagcggtaccatc

SEQ ID NO: 3025 - DNA, 1501 bp, Oryza sativa
gcagcggctcgcaggccttggagaggaggcggtgctgctgcagggtggcgttgcgcgggcaggcggcgtgcgggtcgtaggacatgaaggcggctaggagggagagcgtggcgggcgacctgaagcaggagtgcgcgacggaggccggcatgtgggtgagccccgtgcgggcgtcgcggcccagcgggagcgcgtgcggggagaggaagaggaggagctccggtggcaggccgtccgcgcggtacggcaggtgggaggaggaggaggtgtcgatctcgcgggcgatggccgcgacgtggtcggagatcgtcgaggccgccgcggtggcggcggaggcggcgggggaggaggaggaggaggaggaggaggagaagaaggcgaggagggcgagggcgttggtggagaggagggcgaggaacatgagcaggttgagcagcgacggtgtgcagtggcaggagatgcgccggccgccgccgcggcggggtgccggcacgttgagggacaccgaccccatcgccgccgccgacgacgacgaggcccggggattccgccggcgcggcggggagggatctcggggggttgggcttttgccgcgttggcttcggcccgcggctttggctttccccagtggggtggagtgagagtgaggctgtgagagagcgatggaggcggatggctgtcggtttttggaattgtgaggctgtctgttgccttgtttttggttagcactttcaaaattctacctgaattaaaaattgaatctcaaatggagtagtagataaatggtacttgtaggagtaggagtagtgtagattagttgagttgtacattaattgattaatacacgtacaccagtaaataataaattctaccactatacggagtagtattttattagcctatactagttaatgtcagaaatattaaacatataattttaaccaacaaatatatgaccataaccattgaatgaacttgttcagaagagttgtctgctacagcgctgtggctgcaacaactgctacaacgtctaacgtactccctccgtcccataatataaaggattttcagttttttcttgcaacgtttgaccactcgtcttattcattttttttttgcaaatataaaaaacgaaaagttgtgcttaaagtactgtagataataaagtaagttacaaataaaataattaataatttcaaaaaaaattaaataagacgagtggtcaaacgttgcaagcaaaaactcaaaatcccttatattataggacggagagagtagataactagcagtggctacagccaccaaacggctaagatgcattcttgactgatgaccgaacaactgtgatgttcaatgcagctttaacaactgtaaaaatcaaactataaaatatgcttgatatcttatactttgtttaaattagttgaaataaaatttagacacttgtagtaatataaacttgtaaataaactcttgatacatggccacttaattttcactg

SEQ ID NO: 3026 - DNA, 1501 bp, Oryza sativa
gatactcttttctttcaatactcaatagtcttaatttttttatcaccaatcttagttatttataaattgtattcctagttaaaatcttatttttcttttttctaatttcagaatttattttattttttgtattgtgttcttttcatatttttatttttttattttcaattttagctgtttcaaaattgtatgcctactttaactctctttttaatttgcctaatttcggatttttattttatttttttattctgaattttaattaatctactattcggttcttatatgtactcttatttctatattacttatatttaattcgaaattttagttaattttaaattgtattcctccttgaactcttattttattttcttttttctatttcctatgttttttatttttattctgaattttaattaatctcgtaatggattcttgtatggactcttctttcaatattccttgtttttaattctgaattttagttatttttaaattttattcctacttggactctcttttttttgctaattttggattttattttatttttattccgatttttgattaatttcgtattgggtttctatatgtactcttcaatattgcttactccgtttgaatcttcagaacatgtcaatatattttgccaatcactttgcattgcttaatatatttatcatattttattcagtcatagatggacggggaattctgtaattagttttgtattctaattacctattcagctccaacacatactatatgcaggcaacgtgcatgtccgattcctcgtcaattaaaatattgtaattacttctcagtttcctattatgatagaataggcttagcttagagcagtagtttctattcatattcatattcttcaaattaatctacaccgttaaaatctagtcagtttgtgatctaaaggtttaatattttttgttttttctccgattaatgtgggaatttttagccccaacaacgaacgtggtaccttcttttaagactgttttaataatataacttgttgggtggcccacgcaattgcgcggctagcacctaaacaaaatcatatatttttcatatatttttcagtatgattttacttaaaatttattaaataactatttcgttgtcttaatactttgaaatatcaaaccttagcatccccatatttctaattatgtagtttttaaaagtcacaccagctgctacctttgtcatatcgttctttatttgcttgctcgatctactactatttatattcattttctttgaaaccttaaaaaattgtatcttatagtttttagagtttattatttcgttgggtttcgtttttataatttatagaagtcccgtcaaacgctgccattatactcctctacagcctgttcactgtcttttctctttattgtcattgggattttcaaaatcgaacataagtatcattcggggttcattttttactttctataagtcccatcaaaccgtc

SEQ ID NO: 3027 - DNA, 536 bp, Oryza sativa
gggggccgcctgcaaatgggcggcgagggggcatggaattttgcaggcggcccccttgccgccctgggggagggcgatttttgcctcccccctataaagcccagcccctcccctatgaaatttcattatattcactaaaaatccaaaaaaaacgaaagagagagagaggggagggcagcagaaggggagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaa

SEQ ID NO: 3028 - DNA, 1501 bp, Oryza sativa
aggggtaagaggcctcgtcagtagtgttctacctcttcagtccttatgtgaccgtttcttttggcttacaaacttgtaaagcagtactacttttgctattactactgcagtactacttgtgtttgtctcgtctacgtagttcttttcattcgtatggtgcttgaacaacttatgctcacaacaacacactttcggcgcttcacggtagtgccatatccagtagcgcgcacagtccacaacagcacacatgaaaagcggcagctcgagttatcactatcaactttcggcgctgcctgttgacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatatgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttgtatagttttcaatataaaaagatttgataactattgatatttatataaaaaaaatatagagcacagtacaaaatcgccctcccccagggcggcaagggggccgcctgcaaaattccatgccccctcgccgcccatttgcaggcgggcccccgcacagtgcaaaatcgccctcgcggagggcggcaagggggccgcctgcaaatttccatgccccccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgggagggcgatttttaaaaatcgccctcccagagggcggtaggcgactatttccgtcaattttcaaaatggaaaattatttttgtaaaacttttaataaaaaaaattataaataaaaaaaattctggggatatgtacggggaattggatagggtggtgaggccgggcgtggtgtcacgtgacggtggtcaggtacagtagctgtttccgtgccggtccggtcggtccaccggttgatccggctcggtgaccgtgacaaatgatatggtgttttcatctaggaataagttcacttggtcactctcaaagttgattgaaatttagtccataagcctaaaccacaaaatcggatacctcgactctaaactcttaaaaccggaacaatttgactccctcggtgatttggagagcggtttcgcttacgtggcgcctacata

SEQ ID NO: 3029 - DNA, 1501 bp, Oryza sativa
ctgggctggatcgaagagagacagtttgaacagagggaggcaacagactgggttgagactaaaaagaaggaaagaataggcggcccaaaaccaaggaccaattttcattaaccttttcaaactatctattaacttattaaaagaatagaaaaaggagcctctgtgttcgctctcacgacctagaaattctcatattaatcggagaaaaaaacagaatccatattgaaatacaatttagaaatagttgaaattcagaattaaaaatataaagaatattggaagaggagactagagtccatatagaaatacaatttataaataacttaaattcgaaattcaaaataaaaaaatattagaagaagagtatagagtccatatagaaatacaattaagaaataatagaaatttggaattaaaaataaggaatattagaagtagagtatagagtccatataggaatttaaaactaactaaaattcagaataaacataataaaattaaaagtagagtttagagtttgtataaatatacaatttacaaataactaaaattctaaattaaaaaatatgggaaaaagagtctaaagtcaatattggaatataatttagaagtaactgaaattcgaaattaaaaattaaagaatattgaaagatgtgtttagagtccacatagaaatacaattaaaaataataaaaatttagaattaaaaataaataatattggaagaagagcctagagtctatataaaaatacagtttacagataacgaaaattaggaattaaaaaaataaatatggaaagacgagtctagattccatatataggaatataatttacaaataactaaaatttgatattaaaaataattaataactaacatgtatataaaatacaatatgaatattacacattagtagtttcgtaaagttagtacaaaattgaaaattatgttgtcattttaatatatttgaaaaatacattgagaaaacatatatgctattatatgagaaaaaaatataatgatgctagcgcgcaatctgcacgggacaccatactagtataatgcatagtgaattcgctgctcagttcctattagcggttatattataaaaaaaaacgtttttatccgttacaactgcacatgcatattttcggtgcaataactaaaacgcccacaacgtacggttcgcctcccttgtcgctgtgagagtccattctgagcacagcgcccagcaggcagcaacagcatgcatgcataccccaagccgtgatatatatagcgctgcaccgctcctcgcctcgccgccggccggtggtgccatcgtccgcacgtacggcgtccgtcacccggctgggaggtctcacgaaattacgcacttccctgagaccttccccgcggtgacgcgtgcgtcgtcagccggcgagccggaccaccacaaataaaggcatacattgatacatatggatatatatacgacatcacatcacagcacaataatgg

SEQ ID NO: 3030 - DNA, 1501 bp, Oryza sativa
ttgtgcgccgtgtgcgccgacgccgcggtgaccacggtggcgacgacagtgaggaggtagaagagaatgcagaggcggcggctccccgtgacggaggaggctgccattattgtgctgtgatgtgatgtcgtatatatatccatatgtatcaatgtatgcctttatttgtggtggtccggctcgccggctgacgacgcacgcgtcaccgcggggaaggtctcagggaagtgcgtaatttcgtgagacctcccagccgggtgacggacgccgtacgtgcggacgatggcaccaccggccggcggcgaggcgaggagcggtgcagcgctatatatatcacggcttggggtatgcatgcatgctgttgctgcctgctgggcgctgtgctcagaatggactctcacagcgacaagggaggcgaaccgtacgttgtgggcgttttagttattgcaccgaaaatatgcatgtgcagttgtaacggataaaaacgtttttttttataatataaccgctaataggaactgagcagcgaattcactatgcattatactagtatggtgtcccgtgcagattgcgcgctagcatcattatatttttttctcatataatagcatatatgttttctcaatgtatttttcaaatatattaaaatgacaacataattttcaattttgtactaactttacgaaactactaatgtgtaatattcatattgtattttatatacatgttagttattaattatttttaatatcaaattttagttatttgtaaattatattcctatatatggaatctagactcgtctttccatatttatttttttaattcctaattttcgttatctgtaaactgtatttttatatagactctaggctcttcttccaatattatttatttttaattctaaatttttattatttttaattgtatttctatgtggactctaaacacatctttcaatattctttaatttttaatttcgaatttcagttacttctaaattatattccaatattgactttagactctttttcccatattttttaatttagaattttagttatttgtaaattgtatatttatacaaactctaaactctacttttaattttattatgtttattctgaattttagttagttttaaattcctatatggactctatactctacttctaatattccttatttttaattccaaatttctattatttcttaattgtatttctatatggactctatactcttcttctaatatttttttattttgaatttcgaatttaagttatttataaattgtatttctatatggactctagtctcctcttccaatattctttatatttttaattctgaatttcaactatttctaaattgtatttcaatatggattctgtttttttctccgattaatatgagaatttctaggtcgtgagagcgaacacagaggctcctttttctattcttttaataagttaatagatagtttgaaaaggttaatgaa

SEQ ID NO: 3031 - DNA, 1501 bp, Oryza sativa
ctctgaacctttgccaaacataaatgacgaccgtgtagaaccaaaatccaaattaatggagtataataagtacataaatgaccatatacaaatcttaggctcgaaggaaactaaggtcatacttatatggttgcaaaaatattaatgtatggaaacaaaaccgccatatgatgatgcaagggtgttttaccaggcaacaacttggaatcagaaaaccttggaaatctgctctataaatacttccatttcacatcaaactctgtgtgcaaggttgaagagaaaagtgagcttagatttgtatcaaaagagagatcattcttggttggcctgatcgatcgaagaggagaagctagccaagatgtacaaccctccggcgcagcaggacatgtcctactacgatcactgcaccaagcggcatgaggagaagggctgcctctacgcatggtcagttcatctcttcttcctcccctgatcagttgcagtaattaacctgctaaattaatatcaacattaatttttactacttactagttgtttgaatttcactatgagatgaactttatcgtgccacttcaaggcgtttgttcttgagacctggttgaaagggaattcagattctaggttctcagttctcacgtgttcttgcaagttgcatttttttgttttggaataaattcggaactgttggctaatctctgtcgaatctcctcttcctcccttgcacaatctgatattatttatttttaactcatttctacttcaactgcaaacaactcatcgatttgattagcaataaaggatcaccatatcatgagttaattagttaagcaaagcacctgcatatatcacttttggtgttaatagatacagtacctgccttgcgttcagattaatttggacaagacaagaaaatctggggccatcaaacagaaccttttgttcatgttaataatactacttaaccatgatgtgatactagcaatgatggcaagcagatggtgagtttggtgaccttgcatgaacaattaatcagtggacaggccacttaattggaagagaggatcttgttcctcaagcacaaaccatggaccactccttaatagaactcagagatgattaatactaattatttgtttgcttttatagttggttggtagtttgtgcagttgggcagaactctgcttattccagcctatcagaactgaccactcaaacatgagcctcttgttccaaagaaaaagccaagtagattatccagtcagatactaggaccaatgagcagaaaaaacagagaatttttctgaagagcatagaaacaaagcactaatttttcataatttgacaaaaaaaaattacatcacttgctgacatctgggtccctccagttcagatgatagtacatcacctgtatggagtatggaaaaatgtggcctttcttttcctggcctataaatggtatccactacttccaatcctgcaagcaacaagagaggacaggaga

SEQ ID NO: 3032 - DNA, 1501 bp, Oryza sativa
ttttttccatagaactacaattatctaaatttcatataccttttcctacaaattaaaataacccttcgatgaaacttctatggagtaggagtactgtactctctcaaagaaaattcagagaatagccagctagctgttgtctgttgccctcagattgagctatgcaaatcaggtttgctgttccgaggcaggcagctggacgtgatggaggaagaactgacgccattttgccacacaacagtattatctttaggctagctgctgctgatgacactgacggtttcagattcgtgggtgaggaggcagaggggtagtttgggaaacggtggtagcttcgagaaacccagccattctgccagggtgttctcttcaccggccgtggccacgtgcatgcctctgtgccggtggccccaccgcacagttgctcaccaaacaactttgaaagtttttaaaattataaataaatagtatcatttttttaagaaactttgttaaatttgattttatttttatttttttgctaagttcaaaaattttacaaattcggtcggaagaacctcctacttggagccaccggtaaacacgaaattttggagatccagaaccgaaattgtaagcctggagacagacaccatatggtcttgacggtcatgctcggcgcaagatgaaaattttcagagctttttctgtcatttttggggtcagaaatggaggtccacaagccttggcctaacagaagactttcttctcattgtagttgttgctacacaagtcaattcatttcggccacgtactaacattgacagttgaaatgaattcttacaattaaaattcctacgaatctctttatctctttttttttttgaaaaagtcctatgaatctcctccaattcaaaagagccctaaacgcctaaacccggagagagacggatccactagctccaaggtcttgacagtcaatctcgctgcaagataaaattttgcagagctttaatttttctgccattttagggtcagaaacggaggtcaaaaaataaataaatatttttgctttggcctaacacaagactttcttctcattttctttgttgctacggaagtcaattcatttcggctacgtaccaacattgacaattcgaaatgaattccggtcaggccagtttgaattgttcgtgttcgcatcaattcctgctatgaattgatcaaaaacgttgaaaggtacatatatatgcaggcgtgacttcctggacaataaagctagctattctttaattaggtccttgcagtgaggctaagaacaagctaagctattagctaattaatttaagactagtagatgatttggtgtacagaatggacagtttgcattagatcaagtccaactaggaaggccatcatctctgaaagaatttaaaaagttaaaataattaatccaaattggcgtaagcagtataagcagctctggtcaaactaggtgatcgatggatggatcaaaattgaa

SEQ ID NO: 3033 - DNA, 1501 bp, Oryza sativa
attccttatttattaattccgaatttctattatttcttaattgtatatctatatgaactctatactcttcttctaatattctttattttttatttccgattttcagttttttataaattgtatttctatatggactctagtcttctcttccaatattctttattttttaattccgaatttcagttatttataaattgtatttctatatggacttgtctcctcttccaatattccttattttttaattccgaatttcaactatttctaaattgtatttctatatggactctgtttttctttttctccgattaatctgagaatttatagaccgtgagagcgaacgtacatgctcctttttatattcctttaataagttaatagatagtatgagtcaatagattgaaaaatatgaatggcctatattgattctattaccaatagagaccattataaaatacctcatggaccatttaatatgtgcaatatatagatggcaaatgtagcttaaatttttgaatctcgtaactcccgtctacttgaaacttgcttgcaagatactccctctgctttcaaatatacaaaacttgttttacttgtgatcactaattactcttaaataattagactataaataacgaaagtctcatacgtacgtctacaacgttatacacttaaacaatatggtattttttaagtatttataaataatcttttagaagtatgaaaataaatattttttttatgtgtgtattttaaaacaaagcgagtgtaccttttgaatttaagttttgatggtacacaagacgtcgatcttaagatatatcaacccggtcttatagagagagactcacagaaataagatgtgtgtttataaggataagtgtgtgcgtgttgcgaatgtctgtgtttgtactgtgtttcttttaaaaaatacgtgcttgtgcatgaactatttcattttgcattcctgcataccatccatccatccgtagatcaagggacggacggctgcgatacggctgttcagacggtagagtgtacatgtaagatgtaacctcgcccgttgccacggtcgcacggccacgactccatctctcctccatcggttacctctctctctctctctctctctcctcttctcgtcgccctaatccccaatccaaaacgaatccccaatctcgtccgcgccgccgctcgccgtggcctcccccgtgcgccgcccgccgcttcgcatcccggtgagaagaaaagaggtaaagctttcggttccacggcgaaagtttggatctttgatgcacaaaaagaagcatcttttcctgctttaatctcccttgttcttgagctacaagagatcctctccccgttagaaaatcttgatcttttctaagaaccgtgaaatactgattcttggagatgatcaatggtaaattagtgcagagattaaaactaggtttaggagaccccctccccggattgattgattgattgattgatggaatga

SEQ ID NO: 3034 - DNA, 1501 bp, Oryza sativa
tacaaaaatcaaagtaggtctcataatcatccatagccgctggatatacacaacggttaaaattggccaccccactaactacaactacaagtgattcagagaatttatcccaccaattgcgtaaaactatttggaatcaatcgtccaagtgaaaaaaaaaatgcatattcaccttccaccgagcaaaatttttttctcagaatttacatggatcattcaactgattcctcttgaagaagccagtggtcgtggcattttttggggattttggagtgtagatatttatatttaagaatatatagattcgggtttgagatagagagcaaccatcgaccataattctcgcatgggagacattacgaatctcgttgtagttttacttgtcttatcaattttgcatgaattactatatgttgaactcatactaacacgtactcggctttatctggaatctcattaaatcgaccttttcctggtggaattttcttctcatactattttcttgtttaacatgcggaaaccaactaatactttggtaaaagaaatacattaaaaaccagcttataattagtattcactccaataaaaaagagttttctaaaatatttaaatggacacatacatagccctattcggaaagaaaaaaaacaagtgcagatatacaattcttaactttcataaatgtaattctaatttatatggtagattttaaaagttaaattggatctgatatacaactcttagcatatgttagatagatatatagatagatagatacactatctttattaaaaaagaatgcaattttagcaatgcacgtggacaaagatatgtccaagttcatagctagaattatattctttttcgcatggcagtaatatataaacatataaatagatggatagagagatagatagttgaaattgttttttttctagggaggggggatggaggcactagtagatagatagatacattaattccaagatactattgaattttaattcctaatatacattttttgaagggaaaaaaagaagtttgaaaatgtgacacgcccaaatgtttgtttgggtagttctttatttaggtagtagcacagcttaagaggcacatgtgtcccaaattgcgaatctttgcagcccagtaataggggggctcacctaaattaaccccccaactcgcctcttaatcctgcacgcgccgcgcccgcgccttcttcttcctctcccgcgctttctcttcccgccatctccctataaatggcgcccttcctcttcctccgcccaacccctcaagcagccaaggcgcctcccttcctaatcctacctcgatcgcctcctccctctcgactcgatcgccatggttgtcaacaacaaggtggacagcctctcctacgacgtcgaggcgccaccggcgcaggcgccgacgaccccggcggtggtctccgcgccgccgacgccgcggggcgaggcgccggcgatgacgacgacggcggcgg

SEQ ID NO: 3035 - DNA, 1501 bp, Oryza sativa
ctaaaacaacgtatatagatttgtcttttaaagcattataataaaagtaagcatgcatttatttattatatattataatagaaaaataagttcaaaaatatatctcgtagaccgtatcattatttaaaatgtcaattaaaataaaaccagagggactatagcagatgcttccagcagctagccagccttcctgatcgacttcttttcacagcagcaaaactgacctgatattcaatcaattttgagtagacgacgatagatatatatattatatataccgtatgatgcatagttaggttttgattcgacctccatagccgtaaaaaactatgcgatcgatcgatcaattacgtgcttaagtacaaaatacagtactatactgactcatcagtatcattcgcactatatatgttaaattttcctgctaaagtacgaattgatcctcttcatttacatcgatcgatgcagagttctaagttctaactagaaaaaccgtgtggctttgccgcgcatggtaaagtgaacccagctcattcgactttagtgaagtaactaattagggcccctttacttgaaagaaaaatatagaaaaatataagaacttttattctatatagaaacaataaattttgctatagaaatttttttatatgattctttgaaccaaaggattattaaaaactattgagtcttatcaaatttctaaggaatgcccaaattcatacaagttttggagtatttttaatataaggtccaatatcacgcgaagtctcttatgagtttatctctctcatctaattcttgcatttttcgtacggtccaatcaaatgattattttatatattattttatgtgttttataattctttgttttgcgcttgattttttgtcagaattctatgtttttcctattcatccctcaatctttgtttcaaagtagcccttacaagacatatataggttgcatttgaccgagggagaaaagagaaggggacaattttgctagtacaattgtacccctactttgatgtcaaataccgattttatcctacattttagggttgttattttttgccctatttttttcaaacgaatgaggcgtttacccctgtttttgatggaagtgagtgggattggacttaatgcggtaaagaattagagaaagaaagagataacgattttttaaattatcgattgacccttttacccctagaaaatatccaagtaccgcttggtgtccctccaggcttgagcacttggcatcgactcttcccttcatgaacccaaatccccgttgtgaagcagtggcggcagtgtccctgggccggccggctaggcaatgggcacgacccgagcaagtgcaggccacccaacccagttgcagcgtgcatgaggaggctaggcattgcgcaaagaggccatggtagagaggaggacaatggtggctgctgtagctcagcgtagggaggaggtgcggctgctcgacgtgtcgaggaggcga

SEQ ID NO: 3036 - DNA, 1501 bp, Oryza sativa
tagtaattgatgcagtgagctgcctaactctattaaaaaacactcgctttctgaaccttacagaaatttcgctggccatgcacataatcttctctttgtcaaagagctggaatccaaaatgattgctcgaagatttcgtgaagatagatagaaccatcggctagcaaaggagaggaaataaaaaaacaaaaaaaaagtttttttgtgggctccaccttgcgctgcactgagctgaccaaattgaccataccgcacagagactgagggaggggcacttccgtcatttcgtataagcgtatacgaatacgtatctcatacgcgctctgtatatatagacggtaacggctccgcgtcgtgtgagttggcgagcccgaggagcggaggcggccacaagtctaatccgcgtcgtctgcgcgttcgtgggcgaggaggagaaagaagaggaggaagagagggaagggggcttgatttgatttgggcgcgtctcgtggagtatccggtgagttcttggcgatctggcgaggcgagtgatgagtgattcctgctgctgctgggggattttggcgtgattttcgttggttgcattttgtttctttttttttgtatcgatttgttggagctttattcggtagatctggtcgattccatggtgagttgtatcggcgccggagtgatagctgattctgtttttttgtgtgattttttttttgttttggaaatagggtttgtgtcgaattgagggcattttttttccttaggcaatgcaggatttcgttttgtatgtttttgcgtggaatggatatgaacagacctcgaacaaatggaagaatttgtattttgtatgatggattgcaatgcgatacttgttttggggcgtgattcgattgaaataaatgaaatattagagttattttgggattcctgtttgctgcgcctttttttttagcatttcttgatatgaacaagagaagaagggctgaatttttttcttagctttggaggcatttactgtcccagtattttctcctaccggaagcagaatattttgtttgattggagggttgcctccctttgccaaattgaatcaaatgttctcggatgttttaaaatttccgtggactctttttgccccaggggagaccgcttttagcagctggatcccgtgttttcatttcaagttcttgttttcctagtctccatatatttctgattgttaactcgtattctctacctcacatatgcaaaatcacacttgcgtcgttctgtaattagttagattctgcaagaaaaatccggaattttcaagcatgctagtagttttaaattgatgccatgttttttagacaatgttaattgatgccatatgactataggacacattatattgcgtttctgaatataccacctcatgaaactcataattttgttgattaattgttcaggttgccccttctagtgtgtaacttggagcaaatttggaccctgagacgcaaatcagtca

SEQ ID NO: 3037 - DNA, 577 bp, Oryza sativa
aaaaacttttcaactaaaatgttataggtcgcgttgagggctacaattttgatataaagcttgtcttcattagagttcacatgaaaaagttataagttattttttaatataaagtttttagaccgtcctgtttaggtaccggggtgacacaactgaacaagttggaggaactaaactagtaatctacaagtttagggaccgggatgatacagtcgaacaagcttgaggacctgaacggtcgatttgcgagtttagggaccgtgatgacacaacggtacaagtttagggaccgatgatggactttactctatagtttaaacaattaaatgtgacgatttattaagcatataatactatgtttagaaaaaagtcaacatcgtcgaactagaaaaactgagtttgcaccctaaaaggaaaaaaaaaactgagttcggttccgtgtcgaactcggtctcttcccgcaatagcgccgacccacctgatcggactccgatcgcccccgcccacccataaccctaaacccgccgccgccgccaccgccaccgccactgccgtcgaaacctacgcttcgaaacca

SEQ ID NO: 3038 - DNA, 1501 bp, Oryza sativa
aagtttttgtttgtacatgttacacgacaaaaataacacactactaaaaaatcttaacaggtgatagctcatgggtgccggttcatttaaaattgacacatattgaccgtttcccaccattatggggtatttttttaaaaaaaccggcacctttaagaacttatgggtgccggttttagataaaaaaaaatcagtgcctataatattattatgattttttaaaaaaccaacgcttatgctaacattgaataaattttaaaaatatacctattttttcataatttgtatttatatacatgtgtggggaaatttggcgaaaatataccgcctccgcgcgttgggaacgcgggaacaggatgaaagcgcggcgtggcagcgtgggaacgcgatgccgcatactggatgtgcgggatcggctcgatcgcgcaggccgaaggtgcggaaccgagtcggtcccgcgcgatggctgtgcgcgtgcgctatgtaccgcaggaccgggccggcgcaccctcgatcgcgcagaatggaagtgcgggaccgcttcggtaccgccacggtaccgtatttccaggatgcgggaccgatgtcgtcctgcacccccgccctgcgtgatcgttccaaccctcggtcccgcgcatccggcatgtgcttaatcctcgttcccgcattactagcaagctggttaggtatatttttgcaaattaattccacacgggtatataaacagaaattatggaaaaaaatggttttttttaattttttctactaacattatagcctgtaggtgctagttcttaaaaaaaaccaacacctataattaaaaaaaataaaaaaagtcggcacacccagcctgaccggcgttatctactcgtggagccccatgtgagccacatctgccccttccttttcttcctcttcttcctcctcctccttagcccgtgccaccacccctctttttttttcctccctccacctatttttggatccgcagcccctcctcctccttatgtgtcgccgccacccctctttcctactcctcctttccatctgattgacaccaccatgacgatggagaagtccggattgatgacggcgacggtggcgttctctgtgtgtttgcgtttgcgattttgttaattttgtgattgagcttggttgatgggatgatggtatgtcagtgatgattttgattgcatttggttaatggggatgatgttgatcttagtgatgatggacaactgctcgatgcttcggctcgaatgccgactttttgttttttttttcattcctagaatctcaaatgtattgtctgttgggtgtcaattgggaaatctagcacctatggccagttctgaattggcaccaatccccttttctatagtagtgacaagcacgagtactccatggaatatttatttgttcagtttgttgtgccaacaaatttttcgtttagaagcgtagtacaaatgcaatgctcacattttcatgtgtgtagactcac

SEQ ID NO: 3039 - DNA, 1501 bp, Oryza sativa
ccaaaaaccacgtcccgccgcttctccggtgctatctacctagttcgatcgtccaccgatttcattccgcttcgtctcgcctataaattcgcaggcctagctacctccaaaacccatccatcactccatcatctatctgctcacacattcactgctgctcatcgcgtgcagagcggttaactgaaatttgatttggatcatagttagggattgaattaggatggcaacgacggtgactcgtgcacacctggaccagaggcttgccctcgccaagcgctgctccaggggtacgtacgttaattacgtgtgttttacaaaagaaaactagctagtactactgtaataacattcatgttctttttgcgtcaaatcttcttgcattccatggcgctaataactgaatatatacaaactgatgtatgcttcgtcgatctgcagaggcgaaccttgcaggggttaaggcggctgctgtcgcgaccatcgcctctgccgttccaaccgtcagtagtctctcttctttctcaaatgcttcttctttcttgtgtcaattaattctttatcagaagagtaggttttctaacttagctgcatatgcttgtgtgtgctgtttatttcagctggcgagcgtgaggatggtgccatgggcgaaggccaacatcaacccgacgggacaggcgctgatcatctgcacggcggccgggatggcatacttcgtcgccgccgacaagaagatcctctcgctggccaggaggcactccttcgagaacgcacctgaacacctcaagaacacctccttccagggcaccggccgcccccaccctgccttcttcaggccctgatcaataattacaagaacacaacatatgctatattatatatacttctagctacctggctagctagctgcatatgatcagagtagtatctgtatcatgtagtagtagtagtagtagtaatacaatacaagtactacgcccctgcagagatcgaaccgtttacaacagctagctgctcatcctggcctcttgccattaggcattatctagccacacctgaatatgaatacatgcatgtactcctatcttgtactaataacttcatgtaacactgctgcagtaataatgttcagaaatcacaacacaactagtattgttattgtactcttcctgttcagtgtattgtttgctcgtataaacagaaaattcgtgcgaaataatcaaattactgcaatggacaaatggtaagagataaaatgggtcatgtataattaaggattataagattagcattaagagcactgtgtgccatttttatttaagtactcttcctcctaaaatatagcaaactaagtattggattggacactttaaatttgatagaaattcttcagatttgtaaaattcgattctaagttgctgctatattttaggatagggaagtaggatataaacagtatatatagagtatatatatatatatatatatatatatatatatatat

SEQ ID NO: 3040 - DNA, 1501 bp, Oryza sativa
tcctgtgtgtgggtttatgtttaggttgttacaagggatcttgaatccgggagtgcaatctgcaagcgttcccccagagttcaagatcttccgaatcccccttactcggtaggcaaggtcctccttttatagtttaaggggttaccacatgcaccgcctctacacatcttgtcattggaggggggcccacatcaactctggtcgagccgccacccatgccttagatcggaagtaaggtggccacccgtcctcaggtgatccccagcgcagtcttttgtctgacacggggggacatcccctgtcattccctcataaattcttagagactttgtgggttcatgcataggggatgcaccggtcggacatcggtctccgggcgtcgatgagacggggcatacctgcccccacgccacctgacacagggtggggcatgggttagggttgtcaaaaaagcttgaggctcgcgaactactcgagctcggctcgtcctaggctcgattcgagttcggctcgagctccagacgagccgagcccgagcctatccctaagctcgcgagctttgtcgagccgagctcgagcttctaacgagtctagtaatatatgatttttgttgttatttaataaattaggagatcaaatatgttatttgtatgtcttatattgacatcatatatttattttgttcttttttcctcttctattaatacgatgaactagaaattaattataagattatctttgaaatatatattgtgttacttaaaaatcaagctcgagctggatcgagcttgagccgagcctgtcaaaaagctcgaacattttataggctcggctcgagcttatatcgagctcgagcctaggcagacgagctcgctcgagctcggctcgttgatagccctagcatgggtgcgctgccacccgtctcatccgcctgcgactagtctcagcctggtcaagggcgattgacgcacatcaatcaatcgaacgtcgcacgactagccatgccacattaaatgcggcggtggtggttggggcgtcgcccatcaatgcgcctggcagcgcctctttctctgcccactcagcagcaacgtggcagccgagtgagggcctcggggcgacgcagcccctcaggcccgaggggcgcgacaggataccccgaggcccctatgcagctatgggcgcctcttggctgctcattacccgtgcgcccgacccccccccccccccccccgatgggggggacaagctacgcggccacgtggctagaggaaaggacccttctctcttagtgtgggtacccccgggcccatattaccgacaagggtatatgcaagattgaggtaaaagatatgaagacaaggacttttatataggttcaggccccttatctgacaggcaataaccctacatcctgtttatatggaattgatatagaaaatcacagaatacaacaattgagacgattgggataacctatctagccatcgtcgacttggcggca

SEQ ID NO: 3041 - DNA, 1501 bp, Oryza sativa
gtgtgatatatatatatatatcacaaactttactaactagtttaaagcaagtttgaactgaatttgaacttatttttgttagattttgattctaggtatatagcatccatacatataattagttaggtatgtaatcatggattgtgaaataaagttaaatttgagttgttttgttgataagtataggtatgaatcaaattattataactaggtatatactcacaatttgaaaattttgaaaaatttgagtaattttgtgcattagataccatggtgcccgggcaccatggtgccccatatgagtgtcatatatatatatatatatatatatatatatatatatatatatatatatttacatgtaactattttatgaatataatgttagattagctttataaattggctatactattaacttaagaaccctttgaatcaaatgattcatttatgaattttaggaccgctttgaatagcatgaatggaaaaacggagaaaaatgaaaaaaaaaacatgtagaattttgataagaatataagtgcaaaacagagaactataaaacgtaaaaaaaacacaggaatgatcgtttgattggatcgtaggaaaaacgtaggaattaaataagaaagataaactcaaaggaaaattttccaagaggcggttagagctcttgctaaattatcttcaaaatctctactggatttatcattccataggaattttaaaagataggatattattcaatattttattttaaaaatctttagaaaatattttctcatagaactgaaatccttcaaaatttaattattttcctacaagtcgaaggagctcgtataggattcaaatcctataggaattttttctatgatcatttgattcaaagggatgaagtttccgaatcctatgaaatttctatataatgactcattgcatgtagattttggaatgaacttagtaagagctccaacctatcgaaaaattttctttaaagcctatctctaatttctgcttttttcatgcagtataatcaatcagccattcatgtgttttgcaatcattattttacgctcgtattcatgtcagaaacatgtttttctcgtatttatcttctttttttttttgcaaacctacaattcagagggtccatactcttaagtaatccagctttgggggcttcaaaaaagaaaaagaaaaaactaatccagctttggcagagccccaggcaccgacctgtagttgcatcagcaaaccatggctggacgcgtggacggataggaacagatcgagcgaggcgaggcgaggtagtgtacgtgcgtggcggaatatatggtatcatcgtgaagcagatcgaggccggaggcggttgccggcaacggccacacgcgcacacatggtttcgccccaaaaccacgtcccccgcccgccgctatctgcctccatcgtccactgattccttcttcattccgctacatcgatctcttgggtcttggcttgcctg

SEQ ID NO: 3042 - DNA, 1501 bp, Oryza sativa
cttatattttcgagtggattaaaaaatgatgaaggtaacagtagcagccctagattcacttactcaacccatcgcagtcgctgacggtggggcttagactccgtgtaacaaaggaggaaacaaaccccttcggcttaccgatgacgacgacagctccccccttgactgatttgaagcctggtcacatttcagccatgtcgaccaccaccacagttcctttaccgctctaggctggcgtccacggcaatgagtgcgtggaacaggttttcatggtgttcgatttggcacgggcaacaacgttgggctctttctacaatgaagatgatggccttctctttgacctcatctacgcccgtccaaccgtcgtcatgagcacctcccatcccaggggacaatagtgtcgctggaagcgatttggtaggatcaggatctgagcgagacctctctctcatcatgttgttggcatcttgggcatcgcctatctctcccatcaaccggatgcatgagtagaaggagaccaataccttctcttcctgccgccaggagcagttccatcaccgtcgcactctgtctccttgatccggtaaaataggggttgggtgtcgatagcgggaacagttgattatggtgcggtacaaatttccatataatatatattttaaaaaaagataccattcaacaattcaaaatagtatgctcatggagagcgataaaagaagtagctaatccaaaagagacaaatctaatgaagcctaagagcaagtttaatagcatagctaactactagctccaaatcatttatatccaatctaataatttattcatacaatagttatctataaatatatattataccattaatgactgatcctaccctctcatacacagacaacatcttaaaatccatgctatagctggctagaaatctcacttttcttcactctcttctcttacctttttcacatattcttataaagttatagctggtttatagcatactattatacacaggggcggatctacagtatatgggccggtgccagacgacaccgacgacttttgacaaaagctatagcaaaactgcttatccatatattataacatcatgatctaagcataactagcatactatgacaccgatatatatgttatgacaccaatgaattgattttctagacctgccactgattatacatgctcagtcagaaaaatgtgcttcatgatcacggtttaaaccggttgtcacactactgaatcggtgatcataaagcctataaaccggctcagtgaccggttcttttttcccaatgtctcactcacggtgggcccacctttcactcctccaatgggcgtatggatgagcatggcatccagatccaagagaaaaaaaaaaaaagcaaaacaatcccgtagcttccatttccatggccacaaaaaccggcgacctcctccaccccgccatggcctgacgcccccgagaagctgctgcggcgggaggcga

SEQ ID NO: 3043 - DNA, 1501 bp, Oryza sativa
aaccgaccttgccgcggaagtggtgggcgttgcggaagacggcggagtggtaggcgtccatccggacgcggtcgcagagcatctccttctggtggtagaggtaggagtaggtgcagaagtagttggcgaagtccacctccttgtcgaccaccgccgggcctccgccggcggcggaggcggaggcggaggcggcgccgttggggagggacgccatgggaggagaggaggagaaagacgaggtttttggtggggaagaggaggacggggttgggttgctagggtttatgggggtgggatttttaaagggtggctatcgtgtgtttccgccgttggattgtgctttgaatttcgtgctccaagttgatggtggtggtgttaccatttgaacttttgaagatagatactgcagacagtaaaacctgagaaaatttgtaaattttagattgttgtcgataactttatatatattaaatttggacagagacgtattctttaaattatgtgagatagtaaaggacagtagcaatgcaagacacgcacttctcgggtctcacttgctagctaggcctaaaactctataaggacatgagttttcacatagccatgtgatttaggagcgggggcgaccacgaccgtgaaggcatgatgtgataaggatatgacctccacaatgcaccctcacaattctcttcctgcatgtcacacgccatcgtttcgccacgggagaacgagtgtcctattttggcttcgcgttcttcaccgggggacaacagaggccgatatggcgtgaaatattacgagccggatgccacgtagatatgcagtgaagatcctaggtaaaagaagtgttatttatatacataaataaccaatcatacttaaaaaaaagttaaacaaatgaacacaatttgttcaactttaagttactctacacgtaattgtcgatcctttttgtttttttcttttgcaattatcttattttattttttttcttttagaaacaagctagtatatctatatcactatatgaatataagtcacttagtcacgtgtaactggaattatttttcatatcaatagtacatgcctatcgtcgaataattaaagaaaatcttaagacccaatcattgtggtatctaaaataaataaataaaaacgagatatatgcacaatcaattttgtttggttcaccaaaccatactaataacgatctatccatcgaaaccactatcatttggtaataataactttaaaataaacaagtcaaactaaccaaaccgtggttgcatttaaacaatcatctcactgttctaacacactttgtttacgaatttcgttgcaaaatttgttaaatttttacacccaagtggattgttctgatttccgtgggccgacaaaaccaccccaaattggcccgaaagctgcctcctttttcctcctcctaaccaccgctccggcctctccatctcccgccgctcgccgtcgccgccgccgcccgcca

SEQ ID NO: 3044 - DNA, 1501 bp, Oryza sativa
tcttcccatcgccatcgttgttccagtccgtccgaggcagcggagcggctaccctccggtgcgggctccggcgagcacgctcctcctccctcggtaacaggttagctcttttctccaccgccaccgtgccggcgccgaaaggcgtcaacgtgccggcgcggccccaccccgccggcctcctccccctcccctttgcctcgctttgcccccgccaccatcaccggcccaccgcccgccctcccagcgccaccttcccccaccccacccggcaaccctaaccctaaccctagttgtcgtgacgcggtcggaaaacgcgcgtgacttcttttgctagcgcgtgcccgctaattagtattcctggttttttcttggtccgattacatgcgtcatcttattggaactttacttcagcgggtcgacttctttcaacgagatcgcttgattgggtggtacaatattgctgttatatatatatatataattcaaaagatcaatatcttcaagcatacagtgtttctttagaaacccccttaatgaatctagtaccagagtaacagcagcacatggaattctgaaaaaaaatatcaccaacttatcttacatggaatattgtgcagtttcagattagttccataatgttcctttttttaattatgaagagcttgactgcttctttggtgctttttgtatgcccggtcttcactaagtggtagaagagaacatgttacatactccctccgtttcatattataagactttctagcattgcccacattcatacagacgttaatgaatttaaacacatatatatgtctagattcattaacatatatatgaatgtggataatgctagaaagtcttataatatgaaaccgaggaagtaccttccaattggaaggtgaagctaggtttgattagtgactaccttaacctgcaccccgaaaaaaatacggaggcttaagtgagctcttttctttctgttgtgtttgtgggaacagcctttgctccaagatgataccataaatgtatgtttggggaacatacttggcactcgaaatacagttggacacaacctaaggaataggcttgtacatcaggtgtgacgttgcactgtccttgtcacgtcagcactccatgctatagctgatagttgaactaacagtggcagaacttcatgtcacgcatggtttttgcaaactccgtaagacatgtacaataacaactagctaatatttacgaacaatcaatatatctacttgttggccatgcacaatttagatgcaagctctgcgactgccaagaaattatgctttttggctaccttcttggtgtttcaggcaaccaaggaaggatcagcaaccctgacataatttacatacttcgcattcctgattagttgctcggttatagttttatattgtcgcttcactgcttatgaccccacattttgcccctttgtttttatttctaaaagaaagttctgcttcagtcttgaaaaata

SEQ ID NO: 3045 - DNA, 1501 bp, Oryza sativa
cgagataactacaaagggtaaggcgtgaaacgccccctctgacctagctcgtcgacgtcgagggcaccatttgtgcctcgaaattatcttcccagcttttagttctattcgatttgcaaggaagtttagctccattgcacagaattattgcctaccaatttaggcttctaattcgattcgatttgcaaggcgtttagctccatttgcacagaattgtcgcctactagtaccaatttagcagtcgcacacactacccccaatcgaatcgatcatacgggcaggacgtcgagtcacctggctctggctctggctctggctcgccgccgacgtcgagtgcgcggggctgcctcctactccgccgccgcctcctccgccgctgaagcgatgcgagggcacggtgaactgctcgtagagcgccatcttgttccggggcggcgcccgcgggcctccgcccttggccgcgtcgttgacgtggagccgcgggaacagcgggcccatcaccttccccttcgcctccttccctcctcctcctccgcctcctcccctcgtcgccatcgcctcccgccgcagcagcttctcgggggcgtcaggccatggcggggtggaggaggtcgccggtttttgtggccatggaaatggaagctacgggattgttttgctttttttttttttctcttggatctggatgccatgctcatccatacgcccattggaggagtgaaaggtgggcccaccgtgagtgagacattgggaaaaaagaaccggtcactgagccggtttataggctttatgatcaccgattcagtagtgtgacaaccggtttaaaccgtgatcatgaagcacatttttctgactgagcatgtataatcagtggcaggtctagaaaatcaattcattggtgtcataacatatatatcggtgtcatagtatgctagttatgcttagatcatgatgttataatatatggataagcagttttgctatagcttttgtcaaaagtcgtcggtgtcgtctggcaccggcccatatactgtagatccgcccctgtgtataatagtatgctataaaccagctataactttataagaatatgtgaaaaaggtaagagaagagagtgaagaaaagtgagatttctagccagctatagcatggattttaagatgttgtctgtgtatgagagggtaggatcagtcattaatggtataatatatatttatagataactattgtatgaataaattattagattggatataaatgatttggagctagtagttagctatgctattaaacttgctcttaggcttcattagatttgtctcttttggattagctacttcttttatcgctctccatgagcatactattttgaattgttgaatggtatctttttttaaaatatatattatatggaaatttgtaccgcaccataatcaactgttcccgctatcgacacccaacccctattttaccggatcaaggagacagagtgcgacggtga

SEQ ID NO: 3046 - DNA, 1501 bp, Oryza sativa
gcatctgcgcgggacagagacagacagacagacagaccgccccgtcaaatcgccgcctcaccacctgccgggatcgggccggagttcgggagggaatgttaccgagcgtggagaagaagagagcacggggaaggacgccgccgccgatcgccggggagcggcgggtgagggcggagcggtggtggaggaggacggaggtcgcgcgcttccacatggcgggcggcggcggcgacggcgagcggcgggagatggagaggccggagcggtggttaggaggaggaaaaaggaggcagctttcgggccaatttggggtggttttgtcggcccacggaaatcagaacaatccacttgggtgtaaaaatttaacaaattttgcaacgaaattcgtaaacaaagtgtgttagaacagtgagatgattgtttaaatgcaaccacggtttggttagtttgacttgtttattttaaagttattattaccaaatgatagtggtttcgatggatagatcgttattagtatggtttggtgaaccaaacaaaattgattgtgcatatatctcgtttttatttatttattttagataccacaatgattgggtcttaagattttctttaattattcgacgataggcatgtactattgatatgaaaaataattccagttacacgtgactaagtgacttatattcatatagtgatatagatatactagcttgtttctaaaagaaaaaaaataaaataagataattgcaaaagaaaaaaacaaaaaggatcgacaattacgtgtagagtaacttaaagttgaacaaattgtgttcatttgtttaacttttttttaagtatgattggttatttatgtatataaataacacttcttttacctaggatcttcactgcatatctacgtggcatccggctcgtaatatttcacgccatatcggcctctgttgtcccccggtgaagaacgcgaagccaaaataggacactcgttctcccgtggcgaaacgatggcgtgtgacatgcaggaagagaattgtgagggtgcattgtggaggtcatatccttatcacatcatgccttcacggtcgtggtcgcccccgctcctaaatcacatggctatgtgaaaactcatgtccttatagagttttaggcctagctagcaagtgagacccgagaagtgcgtgtcttgcattgctactgtcctttactatctcacataatttaaagaatacgtctctgtccaaatttaatatatataaagttatcgacaacaatctaaaatttacaaattttctcaggttttactgtctgcagtatctatcttcaaaagttcaaatggtaacaccaccaccatcaacttggagcacgaaattcaaagcacaatccaacggcggaaacacacgatagccaccctttaaaaatcccacccccataaaccctagcaacccaaccccgtcctcctcttccccaccaaaaacctcgtctttctcctcctctcctccca

SEQ ID NO: 3047 - DNA, 1501 bp, Oryza sativa
tcggtgttcatgaacctttcttcattctctgcaactgtccccatgcatcctgtttgtcaaattggctgaagactacaccattcagaaggtagcaagcagcagatatatttgttaatagtaccttgctagattcttgtgccagttccaaacatccaatgcagagaatacaaactctacagattggtcagcacaagcacgtccgattgagcagcatctacactgatgaccagttggagtttctccaatctgctgatcatttctagactagttttcccattaaggacaccataaattgggtaggcggtccagcttgttagcaaagtggtgatagtgattagcaattaagcatgacattgacccatcgaatatttgcatatcttggtcttccagattgcatgatttttccttcatatgtgactggaaacagtggggccatgctaggttacataaattcctgggcgtgatacactgcgaatagtagctatcatgtttactactgtcgtgttgagactactgtacagtagctcgtatgtatttctcgtatgtttgtgcataagtgaggggtcgatgagagtgacttactagacttttctcatcctaaattcctaataactagaaaagatgaccgaaattgggaaggcgacttgtgcctcttttggaatgatcgaaatatagaggaactttcatgttgacctgattcttacgaaaatcatgtaaaactcgtgttcgttgtcaaaaggcccaacttcatctcagatgagcataagtataccatattaatgcttcaaaatggttaatgctagctcgtttttactgcacaactaatgctcgatgtccaaatatacttgggttattattatttttttgaaggatttttcatgtgagtctcgccgaggtccactaaccggtacacaggcgccgacctctggcacattattttacacgagaaatttaaggtaggcatgaaatcatcagtcgcacggatgcaaacgtgacgacatcatcagaaacaatatactgctgcgccgatttaaactacacttaaattaaataattctattagtggtacgagagtagtactactcctgtatgtagaatagatgtgcacgggcgcacgtgtttcatccctctaattctgaatccccacgtgacgatcgagcttaaagccgaacgggcggggcggggggataaagcgggtcccccagccgctgtctccagttcacacccacaacccgaagtcgatcgctcgtgttcgtgtccgcctcgacggcgaactcgacgggtcccgacccgcaaacccaacacccacacctacttatacccacctccactaatccctcctctcatcgcaccaccacgccactgagctcaagctaagctaagtgctaacctaggtgttcgaccatggacaccgaggacacgtcgtcggcttcgtcctcgtcggtgtcgccgccgtcgtcgccgggcggcgggcaccaccaccggctgccgccgaagcggc

SEQ ID NO: 3048 - DNA, 1501 bp, Oryza sativa
agaaaaaaatgaatagtaaaactcatcctctggcctggtccaaagtccaaaccttcggtaggttgtgctaattaatcaagtcagtgtcattaggacatttattaattgcttttctagaatggtgttttcgttacgttgatgttattactgcttcctccgtttcacgatgtaagtcattctagcatttcccacattcatatttgatgctaatgaatctagacatattttatttatatttatatatatatatatatatatatatatatatatatatataatatatatatatatatatatatatatatatatatacattagcatcaatatgaatgtggaaaatgctagtcattatatatatatatatatatatatatatatatatatatattcattagtatcaatatgaatgtggaaaatgctagaatgacttacattgtgaaacgaagggagtactatacaccattaaaaagattctaaattgtgtttattgtaagaataattggggtataaatactgtctccagatggtatcaagcatgaaatgagtagacaacaagacccaccaagaaagctacatcagttgttgggaaccaaaagctttgaggtagaggaattgacacttagcagagacgctatatttttatttttatttttgtttactacctctgtcccaaaataagtgcagccatgagtttccgcgtccaactttaatcgttcgtcttatttaatttttttttataattagtatttttattgttataagatgataaagctttaatagtactttactcgtgacttgtgtttttaatttttttttaaaattttttaaataagacgaatggtcaaatttagacgcagaaaactatggctatacttattttgggacggagggagtagatcataaccgccctaatttactttagcatacgtggagtacaagataatagagttagtaaagatttaccatgccatatttgacattccaagccattagcttccgaaagtcatgttttactgttttcacatggaatgcattataaatagcattcacatttgataaaatttaggacacatattcttgaaagataacaattaattaaacacacaatatttttatatgtatcgcaatagcttccggtgatttcaaagtatatatagtagctatcaacaattcatatgtaagatacttttagaaaaaatgcagtaagatgcaagtcaatcgcatgacaactatattgtagacgccaatatatattgtttgaggcgtggttttaaataggtttaatggtttgcagaatttaattaaactattaatatattatgtaaattcaatatctttcaactgttagttttattgtcatcttatggcattttaagagtttttaagctcgttatattttaaaatatctgtaagggtatagcagtcaacgactgttgactaggcggcaatgacaaaagaaaaaaaagtacactagttataaaaaaagtagaaaaatatttaa

SEQ ID NO: 3049 - DNA, 1501 bp, Oryza sativa
taggttccaggtaatgttttaaagtaacttttcatgcatcaccttttcttttgtgtttgtgcgcgtggttgcaactgaagcttgagaaaatggaagttttttttttcgcattttaagcaccacgaccacacaaacctttactcatgtacagcagtgtaactctccattgctactcattttctgttttgcaccgcattagtagaatatcatgcaacctatttgattcactagctcttagaagaatcagtggtagtttgaaaatttccatttaatggatgttttatgattctaccactactagatgtttcatcagcttcaaattcatagtgatatactgatatgctttgtctcaaaaagaaaaagaaatcatagtgatacgattcaacatgaaactctatataactgctaatgtttgagtgcgaggtctaggcgactaggcatcttattttagtggttgctgttaacttaaagggtacgtttgcctctttagagtaattcaacaatatagtatcagtcacaatgcaataaaaacattgaagtgtctaggcatttagtgtttttctgatgttcagtaatgagttcacagttactgaacatgtttgatcatactgaggtagagtagataagtttgtgggcaccaaatacaagttcacagttacagaacatgtttgatcatactgaggtagagtagataagtttgtgggcaccaaatacaagttcacagttacagaacatgtttgatcatactgaggtagagtagataagtttgtgggcaccagatacaagagtgcaacagaaatttaacgtgctatggttcatcatttgaagtactttctgcagaatgaatctgcagcatctgggtactgagctctgatgtagttctccaggcacttcttgtaggagaaatcttttctggatccatctgaggacatgacatataagcacctacttccatggaatacctgatgcctatcgacctataagcagcaaatgagtcctcatggttttccattttttggttcatctgacgcagaaagattcaagaaggcaagttgcttactgttatgtagttgccgttgccagctatcttcttcttcctctctgggtggtacatgagaacatttgtgacaataaacttctcatcatctggaggaagtttaataccgtccctgcaaaagtattgagagagatggactgtaagggatacaacagaaggaaccacctgggcggtgtttgaacatacacttaacttccatcttatcatctagctatcaacgtactagtggtcgaaaaatgaagaatcctagtacttgtgccttttcaagtttattggaccagaaaaatacctcgattcacggatgatcctctttacattctttgtgattggttcgatttgttcaaatatctgctgctccactggtgtaaaagcacaactcgctacctgcctcatactgcctccacggcgtgatgcctctgatttccacactgctctaccaccacc

SEQ ID NO: 3050 - DNA, 1501 bp, Oryza sativa
tatttccttccattctagttaatttcagcattacaattttaattatttgctgtgttaggattcctactagttagctaattgccatatttgaatctctttcgaatttgtctgaaccaaaatcatttggttcctgacacatcaacggtattctatggtgcaaaaaaacaatgtgaaatatagcacatactgactcaacaatgaaattttagccctgaaattgacaagtagggtcgattctgcagactacaatctgcgccaaaaactaaaggtatacacacgaaacaaacaaatacctgcagggtacgcacggtgaacagttgagacagtcaggcagcaactggcgggcggcgggcggatggcaggctaggacttggggcggggcttggtgtccggcagatggcggggacaggcgaagctgcagcctgagcaccctgtgccctgcagcgctcgtcgccggcaacggggcgggagggcgcgagacaagaggcgatttggggaatggagctgctcggattcggaagcctgaaaccctagcgggcctgacgagtgtgggattttggactactccatttgccaattgccatcttcccaaagtcaggacttggatgatttgccattcgggttcactgatttatttttattttgccacttttcactaccagctcaaaaaatctctacgtatatggattactccttccatcccataatatcccataatataagggattttaagtttttatttgcaacgtttaaccactcgtcttattcaaatttttttaaaattagtatttattttatttgtgacttactttattatttatagtactttaagcacaacttttcgttttttatagggtgaatagctaatttagtccctcaagtttcagtgaaggctcaatttggtccttcacgtttcattttgtccacataggtccttcaaatatttgttttggcttgaaatcatccttgggtccacttaatatgtcatatggctttttctagtcaatatttctattagaaaatgtcctttttgcccttaatttgtatacatctatatactagaaaagagaaagcaaacataaataaacaacattacagatgtacttcccattatttcaacatgtgcacataaaacttaagcaattgctatcgtatatacttgttagtacataattttttttcgttttacataatatactgtgtattatctataaaaaaattaagcatgcaatttttctcttatatatgtgaatgatgaggggtataagtgtcatttataaagagagttgttggttcaaagataagtttgaattaaaatgaaaacttgaaggactaatatggatagattggaatattaaggactaaactgagcctcagataaaacttggtggaccattttagctattcacccttttttatatttgtaaaaaaaaattgaataagacgagtgatcaaacgttgcaatcaaaaactcaaaatcccttgtattgtggtacgaagg

SEQ ID NO: 3051 - DNA, 1501 bp, Oryza sativa
cacttggccatgcatcctttcttcttgcccttggtgtcggcgcacgacagctcctggtccctcttgcccaagcccgagctccccgggttgatcatgtggtagttgggcggcagcctgggatgcgacgccggcggcttcgcggcctcggagacggcggcgcacacgaccaccaagaagagggccacggcgacagccatgtatgcccgggccatcgtcgctagctaagctagctagctggtggtcaacgtacagtaaatttggttaagttggctactctggatcgatcggtggtgaggaagatggctatgagagctaggcgcgtatttatagctaggccggcatttcactggactggcaatggagatgatccatccatgaggtagcatgcaagcatggtgctcggcagggaagactgccggcgagccggcgcgcgtggtggtgaagcgagcgagagcgcctcgtggtgcagtgccatggcgaccggccaggcggcgtcgcggcgaaggcggctggccgttcgatacgtcgtcgtggcaaatcagaaagctcccagcagctgccgtatctagcttcaggtcttcaggagaacgcatgacgcattgcgtgcgtctgaatatttgctagctaacttcagcttgcatgtggagtactttgtccagcttttctagcatgccacgccaccaaatttacaatcagcaaactctgttacaaaaacttgtgtaccatccgttcttgcttggctggtttactgatgagaaatctcatcacaatttacaattagttaaccactatactgttctatatgaaacgataacaacaacgtgtgtgtgtgtgtgatcgagcatgcatgttgggtaatttggctttactgaagaacagaggtccgtgcattgagccagtaatatttaggaacataatatctgaagataagaattaagtgtagatcaaaatggagttgaccaggggcttgattaggatggaaaaaaaggtaaacagctttcaggtccataagccaagcttacttcctttattatgtttgctactagctgaatcaactaattgcagtagattttaaggaactagctagaaggaaaaaaaacggtaaaaccatgtccattgttggaagaaaggaagcaaattaagcatgaagccatacaagaaccagctagcttaatttctttatattattactgttgacctcgatcctaggacgacgttttcgattcgtacgctagcaagatcatgcatagttcagggtgaacgcaaagtgttggattctcagatgtcatgctggtggcttcaccgccacggccgcgccgccggccagccggagagagccgaagccgacgacacatcaccggcggccactcatcgatccactaccccactgcactcgcgatccctataaatgaacatcttctcttgtcctgaatcctcacaagtcacaacaacaacaacagctagcaacacagagtcacagaggttgaagcacatctccatc

SEQ ID NO: 3052 - DNA, 1501 bp, Oryza sativa
tatgtacacaaatgccggtcaacaacttctgcaccaaagccattaaaaagctaacccaagactgaatacctccattagcggtagaaaggtgtggtgcgtaatcgtcaaactcccagaaggctcaaacagatagatgaggacttgcacggccgcctcgaggttgcagctgatctgcacatgcgctctcccagattcactgcccacaggagccgcgggaaaatgtcagacaattacttaggatttgctgttgataggtttgagagattgagagctcgatcgcgtcggggcgactagattactgacctgaagctgccgccgaggagggcgcggaagtaggaggagctctcgattagcctggccagaatcacgcgacgcgggattagaatacaagcagctcattggccggtgaatccggagaagagggcgcggcgagggcttgcctggtgcggtcggcgcgaacccagatggtcgggtacggcagggggtctaggccggcgaggtcgtcgacggagacgggaggtggaggcgaggggtcagcttccccggcgatgaaggacgcgtcggtgatctccaggagaaccgcgtcgccggcgtcttcgccggcggcggcgaaggacgcgccgccgtgcatcgtgctcgcttaggtgggcttgtgttggaatgactttttttttgtcgttttcttttgtgaagaagacacgagagagataagagacgggctggaattggagacagaaacgggcccatctcaaactccatcttgggcctcattttggtaggcccatccacgagtacgaaaagtccaccccttcaaaaggaaaaagtacaccaaaggtccggggagcgctacaaatcggacgtccgatggatgatgaaacatcggacgtgttccatcacacataaaaaaatgtttcagatgtttcataatccgatgaaaaaaatgtttcaacaagaattgttccagcgtgttccataactcgatcaagaatgtttcattgatttatcaaaagatgtttcaatcacatgcaacatccaagaacacttgttgcaacgcacaaaaccagaatattgcaacatccaagaacacttgttgcaacacacaaaacagaatattgtaacatcaagaaatcattataccaatttgtgcaacatccaaaaaagactaattgcaacatcaagtaaacattgtgtgcaacatcaaaagaatagggtgtgcaacattcttgcccaactagttaggcacaccagctttacctttgtcagcgccggcaactactttttcacctcctctatcacataggtagggcacgacgacggagttggtggctacaagaagctcctgagctgaagccatatccgtgcctctctccctatccccatggtggccttgccccggatctgatacttgaggtcaaggatggctagatctagctcgaggaacacccacgttgggggagatgttaatgggagaggaggaagagtacatgaggagttaaagagg

SEQ ID NO: 3053 - DNA, 1501 bp, Oryza sativa
aacccgaatggcaaatcatccaagtcctgactttgggaagatggcaattggcaaatggagtagtccaaaatcccacactcgtcaggcccgctagggtttcaggcttccgaatccgagcagctccattccccaaatcgcctcttgtctcgcgccctcccgccccgttgccggcgacgagcgctgcagggcacagggtgctcaggctgcagcttcgcctgtccccgccatctgccggacaccaagccccgccccaagtcctagcctgccatccgcccgccgcccgccagttgctgcctgactgtctcaactgttcaccgtgcgtaccctgcaggtatttgtttgtttcgtgtgtatacctttagtttttggcgcagattgtagtctgcagaatcgaccctacttgtcaatttcagggctaaaatttcattgttgagtcagtatgtgctatatttcacattgtttttttgcaccatagaataccgttgatgtgtcaggaaccaaatgattttggttcagacaaattcgaaagagattcaaatatggcaattagctaactagtaggaatcctaacacagcaaataattaaaattgtaatgctgaaattaactagaatggaaggaaatatatgtgtgcgccgcaagaacaagaggggaaattatattagggttcagattcgataaagagttacagccaaaacacggggcttatattgagtacgccctctgctagacgacaacgacgatgacgtccacagtacggcaattcttcccctctgtagcacatcgcggcgaatcagggccacccgatcttcataacccttccaatgaatcggtatctcacaatctcagccgtcgattctactacagctatcccccttaactctgaacttccaagtctgattcttcttcaggcctcacatgatgcgtgtttcttttgctgtaacagcgtagttaagatgaatcaactaccatggagtctttcactaaaatcaagacttctcttggtttgcgatgaaaatgaagtttcaaacatgtattcaattacttttgctgttctggcctgttcatggtgtgaatatcgcattgtaaatcaattgaatgacgatcattccatgtctaatatggcagacatttacccatgaatggctattttgttggtgctcgcaacgacttcctgggttatatgctccagtaatgtggaaacaagtataaaaccttgtctgccgtatgcttttatcatgttaacttgttagtagattctttttcttttttaaaaaaaacatggcagatatcaacagttgcggtagtaatttcgcttcatattattcactttcttcgattggtcatcttgagtggtttcctctttcttggttacattctgctactgtgttgttccttcatgcaagtgtactggtcatctttttttcccataatgatgtttgctgaattaactaggagcttagcctgttgtgttttgtgaatgtatgcggaaaatgaataag

SEQ ID NO: 3054 - DNA, 1501 bp, Oryza sativa
cgcacttggccatgcatcctttcttcttcccctgggtgtcgtcgcacgacagctgctggtctctcttcccccccatgtgacccgggttgatcatgtggtagttgggcggcagtttcggcgacggcggctgcgcctggaccgccgcgacggcgcacacggccaccaagacggcgagcgcaccgacgagctgccgatccatggcgattcaatggatggagatgtgcttcaacctctgtgactctgtgttgctagctgttgttgttgttgtgacttgtgaggattcaggacaagagaagatgttcatttatagggatcgcgagtgcagtggggtagtggatcgatgagtggccgccggtgatgtgtcgtcggcttcggctctctccggctggccggcggcgcggccgtggcggtgaagccaccagcatgacatctgagaatccaacactttgcgttcaccctgaactatgcatgatcttgctagcgtacgaatcgaaaacgtcgtcctaggatcgaggtcaacagtaataatataaagaaattaagctagctggttcttgtatggcttcatgcttaatttgcttcctttcttccaacaatggacatggttttaccgttttttttccttctagctagttccttaaaatctactgcaattagttgattcagctagtagcaaacataataaaggaagtaagcttggcttatggacctgaaagctgtttacctttttttccatcctaatcaagcccctggtcaactccattttgatctacacttaattcttatcttcagatattatgttcctaaatattactggctcaatgcacggacctctgttcttcagtaaagccaaattacccaacatgcatgctcgatcacacacacacacacgttgttgttatcgtttcatatagaacagtatagtggttaactaattgtaaattgtgatgagatttctcatcagtaaaccagccaagcaagaacggatggtacacaagtttttgtaacagagtttgctgattgtaaatttggtggcgtggcatgctagaaaagctggacaaagtactccacatgcaagctgaagttagctagcaaatattcagacgcacgcaatgcgtcatgcgttctcctgaagacctgaagctagatacggcagctgctgggagctttctgatttgccacgacgacgtatcgaacggccagccgccttcgccgcgacgccgcctggccggtcgccatggcactgcaccacgaggcgctctcgctcgcttcaccaccacgcgcgccggctcgccggcagtcttccctgccgagcaccatgcttgcatgctacctcatggatggatcatctccattgccagtccagtgaaatgccggcctagctataaatacgcgcctagctctcatagccatcttcctcaccaccgatcgatccagagtagccaacttaaccaaatttactgtacgttgaccaccagctagctagcttagctagcgacga

SEQ ID NO: 3055 - DNA, 1501 bp, Oryza sativa
gaccagaccaggaaaggagacggagacccgattcgttcccacctcctcgccgcccaccgctctccatctcctcttcttcctcctcctcctcctctcgtcgtcctcgtcgccgtctcgtcttctatttatttaggagtatttttttttcatctatctatctgtatctatctataccccccgcctccccgatttttcttcttcttcctcctcttacctcgcgtcgccgccgcgggcgtcagcgctcgcgtcccccgtgtctcgtttcgtccatcacaactcgctctccgtgcggcggcggcggcggcgatccccgatcgggcgactccggcgattgcgaggtaactagcgtctctcctcctcctcctcccttctcgaggttcgctcgatttgggcgcgtgtcgaattcgggaggctggtttgctctgattgggcttgtacagattgcttgcttgcttggtttacgtgcgcagccgcagcgtgcttgttttgctaaaagggcggcttggagaaatttttagctgacatcgaccgagcttgttgcgccgccgccattatcgtgcgacgacttaactgaatccgtttgcagttttctgctatgcggcgtcagttagttcagtttcctccgtgcggggggtggggcagggtgcggtacatgggtgggggcgatgaactgtgtggcacatcgaatttactgcagtaatctgacaagggaattgcaattgtaaggatataagggaactgcttctgctgtgattctcaagtgctgcaaccctaggtggcttccgcagtgcccagcccaggtggtccaatgacttgtacagtaggatagttgctactcgtgtgcacattgcacagtaggtggggtgtgtgaagggccacaaaacacctcttgttattgcttcttttgttgcatatatgctactgcaatcagctatgattttgttcagtctgtgatttgttaatagacagttgcccctgtccgaatgggtcctctgaatgtcaaaaatttctgccactgtttcatcgagcttttttatttgtgggatgggatttatatctaggtgatattaactgccacattgaattggttgctagctgttagggagtatttttcatctgtcagtcagtggaactcaggtctgcagtaagtttgttcatgattgagagcatatagcttatatctcacccaactgctaacttcaggcagataggaacaattacactttattttgttgcatgctatccccctctgtggatctaaagctttgctgcccatttttagatccatcttgcttgtcatgttttctctacttcattttttaacaacagtttgcaatgcattccgttttgggcaattatatgatatacatttttctgcttattaatcttaacaggttgaaattaatacattgatgctgtatcatcacagaggcggtctttcttaatcttcaatattttcttagagctaaacggttatattttggtgtcttcttagcaacaa

SEQ ID NO: 3056 - DNA, 1501 bp, Oryza sativa
gtcccataaaaaatccaatcctggagagaccatctgttactactatctccgtcccagaatataagaagttttagagttagatacggtattaaaatatgtaaaattaaatgaggaaagattgtgatttgttaagaaatagaggtcgataagaaaagtgaatggtttagggttgtgattggttgagaagggaatgttggcgaagaagttttgtattttgggacaaattttaagtgctaaaaaaaatcgttatattttgaaacggagtgagtagcaccgaaaataagctgtttttgtcacccgtgagagcatctcgagaaaaaaaaacatgactgtctcaaattcgattttgagcgtttttcgttagaacttggtttttgtagccgacgattaatactacaagagatcgtgtaaagtccgaatcacagcgtattaatttgcttcacttttcacatggaaacgaacgaacgaaacagagtttgctaaggcttttgctgagagaggagcacgagcaatccctgtgggccgacgaggatctcgctggcgaagctgacgaggccgaaccacaccaccggcgtgacgtcgacgccgccgagcggcgggatcaccttcctcgtcacggcgaggagcggctccgtcggcgcgtacgccaccacgtaggggaactccctcacggggagcctcgggtaccacgacatcacgatccgggcgatgaacaggaacccgaacgccgacagcgccggcccggccaccccgatcgccgccttcgccgtcgctgggtccagctcccctaccaccgccaccgccctgcacacccactccgccacctcctgccactgacgctccggtgcagcagcagcagcagcagcgtggcattggccggtcatggccgccgccgtcgtcgccgcggccacggcgagctggccgtgtgaccctcgctgctgcttcacatcgttgcttcttctccttcttcctccttgtgctatctcgatgtcctgtagtttggagaaatcaatccatgtcgatgaagatgaacaaattaaacagtgcatcggcggtgatcgatccagcaaccaagaagatgattaccttggcggcgctggcgacgatgcacctcctggcggagaagagcatggacactgtcctggacatggaggcttccatggtcatggccacgaggaggagaggccttccttgctttgccttactttggataaggcgaattgaagagccaaggtgggggagggaagaagacgacactgcccgccacgttgctctttctactgggcctccaattgagacggcctaagcccactggcgatgcgaccaaaaaaaaaaacaaaaaccctacggcccaacacaagcaatcgtctcccaacatcaccgcggcggcggcggcggcggctttccacctccccgccggcttcgcgctcccaacctcgccgtcgttcgtcatgttccggctgcgctcctccgctcgcctgctgagagaggtgagccagcc

SEQ ID NO: 3057 - DNA, 1501 bp, Oryza sativa
tcgagaaacatgtctcattgtcacaagccaaaaacaatccatcaattcccggcacctctcattctagatcactaacgtatcattcttgcactcatattcccctaccagctggctaatgaccaacagagaatcgcctataatctcaacgtcatcggcttcaacttctttcaatagctgcaaccccttgaggaccgcttcgtatttggcttgattgttatttgcataaggcttgatggtataggcaaactcaaaacttgcccccctaggtgacacgatcactaagccgatgccacatccgtgagtgcagacggacccatcgaagaatagcgtccagggtactatgaataccaggccgattgagccgttttggtgttcgacaataagatcggctatggcctgccccttgactgccttaggtgattgatatcggaggtcaaattccgtaaggcgaaaatccatttcccgatccttccttttaacactagagccgatagcatgtacttgacaacatcggctttgcacagcacaatgcattcattggacaataagtaatgccttaacttcgtgtaagaaaaatataggcataagcgcaatctctccactggagaatacatcgtctccgcgtccaaaagttttctacttaaatagaaaattgccctttctttgccatcaaactcctggactaagaccaaaccgattgccttctcatcggctgataagtataatttgaaaggcatccccttttgtggaggaatcagaaccggtgggttgctcaaacatcccttgatgttatccaaggctttttgctgctctgcccccagacaaactcctgatcggctttcaacctgagcaaaggcgtaaaagattctatctttcctgataaattagaaatgaatcggctgatgaaatttatcttaccgaccagagattgcagttgtgtcttattctttgggggttggatctccttgatcgcgttattgctactgtgagttacctctatccccctttcatgaacaaggaaacccaaaaactgcccagccgatacatcgaaggcacatttcgtacgattcatcttcaaaccatatctccttgttctttcgaaaacatttcttaaatcggctttatggtctttgaccactttggatttaactattacatcatcaatatagacctccaccaataagctgattagatcgtgaaatatatagttcatcactttttgatatgtagccccagcactcttcgacccaaaggtcatcacaacccactcatataagccgattgcaccaggacatctaaaagcagtcttatgaaggtcttcctcacccataaatatttgattataactagcattgccatccataaaactaccatcgaacacttatcaaagctgaataaaacaaacccttttctagccaaatcaacaattgggtgaatgagactttgtaaaaatagaacaagaggcttttaaattcatcggaacgttattgacatagattaa

SEQ ID NO: 3058 - DNA, 1501 bp, Oryza sativa
ctcatctccccccgcccctcgggtagcgctgaggtggcaagggcgacctcggggtgccacgtcacacccctcaggccttcggggcgtgctaccctgaggccttcgcccggccaccacatggcggggagagcgggcggggcgagaaacgctgctccatgccttcaatgcgcggtgccacaaccgtcccgcgccgcatttaatgtggtgtgggaggacgtgcggcgccgctcggtctgtgatcggtcacaagcgatgggacgggtggcagtgcccccacgttccgccctatgtcaggcggagtgagggcaggtatgccccatcccatcggcacactgccaggggcaccccccgggcgtggtgagccgccgaagtccccatacaattaatggggaatgacggggatgtcccccgtgtcaggcgggggacggcgctgggcccctcctgaagccgggcaaccgtgttgcttccggttgaagcaaaggatagcgatctgattagggccatgtgggccccctcctgtggaggagtaggtgcaaacggtgcatgtggtatccccttgaactataaaaggagtacctcgcccaccaagaaaggggacgactctcagacaacttgagctcggagaaagaacagctaggtttcccttagagctaaaaacctcttgtcaaaattcaccataatcccacacacaggagtagggtattacgctcgatagcggcccaaacctgtataatccttggtctcccacacagccacgagagcgttttagtagttaagcgccaagcggaagtagggtcttgatcatcgcgccatctcccccgaccgaactcacaaaggggggggtctcacgaccacccgctagaggggatctctcctcgacagctggcgcgctaggtaggaggaaatccgcgcgcttgagaaggaagtcgttttcttccgccctaagtttctctccatcctcagtgaccatggttgaggtggtggaacatgaggtggtggtacgcacacccattcttccgggagtgaggatgcaagtgggagtagcgatcctcgacaccatcaccagaattctccaactcctccgcgccatagcccccgacggcaggaggaccccaatcggtctgggggctcggccctctccccgccacctggtggggggaggccacaccgcgccagggtgcggcgccgcctaacctacggcgacgaaggttcgccccagggcgcacttcaggcggtgggggctcttctgcggcaccccccctgtcaacctagagccggagactcctattcagcgatggttggatgacgtggccaacctggtcaccgccgctcagcgacagctggccaccgatggcgggcccgtgactactggtacctcgcgtacccccactaccctctccttgtccgcaagaaggagggcccgtcgatcggccttgacatcgaagcggtcgacagcccaacgtcgtcgtggccctcggaaagccggaggcatcatgatgac

SEQ ID NO: 3059 - DNA, 1501 bp, Oryza sativa
tcttgttttataaccccaattgaaagtggttccccttattattatctaacaacatttctctttttctctctctacatataaatcatatatatttgttcgactaccaattttcgttgttaactttctcgatatccgtgtcgtgcactgctgcgccagtgtcatgagccggcgactatggtttgtgtgcattgtaccatcacctaattagagttagctctgccgccatcagccggtgactatggattgtatgtattgtgccatcatctaattagggctagctccgtcgtcccatctatattttaaacctacatccaccactggctctctataagtaacgaaccaaatgtaatcaagtcaactctcagtactaaagaattggtagggttgagaaccaaagtggcccaaagttgaagcatcaacgcaattcttcaaacattattcatggaatttccaagcaatgcacacgcagtaactatagtgtgcgaaaagggactcaaaactgtcttgttttctgaacgagaattattattgatcaaaatttaccatcagatcaatagcgttatcgggagaaaaaacaaaacgtagtttttaagctgaataaaaaaacagaaatgtattgtaaaggattggagaaggagggatgactacatgattacatttactcctgcacaattttacaaggagcatctttctagcatctatatatacctacagctgaagcctcatacctcccacaaatttagaggcgattcggcgaattatacatatatatatatatatatatatatatatatagctaagcaaccaagatgtactatacagtgggagaatatattcattcctgagcttctttgattgtcttccaggcgtgcggccaagctgctcgctagaacgtgggcacgacgccgcagctggagtcggcggtggtggagaagtactggtcgacctcaaggtcggtgtcgctgcgcttggcgaagcgtcccttgatcctcggccgggtctcggcatacgccttccgcgacgcgtacctgatggtcttctcgaaccgcctcgtcttcctcttctccctgtaccggtgcaccctggcctccctgtcaatggcgcccatgaactgcggtggcgacattatgctgtgcgccgccacaggggagccagctgctgccgtgaagaggtcgatggtgctcttggatgacctcaagtaggaggtggtgatgtctggcacaccgcagtctgggaccgtgctcatgttctccagcgatgacatcgaaacctgagcgatcgtcgaacaaggttgaaatgcatactatactagttttgatattccgcgttttgctgaggatatgtggatgaatgcatattttatataatataaaagatagatatatatgtttaaataatgtgataatgatatggagatgataatttcacattgctcgcatattaaattctaaaaatacaacaaaattataaatgatatatcatgtttacatgaaatttaaga

SEQ ID NO: 3060 - DNA, 1501 bp, Oryza sativa
tccgttgttgtttcttgcaccggtgagttcaccgcgtcgtgctcgtcacgttggtgccctctgttctcgccgccgtgacctagatcgccggtgaccgtgatgtcccgagcctctcgccggtgatgacgtcatcgtgatgtcataaagcccttttcccttctaaaattaaatcttaaaatcagtttaatcttgtaaaaattcataactaattcatatgaagtcggaatgaggccgttcaagtctctaaattcatctaaaatcatgatctacatgttaaaaatatccacatgtactgtttttgcttgtttttgtactgttttgttgattttgttctttcgctttagtttccgatgttccggaggagagcgttttcattgagaaaggttcagaagtgtttgcggaagatcaaggcaagtcacacagatcccaaacaaccctttgagcatgttgaacccgtttaaagctaatgttttatttcaacttatgcattattttcgaatgtcatcgggtggtgagcctttcccaattaattaatggccgaagatgactttattttcctatgggttataatttgattagctagaaccttatatattggtttggttcagctaaatgatatatatatataattgcttagccatgcttagaaacattagcatcattaatggggtgaattatactatattattacttatggttatatttaatggtagctcacgatggttaattgtgttattataattaattgataattaaaacttgattaaaggtgggttgtgagcacatggttttgaaggtcgtgctcatgacaattaaggaccggttcgcgagctactgttgtgaaacattaaccgtgccaaccacaagccagcgtgggcaacggctttaccttttgtatagcatgattcattgcggggcaccagactgagaagcggcgagaagtccatgggggtcgctggggagtccatgcctcttgttatatttatagagggggtgattatgatccaggaatggtgcactgtggtgagttatgttgtgcatggggtattgtcacagcctctattcgggtactttccagtatcgcgacgcatggtagacatgatgttgaggctgtgtcttgtgggtatagtggtacacctctggctagagtaaaactattcgaatagccgtgcccgcggttatgggcgagttgagcaatgtttttcgtgattagtctcacacctctcacaataattattgatgctataattggtaataatttgcttagctcctggtttggagatagatctgtacagccgggtatggttgttcagaatggttgggcctgagcagcatgggcgtgttgttcagtgttgattaaaattaatgattaaagtactctactattttattactcttaaatgtttgctaaatgctgcttttgtaaatgagcctatattatgccatcctttggtatccttgtgcacttgcatatttgctgtgtggcttgttgagtatgtaa

SEQ ID NO: 3061 - DNA, 1501 bp, Oryza sativa
ccacctcaaccatggtcactgaggatggagagaaacttagggcggaagaaaacgacttccttctcaagcgcgcggatttcctcctacctagcgcgccagctgtcgaggagagatcccctctagcgggtggtcgtgagacccccccctttgtgagttcggtcgggggagatggcgcgatgatcaagaccctacttccgcttggcgcttaactactaaaacgctctcgtggctgtgtgggagaccaaggattatacaggtttgggccgctatcgagcgtaataccctactcctgtgtgtgggattatggtgaattttgacaagaggtttttagctctaagggaaacctagctgttctttctccgagctcaagttgtctgagagtcgtcccctttcttggtgggcgaggtactccttttatagttcaaggggataccacatgcaccgtttgcacctactcctccacaggagggggcccacatggccctaatcagatcgctatcctttgcttcaaccggaagcaacacggttgcccggcttcaggaggggcccagcgccgtcccccgcctgacacgggggacatccccgtcattccccattaattgtatggggacttcggcggctcaccacgcccggggggtgcccctggcagtgtgccgatgggatggggcatacctgccctcactccgcctgacatagggcggaacgtgggggcactgccacccgtcccatcgcttgtgaccgatcacagaccgagcggcgccgcacgtcctcccacaccacattaaatgcggcgcgggacggttgtggcaccgcgcattgaaggcatggagcagcgtttctcgccccgcccgctctccccgccatgtggtggccgggcgaaggcctcagggtagcacgccccgaaggcctgaggggtgtgacgtggcaccccgaggtcgcccttgccacctcagcgctacccgaggggcggggggagatgaggccgcgtggccacgcgacttagatgagaaggatacttccctttgctgtgcgtacccccgggcccatttcaccgacaactatgtatagatcaaatgttgcagtgaattgaaatatcctttcgctatttgctgaaacattgtttttatatatagtgaaacatcacctgattttttggaaaccttttgtttcatacgttgtagcaaaatgttccatgaggtgatttggttgtgtttcagctttttaaatgattgaaacaatttcgatctacttgatgtaacaatgcccgatttttgcaaataataataataataatatcgagcgtccgatttgtaggtgcctcgtatttacagtagtgatatttttattatctaataagttcttgcgatttatatatccgttttgagagcgactagagtacgggatcccgtcacaaggacgagatattttaatgaaccccctacccctttcttttctccagttacgagaaatcccatgcgtgagaaaacgagtaaagcaggag

SEQ ID NO: 3062 - DNA, 1501 bp, Oryza sativa
aaggacatctcttttctcctcttggcacgtgtccatgacagtttctgcaggtacaaccatcattgggaagtcgttatccaccgaacgcaacttgggcatgggccagcggcctccgtaatggttcggcagaactcagggttcggccgaacctaggacggctccattggctccgattttcggcctagacactcattttgggcccctcattctattggtgtggatggaaggcccatttgaaggtgtttaattggatttttgggtccaaaactcgatatgttcggatacgcgtttgattctcctcctccttcatgtatattttttctcaacataggtagtttgtcacctgcatacgaatatacaccaacactcgtggaaattgttagaaataaaccctaccactatgttggatgttttgtatttatggttttatgcaggtattgacggtgagaatttggtacttaatagccgtcaacagtcattattcacaagaaatggtccaatactagtaggcccaacgaaggctgaaatacaagcaagccagcttgacttgtatgaaggtacctttccaaattccaatttccttagccgccactaccagcctatctcactacctgcagaagtggaggtaagccactcacacttacgcgaaactatcacgcacttctttatgtcgtgggccagcatcgttatgcgctaagcccctcctccgctgcctggtctatgcctacttgacggcctcagcgttgcatgcataagtaccacaacgacccaactgaacgcttctgttgttgcactcactcaccggttccctgatcgcatcatgccacgcgctgagttctcttccaatctccctctttccaaaggccaacgccgcttgttgtccttaaaagatgcgatgacacataggtgcagggccccgagggtggtgcagggacccaacaggtatggggatgggagacattttccacccgatcatcagttcggaagtgggggcaggtgaggaagtcaaggaccgagggcagagacgttccagcccaacccatccccaaccactattgaaggtcgttaagtacaaaatttaatagtcaactcctgcatagaagaagtaaaatattatatcaacttagtggtggtagtttattactaaccattttcactagctttggtaaagataggcatgcaggtcatttaaggagaaaatatacccgccatgcgaaaaaatgaacctccgaccaatcaagtgcgaatacaaggattggagggcccacctgatactaaaaaccggcctaaagtgaggccaaaccatcctcaaccgccataggggcccacctgttagagacaaagggaagttggttgccagagacggtggaggtggtttggccgaactagcctcggcgctactaaccgctagcttccacgtgtcaactccccattggtcctcaatgacgattaagaggggggtgttactgacatttccaactacccacaaccatcattagca

SEQ ID NO: 3063 - DNA, 1501 bp, Oryza sativa
cttggatccgtgacaggccatatctatgaggtcgggctcatctagcatagcaacatcattctttagatagctaatatccactggatatctaaagctcaaatgcaagtatgatatttattatcactcctaaaacctatatgcaaatatgtcacatcaatccattaaacacataaaaacatgcaagcatatagtaattatatctacaatttatttcattttagaactaacatatacatgataaatcatcattcttaagtcattttcataatattttaatccaaattatttcattatttctcctatatctaacatatatcctgtaacaaagcacggtgcatcatctagttctttagataagaacaagcttgacttagctgataatggcctgcgacatatccacgtcgaaagaaatgagccgaatcaactactggtgggtagggttttgcaacaaaataagagtgatggtttatgtaattatgtcttttaagaaaaattgcatggtgacccgcgcatattgcacggctagcatcgttatattttttatacatatatatttacattttattataaaaatatgttaaaacggtaacataattctaaattttgtactatcttgatcaaactgaccaatgtgtaattgtatatacgtgagagttattaattatttttaattctaaattttagttatttctaaattgtattctgatatggaatttttttacaaaatgtatggcatgagtattaaaaaagtattgtgtgataatgatcagaggaattgtgtgattggttgagaagagtatatgaaggagaatagttgtgtcccaaaatataagtgagaatgatcgaagaaagtgtgtgatcgattgagaagataaagtatctgaaggaaaatagttatgtcccaaaatgtaagattttttaggttagcacgagtattatgaaagttcgatgatgcattatacccggttttgtagttcgggggtgtattttggacaagcataagagttcgagggtgtaaaatggacttctccctttttttttccttccacggccaaaataggcctcgttttacgggtccaaattccagcccatgtatatctctttttttaaggaataagttcatctgtggtcccttaacttgttgatgaatccgattttcatccttcaaccgcaaaaccagatatagtgggtccctcaactgtcaaaaccagtgcagaagaggtccattagcggtttggacagcggttttgtctgacgtggcgcctgcatggctaatttgacttggttttcagctgatgtggcaatgacgtttcgcttatgtggcaatttgttccagaaaaataataaacctcatgggacccacaggccagtgccacacacaaattaataaaaaaaattggtggggccatgtgggccccacaagccattttccctctcttcaattctctctcccttctcatctactgcgacggtggcacgggtgaggaggggcggtggcggg

SEQ ID NO: 3064 - DNA, 1501 bp, Oryza sativa
gtttatttacgatgtaagtctcaaaattacatatgtaagtgggatgtaactactgtgtaaatttatataaatatatgatgaaaagtggggaacgcctacggatcggtcgccccggaccgatccggggctagggaaatcgggcgctagcacccgatttacgtgcaaaactactttaaactgattttttctcctaaattacttatccaaatcataatccgattgcaccattaaattcattgcaattaaatcttcaaaacaagaccacatatggatatattacgacgaaaaaaaatagcttattattgaattatttttaaatgttgcacgatgttccaccagatatatcggaattgtttcactaagtagatcgaaaatgtttcactcgtttaaatcggggtgttgtttcaccttatataaaaacaatgtttcagcaaatagtgaaagaatgtttcagttcactgcaacattagatctatacatagtgaaacattgtgagtacacaatgtgaaacatttttcggtggaacaaaaaataaaccaaattttcttaatagggggtttccaaaatatgtgcgttttttttgttgcaatggaatgttttgttcactgcaacgttagatctatacatagtgaaatattgtgagtacactaggtgaaacatttttagtggaacaaaaaataaaccaaattcccttaatagagagtttccaaaatatgtgggttttttgttgcaaaagaatattttaatttaatgcaatattagatctataaatagtaaaacattgtaagtatactagatgaaacatctttggtagaaaaaaagagagagaagtaggtgggtccagcagatacgcacgtgggggaaggggcgcgcggggggagcgcccgatccggctcccccccgcaccggtcgcccggagtagagcattatcgtgaaaagtggtattttttttcaagaaaactatcgactaagacataacaattccgtatataaaaccaatcagaagatcaggtggatgcagctgccgcagcgtttgcatgtgaacaaatccaatggacacggaaaccgactaagatttgtgaaaaaaaaattgtcgccatctttatagcaattccgttataataattttgccccgttcgatctctcaattgatagaaaaattttcggtgcacgtaaaacgagaaatctcattagcacataactaattaaatattaattattataaaattaaaaaatgtagttatttgaatattttaaacaacttttacacaaattttttttatcaaaaacgtataatttaagagtttgaaaaacatgctaacgaagaacaagaaagttaaagtttggagttgagaaaaaaataatatacaatattaattataaattaattatataccataatatacaatattccttatattatggtgatctgattcaaattaatgtatttttgcccatgataagcccttttttatatgctaaaccgtatttttcttagata

SEQ ID NO: 3065 - DNA, 1501 bp, Oryza sativa
ctgaagcggcgtttcggcggcgcgaggaggcccttgaggcccgtgccatggcgctggaagaacacgccggcgccgtggagaggggcttgacggaccgcaaggccgccgctggtctccgagaggcgacgctggcggcgcatgaggccgcctgcgccgaggaggagtgcgcgctccgcctccgcgaggacgcactcgctgagcgggagcgagctctcgaggaggctgaggccaggaccaaacggctggcggacagcctgtcccttcgcgaggcggcgcaggaggagcaggcgcgccgcaatctcgaatgcgtccgcgccgagagagccgcactggagcagcgggctgctgacctcgaggcgcgggaaaaggagctggacgcaagggcgcctatcggcggggcggccgcgggcgaaagcgacttagccgcccgcctcgcagctgccgaacacaccgtcgcggaaatgcagcgagcgctggactcctccaccggggaggccgaggcccttcgcttggcgggcgagattgggcccgacatgctttgggatgcggtctcccgcatgaagcgcgccggtcggcaagcaggcctctggagaggccagacgacggtgccccccaccaatctggaaggcctcgctccgcacctcaacaggatggcctgggtcctcgaacgactccccgaggagctcgagaagaccatcaagtcatcctcgagggacctcgcccggggggcggttgaactcgtgctagcgagttaccaggcccgggactccaatttctctccctggatgacgtgcagccgccgccgctcgccgcgccctccgccttgatgacacggagccggtggtagcggcgccggaggtcttggtggtggcggaccgtccaccagcacccaggcgctgctgtgccgtcatgaccaagttggccacgtcttccagccatcgttgggctggagactccgggtcagggacgacaggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacggatttgtcgaccctctcaagcgcctccccctgcttagggctttggcgcggaggaggtgggggagtacgagctcgacggcgtggattcggctccccgtcgtcgccgctcacactcggagagaggtcgtgcgcttttccttgctcggccattaggctgaacaagaaaaacttggcgcacacggaagagtctgagagctcagaaaacacacgctgagccccctacctggcgcgccagatgacggagctcgtggctcctcaccgggagaccgcgcaggcccccctttgccagttcggccgggggcttagggtgagatctcaagctctcgctctccctctgtatctggaaagatcgtctgcccgcaagacacacgagtagggtattacgcatggcagcggcccga

SEQ ID NO: 3066 - DNA, 1501 bp, Oryza sativa
ccgcagaagtacagtgaacacttgcatgcatataataggtcaggaggaaatggccaatctctctggagtattcatcaagatcaatgcttgctttgctttgcttgcccggtctcctagctattagtctccatttgattgatgcttttgtactaattaactaccactagtaatgctattatactaattaagtatatgtgcatcaacatagttaattaattcctagcagcctctatcatatcctgacgatttaagcttgtagcattatattagctaagcttttgcagtcaggagtacgtggacaatgactgacctaggagactcttgcttatgggtgatttatatgcatgtgtctcatgagatattatcaaaactgtcatggcagattaaagtatgtttatttatgcttctggttaatatgttatggctgcttgagaggcacagttgtagaagaacctaccacaatcttcccatcttgtgatttttgtcgcttctcgtaggccaattagggatgcaaggaatcggggacttaatctcattaattaatgaaatgacaggacagtagtagacccttgctaatcccggccttctggcaattatatacattgataattttgataatgacacaatccctaaaatttagctttgacctgatcgaatgccatgatcatagtattatggaaatgttttagacaaatctaccagcaccattatattttcacatatatcatcgtctttgcatgttcgtatatatatcacaaattaaaatgaatactatttgcttgtggttaattagcacctcaactcatggttcattttatcgcttgagataaaaattcgggataaattaaccgatcgagattttctaccaagattaagcaaaatatcgtcaacaatttttaaatggaaaaatcgtcaaatattgcgaaaataccaatggatcaacttgtatgtcctaattatgagcactcttaaaactccaagaaaaaaaagacaaaaatgctgaagtgtgatgcatgcatttgtacatattgctcctcccaaatggccgggagtattaatgaagaatcgaaagaaatcatttctttttctgtcttgcattattcatttaaatccaacgatttcagttggtgaattgaacttggtcacctggagcacctttccaaaaagtttcatctctgtacagactctcaagaaaactagttggcaagtggaattctttagtcttctctctaccccggaaaatatcaagaccagcagctagctagcaacttatgaatattttttaattaattatccccattgatcaagtgctgattttaattataacgtgccaaaaagtttcagccgccaatgacacatgcatagacaaattgatttactacaaaaatgcatctgctaattgattaacaagtcggcaacatgcatgaacaaaccacgcacacacatatataatatatatacttgatcctagcttccttccaggaagaagtaaggatcatct

SEQ ID NO: 3067 - DNA, 1501 bp, Oryza sativa
agcatctacaacagttataacattaatttgatggattattgtcactgacatcatcaccagcacctctgcttcatcgaccctgacatctctgctgttgctaatggatgattatgttttcgccgacttattatttcaccttcacggttgacctactatgcaaatgctgatgagcgtctttgtcattatcattggttgctacactgctgttggctggatcaccgacatcgtcatcttcatcatgtcggttgcgtttgtcgtcgtcaagtattttcttcatcttcatgattggtggatttcgtcatcgcctttgatttgcctcgtctgtcaccgactgattatttcgctgccatagttacacaactttattgctgagcgccttcatattcattgttggctgatctgactgctgccgactggtttcttcgcctccacggctgtgcaacttcatcacttttgattggtatcactatcttcactaccaccaatatttttgccacctctgctgggcaatattatctctgtattggtcgtcttgtctctatgccaattgcgtcagctaccatcaatgaacaattgtgactacgtgctcaggggcttactagttcaaacacaagtatcataccttcaatttggacttgctctggatacatgcaatatggattcatgatcatgggtctattttctatgtttaaagactggactatttattattccccataagggttacaaccgaatacttgcgccagtcgggattcaattattatatttattttggagtatcccataagggataatcattcagatcagaagctattcatatgagctacacttggtctatattacccggaagatttattactcgggagcatgttacatgcgtcatcctttaaagggtgtcgaaggcatattttttggcctaggcctaatatgtctgcagcccatattttcaggtgtggcctgttacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgtcccgctgacttttttatataagtcaaggtgctgtttgggtttttaagcaattgattggatacaatatcattgctttttgccacgtaagtgtgcatttttattgaccaatattatggcttaggctgattatatattgtggtcattttctaggcggttggtaaatcctttatgagtttatttactcggattttacaccacatatgccatatatttccaggtgtggtgaaaccgtgtgtcttctagggacttaagcacatctgttaaagcagtgtgcgcatggcgtatgcccaatactttggaaatttctttattcacaatatacaagcttctttatagctattttgctatatcactcatcatattttacaaagcagttggt

SEQ ID NO: 3068 - DNA, 1093 bp, Oryza sativa
ccaccatggccaccgcctccacctccggcgaccccaccgccgccgccggcgagcccacgccgtcgtcctcagcatccgcgcagccacggcagccggcgtcccgcatatcccacatcgtgcgcacctacctcgacctctcctccaaccccaagaagcgccgcgccgctcccaagagccaccccaagcccgccgccgccgccgccggccaaggcgcccccgatgccggagacgggaaggacggcggcgggaaggcggcggcgaccccatcgtcggcggcgcagcccacgaccacgcggctcctccgcgagctcggcgtccgggtctcccgctacacgcacgaggagcgccgcgacatcgtcctccgctacatgcagaagcggagcggccaaaagggcgtcaagcgcgccaccgccaaggtgagctcctcgatccatatcatcgccaagaaggaagaattcgcgtttgagtttaggttaaagatggatagaaatttgatcattattagtattattttttgatggcgccattgttggctgcaggccccatcgaggcaggctctcgcggagcggaggcggcggggtgcgagagggcagttcctcggcaaggagggcgccaaggtatatagaccggggatccatggtttctgattgatttctcagagaattgtttgagagatttcgtgtgttccatgtggcgcatttcatggttgttttttagataatgggaatttatataacccggcttctacaccaacaccaacggcttctgaaaacccggctttcatggttggatattgcaagtgtcaagtaggctaatgtagatgcgcattgagttcagcatgtcttggagttagtagcattggtgcacaatcatgtcaaatggagtctgattttaggatttttacagaataccggtagggaaaaacattcttggtacaaatgaccaagaagcactttgatgctgtggtagatgtatgacattgtgtatttgtctgcacttacgttatcgtttcctcccagactgtagataaaccagaagaagatccagaggtgccgccagaagttattgctaacgctggaggagtgcccatagt

SEQ ID NO: 3069 - DNA, 1501 bp, Oryza sativa
gacagtacgttagctgaaagctccgaattcatttttactactaccagtgcaaagaaattggaaatttaactagctggagtagtagtatctcgatctgatgaaccattgcatttgcaagcatggatattgaaatatgcagacaagcaggggacgactaggattaatgctgacaaggagagatatgcagacaagcagagacgactaggattaatgctgacaaggagtatgcgtgcatcatgtagctagctagctttgaatccatgatcaggggggtgtcgacattcagactgtagtcgacagtgtttggcctctgttgatggcaacgaaagcaataatcggacgcaatgagcacagtgatcctagcagcattcctagtaccaagttgccaacgatcttttgaaaatggacagagttccaagtagttagggcacagtgcagcccaccgtgtagcggctagcccgcccatggttttgcactacatgcgcttttgcttgcaaatttttacttgcatatgatcattggccgtcgtctcgatcagcgctagtagctggggatcgaaaaacaggtggcgcgcgcactagcagtataggcaggggcaacatggcaatgtgcagggttttcagcgtagtgtttctcacttgtcagtgtgagtgtattaacgatatcaatgatccatttgcatgggactagctatagctcgacctacttgctgcaaggacaaataatgttggtgctgctgcgtgtttgcatccagattgatgttactactagctagtatttgcgcatctgatgtcttgctacatgatgtactgaccctcgacctagaatcctggagtgatggctttttcttaaaacattattatcattgttattgttattatggttgttgccttgcaacttgtcaacagagaacagactagtgctcgtgctcgatcgattatatatatatatcaatggctggatcaataaatacgtgatagatcgatcaatatgtattattctctccatcccaaaatataataacttttagctctcaaaatttgtcctaaaatataacaacttctccaccaatattatcttccctaccaatcacaactctccaccattcacttctacctactttcttaataaccgtgtccaactctaaaaatgcttatattctgggacagagggagtacatgtctatagcagctagctgaggcttagcttgctgaacttctgaagctatagtttcttatatactccctccgtcccgaaaaaaggcaaaccatgggtttccgtgtccaactttgactgtccgttttatatgaaatttttttataattcgtattttcattgttgttagatgataaaacatgattaatattttatgtgtgacttgtctttttaatttttttcatatttttttcaaataagacggacgatcaaacattgtacacggaaaccagggtttgtttttttttgggacggagggagtaacctctacctcttcaaaacagcc

SEQ ID NO: 3070 - DNA, 1501 bp, Oryza sativa
ttatagatactagtatatatgcgacttggagtggccttgtagctagattggtagtatatgttgtgttgagctttcagcttagctgcttccagcccttcactcgtatgtatgatagctagttttgtgtttatgttagcttctaattgcacattcttgcaaactttacactgttgagactgtcattttatgctatattttttgcgtgatcttttcaggcaagtgttcgtttgtgcctactgtttaggcatgtgtggctacgagaatctctgttagtaatcgactattttggtcgatgctattatttagttttgatgtgtaccatatttaattaaatttgattcgtgcaagccagcatgctttttccacagaaatggtccatgagcatacatatattcttagctattttagtatttttactgataattttaattggttttttttggtgaaacaatttaattgtcgctttcaggcaaaagaaagatgcacacttactagtatgtactttttcctgtacgcatccatctgggcctcctgttccttcccgcgtggttgtgcatgttttctgatcatgtattctgttctaaggacaggccacgcaaacttgttttattttcacattcgagtcctcttaatttcatccagtccaggtatatatatttttaatttctgccaaagtgtgctttgtttttctcgaaattaattaagatccccaaaagagtgtaattaaactaaagcactaaattaaaacataggaaatattatatgtaggtcgatcatgcacgtacaggcacgctgctttaaacatggcgatcaagcaattaatataatttaattagtacgattggttgattggtcaaatttaattgacgactgatgagtactaatattatatctgaagaaaagacagggtgaactgtttcactatatatacatgcatgtccgtacaatcatggcaaccgtcgaggagataatagtttttggtggaatatattctaagaggttgattactgtgaatgtttaaaggcatgcacatttcagctgtatagcatggccccatatggggtccctcatggcactgaagttttcttcctatacttttcgtggattcatatttatgcactgtacccttcatgttgctctcctgctcaagctgatcagctctaagaatataagagcaggagcaatagtagactataagccagctataaacatattttaagaaaataaaagagaagagagaagagcagtagactacagatttatagccagctacagcatgggctccaagatacatgtgtttatgataagtgaatctaggtattaattgtgtactatatgttatatgtaactattgtatgaattagctattaaatcgactatatatgatttgaagcaagtagttggctatactattaaacttgctctaatagagattttagatacatgatgacgaaagcaaaaaaggtgtgcatgattttcgattgttttaatttgcataccg

SEQ ID NO: 3071 - DNA, 1501 bp, Oryza sativa
aggtcgcgtacggcgacggctcctacaccgtcggcgacttcgccaccgagacgctcacgctcggcgactccgccccggtctccagcgtcgccataggctgcggccacgacaacgaggggctgttcgtcggcgcggcggggctgcttgccctcggcggcgggccactctccttcccgtcccagatctccgccaccaccttctcctactgcctcgtcgaccgtgactccccctcctcgtcaaccctccagttcggcgacgccgccgacgcggaggtgacggcgccgctgatccgcagcccgcggacgagcacgttctactacgtgggcctctcgggcctctccgtcggtggccagatcctctccatcccaccctcggcgttcgccatggacagcacgggcgccggcggcgtcatcgtggactccggcacggcggtgacgcggctgcagtcgtcggcgtacgcggcgctgcgcgacgcgttcgtccggggcacccagtcgctgccgcgcacctccggcgtgtcgctgttcgacacgtgctacgacctgtcggaccggacgagcgtggaggtccccgcggtgtcgctgcggttcgccggcggcggcgagctccggctgccggcgaagaactacctgatcccggtggacggcgcggggacgtactgcctggcgttcgcgccgacgaacgcggcggtgtccatcatcgggaacgtgcagcagcaggggacccgcgtcagcttcgacacggccaagtccaccgtcggcttcaccaccaacaagtgctaagtcattagcagcgatggcttaacttaattagccagatcaaggagtgattagtggtggtaaatggtaattaagcgcgagagtgtgtgatgtgggggtggggcccagtgccaggctctgtgggctttgggagagacgaaaggcgaggacaaatgccagcctgtcctgctctctgcttgtcgatggatgggggggcccactctcttcttctccggtgctttgctgtttcgtctttgatgtctcggcaaagacgaattaaaatgaatccattccaatctgttcatgtgttctatggccgcttttgtttgatgaaaacgtaagcttccaaaatttccatatctccattgctcctggggatgaatgatttcgtaggtgttcggaccaaatttggaccggtagcgtaatacatttgcatttttttttgttctcgagcatttggtaggtaggtggcgataaccgatcacatgcgtgacgtagcttccaaattttgtcatgcacggcattgcatcattgttgatgagagagtatggacgatggatggatggctgcagcagaatggtttttaaccttgcgatgcaatgcttttatacggcgaatttgtgatgggatccatccgttttttgttgcttttgtccggaaaacaccaccattttgtgtggggactggaggtgatgatggcggtggatggggtgggtgagggattactgcagtgcagtgcttgg

SEQ ID NO: 3072 - DNA, 1501 bp, Oryza sativa
ttaccgtttccatttgtgacactgacaattaccgatatcgactgaaacggtcgatgcataccggaaacgataactagatatctcggaaatttccgtatatttttcacccctagattgatacaaatcgcacatgttcgagggaattaaagttgacttattccccgggcagttgctgttgcaattggagacgagggacccaagaagccaggccatgtccgtgtagcgcccatggtttgtgaagacatgacctcaccgatcgattgatactttgggccctcggcgtcgcgttaacagtgagagcatcatatatagcaagaccataattgccaagttgagccgcctacgtacgtctgtgagagttgcagttgtgttgtacaacaactacaagcctctcactgcttcacgtcatgcatcacgggctcattgtaacatcgcctgcctgcctgattttcgcctggctcggtacgtcggcactgcactcctgatcctgaatatgaatgaaacgtccttcaatttccaagctgaagtaaaaacgaccacacgatttttggtttggctgtcagctactgtgctcccctctcgccgccgtgtcattcagacatccacacacccatctcaactggaccccttgtgtcccactcgatcgatatgattcaggtagcctcagccagccagccaatcagccagccgccgtagcgcccaacactgcagatttccactgtgctaccacatgtacgcacgcatctcatcgatccgtccagtccattcattataccgaccgtcacctggactggtgttaagtagccacacagctgctcgagattccgagaagcagccccgacccgatgagagcccatcccggaaaatccttagcatatgtactccagtttcatgttttgaattctaacactatagattgttagtagaatcttgatggggatatatatagctaggctgttttgaagaggtagaggttactccctccgtcccaaaaaaaaacaaaccctggtttccgtgtacaatgtttgatcgtccgtcttatttgaaaaaaatatgaaaaaaattaaaaagacaagtcacacataaaatattaatcatgttttatcatctaacaacaatgaaaatacgaattataaaaaaatttcatataaaacggacagtcaaagttggacacggaaacccatggtttgccttttttcgggacggagggagtatataagaaactatagcttcagaagttcagcaagctaagcctcagctagctgctatagacatgtactccctctgtcccagaatataagcatttttagagttggacacggttattaagaaagtaggtagaagtgaatggtggagagttgtgattggtagggaagataatattggtggagaagttgttatattttaggacaaattttgagagctaaaagttattatattttgggatggagagaataatacatattgatcgatctatcacgtatttattgatccagccatt

SEQ ID NO: 3073 - DNA, 1501 bp, Oryza sativa
atagtatagccaactacttgcttcaaatcatatatagtcgatttaatagctaattcatacaatagttacatataacatatagtacacaattaatacctagattcacttatcataaacacatgtatcttggagcccatgctgtagctggctataaatctgtagtctactgctcttctctcttctcttttattttcttaaaatatgtttatagctggcttatagtctactattgctcctgctcttatattcttagagctgatcagcttgagcaggagagcaacatgaagggtacagtgcataaatatgaatccacgaaaagtataggaagaaaacttcagtgccatgagggaccccatatggggccatgctatacagctgaaatgtgcatgcctttaaacattcacagtaatcaacctcttagaatatattccaccaaaaactattatctcctcgacggttgccatgattgtacggacatgcatgtatatatagtgaaacagttcaccctgtcttttcttcagatataatattagtactcatcagtcgtcaattaaatttgaccaatcaaccaatcgtactaattaaattatattaattgcttgatcgccatgtttaaagcagcgtgcctgtacgtgcatgatcgacctacatataatatttcctatgttttaatttagtgctttagtttaattacactcttttggggatcttaattaatttcgagaaaaacaaagcacactttggcagaaattaaaaatatatatacctggactggatgaaattaagaggactcgaatgtgaaaataaaacaagtttgcgtggcctgtccttagaacagaatacatgatcagaaaacatgcacaaccacgcgggaaggaacaggaggcccagatggatgcgtacaggaaaaagtacatactagtaagtgtgcatctttcttttgcctgaaagcgacaattaaattgtttcaccaaaaaaaaccaattaaaattatcagtaaaaatactaaaatagctaagaatatatgtatgctcatggaccatttctgtggaaaaagcatgctggcttgcacgaatcaaatttaattaaatatggtacacatcaaaactaaataatagcatcgaccaaaatagtcgattactaacagagattctcgtagccacacatgcctaaacagtaggcacaaacgaacacttgcctgaaaagatcacgcaaaaaatatagcataaaatgacagtctcaacagtgtaaagtttgcaagaatgtgcaattagaagctaacataaacacaaaactagctatcatacatacgagtgaagggctggaagcagctaagctgaaagctcaacacaacatatactaccaatctagctacaaggccactccaagtcgcatatatactagtatctataagctaggctgttctctctttccattcgtcaagaactaccacgacgtcgacatcataatcgtcagagagctcgagaaattttttagtatc

SEQ ID NO: 3074 - DNA, 1501 bp, Oryza sativa
ttgctatatatagttattagtctagctacatttccaaatcacatgttaaatttgttgttctcataatggattcctctgttggagatgactgttcctacaatattatattcgaacttttatgatctcttactgtatgcttgcttcttctgcctacatttaacttactgtacttgtttagctagggttacagtaaaactccctcttcttaatttccttctaattacaaactcgattcttcaaacatatatattcagttcagactcatccaaaccgcctctctctataattcacacattgcatgccagttacttcctctgcttagttaattacaaaggagcacgtatgcacatatcccaagattcagtacgttagttttgactagcaaatagactcacatttagtgatatatgcatgcacaaagtagtggtaccaccactactgtaaatgtacttccaaatatatactcactatatcctataacaacggtatataaaaaatgagtaccactaaggaggaatttggttatcagataatagaaggaattttgagtgtgttgagattcagaccttgtagctgaaaccacataccctttaccacgacagcatctcaattaacggcagtatattgcaagtaggaatttatggttagagttcaatacaactaaaatatatatcgccttaagatcgagaagttatatatgatatggacagtagtgcagtgggtgtgcactttcagaatcgaaatgaagcctatgcgtgtttaaatatataaagagatattacttttcaggtattgagaactgatcagctctattgcttgcatgctagctagttctttatctcccaaatttaattaaccagtttgctcctacaggtaaaataaccatacattatatttctttccgagttagtttgtttttcggcttaattattttgcttagcccatcgaaccaaacacatcctatgggggtgtttagatccagtagtgtaaagttttggactgtcacattgaatattatatagaatgttgcatggggtgtttgggcactaataaaaaaactaattacagaatccgtaaccgtgagacgaatttattgagcataattaatccatcattaacaaatatatattgtagtaccatattgtcaaatcatgtaacaattaggcacaaaagattcgtctcgcaaattagtcgcaatttgtgcaattagttttttaagcctatatttaatactttatgcatgtgttcaaatgttcgatgtgacagggtgaaaaattttggggtgggatctaaacagggcctaagtatagtttgcacaatttaatttgttatatatagttgtatttggtatatagatggaatatattcctgagccggcaatggaggacgaggtactcacgtgtggtacggtcgccggatgcatcagaggcttgggagagaaaatgtttagaattttctggatttttcaaagaaaaaactataccaatgcagcatgcttcct

SEQ ID NO: 3075 - DNA, 1501 bp, Oryza sativa
cggcgtggcggcggcgttgcgcggcggcggcgtggcggcgcggcggtgccatgccgcggcggcgtcgtggcgtcccagcgtgtcgtgccgccgcggcgttgtggcgcggcttcgtcggcactgcgagggcgacagcgtcgccggtgccagccgcatcaaggtcggggtcggcatcgtcggcgcggcggagtcgtgttcggccatgacgacgtaggcggtggcgtcggcaacgaggcggccggcggcggtttcgggagagagagagagatcgagatcgaagagagagagagagagggggaggcggcgacggaggtggcgacgacgacgcgcacgagacgacggcgagatacgacggcggcgtcggtgcggggatgccctaggcagtggcggcgaaggagaagccgagagagatcgatcggggaaaaaacttctaagtgttggtggagaagatgagggcgcgtatcgggaatatatatacccctagatctttagtcccggttgatgagaacaaccgggagtaaagataaaaatatctttactcccggttgttgagaacaaccgggactaaagataagagtcccggttgttctcaacaaccgggaataaagatatctttactccgggttgttctcatcaatcgggactaaagatattttcctgctatttccaaattctttttaaactcggttaaggttaggaaccgggactactgataagcggactgaatattaatttccattacatatgtgtttctaaaatagaaaataatgcattaaaattatttaaagtcgaaaaattaatgacaattacttcgaaaaattattgttgtctgtagtaaattaagtcgataaaacgtaataagcaaatatatgatttaaaattaataaaaattctaataatcatatatacttagcatatgaatgatattaaattgttaaaaattgtaattaacatatgtatatacatacgacatgcatcatttaaaattaataaaaattctaataatcttatataattagcatatgaatgatattaaattaattgttaaaaactctaattaacatatgtaaatacatacgacatgcatgatttaaaattaataaaaatttgaataatcatatataattagcatatgaatgatattaaattaattgttaaaaattctaattaacatatgtaaatgccacaagcatgatttaaaacttttaaaaatcctaattatcgcatataactagcatatgcatgatttaaaactgttaaaaactctaagtaacatatgtaaatgccacatgcatgacttaaaacttttaaaaattctaattatggcacataactagcatatacatgatttaaaattgttaaaaactctaagtatcatatgtaaatgccacctgcatgatttaagacttttaaaaattctaattatcgcatataactagcaattacatgatttaaaattgttaaaacctctaataatcgtacgtagttaacatatgccata

SEQ ID NO: 3076 - DNA, 1501 bp, Oryza sativa
tacttgcagcacatcatcttcaactcattgtacttagcatgcggatgaggaggttgcacaaccaattataagtgatgcactgcatatgtactttttcatctctctgacaaggccacgcaaaagcttggccctaattgcactgatgaataaaaggcaaggacgcaaggtaaccaaatctagaaccactaataaacaatatccttatttgttaaaagatcagaaagtaaattatactcataataatagttcagttcttcagtaatttatctccaagattcagtctcactatatttcacaatgttgttaaggtttaatttcttcagaccctgagatcaagtataattaatttcttagatcttataaagcacccatggatcaaaatatcagtattacttagatcttgtagtgacatgccagaataatatattcataaaaataggccaacattgattatattttagtgcaatgaaataaaatattcaatgtcctatagttatattatatatagagcaggtgatgcatagttaattaatgtctttcctattaagttatcagaaaatttaacaaaagaatactggaaactggaaaagggtttcatggataatgcaccaattaaaaaaaaactcgaagtcagctgttaccttacctgaatcggaatgcaaatcaagccctgcttcttgttgcttaattgcaaaatataggcttctgtgagccttttgagccaaggaatcaaagtaagaggaaattatgtatatgtaggtccagagttaaatgaacacagttattcaaccgatgtgtcatgtgctatcaacgagcatgagctgaactcaaatcttacagatcatcaatccaaaatacttgctgcatcttgcttaatgtatagccaaaagtctgcacagcgtaataacttgtgctagggtgtcaggaaagtgcacgagtctccttatggatggaagttaaagagacattaactgggattcttcatgtgctcagcctgcaaaacgcatacgtccctgccattgcaaaaacgacaaacaaaatattcagaaccaaagtggatcattcggccatcttggccaaaacatgaacatgtttggaatgacaattttcaagaacaatggaagtcagtaagataggagaatatcttacctgcacttcaataacttcaatgctaaactcagctgcataaccttcctggctaattagatgagcgcatcttctatgctcttccagttcagctttcccttttcaaacaaggtctttcatcttacttgccttcagttgttcgaaccttaacaatgaaaaacaatgcatatgccacacatattgattaactttagtacattgtacccaaatactcgctgccaaacaatattaccaaaaattaccttgtcattcatgaaatgtgtttagagaacatgtgcataatgacaggtaccgtcattcatatttatttactccactactgaacagtaattttgtaaattatttaagaaacata

SEQ ID NO: 3077 - DNA, 1501 bp, Oryza sativa
agctagtagctagctgtaatggatccggatcaaattaagcacttacaagcaaccagagcgaagggagggatctccatgggcttctccggcaggccgacgaggatcatcttcccgttgggcttcagcagacccagcagcggcgcgatcggaatgttggcagacaccgtgttgatgatgccgtccatggtgcccgtcgcggcattcatctcgtcggcattcttggagacgacgaacgcgtcggcgccgagccgctccagcgcctcctgcctcttccccggcgacgagctgatcaccgtcaccgtcatcccgaacgccttggcgaacttcaccgcgacgtggccgagcccgccgaggccaagcacgccgacgtgcttgctggggacgttcaggccgtggtacttcatggggctgtacacggtgatgccggcgcagagcagcggcgcgcccttgtccagcggcatggcctccgggaacctgaccacgaagcgctcgtgcaccaccaccatgctcgagtagccgccgtaggtgacggtgccgtccttgtcgacggagttgtaggtgaagatcacgcctgggcagtggttctccaacccctggttgcagctgtcgcaggagtggcacgagttcaccatgcacccgacgcccaccttgtcgccgcccttgaacttggtcacgttcttgccggcctccgtcaccacgccggcgatctcgtgcctgcgccatcgagtgcatgtttgtttgatcagaattaattcagaataatgcatcgtactccctccattccaaattgatctacatatagtttttttttaaggttattcctaaattatctgcatatttgtatttattcattaagtctattcgttatttatgcattggagtaaatgggcattgatgcgtgcatccatgcacatggatgcacacaagtatttataacacacatgcaatatcttaatttgctattagttagaaaatagtggtgatggtacatgcatcgagtttgttgttagagtaaatatagtatgagagagttattaatttttcttggtttttgtgtacctataaaatatgtagatcaatttggaatagagggagtatgtaacaacgtacaaaacctgtttgtaaagctagcttgcttaattaataattacccaggaacaagtgggtaggtggcgttcttccactcgttcttgatgctgtgcaggtcggagtggcagatcccacagtaaagaatctttatcaccacatcatcatctccagtgctcctacagattttcaagtaattagcacaaacgctatttatattgttgattaaagaaaaactctacgcacaggcaccaactactagacggcgcgtcttttgtaaaactttgttcatcattattttctttgtatgttcttaaatcatttttcagcttttcaatatcaatattattatttatgctctcaaattattatcatctttaaaacgaggcctaaaaacgtactcaatctaaactct

SEQ ID NO: 3078 - DNA, 811 bp, Oryza sativa
  unsure (1)..(811): unsure at all n locations
tttttatctttgcttgttatgttcttatattcagttcttgtgatgtttgttcctgtggtgttttaagacccagagggatcctactcctatctatacttgcttgtcatgctcttatcttcggttcttcgattttcttgccttttcttgactcgatggtgggaggaaaatggatgtggtgggaggggaaatcgctgggcgggatggggtttttctgggcgaatcgggaatttcttcactggatgcggcgcgaggtcacggtgtggcgaagaaccgaagcccacagcgcaggctcctttcgtttttttggccgcgcgtagactcgagcaaacaaggttctacgtcgctcagtatggatggacgtgaggagcctaacttggcacgggcgctcgttccatgtcgaacanaatcctccatggcgccccataacaccggtccagggtggagcaccctaaaagcctaaagaagctttggaattctctcctcttatggagaatgtatcattggttgatgtactatgctacgaagcactgatacggggaacagtcagcgtatccgtatcggatactccatcggatacgctccgatacatatccatacgtatcctcaatttttctgattttcaaataaataaagataattcggatacttcttggatacggctctgcgcatcctggatagtcccaagtcccaaccctaacaatacttcctccgtttcacaatgtaagactttctagcattaccgacattcatatagatgttaatgaatctaggcatatatatgtatctagattcattaacttttaaatgaata

SEQ ID NO: 3079 - DNA, 332 bp, Oryza sativa
ttgatattttctaaaaaaaaactttgggcaatgatccaccatgtttggtgctagaggtacttccatcatgttttaaagatttaactgaatatgcaattctaaagtgaatgatcaaaagcctctgtaatgaagttagcagtctgtgccagcaaaatatttggctataagaccaatatataaatatccctcttaaatttatggatgaattaagttgaatgaatatgtttcaaacgcatataaatatcaaaacacacatgatcaatgttttgtagttgtacatattattttttttaagttttatttgaaccttttcatgctctgacttagttagc

SEQ ID NO: 3080 - DNA, 1501 bp, Oryza sativa
ggaaggctaccctgttgtcgactacgagtcagaacttcagaccgccaagtcgacaatagttagataggctatcccaaatattgtacttgtgtgatccagatgaataaagagcaacaccggcttcggccaacaggatgtagggttattatctgacaattcaggggcccgaaccttgcataaaaatcctcgcctccatctcttttacctcaatctcgcatatatcctagtaccaacaatccccatactatgcaaatactggaatcgcgacatcaaacgtcgacacatatatcttagttaatctagtttggtatctcagtttacttgtatcggctaatattcgttttagggtttatgccagtattggctaaatcgctttaccagattagattagctaagatatccaccactctgaaaatcagtcaacggcttgattgtcagattaaaaagttgccaacaaccacttcgccagagattgaaagccgatgcagccccacgttaggtgccatgttcgatcggatgataaataaaaaacctcgggtggcgatgtgctgagagtagttgtattgatcgttgagatagtttacaataaccccgtgtgtacatatttatacccatggatagatacgagtacttcttggacaagaaagaaattttctaaagataaaaggaaaatataaagtccttatcgaacattaaacacactttcctaaacataaaaggaaactaacatactcttcctaattaatagataaactgtcatgccgcatcctccttgaactcggtcacttctgaataagcttcctttaatgaattaatttccctaaccaaatatagcaacaatccgactattggcgacttgataattcccatcggccgattctaggactctaaaaacgatactgactctaagccgatgatgacttcggggcttatcaaatttcaccgttaacaagatgatcaccgatgattaaaattgatgacgcagagcgacgaagatggtaaatctaatggttttattttatttgatcgaggtgttggacgatcaaattttgtctagacttatttatagttttgacatactatcaagaggggttatgacctaaacaaagagtttattaaaatgccatattagatcatttgcattgtctgaccgctagacccaagccggtctgatcggcatgtgttggctggtatgaccgggccccctctgagccagttggatgcccttggcttaacgatccagagccgccagagtcgaggccggtctgattgagcccctggaggtctaaccaagcctcaggcggtctaacaggccgacctatggcagtcagaccgtgctagttgtgcctgcgcattaaatgcacagtagtggctaactttctagctattacactgatgggcggtttgaccagcaggcaacagaggttggggatttcgaccccaatggctagtttttgtagatgggggtataaatactcccccatcagcagcaaggggattc

SEQ ID NO: 3081 - DNA, 1501 bp, Oryza sativa
tatcattcttttaaaagtatcttctcggaataatttcttatttccaaatattctcagatacactttcaataatgtagatatgagatattatgtgcgaatggccaccccaagataatatacttcaggatatgcaaaatcagttggagaatgcaaattcggttgttctctttcatccctcatatatgcatatgtttcttaaataatttacaaaattactgttcagtagtggagtaaataaatatgaatgacggtacctgtcattatgcacatgttctctaaacacatttcatgaatgacaaggtaatttttggtaatattgtttggcagcgagtatttgggtacaatgtactaaagttaatcaatatgtgtggcatatgcattgtttttcattgttaaggttcgaacaactgaaggcaagtaagatgaaagaccttgtttgaaaagggaaagctgaactggaagagcatagaagatgcgctcatctaattagccaggaaggttatgcagctgagtttagcattgaagttattgaagtgcaggtaagatattctcctatcttactgacttccattgttcttgaaaattgtcattccaaacatgttcatgttttggccaagatggccgaatgatccactttggttctgaatattttgtttgtcgtttttgcaatggcagggacgtatgcgttttgcaggctgagcacatgaagaatcccagttaatgtctctttaacttccatccataaggagactcgtgcactttcctgacaccctagcacaagttattacgctgtgcagacttttggctatacattaagcaagatgcagcaagtattttggattgatgatctgtaagatttgagttcagctcatgctcgttgatagcacatgacacatcggttgaataactgtgttcatttaactctggacctacatatacataatttcctcttactttgattccttggctcaaaaggctcacagaagcctatattttgcaattaagcaacaagaagcagggcttgatttgcattccgattcaggtaaggtaacagctgacttcgagtttttttttaattggtgcattatccatgaaacccttttccagtttccagtattcttttgttaaattttctgataacttaataggaaagacattaattaactatgcatcacctgctctatatataatataactataggacattgaatattttatttcattgcactaaaatataatcaatgttggcctatttttatgaatatattattctggcatgtcactacaagatctaagtaatactgatattttgatccatgggtgctttataagatctaagaaattaattatacttgatctcagggtctgaagaaattaaaccttaacaacattgtgaaatatagtgagactgaatcttggagataaattactgaagaactgaactattattatgagtataatttactttctgatcttttaacaaataaggatattgtttatt

SEQ ID NO: 3082 - DNA, 1501 bp, Oryza sativa
aaatggataaacacaagctcaagatagtgtgagagtagatgcaagggatgtatgtaaataaagcaagtgccaaaagaatccccttgctgctgatgggggagtatttatacccccatctacaaaaactagccattggggtcgaaatccccaacctctgttgcctgctggtcaaaccgcccatcagtgtaatagctagaaagttagccactactgtgcatttaatgcgcaggcacaactagcacggtctgactgccataggtcggcctgttagaccgcctgaggcttggttagacctccaggggctcaatcagaccggcctcgactctggcggctctggatcgttaagccaagggcatccaactggctcagagggggcccggtcataccagccaacacatgccgatcagaccggcttgggtctagcggtcagacaatgcaaatgatctaatatggcattttaataaactctttgtttaggtcataacccctcttgatagtatgtcaaaactataaataagtctagacaaaatttgatcgtccaacacctcgatcaaataaaataaaaccattagatttaccatcttcgtcgctctgcgtcatcaattttaatcatcggtgatcatcttgttaacggtgaaatttgataagccccgaagtcatcatcggcttagagtcagtatcgtttttagagtcctagaatcggccgatgggaattatcaagtcgccaatagtcggattgttgctatatttggttagggaaattaattcattaaaggaagcttattcagaagtgaccgagttcaaggaggatgcggcatgacagtttatctattaattaggaagagtatgttagtttccttttatgtttaggaaagtgtgtttaatgttcgataaggactttatattttccttttatctttagaaaatttctttcttgtccaagaagtactcgtatctatccatgggtataaatatgtacacacggggttattgtaaactatctcaacgatcaatacaactactctcagcacatcgccacccgaggttttttatttatcatccgatcgaacatggcacctaacgtggggctgcatcggctttcaatctctggcgaagtggttgttggcaactttttaatctgacaatcaagccgttgactgattttcagagtggtggatatcttagctaatctaatctggtaaagcgatttagccaatactggcataaaccctaaaacgaatattagccgatacaagtaaactgagataccaaactagattaactaagatatatgtgtcgacgtttgatgtcgcgattccagtatttgcatagtatggggattgttggtactaggatatatgcgagattgaggtaaaagagatggaggcgaggatttttatgcaaggttcgggcccctgaattgtcagataataaccctacatcctgttggccgaagccggtgttgctctttattcatctggatcacacaagtacaatattt

SEQ ID NO: 3083 - DNA, 1501 bp, Oryza sativa
gctggagtagtcgattgattccccacttctgtgttggtgtgcgctgacgtgccaacgtcatcgatagccaatacctcccgcggcgcgctcgttgtcgatgacccatagtcctcaaggagatgtaagaccgatggtttgtgaggatcgatatcgattaccccaacgaatcgatttgaagttggagtcactctttgttacttgctgttatccctgatggggacatatgacttaggagatagagctttcatggcgccgagaaagactttgcagctcgagaggtcgtgattctttgtcttgtgaataggacaatagacatcccgagttggagaagtacgctgaattccacgttctttgcaggcgcgaatttcagcacagacgttgaggaaaacccagcaatcttgcagagtgtgtttcttggttttgtggataggacaccaagaccttgtggcttcggaagtcatctttgtcggctcgtggttcatgtcggaaggacaaagtttggccgtatcagaatccttctcgagcttggatgtcgtcgatattccgttctccgtctcgatgggaggatatttcgacatggaatcgccttggttcgtagccactgcgttctcgtctccggtcattggaggaccggttgagatcggcgtcgtggtgtaaaccgggaagacgatttcaccgacttgagtccataccagcattgttgaagtagtgagtacttggctgaggctggtgctgacgttgttgtcgacgaagctggatgacatagtagtagaaccttgagtaccaaggccccctacctggcgtaccactgtcgacgggtgatacccgtagaccggatatagagggtattggggtacgttggtacaaggatctacgtagtacgacatcaagcaaacaaaagacaagaattatactggttcaggccccttgacaggtaataaccctaatccagttgatgtgggattatatggtagaaaacacaggttacaaagggaacaagggaacttgtcggatccggcgagattgtagtcgagttgtttcgactagctcccgatgatttggctccttgtaggttccggcttcgtaggctgtgtaggttgtgttggccctgagattcaatgccctaaaccttccccgggggtcccttttatatcgcagatctagaggtcttcacgtagaactcgcatgtatcagaccctatacgatacgccaacgacccagttctgtccgagtaggactcttctcgtctttagactccgtgaaaggtttccttagaatatacaggaaatatccgcatgcgcgtgggtatgccatatcgatatgtaacgtatatcgaagggtaaagggtatgcctaacccgtaaccctgacactactatattctgagacgaaaggagtattaatttctagttttagcatcagctctaggctctagaataatcttgaattcatctatttatcaaaaaacagaaacatgtaatgcatttgctttacttttctta

SEQ ID NO: 3084 - DNA, 1501 bp, Oryza sativa
ctcaaattattacaatcccaataataagagttttctgaaatttaataaaaataacattgttgactaacaaataatataggtatccacccactaatattggtctccatgacgttgccacaaatgttcgatgagatcctcttgcaaccggttgcgaattgtcttgtcattaatttttggatgaggaaatcagccacctgagtagtttttctctcttcttaatcttcaacatcttcgatcacgccggccacaacttcattgccgccgtggagctcgcccactccatgtgccatggacaagctcgaccatgccttcaccgttgaggggatcacctgaggtacgtggggccgacaggatctagtgacggcggcctccctcgatgccagatctggtgatggcggcctccataggtgcacgggagggggctcctagtgctcctagagggacgagagggaggtcggcctgacgctagatcaatctgagctgttcattttgatcagcagctctttttcccttccccaccacgaactgcctctccccctccgccgctccgtctccgtcctccctgttccctcaccggcggtgcctctccccctccgcccctccctctccctcgccatgaggttgcaggaggactcgacggtggtgggcggcggcaagcggcggatgacgtacttaaaacccaactcaaatacggatctggatttccaaaagcaaacgaacataaaaactgggcacatacacggatgacgtaccaaagtaccagcaaaaacatcttcaatttttataatagtagagatagagattttcccatcggagaaggattgaagcgggatcgatcgcacgcgcgttggatgattttttttggtgacggacgaaaattctcacccggaagccttacatatttttttaagtaggtatagatgtgtaacaatgaataggaaaaaacggggcgtgcgccatatttctattatccttgtaaccttacatattttaatccaccaagaatgttctgtacaacttgaaaataaaaatatgtactgcattgtgaccttgcagatagaattattttagagaccttggttcaatatagtgctgcataatctagagttgacacttgtttatgctgcttgttgctcgctgttgctgcacactcccagggtatcatttgaatgctatttaatgatatgttcatgctcttgtccagagtcaattcacaatcaacacagatgctgatccagtgatagctgcattttctgatttgctcaaaaatggacagcggcagatgagatacaggctaaagaagaaatatttcaatggtataccagcaaatgaagttagaacaacttcaccgctaagctctatgactgacaatgagtggaaacaactcgtggacatgtggtctaccccaaagcataaggtatatctttccttaatatctatcataaatgttgccttacaaaatatgaattgtctgtccagtaatgtttgtctttctatagga

SEQ ID NO: 3085 - DNA, 1501 bp, Oryza sativa
cgagccgattccgttttcgtaggtcccgacaacaacagagacacggtggcagcgacgactgtggtacaaaacgtgaccagaactcgagactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcaacactcaaggctattgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagataaaccctattcctgcaagcaaatcgaagaaacaagcaagaacaagataaaagcaatctgatattgcaaataggaatttaatacaaatgataagttggggttccaaagaacaagcagacggacggtctagccgacacgcgcgctgcaagcaagtagcaatggctaaactttaatctatcaaaaacccaagaaaccctgaaggggtacctaactatttatagaggtgggaggatgaccaagagggtccaagggtcatgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcgtgctccacctggctggggcgcaccccacatgggccccacctgggccggggtcccagacgaagttacaagcccataggcccattataggtgacgcagcaccttgttgcttcaattgcggctcaataagatggaattttgcaatgaggctggatccattggaaagaggactccaagagctttccatcaagtactcacgggccgaaaacggaggtcgtatgcagattcggcagccgtttgaagtcagcagtgtagtaggtggccgaatcggattccagcacttggaggacttgatcttgatatcttcttgttgattcatgatgtgagcaatggtcgtatccatagtagctatggtcacatcagacatgagttgggaaacttcggtgtacttttttttccaaaagaaattagggaaggcccaaaaagtaagatggaattgaacgggatcagatcgtccgcgtgcgagccgtttcgatccccctacctcctcctcg

SEQ ID NO: 3086 - DNA, 335 bp, Oryza sativa
cgaaaaaattccaaaaaatctcaaatttcgccctataaatagggcatgaaccccagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaa

SEQ ID NO: 3087 - DNA, 1501 bp, Oryza sativa
atgcaaattctcgactctaatgaaacgaaacttgtgtttgcagctttttgtggagacgcagatgttctctgttctatcagattctcgactttccacatttgagaatgaactaacataaaacggtttgctctagtcagagatcaaagtaatcaacttccccggtttgtggcgaaaatttccctgtcattagaacgatcgggcaatgggaagaaaaggcagtccggaccgagaattgagggttagactgcgcaagccccagaagtttccgttcaatgctggagcttaaaagacggatgaatcggatagtctggacatgaaaaatgtgtgatgcaacccagtcttttaaatgggatgcacctgtcctttgggtttgggaaggtatacatgggatggaaaagaaatgtttcaatgctgcattacagttatatatatttttggttcctagtattctcttcgttatacaaatcagcgtatatagtgaaaagaatcctgtaaataagatagcttattcattgcagtgcgcatatacccggagttcgggttaggtccctagttcgggacttcgggtgcacaagaacgtcatcacagttattagttgattataatgtattcatctttcgtagctttttcgaagggtatttgtaaatatttcaaaccatgaaccatcataagttattactccctccatttcataatgtaagattcggaatcttacattgtgaaacaatgtaaaacggaggaaacggaagaagtaataaccttgactgaatgacaaggcaaggacgcatggtgaataacatcgtctcaatttgcaaagcagtataacttataaggctatgcaacagacattaaccaaccacacctcacaacacaagcacgcaacagaggcgtgatcacgtgacaaaattgcacctcgttggagcagagatcagcaagcttggtgatcaccaaggatgagtactcttatctgatcacaaccgcggcgtgactcgagtatgaagtttatgagctgcaagatatcacgcatcaccagagaggacagcctggtgatcattagaccatgattgagctacatgctatattgacgctagctgttcacgtccaaacctcagggcggcagctactcttcccctacattgcctaatttgccttgcacagcaacatcttctcctaacaagaaaaaaagaagacacgcagactcccatctctgaagccccaaaaacagagtcttccatgcacacaagaaacaaacaaattcgcaacgtgcgtttcgttgcagattcccatttgctgggattaatatccagtagtgtgcacacacacacacacccgtacatcgtacaaaatccgtagtactttgcttggctgcatctgcattccaagcctataaataccgtgcgcgcgatcgccaatccagagcacacgcagcaagcaaaagtcagtgatcagtgagtgacctcttgctaaaacgcacacgaattcgcagagatggatcgccgcg

SEQ ID NO: 3088 - DNA, 1501 bp, Oryza sativa
tataaaatatgtctttgatcttatttttctattataatatatataactagcatggtggcccacgcagattgtgcggctagcatcattatattttctctcatataatagcatatatgttttctcattatattattaaaatatattacaatgacaacataattttaaattttgcaataacttttcaaaactactaatgtgtaataactactctagtctactcttctaatatttcttattttttaattctgaatttcagctatttctaaattgtatttttatatagactctgctttttctttttctccgattaatgtgagaatttctaggccatgagagcgaacatagagtctcttttttctattcctttaattacataatagataaataaaagcatgtttacttttattacattgcattgaaagacaaatctatatatgatgttctaattcctttaaactaaatatttttaaagttattgatggtcaaaattataaaagtttgatctcaattaatatggaaccggagggagagtaataccaagcgatgatcgtgttatcgtgttgtttaacggagctctgcgtgagactgacgacaaaatttgttacagatatccatatcttgattgtaaaaattcagtagtgtttgcttcaacaacactttcttttttcagttttctatttttgttttttctctctcccctagcataagccggtctagctgattgcgtcgtgtaaattaaattcttttcttctaatatattgacgtgtaatctttttgcgcgttcgtgaaaaaaaaagcttcaacaacactgcaacagaccatacacgtccttagcatgttgcaaggaaaacaagcacagatgatgccgaggactggacaacaaatcgtcgactttgatcactggtgctagcttaatttcgagcttagcagcctgcctgaataaacattcggtagtgctactcacggttcatccccagtgttttattacgtagctccattagctgtgacacagaacaggtcaagttttaattttttttttccatattttcatctgagagcttgtattcaattctatcatatccttatccatcatgtcgttcattaatccccaaaaccagcacctaccagcttgctatacgcacaagtacccggctaattttccaaaatcacaaaccacaccctactgatctctagaaacttcaccgataaccgtaatatggcaaatccggaggggtgagcacagcctcacacgatcacattcgtgactcactcgaaagagaaagcgagagaaacaagaaaagaaaaaaaaaatatccccatgtgttgccaactcgccaccggccacacccggtgtctctcgtgcatgcgctgcgctgggtgtatatataccggcctctctcccgtcccgtctccgcaccacacaggcagccacacacacaccactccatttctgagctcttctagtttgagtgagagagcagcagaagggagtagtgcaaga

SEQ ID NO: 3089 - DNA, 1501 bp, Oryza sativa
ctcctcctgctgatatgactcctcaaattgatttctcagttctctttacagtcctacatctcatgctctcttcttatcaaccttacataactggtggaaacctctacttgatttttctgtggtgcatggtcaatcaggtctgaacatatgaggttacaaatgccttacctgcattatgcttctgaaatttcactgttagaaggccatattccgttgattcagaactttttttttgatgtgcaggcctgcttggaagcacaaacgaaaggatcacatatgtatgtgagtatgtctatttgctaattactaccttttcctgcaaatacgcatacaccacttggatgtagatacccattctgcattgcttttcatgttaattaacttgattgggtaaatgtttactacattgatcggccggtatctcagagtacaatcaataagtgactgaagataattcattagccttttatgtctatatatgatcataaaaatggctgcagggtgcatcagacaagcaaaaggtatatggtaagtgatggcacatttcttagggaagggatttacgagttcaatgtcaaaatcctctctatcagtcgcctcacattttcaacttacctaggttgcttccctatttttagctacataagaactatatgtatgtcaccccatcagagttatttatattcacatgttatattctaaatccatatttgttgagatgtgttctataattgatctctatgcagagtatcctatcaaaacattaacaatgttagaccgtacttttagtgggtgttgcatgcagttattattatcaaagctatcaaaggtattttacattgttacatctccttcaccctttataggtttctatattacaaatgctcatgttattgttttaattctttttcgaccagtacaacctgattagctattcttactaattctatattacagatgctctgtgatattaattgtgatcctctttcattatacaggtatgattccttctatttacattttaaatttttttatccgatggatttgttttgcctcccttttactctacaattgataatttacatggctattgttccatacgcaggaaatgcacggacagcttgtaaagtaaacttgatgaagagtggtttcctatctccatcaaagtttgtcaaattcacttgtctgctgctgtattgtattgcttacaagctatttttcttataccatcatcccatacgcttagatgcatattgtacacccttgcctcatgtaatcatgtttgcagatatattttggtacatatatagtccagtgactctacgagcaactcaatttactactagaaaaaagatacccagtgttcttctcctttttatttaaatattttagtagctttcattttctttacaaccttacaagcaaaatgtttgatcttgatcatggtttagaaattggccgcctcttcgaaatacaaggtaaattaaccaaacattgacct

SEQ ID NO: 3090 - DNA, 1501 bp, Oryza sativa
ttaaataaaacgaataatcaaatattaaaaaaagtcaaaacgatcggtaatataggacgaaggtagtagagtttactcctactcagtacatattaagataagatcatgttgtcattaccggtaaactctggcttcgccttgcatgtgatggggcctagcttgacttgcccctggagagaactgtatgatctctgcaatacgatcgaactgtttgcattgcaatgcacatgtgtatgcgagaaaagtacttcttagttatcacctgatccaatcacaaattggtgataaaatgaagtggatggatctaatctaagtcgttgccttgctggatgaggatttcattaattgcgtggatcaatttgttcgcgcgagctttgatctgatagggaaagatatttttgtatatcattaagtgtatttaaaataccttggagaaacttgaatgtgcgacaatttccgcgaattatgagctggctagtgctcttggtcaaatatttggatgtgcttctgagctggagaacttagcttgtttagttaagacataacaattcaaggcaatttggttaggtggcactatcctatacttaagccagactaaattaagcattgtttccataaatatgtcgccatcaattaaagaaaatggagtaggcattgcccttttccctataagaatttataaataagcaatgcatatttttgtacctgttcttaaatgaaaacaaaagtatccataaggcataaaccacaaaatgccatctctttgccacctgcttcttcagaccgggtttcttgccgatcttcttcgccatttttctgatgacaagtagtacttgactaccttttccatctaatacattttttttctggaagggtggccgttttcatttttttttaaaaaaaaaattccgggctacaaataccaagctttgattctttttcccatttttagagaaaacattgagcactgatgattttgccgtttagactttgacgtctcctctctttgatacggcccattcagatcgaagatgagtactccagcacggcccacatatgacacttcctgggcttgctatctccgtgtccatccacgcacttacggggacgcttaatgcgtgactgacggcaggcgcgcgacgcccccagtactactgctactagtagtacactaggaaccagttattccctccatctaattttaatagttatatttctaaatttaaaaaatttaatttagatagtcatatttcaatctaacaacctatactcttaatgactttttcggatttaatacatgactctctattcttccacacaagattggctacatgggcatcgaaaaatgtaaattttaatgaatcgcttgtttacgagatataactattagcatgtttaaatggatgataaatagaattacttatccttggtctgtgtgccaagataaaatatgactataaaaagtaaatggatggagtatttactaccagtattactacta

SEQ ID NO: 3091 - DNA, 1501 bp, Oryza sativa
gcaatctacaaaacaagcacaacttatacacatcactgacaactcaaattcagaactagaactagagttacataaaacccagaactagagctagctagcatcaaagtaggagctgctgtttttcaatcaaatagaaggatctcatcatcaaatacattataacatgggtacagaattaatcacccaatcagttcatttaacactagacatattagtgcttgaatagctatgataaacatgttttatacaagtatcatgttgaggaaaacaaatctgttagtctaatgagactaaaagctactgttgttagtttaaaataaatcagtttaagtatacattactgtatatactactgcaatttgttgctagtttgtttgtgaaacaatgacgatagaattagtttacaattcagaaatgttaaactaattacagagtacctccatagctctacaatcctcaaaatcaggacaccccaacccttgtaatttccaaacagaaatataaccaacaaccacaagttgagactccggaagcaccaagaactgagtacttcactgtaaaaacttgtatagtcaattttacaagacatgctcaggcaagcatcacagcatcagttacactaagcaaaactaatcaaggcaagcatgtttccatagccaccgtacagctctcgctctcaccatctgctgcctcaaagccaccgtgaatcaagaactcaaatcaagaaccagagttgggcggtgcggtggcggcggcaaatcaagaacgcatccccacccaaccaagaaaaaaagctccacgcccaaatcaagaactcaccagatcgagcaggatacgaggaggaggacgatgaatcgctaagcgctcactcaccagaaagctgcacggcgagaagagagatggcggggacgacaggaaagggagaagagaagaaaaccctaaccctagctttgcaagaggagggaagaaggggaaaggcagcgtgctcaccggagagaaggtggcggccggaggagagagccatgtcgtcgccgtcgccgtcgccgtcgcctccgggtcgcgccgcgcgccgccccctccgtcgcgtcttcgttacgccgctgcctcctctcgaggaaattttccacaccccaggagtagatgattttttcccgggcctagagaagagggaaaccccgtggtgggccgggctaaaattcacggcagggcttaaccgaacgcacaatttcgcatgggccgggattttttcctcgccggggtgatccacagggattgggccccgatcccggcctggaacagcccaaccgaacaaggcctaagagaaccatctagtccaattcctcaggccaaggccctacttccaacctcggtatccccctcccgtctgctgagtgcttatcagagatagacaaagacaaaactttgacataaaatggctgttatattaactgctgtatcatgacccatgcttcagtggctagcaaacattgttattaaatca

SEQ ID NO: 3092 - DNA, 1501 bp, Oryza sativa
atatttgtttgtattactatgatttaataacaatgtttgctagccactgaagcatgggtcatgatacagcagttaatataacagccattttatgtcaaagttttgtctttgtctatctctgataagcactcagcagacgggagggggataccgaggttggaagtagggccttggcctgaggaattggactagatggttctcttaggccttgttcggttgggctgttccaggccgggatcggggcccaatccctgtggatcaccccggcgaggaaaaaatcccggcccatgcgaaattgtgcgttcggttaagccctgccgtgaattttagcccggcccaccacggggtttccctcttctctaggcccgggaaaaaatcatctactcctggggtgtggaaaatttcctcgagaggaggcagcggcgtaacgaagacgcgacggagggggcggcgcgcggcgcgacccggaggcgacggcgacggcgacggcgacgacatggctctctcctccggccgccaccttctctccggtgagcacgctgcctttccccttcttccctcctcttgcaaagctagggttagggttttcttctcttctccctttcctgtcgtccccgccatctctcttctcgccgtgcagctttctggtgagtgagcgcttagcgattcatcgtcctcctcctcgtatcctgctcgatctggtgagttcttgatttgggcgtggagctttttttcttggttgggtggggatgcgttcttgatttgccgccgccaccgcaccgcccaactctggttcttgatttgagttcttgattcacggtggctttgaggcagcagatggtgagagcgagagctgtacggtggctatggaaacatgcttgccttgattagttttgcttagtgtaactgatgctgtgatgcttgcctgagcatgtcttgtaaaattgactatacaagtttttacagtgaagtactcagttcttggtgcttccggagtctcaacttgtggttgttggttatatttctgtttggaaattacaagggttggggtgtcctgattttgaggattgtagagctatggaggtactctgtaattagtttaacatttctgaattgtaaactaattctatcgtcattgtttcacaaacaaactagcaacaaattgcagtagtatatacagtaatgtatacttaaactgatttattttaaactaacaacagtagcttttagtctcattagactaacagatttgttttcctcaacatgatacttgtataaaacatgtttatcatagctattcaagcactaatatgtctagtgttaaatgaactgattgggtgattaattctgtacccatgttataatgtatttgatgatgagatccttctatttgattgaaaaacagcagctcctactttgatgctagctagctctagttctgggttttatgtaactctagttctagttctgaatttgagttgtcagtgatgtgtataagttg

SEQ ID NO: 3093 - DNA, 581 bp, Oryza sativa
cacactgtcacactatgtgtataaatgatagaaatgataattacctagcagcattttattattcagtctattcaaaagtcatgtgaccttaatccatcctctattcaaatttcgatgaatgatttttttagatacgtgtgaccttgagttgcccttaatttataaaacatatcttatgaacaaaatataatcttttatttaaataatatggatgcccacacatacgcgtgggccaccttcctagttattaagaacaaccgaatcagtagcgagttatataccgtgttattggaggaagtcttaatttagttaattatttgaaaaccctggttaaatgtgaaatagagaagctcgacgacaagttttgagatatactttattatttgatgacaaattatattgccgagctataggatgaactagaaaatccgcgcgccagttggcgcgctaactaatttgcaccttggtttttccatgtataatattttatttacgtaaaaatcatacacttatcccttaactggatgttattattattattattattattattattatttcatatataatgctttctcaga

SEQ ID NO: 3094 - DNA, 1501 bp, Oryza sativa
caggcattaaccagagtacacagacgacaattcgatacagtaccacgtcttacaaaaatataaaataaactcagaaaagtagcggaaaaattaaagaccatttaaacttaatcttctcacgaaagcgaagcttcctccataatccacacgcgaaacctcgacgtctggcacaagcctaatcttcatagaactcaccatccgacaaactctctgccactgggggattgggaaaaataaggcaagactgagtacaaccaccgtactcaacaaatcataccaaggttaatatttgtagtaaaaagcagcattcataaatcataagttgaaagcagtaaaatagtagataattaagcaatattaacctcatcactgtccaacgctaaaaccacgttgcgacaagcccagcccaaaccacctgaactacactagttcattaagtcaaattattaaggtgagactaatcatgataagctagttgaccgcccaataaccgtgggcaaggctattcgaatagttttactttaattagaggtgtacaactttatcgacaagacacgattccacacatattaccatgtcccgaagtacctccacgatactacaaagggggaaatagtgacaaaaccatccatataaccacccctaaccaacacacccaccaccaatttcacccccatccatatacaggcaatgggcagtccccgctcgtgcctaggtaaatccagaagcagcatagacgaaaatctaggtccatccatactccatcaccccacccttgccaacggtgtgttcgctagaaaagattatacttaagattcaaccttgagcctatctggcctgtggttagtacgagtatatcttcgagggattcccaagaaccggtcgttaattggcatgggcacgaccaccaatcaaatcatgcatgtacccacaacccaccaatagagcatatttcagttaattaaccatataccaggatggtataacatcatcataaaaaattaaggactaaattataatgaatcccaatgtgaggtaattgatctaagcattcctaaaccaatcatagagtcaaattattatcacaggctatcaaataaatcagggtaatcaaaaggctaagtacgggtaaattccatcccacatgacattataaaataatgcatgttttaagagaaaagcagggattttgaagataggctcaatatgatcaatgatatccgtatgacttgccttgctcttgagctgatgggaccactacgatggatcaggtcatctctgacgggctcatacccttatctgtgatgggttaagcactggtcacagatcagtgatcactgatgactcggagtcacctgtgacgggtaaagacccgtcagaggtaagagttacctttgacggattgcaaattaaaatatgtcataggtaacgttcacctgtgacggaggggtccgaattgggaccgccatctcttcctcctatagcgcccgcgtcttcgaca

SEQ ID NO: 3095 - DNA, 1501 bp, Oryza sativa
gacgattggtttgtgctgcactattgccgcaatactcgtctcaccagagacataaatttcatggctgcactcataccgcgacttcaaatacaacatgactatgcaatgaccgagacagggacacgcatgtgaaagcacggcattgagagtctaaatttgggttgctgcataattatgaactgcttgatctctaaaattgtaaagtacttgatctctgaaattgtaaagtagtgctgcctttagtcctaaaattgaagttacttatattcagcaagatcatatgcggctctatttgatttttctattgcttggaagtaagaaaaatgtgtttttcaaatgattcctgctattcatagtttataggccaaagttgtactaaatttaatgtgtcattttatgcataaattctgatgaattcaaacaagtaaaataaattttaagattcatcagaattaattggttcaaatatatttacttgtggatttaaatttttgaaagatcaattatttattatatttagagtttttttaacatatcctgtgtaacaaaaaaacacaatcattttttagctgagtaggtattaatgatcctattctgtgatataagaaaacaagattttctttttttctttgttttggattttttttgcataataatgttgggtttaccgtatattctagagttatatgaatagtaccgagtagacgtaggatatttaaagaaggaaaatgaatgtaaattcgttattttagatttgttttttcttaataattttaggtttattatatattgtagagttataggagtagtaccgagtaggcgtggtatatttatagaagacaagggagtagaagttcgtgtggttggaaagagaagatctggaagccgaatctatatgtgatatttttctctagattttttctcacatatgattgttaggtgtttgttctctagtataaatttataatttttctccaaggtaagaggcgccaagtggaccaatcaaaagctagcaaaagtgccagctttagattatgagattttgcagtaaatgggccggaatgttccgctttcggccctacaacgggacgggatatacggccgtaaaagagcctgctgacaggccataaaaggcccacagagtatcgatacaggggcctgatggtccgaaatcaacataaaggagaagggataagttcactttaggtccctctatttgtcgtccagtctgattttcgtccctgaaccgtaaaactggatacaacccgtcccccaacttacgaaaatgggtaaacgaggtccctcggcggttttgatagtggttttggctgacgtgacgcatacatggctaatttgactcggtcttcatttgacgtggcacagacgtggtgcttacgtggcaatttgatctaagaaaaataataaaccttgtgaaacccacatatcagtttcacacataaattaataaaaaaagtgggacctacgtgggccccacatgtca

SEQ ID NO: 3096 - DNA, 1501 bp, Oryza sativa
aagacgaatggttaaacatgtgataaaaagtcaacggtgtcatctattaaaaaacgggagtagaacttttttttctgtgcctagtatcctcttaagctttgattggaccttggaatcagacttcagcaggtgtctgccttcgcgtggcccttgaactagagagcccaattattaactgggcctttgtttgggccttatacaatctacagttacataaccaaatcaccgcgaattgtacacatacgtagtgaccagtgaccacatgtttgatttgtacttgtcaactgacatcgacctaaccaatctaacgaagtaactatcactgattaagccatatgtgaccaaattaagaaagcttttatcttagagttgcagcagcagccgctatactggacctgtccgagagagtttctaccgattacaacttttctcataatcaaagactttatgaaatagtctaacttttttatctagattttaagacaatatagttatagaatttagaaaaataaactattagtcaaaaactgaattttctagtttattcatattctcataagttagactatctgtcaattctttctaagaatcacaatgaacatttaaaaaaaaattaggacagtctttttttccttgacctatggtggcttttgagcagcagcagagcggcggctaggttgtaccgttgtaccgttgcagcctaatatgccacagctatcgcaaatgataagccagcctgagaatcacatgcaggcttcagaagtactcctttcgttttcgttctaaattagttgtctttttaccatttaaattttatctcataatagttatcatttttaagtcaatcatatcttatttaaatttattcttattctaccctcaattatgcttatatgctcaaccatgcattatttgtattatagttttcgatcactcgttctcttcggtttcagtggagctgaagtccatctttccggaagaccgtttgtgatcatctgctggcattgctgcttttggggacttgctgggagtttagtggggctccgccctctcttgctctaggagtttttatcctctttaactagtccttaaacaattcttttccggttttttcttcctcgtcccctggcaatggctttctagccgtttatgttgtgtaaccaaaactctgctttcttctagtatattgacgcgtgaactttttgtgcgttcatgaaaaatttgataaaggcattataatattttactccaaatcttagcatgtagtaccaaaaaatctagaacgtcaactaatttgggaaggaggtagtagtatttgtaggtttggtgcagagcaaccggtggcaggttgcgtgcatcttcagaaaagaaaaaaaaaagctacttcctctatttcatatcataagactttctagcattgcccacattcatatatatatatatatatatgttaatgaatctattaacatatatataaatatgggtaatgataaaaaatctt

SEQ ID NO: 3097 - DNA, 1501 bp, Oryza sativa
tcctgaaagctttagcttgttataatttttagttatttggaatattattcttcatggtgtattaacaacaaaaaccatctatagagggctgcttactcacccagcatcagagtagataccaagctttagacctttcccatgcacatagtccgcaagatctttgatgccagaagggaaagtttttgggtcaggtagcaattgatcctacatgcacaggaaacaatgtattaaaaactaaagaggtaaacttgtaatgcatgtatttatatggtcagtaatgcatttgtatttgtatcagtacaaccaaagaagactgttctgagtgacgtcctgtccaagctcgttaaaattatcaaaagaccaaagcattgacatatttaggaacaaagtaattggagaaatcacagcctaaattagcaaatgaaatgcattaccttttttcctctttttacattggaccaacaatcatctgaaaaggcaatgaacagcaagtaaattagaggataacaacatacttgcttcagccagtaatatataactcttgagccaagtaatgtaccgatatttacatagttgtagcccaaatcagccagccccgtcgagactagtgcgtcagctgtttcatcagatagaagaaaactttcattagaagtacatggctaaccaaactctactcttaagtctgaacaaccgaaaacgcattaggaacttgtcaattgttataaccaaacacgacatgagaacatgtcacttgaacagtgggtagtaacaattccattccaatatccaacctcaacagtgttctattctatcattgcactctgagcagtggaagtgtggaagatacaacactaattaaggaaatatgtatcctccaatttccagttcagacaaggacttccaccatatcaggggaggaaaaaaaaaactgcggtgcagaattgcagatttaaccatgaaaattaaggggatcccgcggctgaacctgtgtcgcggatgaccgtctcgttgatgttgcaggcgaagaaattccagctgttccatctgcgccacagaaccacaggcactaataaatcacgcactcaacgcagtgaacgacgatgaattacacgcgcacgcaacaggcgctggacaaagcagcagcggaaggggaacgaagcgaagaggcgaagcattgggccgattgattgaacttaccccatctgcggggtgagggcgaggccgttgttgagctgcagcttgccgtagttggaggtgtcgtagaggcggcgcagcgcggcggtggggaggggctcgatccgcattcggctcgccgccgcggcgaccgccggcggcgagacgacgagggccaccagtaggaggaacgggaggcggaggcgcggcgcctccatcccgcttcgcgaagcttaccgaacactccgattccttcctccctccctccgaattccgagcagccgtcgttgaaacagctgtgcaggcgatttccgagctcgttacggct

SEQ ID NO: 3098 - DNA, 1501 bp, Oryza sativa
gtgacaggcaatcgtattctgagccatttttatccattcattcatttactttgtggcctgtagtatacgagtatgtcaagatttgtttaaccatcacttttaagcagcaccgattgatgtggattcttttttttctctctcttgcgttggtgattgatggggaatttatataaatccaccacaccacctccaactgtgtacaagggacttgtgagttatagcaagggcgttgtcgcatgaatgtacgatgtattataagcttgtattttcttatgataacatgtttttttctggaggtgaacgagcatacataaggaaaataaattacaaaaacttattttcctacacgtcaaataacttatacgtcaaacagagataggccgatagctacatcattataataaacaaaaactttaaagcattaaatattttgacgtgttttataaaaaacaatctagacgtgcatacataaggaaaataaattacacaaagggcagctaaccatgtcacacgatgagttggcaatatttttctgtgcttaagcgtaagttttgagacttttcgacatgacatacactaacaactagggggtttggttaattggcgcgccagcccctcccccacgcgatttttttcttttttttcatgaaattttttctttaccttttacactttttctgattatttttttaatcttcaacacacgtgttttcaaatgttttgaatttaaagcttgacttaaaaatttttaaatcttgacttaaaagtttttaaaccttgagttgaaaattttcaaaatttgtcttgcaaatttaaattttaagagaaaaatttcaaagtttgagttgaaagattttaaaatttgacttcaaagtttaaatcttaagtcaaaagttttcaaatctaatttaaaagttttcaatctattagtaaaaatatcccaacaaaaagataatcttctcctaattatgccattatccttaactaactagttagttaggttaactcactgaaacatgcgccggcggcgcgcacgcgctagctagctttcccgaacaactagtatatccagactaaaatggatcaatagtaatagtacagagttactccatccgtcgcgcgaaaaaaaaaatctagaactgaacgtgatatattttagtacaacaaatttagacagatatatgtctaaattcatagtactaagatgtcacatcatgtactatgttgatttgggatggagggtgtggagattatgggtaccccatacccacacggcatggttatccgactagttataggggataacttatatatatgaaatatgtaacagattatgacttgggtattacgtttccctgtatattatggaacggcctaaagtcctggtttgataagattgtaaagtagatttaggaaaccgataccgtgttggttaaggtttctatcttgtaatcatgccccccatcctatataaggtgggcaggaggccctctagggggca

SEQ ID NO: 3099 - DNA, 1501 bp, Oryza sativa
agggcataaattaaaggctaaccacgaactggattgataccagccggcaaaaccatgtacaataaataactacttcatcaaatagttgttaactaaactatgctttaaattaaactatgctttcaaattaatcttatcaaaatcttgccatttcctctaagatatagaaaggcgttgtcattggcatgatactaaatctgttaagattcgattcacacatgtgcaataatgctaatctaattctgcaaattcagcagcaagctatactatgcatacatgatcgtaactaattgacagagcagcaacattcttgttccatatgccatgcatatggtagatttttccctcgaatccaaggaggaatgacacatatagagttaattacactatggtccaccttttgttaccaaagttttattttgggctatcctctaactcatattttcactttggacctttggtgcacttttaaccacccaaagtcattttatgtagctgcatctactctataatattgtaaagaattgcccgtgtaagttgaaaaagattaccggtttacaggttgctgatgtgtttaaagttggaaaattcatttatgtattcctaaaaagtttatggggtggtccaaagtgaaagaaaggtaaagtaacctagcccaaagtgaaaaaatgtgttaaagggtggtccaaagtgaaactttggtaataaaaggtggccctaaacgcaatttactcacacacatatatataccatgaaacttttcaccatacatctatggtgtcacatatgcacattaatttatcactaagaaaattcaaacccacgaaataaaaaaaagataaatttagctgtaaattcttttccacaacttttataatctgtttgaataacattatattttggggggtgaggaacatatgcatgcaagggacatcttgctccctataaaatgaccactctgaacaaaaaaaaagtaacagcatgagtttattggagtttttatctagacataaatttgttgtcaaatactccctccatacttgtaaagaaagtcgttttggacagcgatatggtctctaaaacataactttgacttcttgtttctataaaagtatttattgaaaaggtgatatacgtatacttttatgaaagtatttttcaagacaaatctattcatataatttttacattttcaaactcaacaaattgagagttatttatgatttatattcccaaggtttgacttaaacattgttctaaacgacttcttttataagtacagagggagcgtacgttgagcacacacacttcaatttaaagttggtttatgcgtaaaatttccccgctagctagctagattctttcttgcattttatatattgattgttatgttccaaatccaattggacaaactaaattaaattagattagatctttcatctagttatttttggagcattaaatgacctatatataggtagcgcaaaaggtaacacggagt

SEQ ID NO: 3100 - DNA, 1501 bp, Oryza sativa
ccaagcacaccacaccacaggtttcacccccacccctcgcaaggcagcgggcagtcccctctcgtgcctaggtgaatccggaagccacataggccgtcgcaaggcccatccaaactccatcacgcccacccttgcctagatgcgtcaactagaggaaagctacactacaagcccagtcgttgcccacgctggcttgtggtaagtacgataagttcttccagggcatcccgcgaaccggtccttaaatgccatgggcacgaccatcaaaaccatgcacccatagctcacaatttagttaattttaattaaccaacaccggagcggtggtattaaccatcattactagaatctgatatctatgtattaatgtatttcccccattgtgtgctagttgaactaagcatggctaagcaatccctagtccaatctctagtcatgttataccccaagctaacaaaggagcatggtacaaaaattagcgtggctgtaacagtaggtaaacatcccatagtaacattataaaacgatgcagtatttaaaggaaaacgatagagcatttgcaatataggatcaacatgttcaagtgacaagcatgacttaccttgctctgctgctggaggaacctcggcgattatttcaaagtacaccggagcggtgggagagccggaatctaagcgacatacaaagaaaacaatacaaacaggccataagactactgaaacagagaacaaaaccatttttaatggattctatacatttttcttgatttactgagacttgaatgggcttaaacggaaacatccttaattgatttattgcgtaataaataaataccgggagagggaggggcggcgccgacatgcgggccccacaaggcagtgactcggggagggcggtccatggtggaccgggtccacggaccggggaggagcggcgcaccacgttgtgcacacgtggcgctgacgcggcgcacacgtggcggccacgtggcagccacgcgggcggcggggttggacggccccgatataccgcccggtagatcggacggcggaggcggctcgtggccgggcgcgcacgggcacggctcaagctgacccggcggtcgtggcgcgctgcggcgcagcacgacgcgacggcgatgcaaggcggcgaccggcggcgaccggccggcggcggagggcggtggcgtcacagcgaccagacggcgacagcggcggttaacggctaggcgccggcgcggcggctaagcggcgcgggagagagggaggaaggggaggaggggtctcaccgacggcgaccgacgacggcgagcgacggagggcgatggcgacggcgagacgggctgcggaaccacctaagggatcaaaagggatgagttagagagggagggggaaaccatggatggctagggcggcaaccgaaggcgccggccatggcgaagctcaccggcgcgcggcgcggacggggctccggcggcggattgctacggaggaggggtgga

SEQ ID NO: 3101 - DNA, 1333 bp, Oryza sativa
agttcacgatggtcaatcgtgattggttaattaattacttgccaactaaaccttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttaattgcgggggcaccagactgagaagtggcggagataagcccacaggggatgctggggagtccatgccttgtttataagggggtgattatgatccaggaatggtgcgctgcggtggattgtgttacgcaaggggtattgtcacagctcctttccgaggtaccgtggtggtattgaggcacatggtgacatgatgtggggctgtgtcttgtgggtacagtggtacgcctctgatcagagtaaaactattcgaatagccgtgcccgcggttatgggcgggtctaacaatgtctttcgtgattagtctcacacctctcatcacaataaaagatgctataactggtaataatttgattagctcctggtttggaatggtatattcctggtttggagatagatctgtacagccgggtgtggttgttcagaatggttgggcttatacaacagggtatattgtatagcgttggattaatattgtttaattattacttaactgttttattaaattctcaaatgtttattaaatgctgtttatgcaaatgaaaccctactatgccatcctttgttatcctgtgcacttgcatatttgctgcgtgacttgctgagtatgtcatatactcaccttgcaatcgttcatcagaggaagagttctacagtgaagctgttggtgtggaggattaggtgtaaccctggtcaagctgcctgtggagtggagtcgtctgtgccgtttatcttattttccgctacttagatctttattgattgagaggaactatctacctctgtaatgacattttattcgcttattaattagagtaataatggtactctattatctttgttattgtgtgcctcggctgattcctggacgagggtttacacacatgtaagcgtttggaattttggatagaaattccgggcgtgacatgtacccacaagacacagccccacgacacgtttctgtgcaccgacatgccaccacgacataccggatagagaccgtgacaggacccttcgcataaccccctctaaccaagcacaccacaccacaggtttcacccccacccctcgcaaggcagcgggcagtcccctctcgtgcctaggtgaatccggaagccacataggccgtcgcaagg

SEQ ID NO: 3102 - DNA, 1501 bp, Oryza sativa
ccgtcgtcctcctctccggcgcccgccgccgccgctccggtcgccgctagctgccgctagccaccgtgccgagccgtgccgtcgacgttgttgcgttcaccgtcgtgcgggccgtcccgtccacccctcctccgtagcaatccgccgccggagccccgtccgcgccgcgcgccggtgagcttcgccatggccggcgccttcggttgccgccctagccatccatggtttccccctccctctctaactcatcccttttgatcccttaggtggttccgcagcccgtctcgccgtcgccatcgccctccgtcgctcgccgtcgtcggtcgccgtcggtgagacccctcctccccttcctccctctctcccgcgccgcttagccgccgcgccggcgcctagccgttaaccgccgctgtcgccgtctggtcgctgtgacgccaccgccctccgccgccggccggtcgccgccggtcgccgccttgcatcgccgtcgcgtcgtgctgcgccgcagcgcgccacgaccgccgggtcagcttgagccgtgcccgtgcgcgcccggccacgagccgcctccgccgtccgatctaccgggcggtatatcggggccgtccaaccccgccgcccgcgtggctgccacgtggccgccacgtgtgcgccgcgtcagcgccacgtgtgcacaacgtggtgcgccgctcctccccggtccgtggacccggtccaccatggaccgccctccccgagtcactgccttgtggggcccgcatgtcggcgccgcccctccctctcccggtatttatttattacgcaataaatcaattaaggatgtttccgtttaagcccattcaagtctcagtaaatcaagaaaaatgtatagaatccattaaaaatggttttgttctctgtttcagtagtcttatggcctgtttgtattgttttctttgtatgtcgcttagattccggctctcccaccgctccggtgtactttgaaataatcgccgaggttcctccagcagcagagcaaggtaagtcatgcttgtcacttgaacatgttgatcctatattgcaaatgctctatcgttttcctttaaatactgcatcgttttataatgttactatgggatgtttacctactgttacagccacgctaatttttgtaccatgctcctttgttagcttggggtataacatgactagagattggactagggattgcttagccatgcttagttcaactagcacacaatgggggaaatacattaatacatagatatcagattctagtaatgatggttaataccaccgctccggtgttggttaattaaaattaactaaattgtgagctatgggtgcatggttttgatggtcgtgcccatggcatttaaggaccggttcgcgggatgccctggaagaacttatcgtacttaccacaagccagcgtgggcaacgactgggcttgtagtgtagctttcctctagttgacgcatctaggcaagggtgggcgtga

SEQ ID NO: 3103 - DNA, 1501 bp, Oryza sativa
ccgccatggccaaccgtcgaagtgccatgaccatggcgacctccatcctaacgccgccgactcctccctccttcctcgtgcacagcagccacggccagatctgcaccgccatcggcaaccttccgaaactccgccatccgcgcacacagcgtgtgctaaatttgagcatttcattgcatgtgttgtagtggttcacttgcttagtgagatgtcacgaagtcccaggttcgaatctccccctcgacgtattttttgcctttatgatcatcgctcacgggaaatagcgcaaaaatttacaaaaaaaacatgggaaccgggtgatcaaaccacgtgtctacttgtggttttaaaaaaacggatgaccaacaccacttcggtacaagatggtttatgtacgataggaacatatactctcacttaacagatatatagggttagcgccatgattgctggcacagagccattggactgaggtgacggcttatttttgaaataagtttttgatatagttctcttttcaaatatgttttctaaaagcgttagattgtcaaaattatagcaaagaccattggtgtcatgtgacaccattgctataacactagctccacccccgagtcacaggtttatctatccagaagcggttgaactaaatagccaatatatagcagaagaatagtaggaagagctcatgtaaattattttcaaaatgaatgaacatttttcatcaatttgtacatgctgaagtttttttacagtatatatcagcgttagtaatgttaaggaacaataatgagatgttagggttagggtttatgcgccacccgggcgaccgggcggcggcagagctctcgcgcgtggcgagatgggtctggatggagatctcctctgatctgctcctgatgtctccgggggttttacccgccgtgggttgttctgggggggatttcctccctgtgttgaaacgtgatctggtagggtggcctgatcatactcgtataggagataagttgaaggctttccctttaggcggattgatctatgggaaaggttcgttctctgctttccgtattgttccaggggatctgtggcccttgcgaaattctagaagggggaggagattgaatctgttttggtatccgaagttcgagttgtattggagacctaattctgtggcattgcagtataaatacaagtcacagtggtggccgaaggtgcggttcaaagtttttccggcgatagggctaggcgttgtcaaccccgtctctttgtttgttggatctagcggaagtctcatggcggccaatgtcggtgggggtgataaagggatcgtcattgggacgatttcccacccgaagctgatgagcggtaatgagacggacgcggtgattctcgacaggattcctctgaagatgatcgagggagcagcgggcacatctgatcagggccaggaacacacaacggctgcgaggaggggatctgcagagaacaaccaagttgatgc

SEQ ID NO: 3104 - DNA, 313 bp, Oryza sativa
gggtgttatgggtggccaatcaaattcaccgtgattagtctcatctataataatttgacctaatggaacttgtgtagttcaagtggttggttgggcctgttgcaacgtggtgtagtgttgcgcagtgatgattaatattgcttaattcattaaaacgattttactgctttcaacacctacttttaaatgctagaattatgcaaataaaccctcagctcccttggtatatatacactacatcatacctctcttccggtatgacttgctgagtatagtgggtagtactcagtcttggtctgtctcccaccccaga

SEQ ID NO: 3105 - DNA, 1489 bp, Oryza sativa
tgcctcggcagctagatttgattcggccgcaactggattttgccacattacgagctgctgcaagttaaggcaaaaattgttttttctgtgtgtgtgtgggggtgggggcggggggttgggatttgtttgtgtgtttgtgcttccacctttataatttttgtagcgtcgatcttatgtttggaataactaatgattgtccgattgggattttgattgatccttttgtgctttgtaagctgtaacggacagaggctgtcgctacatcggacatggcggatgaaaagttggggtgaccaacggaaaattgcagatttgcgcatttgcgcgtatgggatgggagcgacgcggtcgtgcatacggacgaaaattaggtgaagaaaggaaaattacgaatcttttaattagttaagataaagtaacacagtcggacgtccatggtagagtgaactgtgaaaaccagggtttcccaaaccgtcgggctcggggttaccgcgccccggcggtaagcacggtaaccgcggtaaccgcgaaaaaccgtgcaaaatttatcgaaaatttaaattattttttaaatttatttgaatttaaggaggttaccgcagtttttctatatcgtaccccgcggcaagaccggttaccgtggttactagcggtaatgtaaacccgggtgaaaaccaactaaaacagtggaaaaagaaatagagttgtttcaactttcaagaaaagaaaagaaatggaaaaatacacacaacaagggaaacacgatttaaaaggattggacttttcctcgcaaaaataaaagaagaaatcgattgggacttggggtttagaattatagcggtgatctctacgatcgatctgttgcattgccacctcgctcgcgcttttactttaatctgcggtgatctgtatgattaacacgtacgattctcaaactttcgtttcaagaaagaaaaggactcaaattcacattgggttttatgtatatatatatatatatatatataggtaaattaactggtgctacatggagtatgggtttcaaaattcaaattgagtatctacccaatttgaatgagtatgaattttttttaaatgtttagatatgatcaattaacttctttcaaactgaattttttttgttagattttgattctagttatataacatccaaacatataattcgttaggtatgtaataatgaattgtgaaataaagttgagtttgagttgttttgttgttaggtatttgtatgaatcaaattcatatacctagatatctacttacaatttgtaaatttttaaaaatttgagagaatttatgtgttttatatcttggagcccgggcactatggagtcccatatggatatatatatagttgtacaatctcggattaattaacttatccctccatcgatcgatcacatcgtgctgttttatctctccatcatccccaccatcgccaattcaattcaattcgacgtggcca

SEQ ID NO: 3106 - DNA, 1501 bp, Oryza sativa
gatagcaaaggatggcataatatagtctcattttgcataaatagcatttaataaatctttcagaatttaataaaacagtaaagtattaattaaacaatattaattcaacgctatacaacatacccgttgcataggcccaaccattctgaacaaccaatcctggcttctatcagcaaaccaggaatataccattccaaaccaggagctaaacaaattattaccaattacagcatcatttattatagtgagaggtgtaatactaatcacgaaagacattgttaaacccgcccatcaccgcgggcacgactattcgaatagttttactctggccagaggtgtaccactgtacccacaagacacaacctcaacatcatgtcaaccatgcatcgcgatacttaacaagtacccgaatagagattgtgacaataccctctatataacacaattcaaagcagtgcaccgttcccggatcataatcacccccttgtaaacaaggcatggactccccagcgacccccgtgggcttatttccgccacttcacagtctgttgctctacaatgaaccatactgtacagaaaataaagccgttgcccacgctggcttgtggttggcacggtaaatgtttcacaaccgaaaatcgtgaaccggtccttaattgtcatgagcacgaccatcaaaaccatgtgctcacaacccacctttatcaggttttagttggcaaattaattaattaaccaatcagattaaccatcgtgagctatcattaaaccatgattaaataataatgaatcataagtatcccatttatatgagctagtgtctctaagcatggctaagcatcctattcactttagctaaaaccatataatgttctagctaatcatattattacccaagtgacaaagaataggtaatcaataacaaaagggctataacaaagcaataggttatctccacccaatgacattcgaaaataaatgcaatagttgaatagaaacaatagctttaaacgggatcaacatgctcaaagggttgtttgggatctgtgtgacctgccttgctggccttggaactcttcaaattcttctcctgcgaaatcggactctccgggaatgtcggaatctaaacagaaaagagcaaaatcaccaaaacaacacataaaaaagcatgaacagtatatgtggatatttttaacatgtagatctcaattttagaaaaatttagagacttgaaccaactaaatccgagctaagatgaattagttatgaatttttaaagattaaatcggattaaatcatttatatagattttaattgaattatgacgcaatatagaattatttttgaaaaggaaaaatgaattattgcgtcatcgggctcggctcacggtggaccgggtgcacggcggcggtctacggaacgaacggccgagatctatcctatccaaaacggacggccgagacaacttgatctaccgcggtctacggggaaacaacgacga

SEQ ID NO: 3107 - DNA, 1501 bp, Oryza sativa
tgccagattttatttttatttttccgctgcagatttcttcgttgtgaggactaagtgcctcttcagtaagtatttatcgctttagttcttttgatgaatatgtatattaaattgtcagtttgtgtacctcggttgattcctggacaagaattttatgcgcaaattagttcggaaattactagtgaatttctgggcgtgacaaattatgggtctgtttagttcgcgaaaagaaaatttttgggtgtcacatcggatgcttgaccggatgtcggaaggggttttcggacacgaatgacaatactaatttcataactcgcctggaaaccgcgagacgaatcatttgagcctaattaatctgtcattagcacatatgggttactgtagcacttatggctaatatggactaattaggctcaaaagattcatctcgcgatttcccccctaactgtgcaattagttttattttaatctatatttagtgctccatgcatgtgtctaaatattcgatgtgatgttttttagaaaaaaaaattagggaactaattaactaaacaaggcctatatatagaacccaatgtgaatttgagtccttttctttcttgaaaccaaagtttgagaatcaatcgtgttaatgcaacagattaaagtaagagcacgagcgaggtggcaatgcaacagatcgatcgtagagatcactgctaactctaaacccctaagtcccaatcgatttcttcttttatttttgtgaggaaaagtcccagttcttttaactcgtctttcccttgttgtgtgtatttttctatttcttttcttttcttgaaagttgaaaccaactctatttctttctcccctgttttagttgatttccacatttcactctaccatggacgtccgactgagtttctttatatatactagcaaacatacctgtggttgcaacggatgaaaaaacctaatgataatatactttttcatacataaccatattgatgacaatcagaaaattagaaaattagaacatcttaaatgtaatggcccaacctcgatgatggcaaccttaccgatgtttggtttacctaaaataattggattattcatgtgacaacatgcatataatcttaaatattattttaatctcattcttacaaccaatcaaatcctacactgactcgcatggtcaagtctacacaaaatagagccactgtgcactcttttctaaataacaattacaatatgtttattttctaatattatttccatataatatgttatcaagaatagtagctatacttcacaaaaaatagtatgataattgactacagaggtgtgcagggtctccaatacaggagaatagatgatgaaacaaaagcctaggagatgaaaaaaaaatcgatgatcctaaccaaccaagcgtccatcaatttagcctttttttctgacaattttttcctcgtatgctttttattttgcttttttacagacgatggaaatatttttttct

SEQ ID NO: 3108 - DNA, 1501 bp, Oryza sativa
taaccaccaggaacaaaccaaggagcccacctgttagccactcaccaaaggcggtgccaattggcgttgggtctggtacattcgaaccctggttcggctgaaccaatcgtggtgcccccatttcctcccttctacgtggtgatcccttgttggctcctgatggcggttgtggagttaacgacctcctcaaccatcataagccagctataaacagagatcacctcttcactctcaaagcacacactcaaggtgtaaatctctcactccataccttgcattctctctagtagcagtggagttaggttatgagtaatctttgagcctatagtcttcttggagattccggtatgtctttggtacttcacctttcttgtaagactatagttgctttaatagaattatcttctttattctattgtgttcatagttgatatgctaattcattagttatatgctctatgaatagattatacttcatttatatgattcacttgattagattagtcgatctatgctatggtaatggtccagtgaccttaacgggttgcactagttctaacttgtccatccgaagggtgggagtgccaggggaattagtgtcattatttagtaacataagcatggtgcttaggtcagcaaaatgttgttggatgcgggtatgtcccacggaaagtgaggtagatgagaggtggtgacaaacatgtccgtcctttgtgttcctccacatctgggtatgatgtaagagttcgtaaaatgccataaccacgctggcaaaccaacaaggagtggtctctcggtagtacctaggtgcctagaactaagtcctaaccttctaagcatgtatgtattaagtgtaaactatacattataaatacaaaagtacatttaaaccatagatctctttagttcttctccactacctagtgtatcatttttagagatgaatctcctatgtatcacactacccttatccatactatcaattaacccctatttagaaaagtaattatagcttgattaaggaatgcatgaacttatttttttacaccgccgcttttcctgtgaaaagataaatgtgatacccttggaatactccttgggtgaaatgctacatatgtatccatgcgcttgcggatttatctaggaccttaagaaataccaacagttgctctaaactatcctaactagatgtcgttccacacactagaaaatccaatccgcacaaatcacactaacctatccagactacacgtcattccatgcaccggaaagtccgatgtgttttcaaacaccgaattacgcagcaaaacaaaattacaaaatgaagttgcgtctctgcaacaatgaggggccaattttggcatgtgcattcatctagttctcaccactacaagtttctaaggggcgaggagaacactctttgacggaggtaccgctctcctataataggcaatgtggtactaaagatttacatgcatccattcttttaaagtgggcattt

SEQ ID NO: 3109 - DNA, 1501 bp, Oryza sativa
gaggtcgaagtcggagagcatgatgtggccttcctccctgacgagcacgttctccggcttgaggtcgcggtacaccacccccagcatgtgcaggtactccagcgccagcaacacctccgacgcgtagaacctaagaagatcgccatgatttcagaatttcacctcctcttcttctccaactccggcgatcgatcgaacaagaaatttttacctggcggcgtgctcggagaagcacttgttgggctgcttctggcggagggaatggaggttgccgccggagcagaactccatgaggaggcagtagaacttgtcggtctcgaagtgggagtagagggtggggaggaaggggtggtcgaggaggccgaggatctcgcgctccgtctgcgcgcgggcgagcttgttgcggctcaccagcgagctcttgtccatcaccttcatggcgaacagcgcgccgctccctccgccgcggagctcgacgaggtacacgctgccgatgtcgccgtacccgagccgccgcagaaggcggaagtgtcccaggctgagcggcgactcgcgcgcgctcgccgcccggatcgcctcccacctcccgtccccggcgccgcccgtgtgccgccgcaccagcgccggagcagcgccgccatcgtcgtcgtcttcgacggcggccgccgccgccgtcctggacggacgggcggcggcggcggccatgtcgacgacgacggcgtcggcgtagatcgggttgatgctcttcctgaagcccgacggcttgtccggcgactgatccttcgccggtacgaccatcctcgggcttggcagcgtcatcgggtacacgccggcggcgtcgaagctccccgcctcctccatatatataccgccggccgccgctgctcgatctctccgatcagtttcgctccatgccgtcgacggggtgttcgtcgtacgtgttgctggagttttaaggccggagacaatgcagccggccggcagcaagttcgatcgggaggggatattgtatggatcgccatggctgggcgcgtcgtcgtggccgccactacaagaatgggtcgacgtggagggggcgaactggcggagttgaggcggcgcgacacgattgatcggttggttggtggtggatgtcatgtccgtcatcaaacgcgcgcggccgggtggccggcaggtcgttggtgacgacgaccagattgacaagtatgaggggctcaccaattggcctgcttggaagcccaccaattggcccagaaaaaccgggaatttttttatttttaattttttttattaaaagatttacaaaaataattttgtatttcaaaaattgacagaagtagtcgtccgctgccctctgggaggcaaatcgccctcccagagggcggcaaatgtgacgtggcagacgtccgttcactctcgggcgacgaccgtcaatgaaatttgcaggcggcccccttgccgccctccgctagggcgattttacactgtgcggggggccgcc

SEQ ID NO: 3110 - DNA, 1501 bp, Oryza sativa
aagttgagggatgttctatatctggttttgcggttgggggacgattttgtaactcgatgacaagttgaggtaccttcgatgtaccttttccttttagcatggagaggcacttttgtcctgcccaattgtattaggagggaataagtccactttgactacctcaaaatataggtctaatttggttcgtacccctgatctgcaatgctggatattttgacctcccaattattaaaacaggtgtagtttgactcccttaatggttttgagagtgggttttcgctgatgtggcacgttcatcaggaaggaggaggtgtgaacgaggatgatagtggcaatgagatgggaggctgacgaaaccgtcgatgcaccattgccgactgctgtcacactcctcgtcaccatcgtgccgccgacgactgccatcactggctctccctgatagctcagcggtgtggggaaagtggaggagaggagaaagaaaggaggcatgtgggccccattgataacttagtaggttggaccaagtcaacgtgctacatgagcgaaaccgccctcaagagcagccgagagaagcaaattacaccaattttaatagtttggtggtaaagataaccgatatatgaattagaatgttggacctctattcaagggagtcaaagtggacttattcctattgggagttaatgaaatataaaagttactagggctggtttacccctaaaaagggtagaggtattctttagacagggttgaccaaatatttatgtagtgaacgtccattgatatttatcaaaatagtaaatgcctcaatggaaggttttggtttagggcatgcttagtagggctccaactcctaaatttaactctaagagtcggatctgaagtgaagctgtggagcagcctaaaacaaattccacctatttagtttattttgtgagagcactttaacccgctccgctcccttttttggtggaactgaaaccgtttgattgggctccagaactggagttggaactctgccaaacaagcccttaacaagtagcatgtaccagaaatgccaacggattgttattgacggtcgttatagaccaattccaaccgtcaatatatccaaaaataaaggagaactagcaatgcttcatgcatatttgtttaagaataatctatttccatttatacttggcaaaatattgtttgcaggagaacttcacataatcggaggaagaataaaagaaaataacatcaaagacacacctccgaccaatcagtcgcaagtacaagtattgaagggcccataggtcaggtgaaaccgccataaaatgggtcataaccgccataaggacccaccagtcagcctcctggacaaaggataggccaggaggtggggcccagggttcggttgaaccaagccgaaccgccatcaggccctttctgacaattccatgatagcttctcaaagacggttgcggggcatttctgacaattccacaactgtcatatg

SEQ ID NO: 3111 - DNA, 1501 bp, Oryza sativa
agaacaaagtaaataaactagagagagctcttgattgcttcttcttggtgtgtgttggagtggagaaggtgagctccttttatagggttcatatgacagttgtggaattgtcagaaatgccccgcaaccgtctttgagaagctatcatggaattgtcagaaagggcctgatggcggttcggcttggttcaaccgaaccctgggccccacctcctggcctatcctttgtccaggaggctgactggtgggtccttatggcggttatgacccattttatggcggtttcacctgacctatgggcccttcaatacttgtacttgcgactgattggtcggaggtgtgtctttgatgttattttcttttattcttcctccgattatgtgaagttctcctgcaaacaatattttgccaagtataaatggaaatagattattcttaaacaaatatgcatgaagcattgctagttctcctttatttttggatatattgacggttggaattggtctataacgaccgtcaataacaatccgttggcatttctggtacatgctacttgttaagggcttgtttggcagagttccaactccagttctggagcccaatcaaacggtttcagttccaccaaaaaagggagcggagcgggttaaagtgctctcacaaaataaactaaataggtggaatttgttttaggctgctccacagcttcacttcagatccgactcttagagttaaatttaggagttggagccctactaagcatgccctaaaccaaaaccttccattgaggcatttactattttgataaatatcaatggacgttcactacataaatatttggtcaaccctgtctaaagaatacctctaccctttttaggggtaaaccagccctagtaacttttatatttcattaactcccaataggaataagtccactttgactcccttgaatagaggtccaacattctaattcatatatcggttatctttaccaccaaactattaaaattggtgtaatttgcttctctcggctgctcttgagggcggtttcgctcatgtagcacgttgacttggtccaacctactaagttatcaatggggcccacatgcctcctttctttctcctctcctccactttccccacaccgctgagctatcagggagagccagtgatggcagtcgtcggcggcacgatggtgacgaggagtgtgacagcagtcggcaatggtgcatcgacggtttcgtcagcctcccatctcattgccactatcatcctcgttcacacctcctccttcctgatgaacgtgccacatcagcgaaaacccactctcaaaaccattaagggagtcaaactacacctgttttaataattgggaggtcaaaatatccagcattgcagatcaggggtacgaaccaaattagacctatattttgaggtagtcaaagtggacttattccctcctaatacaattgggcaggacaaaagtgcctctccatgctaaaagg

SEQ ID NO: 3112 - DNA, 1501 bp, Oryza sativa
cgtgcctaggtgaatccggaagccacataggccgtcgcaaggcccatccaaactccatcacgcccacccttgcctagatgcgtcaactagaggaaagctacactacaagcccagtcgttgcccacgctggcttgtggtaagtacgataagttcttccagggcatcccgcgaaccggtccttaaatgccatgggcacgaccatcaaaaccatgcacccatagctcaccatttagttaattttaattaaccaacaccggagcggtggtattaaccaacatcattactagaatctgatatctatgtattaatgtatttcccccattgtgtgctagttgaactaagcatggctaagcaatccctaatccaatctatagtcatgttatacccaaagctaacaaaggagcatggtacaaaaattagtgtggctgtaacagtaggtaaacatcccatagtaacattataaaacgatgcagtatttaaaggaaaacgatagagcatttgtaatataggatcaacatgttcaagtgacaagcatgacttgccttgctctgctgctggaggaacctcggcgactatttcaaagtacaccggagcggtgggagagccggaatctaagcgacatacaaagcaaacaatacaaacaggcaataagactactgaaacagagaacaaaaccatttttaatggattctatgcatttttcttgatttattgagacttgaatgggcttaaactgagctcggatgaattagatatgaattttagaagattcactgtgtttctactataacagaaacatgcttaattgatttattgcgcaataaataaatcccgggagagggaggggcggcgccgacatgcgggccccacaaggcagtgactcggggagggcggtccacggtggaccgggtccacggaccgagggggagcggcgcaccacgtggtgcacacgtggcgccgacgcggcgcacacacggcggccacgtggcagccacgcaggcggcggggttgcacggccccgatctaccgcccggtagatcggacagcggaggcggctcgcggccgggcgcgcacgggcacggctcaagccgacccggcggtcgtggcgcgcggcggcgcagcacgacgcgacggcgatgcaaggcggcgaccggcggcgaccggccggcggcggagggcggtggcgtcacagcgacacagacggcgacagcggcggctaagcggctaggcggcggcgcggcggctaagcggcgcgggagagagggaggaaggggaggaggggtctcaccgacggcgaccgacgacggcgagcgacggagggcgatggcgacggcgagacgggctgcggaaccacctaagggatcaaaagggatgagttagagagggagggggaaaccatggatggctagggcggcaaccgaaggcgccggccatggcgaagctcaccggcgcgcggcgcggacggggctccggcggcggattgctacggaggaggggtgga

SEQ ID NO: 3113 - DNA, 1501 bp, Oryza sativa; identical to SEQ ID NO: 3103

SEQ ID NO: 3114 - DNA, 1501 bp, Oryza sativa
cggaagagggagacggcggcggggcggggcggcacggcccgatccatttgatctaggcttcccattgcgaagttacatttttgcccttccatctgagttttcaggtcggtattgtacaaggatagaattggtaccgagccgttggatctggccaggaatttggtaccacccggtaccggtaccgagcgctggacggtaaaaagactcttaaaataaactccaaatttactcaattttaaaataacctttaggcatgacattgataatgctacggttgtagagcatgtgaagaaaaccgatcttcagactgcaaataagtttctataagagctttttattgttcataattattataggatatttttttaaaaaaaatgttgataaactcgccacccaacatacggagtacaaacaagatgtgtttcataagattttgagaaaaccacataccgcacgtgtagcataggtaatttccgtctccctttatcacgtgagtgagtcgcgtcttctttccaactatcgatacgtcttctcaaaaaaaaaagaaaaaaaaagagggacatcactgagaaaaactacgccgacaccagaaaggctgtggcggcggcggctcatggctcctcttcggtcggtttggcaccgtcgcgctagcccctactggtaggctcgatacccttaccgcggcatttatgtgataggttctccgtgatcgccgccgacgccgacgccgacgctcgccggtgggctcgagatcgccaacttctcttctccctctctgccacggaatagccaagaatgaacagaatctgtccaactatagccagtctctgattaatttacagaaatttcgcatcgtttttgatttgtggctgacaccatcctattccccatgcgtgcagtattttgtttcatatatatatttttttctttttgaggataggcaaggagtaatgcctaacatatattctcattttcagtctgtttgcactaattttgctatttttatatttagtccatgcttcaatgctgagaatggtgagatcggatacttttttaaaaaaatctccattgctaaattaaaaagttcggtacatcttttttttttacttcgaggaagtttagcacatattaaattacatacgtattacatatgcaatttatgtaatctaggtctcgattttgttttcttggagatctgtgatgtcatctttaccatgggtgacaatggaactccgtggtatcgtgcggattcatccggatgtttttcatgcatgttacatatggctttagcactcacagttatgtttgtttcctttaaattagttattctttctgtaatcctattaacgtccatggacagactgaaattatctttttgactttaacacttttatatttttcttcgtcataaataatcagttgtaactttctaaagtttgttgttctatgatcaggagttcatggatcagccacttttggaccgtgcagcttcttcctcgtc

SEQ ID NO: 3115 - DNA, 1501 bp, Oryza sativa
tcgccggacctcttggttgccggtttctctggatggggatcccgatttagttagccatattctgcgttttgggggaaccgggacgtcgcaaatattgctcctggattggcacctgttcttcccttgtttgcgttgcgatttctttctactagtattattattctgtattactattggtctgcagaagaggcccttgctggggattttttttttatggaatatgacgatcgtaggcattgtgttcgtggctcaatttcaaattccgagtaggaattgggcgttttttgtatagtcggcaagtaaggtaatggcggtggcgaccattctgtctgaaattgaatacacagatgtgctagttagtttcatgagatgcaaacggcatggatttgtggtgctccttggcgcgctacccggatgttctagtttcatgccagtcatgccgatgctgctaaactactatgtgcaagtcaacatcgtatgtgcatctgtttttaagattatttttgttagccctaaaaggttcaatcctagggtggttgatgtaagcatattttggaagcacctgtctgttagcttatgggaatcattagtcattacactttttagaaatggaggcttgtgaagtatgtgagaaatataaagttggtacaggatagagatggtgccaaattccttatctagaaagatttggtgccaaatgcctaaagcaaggagctgtcaccatgtgtattaattttagcaacatctctcacaggattcacaaaagtgaatatttaaaaaaaccaaatttgcattttagttggagaatggcttcatcccttcacggcttcacctgatgaccagctttgaacctggtcttttacactcggtgaacaaaaaaaacttatcttttacacttcctttgatcattctcatgcccactaagcactgaaatgttggaacaccagttaccttatgccagaactgtcaattgctggactttttatttagtttcattccttttttctttgttgatgtaagtctcactgagtcactgactcaatgtcagtgctttttgcttgtacgaatacactggttaatgattataagacagattatcagatgtagtgttttcttgtgatttgtttgtcacgaatggaactcgttgcatgggagagtcctgcgttgagaaattactttcagttgccaaccaatcatatgaatgctagtgtttacctgtttcaccttgtgctgaacagaccaacatagatacttcgaactaccctaaggacttatttgcctgctctttagtttatttattgtttaactaccacactctcggtccaaagtagatggcatttgaatgtgaccacctttgtagctttttcttgaggatttcaatactttcatttgttgacaccagtatcagtttttatgtgctaattttttcttaatgtttcagtgttatgtttttcatcactataaagtccaataaagtgaagagtgactctgcatagccaga

SEQ ID NO: 3116 - DNA, 1501 bp, Oryza sativa
ttggctcctagcgtaacaaagcgtaacaagtctggattttctacattttacccctttttaaaatcttattttgcaaatagatctctagaaaatacttattttagcaatggaccatttttctccaactagagttgttagcgccaaggttcaatgtcttagcatcaagcactggcaccaacaccgtcgccttctgtggcagctaaatcactgacgttaagggagtcggtgtcaaaaaaactgaaacataagtacctatttgtagaatattttttaaaaaaggattaaaatataaatatattttactacaacatgcccttagcgcaagtctcttttgcggtaatggtctattgtaagaaaaagtatttacatttcaacctttttcataaaatttgttctataaataggttattggttctagtttctttggcgcggatctcacctagatcacttgcgctaagaaaaagatatatttgtttgtctaagtgtatatttataaaaggaataaggctgcatccgttcctccttgttcccaacctctactccctccttttccatatgcacgcttcctaaactgctaaacggtgtaatttttgaaaagttttctataggaaagttactttaaaaaatcatactaacctatttttaaagttttttttagctaatacttaatttatcatgcactaatccatcgctccgttttccatggggagggttcccaaccctcaccaaagaacacagcctaagtcaacataaccccccaacctattaccaggtgattacttaaccccctcacctaataaaccagctatttaaccccctaatcttgttgatacagtttaattaataccatacagtggttttgcactctggttttgccccgctggcgggacacgctcgaccagcctggcacagtggatcgacaggcgtgtgggggatggggtgaataaaaatatgagcggttctctcctcgttctccttggaacctcctctctctctctctctcctaggcgaacaacctgctgatgacagggagtagatccatttgattggattgcagggtgaggtaaaggtgagtctccacaacctgtttctatgttttttttcccaatcaggttatctcttcaaggattagggctaattctacaaggtcttttagtggtgggttatgtattttttctgtgaaattttgatagtgctatgttgtaggcagtaaaattctcatcactctctgtgaatttctcggtaattttatcgtcttgatgattttaggatttagggcttatgaacacaaaaattagctcatacgttggtaccaaaggacacataaatttgctctatgggtgtaagatcttgctttggtttttttaagactaaccgaggctagaagcctcagataatatatagcgtatgatcttgctagttgttgtcatttaatatcatcaagagttaggattatttttgtttcttatttttgcaagaatggatccatcggattttcttc

SEQ ID NO: 3117 - DNA, 1501 bp, Oryza sativa
ggtggcaagaatggcaagatttgaggggctcacctttgtctaagggacaagttcctccatggttgtgctcccgtgttcgtcctcgccaatgtgttggtctcttctcctccttgatagatcatctccttgtctagccaatttttcttctccccttcctagccgacatagagatggtatgagtatttggctgagaactaatttggctactaactattgggattgagggattggttcttgaaatggattgggcagaatcttgcattccgctgatttgtggattttgggactttggctattccctcctcgctccctattgctctcctcctcccctgatctgctcactcctcaccaagtgcttggggctcatatgcatgcatcagtgagcaaatgggcatggctgtagccatgctttgactgcttgactgagaggtgatgaggttgtgctactacctttgtggccttgtgtgagtcctcctatgtgcagctatgtgattggtggaaaattagtactgctggtgaattgaggtccctttggtgaggttacttctttatatgagatgtgtgacttcttagtgttaattagccggagccggatgacgaacccaacttaagggaggggtgccagacggtattagccgatctaggtatctcggtgaatggttgaatatacaccacttcgtgtatgggtctgacggcaatatttatttacatattaccttttgtgcataaaagggtcaagctatgcatgtcctgtgcaaccgtatattcaaatatatgatgtattgtattattagtgtaagtgtatgtatatgctgactgtttacagtggcgtttgtttgtactatatttccaattatcactattatattgtggttgtatattggacattgtttgtttgtttaacttcgacgaatgtgaatttcataaattttgagtggcttattcttatttccaacaattttgctagttaactaattaattagtgatatatgccacttaatttttaatttttaaaatagcttaaatttccgggtaacataattatagtttgggtttatttttactttccaaaagtcccgccaaaccatcagcggttttgccattgtactcctctacggctcgctcgctgcctcccttctttattgccttctttattgtcattgagatttaaaatagaacatgattatcattggttttttttactttttagaatttctaaatctttaaaaattggacttgtagttttattttttataatttttagaagtctcatcaaacgatgccactatgcccctctgcagcccgtccgccgcctactctttattgtcattgtgattctaaaaatcgaacataactatcattacaattcattttttattttctagaagtcccgtcaaccgtcggaggctctgcaactatactcttatacaccccgctcgttgcttctcctttttattgtcattgagattttaaaaatcgaaaatgattatcaatgtggttt

SEQ ID NO: 3118 - DNA, 1501 bp, Oryza sativa
catgtcgagtcatttttgtatggcaacataaagtgaggtcataactacagggcatgtctactgtagcatattacatatatatatcccagtaaaacataaacaggtgagttacaggggaaaatccaatatcatagtaacacataagatatgctacaagtatactttataacatatttatataaggtcttgtctagctttaatgtaactgatgaaaaatccgaaaaatttcagtcacttttttggacgactaggatcgcatcaagatttgtgcatactcattatctctcccttaacgattcttctcttttctagttcgcatgcacgcacatgagactcaggacaaatcgccacgccttgctttcttactgagcactgaggcctccactgccaccgcacttcgccccatggctcactagctagccagaagccatcaacggtgccggcgagccccctctagaccggccacctctctcttcctctctaatcttctggcggcggcgtggtgctatcgggttcactgccgatgaccacatcctccaaaccccatgacatccctcacccctgccaccaaccctacccacctgcgtgcctctaactccgcgtctccagcagcgcctccgccgcctcgccgctcatcgtcgatcaggccaccccagaaggccatctccctaatcctgggagaaaccgctcctttcttcccaaaaccccacggcttcccccaaccctagccccaaaaccctaactctaatccgtaggtcatgtaccgcaatcggatgtctctggcgatgagaaagataaagggatcggcgaggatctcttcatcactgttgccatcgccgagaagtggttgaagacaattctctaaacgttggatttcaatccaatgggtagggagcaggtgaacaccaaatctcagtcacctaaaaactaccatttcccttcattcatataaagatgtgagatgagaaagtacaataggagcacaaaatgtgttgcatatatatacacatggcagtaataatgactgacttggttaaaaggctagtaataaaattaaataaagtatttgagtacacgtatatatagcatagcggttgggaatttgtcgtttatgtatatatatagcctgacataacatgtggtttctggattttcagtttcaaaaacccatttgtcgtcgctcacttgatatatatcattaattactgacatgcaggtcgcgtcacttttgtatggcaacatagctaggtagagagcatgaaaacgtgtacgcgtgcacgcatgaggatatgtaagtgcgtacggtgcagctctgttgcacggcgagacgtacccagccagaaccagagaccgaccgagtccctcacctgatcagctgcctcacaaggcggaagcagtgcaactgcgcaagcatgcacgtatacgcaacacgcgtgtgtgtaatataatgtgtagctggctcgatcgatcgatctctggctgcctggctcgccgctcacgg

SEQ ID NO: 3119 - DNA, 1501 bp, Oryza sativa
aaatatgaatcataaaaatgacatcaatattgaacgtcgattattattaatttttccaatgtatcacaagttcccaacatataaatatgactaaatatgctaatagctttgtggctgagttttttttttaaactcatggatagctggtactgcagctggttcaggcgttcagttgcacatgcgtgtgagtgcgaatatgcagccggctcaaccggtcagcccgcattctcttgtgtatttgtgcacgcactgccatgggccaaggaccaaaggcggtaagcccattgggctcatttcatggactctgactaggatgccacgctagctatatataggtgcaaaaagttgttgaaaacaaaacttgcactattgacataataagtactgtgattaaatcatatatatttttttataataactctaagatataataattagattaaacggttaagaagtttgtttgtaataagcttttggtacgcgtacgtgccgagtgtttacacgagcggagtaataataataataataataataagcagcacctgctggagtatcatgtccgtggccgacgaacgacacctgcaggttggtgatcttgttgttcgtcctcgccgcctgcgagctgtcgtcgacgtaccggccggcctccttctccaactccgatgtcatcttcgtcgtcgggaagcgggccaagagactgcgcggggcccgggccgtcgccgcgtgcgcgcggcagcagccggcggagagcgccgccgccagcaagagacaggggaggaaggacgacgacgacgacgacgccgccgccgcccggaggctgaagcggcggcgagctgcggcgcactcgttgcccttgcccaccatggtctcgccaccaccagcttcctctagctaaacacacgtactgtgatcaactctttggaaacgaaattgaaggaaagaaagctagctagctaaacgcttgctgctgctgctgctgcgtttggagcgcgcggctatttataggaccgtgagcggcgagccaggcagccagagatcgatcgatcgagccagctacacattatattacacacacgcgtgttgcgtatacgtgcatgcttgcgcagttgcactgcttccgccttgtgaggcagctgatcaggtgagggactcggtcggtctctggttctggctgggtacgtctcgccgtgcaacagagctgcaccgtacgcacttacatatcctcatgcgtgcacgcgtacacgttttcatgctctctacctagctatgttgccatacaaaagtgacgcgacctgcatgtcagtaattaatgatatatatcaagtgagcgacgacaaatgggtttttgaaactgaaaatccagaaaccacatgttatgtcaggctatatatatacataaacgacaaattcccaaccgctatgctatatatacgtgtactcaaatactttatttaattttattactagccttttaaccaagtcagtcattattactgccatg

SEQ ID NO: 3120 - DNA, 1501 bp, Oryza sativa
gcggcggcggcgggggcgggggcgtcggcgcgcggcgcttgcgggccatgggtgatggatggctcgctcgctcgctcgccgctagggttttggggcggcggaggagaggaagcgggggagatgcgaatgcgaatgcgagcggcggggttctcggcgtgggctttgggcctttgtggcgggttgatttcaggagactgttgggtttcactgacgcgtggggccgggtgtagcgtacgctaacggttcgaattccatttttatttacttgttgtatttattttgggcatttcgtaaaggagaaagttctttcaaatgtcgcggtttgcccggaggagatcgaggtgaaaactgaaaaccgatcatggtaggttttaccaaaacagcgcgaaagccgatacaaaccatagaaccggtgacctttttttttgttaactatgtatgaaaactaactaaaatcaattggaattcacaaattgggtcagggtggtttcaagcaatggcggagctagaaaattttttaaaaccggataaatataactagtatttgttatagaaatttcatcaccaatttactcactaatataaaattttaatggagttttcgcctgcccagacgatgcctccgccattggtttcaagaaaaccaagcgattctaaaaaacaaatcggatctgtgaatcccaatcgagaattcggggcttggggtttgtgcaacttcaaagtaataacatcaagatcatctctcggtcttttatgatcggaaaatacgcttgagatcaagagaagcaatttaatgtggcggcaacaatatagagaaaggtaaagagaaaaaagttgtcacaagatgaattgaatgataggagatactcgtcccaaaatataagagattttaggtggatcacatccacctaaaatctcttatattataggatggagggagtatgaaataaaacaatattactgtagatcaaatttcttagtactacaaaatatatatatttcctttgtttttcaagcttgctagctttccatttattgaacccacgttattattccatggtcacgtgttttgcagttagtcctaataagatccattatcataaaaaaaaaggtagctgaaaatggagtgtgcggcatgtactagggcgatcgagaggatatgcagccggcacacggcacggcaaacaagcagcgcgtcagccagagcgtggtatgatggacgggcggtgtgccggtgtggcgaggcagccagcaaaaccaaaccaaccgcacacgatcgcacgagacgactcgcccagccaccgatcgatcgcccatcggtgccgcgactttttttgtttctttccacgaggcgagagctccatctgcgctcgtcacatgtgccattgtgccaatgtcacacgattccctttagctatctcttcgtgagcccatatatacgtgtacaatacaatacgaaaatcacatccaaatgtgcagcaaaattgtaaatgacaaaaaa

SEQ ID NO: 3121 - DNA, 1501 bp, Oryza sativa
gccgcccgctgcgctccggcgccgccttcaccgcgtccgagatcgtccggtgcgtccccgtcccgtccttcgccaccaccatgtccgcgctctccaccaatggcgccgcggggaccagcagcagcctccggtccctcgccgacagccacctcgggaagaggcttcttcttcttcttctccctctcttcctctgcttcttgctcttcccgccgccgttccggacggggacgccggcgaggccgtccttgttgctggttgccatggccgccgacgcggcctccgcgtacattgtgaggcagtcgcggaccatggcgcgggcggcggcaaggtggggcgcggcgtccgcgccgtgggggatgccggcctcattgaggctgtcggcgcaggtgtcgtggttggtgagcgcggcggagagccacgtgaccgcgtcgtcgtgggcggcactgggctcaccggcgccggcaaggaggtcgagggagtcctcgagcagctccgcgcagtcgtcgcgcgcggcggcggcgaggggcgaggaggaggaggagcccgccgagaacggcgttgtcatcacagcggaggccggcgcgacggcggcgcccgacagggcctcgagcgccttccccacgtgcaccgccgtcgcgttgagcgcaatgcggagccggtggtggcgcgccgccacagcctccgcctccagcgccgaggccgggaaggcgtgcgcgccggagagcggcagcaagaagcaggggaggaagacgaggaggaggatgaggcggcgagcgacggcgtggcccatggcgagccgagctagctagctatggaagctggaagaagtcgacgaggtgctggactaccagcgatggcggcgcggccatttatagggcgattgggggtggcgagaatgatgggacgcgcgcgggcggcgagctgggaagcttttgcgtctcgcggaaagcgcggcatgtaccgatggtttgcctgccatcgccggagaacgatgggctcgctcagctccggcggcggccgcgtccgcttggtttgttcgccgatccatgggcgcggcacgagacgagagccgcgtgggctgggctaccacagcagcacacatgcagatgcactgctcgtttggcccccaccccacctggctggcgcgcccaccgcgcggcattgcgcttgcgcgtgtgcgcgcgctagctagcgcgcagtgcgtcagtgagacgctgcgtggtctcgcgacgggtacaaatcctgctctgtgtgcacgtacaaaccacggctcacagatcactgatatgtgtcacttgctcttgggcgcatattttcggtctatattactactcatggagtagtagtagagtagtgcacctctcaactaccgtctcacacgaagcttacgaaatgagataaaactaaaaagatgatgtggctagtgaactaacgttattaggtgcatgagtaacatggaaatcaagagattatatcataagtaatgttatttgaccaacaa

SEQ ID NO: 3122 - DNA, 1501 bp, Oryza sativa
cgatgtagtaaactccacgtcttctccatattcaggtatcaccggttaacgcaaaaatgagaggcctctccgaatagattttacgtttcaaaaactattcgatccggatagagaaaccccccttcctcccatttaccggcggttttgggctaattatagagattaatctcctaatgaggactgaggagacgggcccagcctgtcacgtgaggagcacacgatggagttagctactgcatgtagaggccatgtcactctgtaattggcccaaaatggttcaagagattagtttaatagtatagccaactatcagctctaaatcatttatagtcaacctaatagtcattcatataagagcacccgcaatggtaaagtaatgtgctctctataaaacatgtacatctcagcaatatactcgattaatagtaaaccaccttaatagtatgtctacattggtatttatagctctctcatgcattgcctcgtttttctctatagactatctctaagttagtagatagctttgctctctctcttcatttaatacctttcaagtaggaaaatatgctgacatggatttcttgtagagagtatatagataaccattgtgggtgccctaatagttaattacaaatatatactatatcattaataactggtcccatatatcatatacacatagtgttctagagttcgtgctgcagctggctacaaatctatagcccctgtcggctattttttttttcatcctctgcgaaccgtctcaccggaaggaagctcagcgccatgctcaccggaaagaagcagtcgtgccgtccggtgcctcctgcaccctagtgttagggatttgggctctagaggatggggaatttgagggaaagagagacgagaggagggaattatttaattttttgctatgtcatccgtcggagtgtcatgtgagataactctggaacaaaactggctataaatgggaatgagggggttgtgtgtccggactgaatagttatggtgaaaatgctcgatcggtcgactgggggaggggggaaattggttgtttcccctcccccacgcgcgcgccccgctggacccacccacttgtccctacacttgtttcacaaaagatgtttcacctagtgtacttataatgtctcactatgtatagatctaatgttgcagtgaattaaaatattcttttgcaacaaatcacccacatattttagaaaccctttattaagggaattcgtttcatttttttgttccacccaaaatatttcatctagtgtactcataatgtttcactatgtatagatccaatgttgcagtgaactgaaatattcttttacaacaaatcacccatatattttggaaactctctattacgggaattcgtttcattttttgttccacaaaaaatgtttcgccttatataatgtttcactatgtatggatcaaatgttgcagttaactgaaacattctttcgctatttgctgaaacctg

SEQ ID NO: 3123 - DNA, 1501 bp, Oryza sativa
agttctccttgcaatcctttttctcacttctctttttcatatcaactttgcatgactagcggcagcctgtactttatttttctatttttctatggtgttggtaaatcaagtctaaagatatgaggtaaatcaagtctaaagatatgaggttacatatgttttacctacaatatgcttatgaactttcaatgttagaatgacatattttgttgatacctgcagttatttttttaagcacaaacactaagatcacatatgtatgttctgtttgttgattaccttttcctcagatacacatgctccagttggaatgtgcatagccattatgtcttgctttacatgttaattaattaactgatttagtgaatgtttactacagtgattggtccgtatcacaaagtacaatggacaagtgtgactgaaggtaattcactagccttttatgtatatttatagttataaaaatgtctgcagtgtgcatcagacaagcaaagagtatatatgggcggcgatggcacattcctatggaagggatttatgagtccaatgtcaaaatcctctctatcagtccatataatagcaattgcctaccatttatatgtatgtcaccccatcagagttatattcacgtgttcttatattctaaatccatatgttgttgagatgtgttcttcaatcgatatctatgcagagtgtcctatcataacattaacaatgttagaccatattttggcccttttcatagaaacctaccaaaatagcacttagactgacttggcaacaaagaagttacttggtcagatatatttttatgtttgagcttacttccatagtttccatctatgcagcgctcaaatttattcacccgtgttgccattcgcttaataaaccctattgttttgtcctataaactttccccacgttagatgtctacctcggctgccacgccgttgcctgatttcgcaccgtcgtagttgctcctagggttcaggttgagtttgtgccatcctttatgcctttatttttcacagtgatttaatttgtgtttattttctatcacttaatctctgctaaatgtgatctgcaagtattgattggctggtgagtttgcagtgcaagactcgtggctttgttttggttgacgaaggtagtttgatctaactataacttttagttttactttattttacttctatccatacagtctcgtagcctcatgctttcaactttctgatgctatagtacaggtgctacattcagctgtgctcttatgaattgataaataggtttattccactgaagaaacacttctggtagatatgttgtgccaaaacagcacttagattggattgacaggaaaaaatgcttgctcagatgtccttctattttgtgcttacttttatggttcacatatatgcggtcttaaaatttattcagctatgttgccagtgctttctacctatagaattgaacttctttggtttacctccaaggtaagtac

SEQ ID NO: 3124 - DNA, 1501 bp, Oryza sativa
aagaaatagataataaatattggtgtatttagaaatacggtaatctatctatctatctattatattattaaaatagctttgaaaggaggcaccacgttcgctgtgggggttagaaattcccacattaatcggagaaaaaaaaaagaaaaggagagtccaggtagaaatacaatctaaaaataactgaatttcggaattaaaaataagcaatattgaaagaagtttccatataaaaactcaatacgagattaatcaaaattataaataaaagtaaaataaaatcacaaattagaaaaggaaaggagagtctaagtagaaatacaatttaaaaatagctgaaattcggaattaaaaataagcaatattggaagaagtttccatataagaacccaatacgagattaatcaaaatttgaaataaaaataaaataaaatccaaattagaaaaggaaacgagagtccaagtaggaatacaatttaaaaatagctgaaattcggaattaaaaataaggaatattaaaagaagagtccatctaataacccaatacgagattaattaaaattcggaataaaaataaaaataaatatgaaattagcaaaagaaaataaagaagagttcaagtagttagctgaaattcgtaattaaaaagaagcaatattgaaagaaaaatccatataagaacccaatacaagattaattaaaatttcgaataaaaatataataatatccaaaattagaaaatttaaaacagagttcaagtaggaatacaattttgaaacaaataaaattcaaaataaaaaataaaaacattaaaagaacacaatacaatattaactaattttttagaaaaaataaattctgaaattagaaaaaaaagatttatattaggaataaaatttataaataactaaaatttgtgataaaaataaagactattgaaagaaaagaccatctaaaacacatgacgaaataaattaagtaacatggctataaagtagtagagttggtggtggttaatacggcatataaaaattattaataaaacaccaaatagaatcctaatgacgattaaaaggagggacatcaggtatgccgtgaagtaaacaagtaaagcggttgccgggacttctagaaagtataaagaaagaaaaccacattgataatcattttcgatttttaaaatctcaatgacaataaaaaggagaagcaacgagcggggtgtataagagtatagttgcagagcctccgacggttgacgggacttctagaaaataaaaaatgaattgtaatgatagttatgttcgatttttagaatcacaatgacaataaagagtaggcggcggacgggctgcagaggggcatagtggcatcgtttgatgagacttctaaaaattataaaaaataaaactacaagtccaatttttaaagatttagaaattctaaaaagtaaaaaaaaccaatgataatcatgttctattttaaatctcaatgacaataaaga

SEQ ID NO: 3125 - DNA, 1501 bp, Oryza sativa; identical to SEQ ID NO: 3117

SEQ ID NO: 3126 - DNA, 1501 bp, Oryza sativa
atatagaaatggcagcacatgtaaacatgtaagcatgttcaaaacagtagaatctggaatcaaatacacataggcacacatttgttataacaaagtatataacagtagcaagtgaaaatacatgtagtgcagttagtgtacacatggcagcaaccatgtgttgaagttaagaaaaaaaaaacggaagcatatcaccttctaccacaatacaactgagtagttaaaataagtgcacaaatatgcgttcataaattgtagatgcagcaagttggtacttaaaagataagttttatttattgttgtcattacatctaagataaattaaagttttgctgcaaatacaacacacaattcagttatgtggtttgatcacgttgttgctggaaatattgttttagatatgtaacacatgccaactttgcaaacaataacttcagctcctaaatctcttgcttaatacagaataattcaaacatgtgcaagttcaattatcagtaatcctcaacacatggcactaacaggtcagattttaattacaacatgtcatggctgatcgccttggattattttgcaacctatgcatgctgctcattgttatcatgataaatacagaaacattgcagacatgttcaaattaaatgtgctcttgtcatctacacatggcatgaaaagatcatagtagagagatcagaacatgtaaactttaattcagtaccctagacagatcagaaaacattcaacattcaatttaatttgcagaaaaaaatatcattttttgtaatccatacattgagctcatacttatcattctatgtacaaaaacattgcacacaatctgcagatgtaatatcagttgtgaactacacatggcatgaaaagttcatatttttctgtgtttttttgagtgaactacacacttacaagtttcattgtgtttttcagaaacaaatgtctaggtttgtgatgtatacattcagctcaaaattatcttggtatatacacaagcatttaaaagaacacacatatttaattatcaaatgtggtgtacacatggcatgaacagatcatattaggctgttttaaattaaggactacacttgtgacaaatatggtgtacacatggcatgaacataatatattgttaataacatggcataattaatcataaatgtagtttgacatatctaggcatagaacaagtggtctgtaatgtcatgtactttgggatcaacattccaaatatatgtatgatagttaatcatacatctatacacctatgtataaagttttgatacactggcatctagagtatatctataaacctatatatgcatgaaattctgctacaagtttcaatgtaattttcagatacaaatgtcaaattttgtaatctatactttgagctcataattatcttggtatatatagaagtattctaaagatattgaaatttaattatcaaatatggtgtacacatggcatgaacatatcatactaggtt

SEQ ID NO: 3127 - DNA, 1289 bp, Oryza sativa
ctccatccgccgcgccctcccgttgtttcccgcgcgcgcgtgccgagtggccgaccgcctggtcaccgctgccgtcaccctgtgccgcgccagcccgcgcctgtcgcccgtgtcgtcgcgccgctccaaaccgccccgccgtcatcgccgtcgtcaccgcctcggtcccgccactcccgcactagcctccaagggacggaggcagagcctccctcctccctctgccgcgacgcccccgctccctcctccttttcccgaagaggcaaggggacaagcccctttcccccccctccttttccccttttcccccgccggcgtcatcctccctgtcgccgctttggccgcgaccgccgagcgccagctcgcgcccttgaccgcgcaagttggttcccaaaccgacattgctgcccatttaaaccccagctccttcccctccaatctccctcgttttcgcctccgtgccattgccgccgcccccgtgctctgttcgccgtcgccgttcgttgttgcgcgtgtcggaggagttggcacgagcaaggacgcggaaggggacttcggccgcgccctctccttcctcttccccggcccgaggccggagagattactcccgcgccgtcggcctctcgtcacagcgccccgtcccgcacggtagtgtctccctccgttcttcctcctcgctccatctcctccccctagctttcggtagtagcccgagtagactccccgtagttagccggcgccgccccgaccgttgtcgtcgctcgccgcgtgctcgccgccgtcgccgctcgagctccatagcacccgctcgtcgccagcctcgctcggcgtagctccgtccaatccgacgctagcatcgagttcccgaagccgcgtagatgctctcaccgccgggaatcgacccctcgtggcctcgtcgccgtttccctcttccctccccgccggttgtcgccgctgcgattcgccgccgtcaagctccctccggcgaatccgagccgttggctcgtctcccctcatcacgaacaaccgcccggtgtgctcgcttttgcccgtatcgccgtggttcgctccgccgctcgccgccgccgcccgccgtccattcgcggccgggtcgtcgtctacctcccgccggcccgcgtggcagccacgtaggcgccacgtcggcgccagctcagcctagaccgggtcgggccgaccccggtcagtccctccccgtgcacgcgttccaccgcgagccgtgaggctgtgcgtgggcccgccgcacccgcgtccaccgcaaaccgcgcgcg

SEQ ID NO: 3128 - DNA, 1427 bp, Oryza sativa
gtccacacacaccataagggcaaccacgtgcgggtggccctctcagacataagtaaacaacggtaggcccaatcgacgtcatagtcgtcatcctcgtccttgacggttcattctgcctccttctcaagaaagcatgcgcaagtcaagcagctttgacgtcggcaagaacccacgtccgcctccgcccaccccgccgcggtggtcgccggttgctgccgcaagaggaggtcggcgtacaagcagctatatgcggcaaggcgagccgaggtggaggagatatggcggccagaggtagagaagaaggagaggggaggggttgacgggtggggaccaagtcgctttccacgtgggcacgccacgatggctcgttacgtagacaaaagtggcaaattgttaagaaatcacctatctccagtggtaaattactaaatacaaatcaaataggggcatttagataagtaacaaatagttaaatagcccgtggtaacgggctaatcgccgccgaatctctcttcttctcctccttcccttttttttctttagttattttccttcttctccattcccggccatgttcttcaattcctgtccggctcagtactttgtgacacggaaatctgctcttgtaaaagtttaggactgtttatcagaatctggagttttggacacaaggggtggtggtgcagttggctagcgcgtaggtctcatagctattgagtgatcctgaggtctaagttcgatcccctctcaccccacaaaccttgcccttgcgatgacgaaaagctcttcggtggcaacttgggtcgccaccttcgtctgaactcagatgatccgagcacaatccgagcttcgtttttttttctttattttttttgagtttttctttccaggtttctcgatctaacaaccatctgccacctggccatgatcagtcgcgtccgcgtccgcgtccgccgctcgccggtgggcccgtctcccgcacatgggcacgattcccttcccctcccaaccgcgtcgccgaaggaaagcaacagaaaaatcccgcgcaacccgaccccgaacaggctgccacgacggtgcgagctgtcctccataactccagccatctccccgctgtgcgctcccgtcctcccgcccccgtccccacccgtcagccaaacccatcccaccacgaggagtgaaccaaaaacgcgagcaaccgagcagagcgaggagctcgcttgctttgccgttgccgacgtcgcccccaatctcccgcataacgccgcggccgtagtagtcccgaaacctccctcccccacattgcttgtctcctccaccttgaacccgagtttctcacccacatccaccagatctgcgaggaggtaggaaagctcgatgcccgatctgtgaagcggaagcagttagctagttgtagttgagagcgg

SEQ ID NO: 3129 - DNA, 1501 bp, Oryza sativa
cgccaatatggtcaatcaagggtcatgatatctaaatacattgtaatatgttaaatcaagaagtggtgttcgtaataagttttccagtaattcagttttcagcttaaaccttattagtaacaaatattgtgtcttgagatcgtcatcagtttggacttttctatgatattttttctattcagcttattaaggtctgtgccagtttttataacagagacaatattagattagtaggtaggagtacatgttaataagagcatattaaggtcagttagctttccacctcagctgctgataattgagtagcactagactaatagaacatgttaataagagcttgaatggtaagaacagtgtttcatatagtggaaagacaagattctgaaaaacctgcagttagaatctggaaaacagttttttcgggtagacaatgcagcatcacgttaagatcagtactccagagcgattaaaaaactgttagaaaattctaatgagcccagagaattgaccgttggatgacgtgcacggatgatgcgtcgctctgggccaacccatttaataatccattgaaatcatggggtatggattttttttccttttgtgacatagcagtacagcagtacagatcaataaaaacggaagagaaaaatccatagcgctagcactgttctacagcctgttcactctagctgcaacagtgcaaatgcaacgcttgcacatacaattccgttacagcacgcccgttctgaccaggtgcatgagtaaaacaatggtcacggacttcatgatcatatactgaattagtactactccctccaacctgataatattacttaacattttggatagaaacatgatcttcaaagccaattttgatcactattttttattacaatacatacagaaatatcaataagtatatgattttatcaagcactttttaaaatcttatatggtcaccatatttataagacatattttaaaagttatttatatagtaagacatttagagtttgataataaccttgttcaaaatgatacgagtaaatattattaggccgtgttttgttttaaagtttttcttcgaactttcaattttttcatcacatcgaaacttttctacacacaaactttcaattttttcatcacatccttccaatttcaaccaaatttttaattttagcgtgcactaaacacagcccttagtcaaaaaggagcagtagcagcagttgttgttgacagtagtactccactactgatcttgcaacgcgaggtacacagaagcagaacaccggcaatttctgttgtctgaaacatcgggatattagcatagcactgcactgtgaactctggtgtcatgtgccgcaagcagcgattcgatcaatctccgttcgatcaatcttttccaccacctttcttcatcgtactctggcagtaaaaatggactgtaaaatggcttcttccaagagaaggccggagtaccacacagttcacgaggtaa

SEQ ID NO: 3130 - DNA, 1501 bp, Oryza sativa
actgctcctttttgactaagggctgtgtttagtgcacgctaaaattaaaaatttggttgaaattggaaggatgtgatgaaaaaattgaaagtttgtgtgtagaaaagtttcgatgtgatgaaaaaattgaaagttcgaagaaaaactttaaaacaaaacacggcctaataatatttactcgtatcattttgaacaaggttattatcaaactctaaatgtcttactatataaataacttttaaaatatgtcttataaatatggtgaccatataagattttaaaaagtgcttgataaaatcatatacttattgatatttctgtatgtattgtaataaaaaatagtgatcaaaattggctttgaagatcatgtttctatccaaaatgttaagtaatattatcaggttggagggagtagtactaattcagtatatgatcatgaagtccgtgaccattgttttactcatgcacctggtcagaacgggcgtgctgtaacggaattgtatgtgcaagcgttgcatttgcactgttgcagctagagtgaacaggctgtagaacagtgctagcgctatggatttttctcttccgtttttattgatctgtactgctgtactgctatgtcacaaaaggaaaaaaaatccataccccatgatttcaatggattattaaatgggttggcccagagcgacgcatcatccgtgcacgtcatccaacggtcaattctctgggctcattagaattttctaacagttttttaatcgctctggagtactgatcttaacgtgatgctgcattgtctacccgaaaaaactgttttccagattctaactgcaggtttttcagaatcttgtctttccactatatgaaacactgttcttaccattcaagctcttattaacatgttctattagtctagtgctactcaattatcagcagctgaggtggaaagctaactgaccttaatatgctcttattaacatgtactcctacctactaatctaatattgtctctgttataaaaactggcacagaccttaataagctgaatagaaaaaatatcatagaaaagtccaaactgatgacgatctcaagacacaatatttgttactaataaggtttaagctgaaaactgaattactggaaaacttattacgaacaccacttcttgatttaacatattacaatgtatttagatatcatgacccttgattgaccatattggcgactctaattctatttgaacatctaatataactttaaattttaaactgtaatcgtttttatatacatgtttaacacaaaactcttaagagtttcaactgaaacatgcaaagcctgaatttccagttggaattctccaaccgcaaaggatcttggccacgttcagcgccggtcccagtttatcttttataacccagcactttgagctttgaagcacaataccaggcatgtccaattgataatgctgctcggtgtgcactttgactgcactttgtcgatgacc

SEQ ID NO: 3131 - DNA, 1501 bp, Oryza sativa
gtccactctgaaaagagcaacatttgtcagacaatctgtactaattttgccacacaaacaagtgcatgtgcattgattttctttacttccagacttaacaaaatgcactgttatctctgttccttcctacaactatcattccatcgatcagtaactcagacaattcggaaggcataaatggctaatctggagatggagcgaacaggcaaagttaccatacccccagcttgcaactgccaaggccgtgttcagaggctccaggggatccggtggtggaggcttgttgctagtcttcacggcacagaaacggcagccgcgcgtacaggtatcaccgagcaccatgatggtcgccgtggcgatgccgtcgccttccccgcccgcccctcccccaccgttccagcactgcgccccaggagcaaaggatttagctgttctcgcagaaattgctcgcgaggatcaccttgctctagtcccatacgatacgactgaatcgcgtacctcgccgatgttggggcactgggcctcgacgcagacggtgttgagcttgagctcgccgatcgactcccgcagccgcgcgtacttctccccctgcgccgcacgctgccgcagccacgccggcttcttcacctccgggtccctcccggtgtacggccccgccgccctacgcgccgccggcgccggagccggcggcgcagcctccgcgcggcaccgggccacggagaccgagccgggccggctccggcagacagggttcccgcaggccggccggatcgggggccgcggcaacggccgcgcgagcgagctctgcatcatggccgacgaattcggcgccgccgctcgcacccgcgcggagtcgtgtagccgtggcgcccgccgccgtcgtcgtgcggggcgatgggttcgaagcgagacttaaagattttgcttctgccgattttacccctctgctctggccgcaaatccactggatggttggatgggttaggggtaaaataggaattatagaattagccggcgatgataccaaggttgctgctcaaccagtttgacacccgctgccagttgtttgctaccagagttttgatttgttgtcatattgatattgaaacgtcaaaataggcaggaatttcacataaattagtttagttcttgtaaaattcctccatttcaaggcctaacaattgctgaagatttcatactgaaaattcctcctttccaaaagaggccctcacagatgttggaatttcatactgagatagtgtacatcaaaccgttacttgaggctagctgtaaccaatagcagcaagcacaagaccagcatattgacaccatcaaaaagacaaaagcattcaaatgctccagtttatatggctgtaataactactacacaaatttacaaataaaggcatgcagcctcaatcctggcaggaagtatatagtgcaaccggagttccctttaaacaaaatgtaggcagagtaatgaacaaaccaaacatttatg

SEQ ID NO: 3132 - DNA, 1501 bp, Oryza sativa
acatgtgtgattgggcggctaaagccggccaaagaccggtgctaactgctcattatagtcggtataatcgttggggttagttggatctcccgcggtgcacggcacacgcggcctattatactaatccaccgtcccaccaggtgtcgcttgacacataagcaaacgcggcggaaaaggagaccggccctcttcggttaggctagcggcggcctaattaacgtactccgcgtagtagtagcagtagcgctcgtcgcgtcacgcacggcacggcgtgcggcccccccatgccatgcgctgctccgcgggacgtgctggtgtttgacgtccagccagccaggtgctggatcggatcgagcgggacgtgccgtcggcgaagcgcgcggggcggcgcgtcccctggccagcgcacgtgaggcgtgcgagctcggcgcgggggagacggacggcaagacgatctcacagggggggacgcgtgcgcgctggccccgcccgcgcgcggaggcgaggcgccgggggcgtgggcacgtagtaggctgcacgcgtgggcactggccgaaacggaactcgcgcaccgtgcccaccacgggtagtacgcggccgccacaccgttcgggcgcgagcacgtgggcgggggtgggacggtcgctgaccggtgtttctctactcctggctcggcctctgggcggtttttcaatcggcaacaacggtgagtgattcggtgggtaggtaggttggtggtgagagcggcacgacgacatgggccaccctggtctgcgcgtatgttcggttcagggtgggccggcatggacgagtcgtcgtaggatgcgtggatgaccggtgatattggtagcagtagtaacctcgcgtcatgtaacccattaggctagtctgtcgatctcttgaatgtcgcggttcgccccgaaccacgcaattatacagccttccaaggagtgacgccgccgtcggcgatcgaggtctctcgcaggacactactgaaacaagctcgttacagaaaaagaaaaaaacaaccattctacttaattgaaatataattggcagttctcctgccggtttagttaaaaaaaaacaagctcgttactcaacttgacaagttcctttgtgtattgtctacaaaaggatggcttatacttactccgtccttaaaaaacaactcagaacagaatgtaacgttttctattacaataaatctaaacatgtgtactataaaacgttacatcgatagagtattttatactactactttgtaaatctcctcgccaaaggaaaaaggaaagtaagacgctcatttggctgtaggagtgtaggtgaaccgatcaaagtatcacacagttcgagaaatgatgggagcaccttcaaattgtcttatcctaaagaaatcgatgcaaatatattgttttatgaatcattgatcgagatccgaacacaatacaaagcaacggattgttgttatagtaatatgggctgttgagactcaaatttg

SEQ ID NO: 3133 - DNA, 1501 bp, Oryza sativa
atacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgtcacggacattcttccttcatgcacctcacttcatacacataatttgttgacttgaccaccctaaactctctctgcaatgaaactgcccaatgcttcaccgcctccttcatctcatccttatgagcataccttgcaccctcaattacctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgcttcccttctgctgccctcccctctctctctctttcgtttttttggatttttagtgaatataatgaaatttcacaggggaggggctgggcttt

SEQ ID NO: 3134 - DNA, 578 bp, Oryza sativa
gcccccttgccgccctccgatagggccactctccgctgtgcgggggggccgcctgcaaatgggcggcgagggggcatggaattttgcaggcggcccccttgccgccctgggggagggcgatttttgcctcccccctataaagcccagcccctcccctgtgaaatttcattatattcactaaaaatccaaaaaaacgaaagagagagagaggggagggcagcagaagggaagcggcgaagccctgctggttcgctcacttcatcacaggtatgctcccatacatcttttgcatttgtactaatatattacgtttgagtacatatgttgcgttttagttttagttccatatattttagcagatctgtagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaa

SEQ ID NO: 3135 - DNA, 1501 bp, Oryza sativa
atttcaatcaaaatccaaactttggatccagttaaaaacacagccttagttttcattttttttttctttaaccaaaaaaaggtagggttactgaaaaccacactcaaagggattgtttggtaaataggacaggagaataatatcagacactctaaaggtaatattactgtatcttagtcatctattctttacaacacatttaatcctaaacatttatctatttttcttctcaatcccaccaatcataagtcataacccatttgctgaacacaccgaagggtttctatctgatattacaatttgtaaataggcaatggctacacataaaatcttattttagtgtgacattgactagttcgtaccgtctaaataaaatcggcgaacattttatattgtattccctccgttttatattgtaagactttctagcattactcatattcatatatacgttaataaacctagaaacgtatatatgtttagattcagtaacatctatataaatgtggggaatgctagaaagtcttacattgtgaaacggaggaagtatttgttaactctagaaagcatacggtcggctataaatccatgtagaacaaatgacatgttgtgtgtggtgagttcaccgtctgaaacgcactatataattttagagcctattcgatttggacgaatttcatgggaattttaaagaaattgacctatttttcatatgaagtatttgttctagttaaatttttccgaattcattgtagtgtaacctgcaaattttaaccgtgacaaaagtagtactaattttcgtgcaacaactgcaattgatattaccaaaatgaactgatatgataaaatacgaacttaactcgttagtttcttatggtgggactaacttacctgggttaagtactatacttgacatgtgtgatcatatttacagctaattattctttcagcggtaggtaacgtacccatcaacaatgttgatccatgatgacttcatcaatacatatatcggtccagtcttctgggggtgatcgtgtgtgctctagcaaggggcctgtgataacttcgtcgatctcaaaatatatcgacccagttttccggagcacctcataaggttaaggtgtgcgcatgtacatttcaacgaggggaccgtggtgacttcgacaatctcaactctcaagcgatgccgacccaatctttcggggatgctctcgtgtgtgtttcagtgagagatctgcccgcggtgactttgttaatctcaaatatgcccgtggtcttttaagatgcttgtaaggataggatgtgtatatatacgtttttaaggtaagtgcttgtctctgcatctggtgtttatactgtactatctccgttaaagaaaaaaataacctaggagggatgtccagatacttgtgcgagtttgattttttttggacggggagagagtaggttcaagaggaaaaaaaaactgatctgaaaccccgggtaacctaaaaacctcagc

SEQ ID NO: 3136 - DNA, 1501 bp, Oryza sativa
ttctcacttcagaataaaagtaaacccgatgatacttcacgctttactacaggaattcatataaaaccgtaagaatgaatgtggtgacaataactcgtgtgatgttgctgccgacttgtctagcgtcacgtaaagatgggtgaaaatacagaactatatagcgacaattgaatttagctattttggattactaccaaaatgtgtccaaccaatttattggcagcttgaatagtaatgttaggtgtttggattgtagcaaacaaatcggtaatgcctcaagtaaatttggcactaatctaaattttctcctctgtaatattaaatctctataaccgatttaagggccaaatatctagcctcctattgagccacgtgcacactaaatcatcgtcgtcgtcgtcgtcgtcgtcgtcatcatacaatgaacgtaaaatgtttattcgcattttgatttgagccaggtatgcttttaagatgtgccgttggatttggaaaggattggttagaaatatagagggcaggagaagattcatgacacttccaatggaaggatcggaagaaaacatgggaataataaaagcatagtcattttactttgatcagaaaaggggagcatctggagttaagctcgaaaaagaatgttagaaaaaaaaactaatgctttttccaagcgtggtgtgttcccttccaacaatacagaacacggttcttcgaatgttcagaaattaatgctttaatataaatgtttaaaaattacttggactaataattaaaatataatacctgctaataatatacaaagttgagaacatatgctaatattaatatttacgacaaattttacatgctaggcatgttaattatttatgatcacaaatattgtttataatagataaacttcctagttcctacaaaatatgttctttaagaacttatttacaatataattataatcaatatattgcatttaataggtgggaaggcatagtcatgcgaacgcacgactttactggctagtatttagtaaaggcttctttagaaaactgccatgtgttcatttaaaggtaaagaggtgcagtatatgtgtgttggaaagtatgtctcctgtgcacatatacctataataaatctctagaaaactcaatacattgcctggtcatttgagagattacctggcttttaaagaagatgaaaggtaaccctcccgtgtgcgtgatggtaaatacttcatccgtcctaaaatataacaacttttaacccttaggatttgtttcaaaatataataacttctcaaccgacattttcttcccaacaaatcacaatcctccaccattcacttttcccacctacctccattattcatccaatcacaaccctccaccaatcacttctacctactttcttaataaccgggcccaactctaaaacttattatattctggaacagagggagtaagtgtttatggcacaaaatctatacgattgtaacttttcatgtggt

SEQ ID NO: 3137 - DNA, 1501 bp, Oryza sativa
cagattacttttatcttgttcttgcttgtttcttcgatttgcttgcaggaatagggttgatctgcaccggcaagatcaacaacccacggagaggtgtatcgatcgctaaggcgcaacacaacgtctcgtacggttgtagtcggatcgtcaacgtttctcccaaatcgtagttatcacaactcaccgaaagatcgggccaacaacagtcttgagtgtcgagaggaactcagggttcatcatgatttgtcctaaaatataacaacttctctaccaacattctctttccaaccaatcacaacccttaaccgttcacttttcacacatatcttcactactcatccaatcataactttccaccattcacctctacctactttcttaataaccgtacccaactctataacttcttatattctggaacggagggagtataagaagaatgtaagatgttactctctcgattctaaaatatagtaacgtagaacaatggttttattcataatactattatatatctaatctaatcttaaattactatatatttgggactgagggggtattacatttttatggctcttatatcacctagtaaaactaaaatgagcggataacaataaggtaagtatagtttaactgattaggttttttttttttaaatctgtttaccctagttcaagttttaaacttgatatgagtgttcatatatatttatgtctaattaaattatcctgtttcggaggtgattaactagaacccgtgtagagcacattatttttcctataaaaagggaacagaatagtatcaggtacatttttgctagagcgatgttcaaaatttccaacgtttatgttgaaagtgcacgttcgtcgaaagtgcgaaattgtcatttgcaaaccgcaaaattcttcgacacggtgcaaagaagtccatatggcttacataagattatgtgacgacgccgttttgcaagtatagatcatatcgcacgcttgcttaagtcaatgtacatccttccattttgatgaagagagacgatgcattaacagttccaaatatagttcagttagttatcccctcagctgagaagcaaaggtcaactctttcctaattaaaagatcttctctcgatcggttctcgccattcatcccagatcggagattccgtggctatcatcccactgtaccactggctgcttattaatcggcaagagaggctcgcagcggctcaatgcacctggtccacccagcctagccacaaccggtccaatccaaactctctaaacacaggagtagcggcgtgtacatgcgccaactgcccacgcggccgctgtcaagttgttggccgccaactcttcgcctcgctcccgtgtgtagtacggtaaacggtgtactaccacttgccctgacgtacgtactacacgcgccccggtgagccggtccaatatatacacgtcgtactcccgagaggccgagacgcgccggcagagagcaagcagatcaat

SEQ ID NO: 3138 - DNA, 1501 bp, Oryza sativa
gggaggagccgaagggtttaggaggaacgggaaacggtatggaagctgaggtttttaggttacccggggtttcagatcagtttttttttcctcttgaacctactctctccccgtccaaaaaaaatcaaactcgcacaagtatctggacatccctcctaggttatttttttctttaacggagatagtacagtataaacaccagatgcagagacaagcacttaccttaaaaacgtatatatacacatcctatccttacaagcatcttaaaagaccacgggcatatttgagattaacaaagtcaccgcgggcagatctctcactgaaacacacacgagagcatccccgaaagattgggtcggcatcgcttgagagttgagattgtcgaagtcaccacggtcccctcgttgaaatgtacatgcgcacaccttaaccttatgaggtgctccggaaaactgggtcgatatattttgagatcgacgaagttatcacaggccccttgctagagcacacacgatcacccccagaagactggaccgatatatgtattgatgaagtcatcatggatcaacattgttgatgggtacgttacctaccgctgaaagaataattagctgtaaatatgatcacacatgtcaagtatagtacttaacccaggtaagttagtcccaccataagaaactaacgagttaagttcgtattttatcatatcagttcattttggtaatatcaattgcagttgttgcacgaaaattagtactacttttgtcacggttaaaatttgcaggttacactacaatgaattcggaaaaatttaactagaacaaatacttcatatgaaaaataggtcaatttctttaaaattcccatgaaattcgtccaaatcgaataggctctaaaattatatagtgcgtttcagacggtgaactcaccacacacaacatgtcatttgttctacatggatttatagccgaccgtatgctttctagagttaacaaatacttcctccgtttcacaatgtaagactttctagcattccccacatttatatagatgttactgaatctaaacatatatacgtttctaggtttattaacgtatatatgaatatgagtaatgctagaaagtcttacaatataaaacggagggaatacaatataaaatgttcgccgattttatttagacggtacgaactagtcaatgtcacactaaaataagattttatgtgtagccattgcctatttacaaattgtaatatcagatagaaacccttcggtgtgttcagcaaatgggttatgacttatgattggtgggattgagaagaaaaatagataaatgtttaggattaaatgtgttgtaaagaatagatgactaagatacagtaatattacctttagagtgtctgatattattctcctgtcctatttaccaaacaatccctttgagtgtggttttcagtaaccctacctttttttggttaaagaaaaaaaaaatgaaaactaag

SEQ ID NO: 3139 - DNA, 1501 bp, Oryza sativa
tccccgaaagattgggtcggcatcgcttgagagttgagattgtcgaagtcaccacggtcccctcgttgaaatgtacatgcgcacaccttaaccttatgaggtgctccggaaaactgggtcgatatattttgagatcgacgaagttatcacaggccccttgctagagcacacacgatcacccccagaagactggaccgatatatgtattgatgaagtcatcatggatcaacattgttgatgggtacgttacctaccgctgaaagaataattagctgtaaatatgatcacacatgtcaagtatagtacttaacccaggtaagttagtcccaccataagaaactaacgagttaagttcgtattttatcatatcagttcattttggtaatatcaattgcagttgttgcacgaaaattagtactacttttgtcacggttaaaatttgcaggttacactacaatgaattcggaaaaatttaactagaacaaatacttcatatgaaaaataggtcaatttctttaaaattcccatgaaattcgtccaaatcgaataggctctaaaattatatagtgcgtttcagacggtgaactcaccacacacaacatgtcatttgttctacatggatttatagccgaccgtatgctttctagagttaacaaatacttcctccgtttcacaatgtaagactttctagcattccccacatttatatagatgttactgaatctaaacatatatacgtttctaggtttattaacgtatatatgaatatgagtaatgctagaaagtcttacaatataaaacggagggaatacaatataaaatgttcgccgattttatttagacggtacgaactagtcaatgtcacactaaaataagattttatgtgtagccattgcctatttacaaattgtaatatcagatagaaacccttcggtgtgttcagcaaatgggttatgacttatgattggtgggattgagaagaaaaatagataaatgtttaggattaaatgtgttgtaaagaatagatgactaagatacagtaatattacctttagagtgtctgatattattctcctgtcctatttaccaaacaatccctttgagtgtggttttcagtaaccctacctttttttggttaaagaaaaaaaaaatgaaaactaaggctgtgtttttaactggatccaaagtttggattttgattgaaattgaagatgatgtgactgaaaagttgtgtatgtatgacaagttgatgtgatggaaaaggactgaagtttggattcaaattttggatctagacacagcctaagtagtaggagaaacgtggttggtcacgatgtgcatacgcctccggccttccacatccttccagaaacgagccggccggattgctctccaagccaaacacggcccagagaggcgagagcccccacaccgccaaacccgacccggaaatcaactgcacacgctccgatcccctctctccagatcgattcggacccca

SEQ ID NO: 3140 - DNA, 1501 bp, Oryza sativa
taagtttagagtccatatagaaaaacatataaaatttagatctaattgaatttcgaaattaaaaataagaaaaattaaaagtataatttagagtccatatagaaatacagcttagaaaaaactaaaactagaaatttaaaaataaaaaaatattagaaaaagaatctagagtccatatgaaatacaacttagatgaagctaaagttcaaaattgaaaaaaaaaagaaatactagaaaaagagtctaaagtccatatatgaacacaactagctgggtggcccgcgcaattgcgtggctagcacctaaacaaaatcatatatttttttatgatttcacttaaaatttattaaatagctatctcgttgtcttaagactttgaaagaccaaaccttatcatccccgtgtttctattatatagtttttaacagtcacaccagttgctaccctttacttctgtcatctccttctttatttgcttgctcaatctaccactatttctattcattctcctggtaacctttaaaaattggatcttatagtttttagaatttattgtcacgttgggtttcatttttataatttctagatgcgcagtcaaatgttgccattatactcctctacggcccatccactgtctcttctctttattgtcattgggattttaaaaatcgaacataattatcctttgggttcatttttactttctataagtcccgccaaaccgtcagcagctttgccattatactcctctacggctcgtccgttgcctcccttctttattgtcattgagattttaaaatcgaacatgattatcattgttttttcttttactttttagaagttccgaacatttaaaaattggaccttgtagtttttagagtttactgtcttgttgagtttcattttttatatttttttagaagtcccatcaaacgatgccactacgctcctctacggcccgtccgtcgcctactctttcttgtcattgggattctaataatcgaacataactattgttggaattcattttatattttctagacgtcccaccaaacgttggtggctctgcaactatactcctctacaccccgcccgctgcttctcctttttattgtcattgagattttaaaaattaaatatgattatcaatggggtttatattttttactttctagaagtcccggaaacggccttgcctgttgcttcacggcttgcctgtcgtccctccttttaatcgtcattaggattctatttggtgttttattaacagtttttatatgtcgtatcaaccgccaccaccctacttttagatggtttcgtcatgtgttttagatggtcttttctttcaatagtctttttaaccaattttagttactccatccgtcacataaattgtgcttgtactgtttgaccactcgtcttattcaaaaaaaattgtgcaaatataaaaaaataaaaagttgtgtactgtttgaccactcgtcttattcaaaaaaaattg

SEQ ID NO: 3141 - DNA, 1501 bp, Oryza sativa
agacaattattcaaggtgatgtgtctacaatatccaaatatataaagaaaaagcaagcccgctacttcggtcactttgagctttgatacttggaatgaatatgaagctatggggaaatttgcctactcctgtacacatcatattgttgaaaatcagtttatttttttaggctatttccccgcaaatttcttacctcaattccaagctgtattctactctcttgctctttacttatagcaatgtcgatttgggcattttgagttgtcatgtagggcctagatgttcaaattctgccacagctctgggtttcacaattcacgtttgagtatgttaagcctggaaaatttgggaattgcctaagcagcagttttcctgtgttacatacatgaccccagtgaggtggtgtgtgtcatgttgacgtgccacttcacttcacactgaagcagcagaatacctgagccaattttgttcttcccggctgagagatccaacccaaggtacaattacaaatgaggaccggcacaatagctgctcacgtagcacggtggccaaactaagaagctaccacctgttctacctttttcattggcaaaattgagaaattggccaacctttttctttggcaaaattgagaagttgttctacctttttggttggcaaaattgagaaataagctagaggcttggaaggtgctacctttttgtttggcaaaattaaagctggcacctattctaccttttttctttcgcaaaattgagaaatactgtagtagggtactagagacgtgtgtgataagtccgggaagttatctggcgtggtcgccattgcgttgcgtcacacagatgacacaacacagccaaaggcaaatctaatcaagtattcactcattcattcattctctggacgcatgctccaatcacactcgagctgacgcacacgattgacccctgaagccaaaaaagaaaaaaaaacaagggaaaagaaagaagatccactccattttactataggtcgcttgacgccgaagcctccatcgattacatttacgcatgattacacatctcgtgcgcccaaatcatgcctaatccggtaccccgcagcggtaagcatttttgacggctgttccctcgcatgaatcggctttgcacggatgcagagatcggcagcacgttgccaggtcgactcgagcgatgagctgcagcgtcaactgtggagatgctcgcaagctggccactagtcgcttccgatgattaagctgatggttccttccgacaacaacatggattaatttaatcaggtcttcgctgttaagagtaagaatccctcctcccaccaatccaggcgaagaaagtccaagcacctgaggatgagatgcatcagacaaattgttttctcacagagagagaggtacatccgccccgtcggtgtggagatcagacggctccgtggggatctaccgaccacaccccgtccagtccggtctccatcgctttatcaggtt

SEQ ID NO: 3142 - DNA, 1501 bp, Oryza sativa
aggagagtccaagtagaaataaaaatttaaaaatagctgaaattcggaattaaaaataagaaatagtgaaagaagagtccatataagaaccgaatatgagattaatcaaaatttggaataaaaataaaataaaatctaaaattagaaaagaaaaggagagtccaagtaggtatacaatttaaaaataactgaaattcggaattaaaaataaggaatattgaaagaacagtccacataggaacccaatacgagattaattaaaattaagaataaaaataaaaataaaatccaaaattagcaaaaaataaaaaatagtttaagtatgaatacaatttaaaattagctgaaattcggaattaaaaataggcaatattgaaagaagaatccatataagaacccaatataagattaattaaaattcagaataaaaaaataaaatattatccaaaattagaaaaattaaaagagagttcaagtaggaatacaattttgaaacaactgaaattgacaataaaaatttgaaaaaaaaaattagaagaacagaatacgatattaattaaaatttggaaaaaaattctgaaattagaaaaacaaaaacaagatttcagttaggaatacaattcataaatactcactctgtcccataacataagggattttgagtttttgtttacactgtttgaccactcgtcttattcaaaaaaaatttggaatcattattttttttgaattactttattatccaaagtactttcagcacaactttttatttttttatatttgcacaattttttttgaataagacgagtggtcaaacagtacacaactttttatttttttatatttgcacaattttttttgaataagacgagtggtcaaacagtacaagcacaatttatgtgacggatggagtaactaaaattggttaaaaagactattgaaagaaaagaccatctaaaacacatgacgaaaccatctaaaagtagggtggtggcggttgatacgacatataaaaactgttaataaaacaccaaatagaatcctaatgacgattaaaaggagggacgacaggcaagccgtgaagcaacaggcaaggccgtttccgggacttctagaaagtaaaaaatataaaccccattgataatcatatttaatttttaaaatctcaatgacaataaaaaggagaagcagcgggcggggtgtagaggagtatagttgcagagccaccaacgtttggtgggacgtctagaaaatataaaatgaattccaacaatagttatgttcgattattagaatcccaatgacaagaaagagtaggcgacggacgggccgtagaggagcgtagtggcatcgtttgatgggacttctaaaaaaatataaaaaatgaaactcaacaagacagtaaactctaaaaactacaaggtccaatttttaaatgttcggaacttctaaaaagtaaaagaaaaaacaatgataatcatgttcgattttaaaatctcaa

SEQ ID NO: 3143 - DNA, 1501 bp, Oryza sativa
attgttatcatgtctagatcaacctgtataaaatgtcccatcgatttatatatatggcttaacgagatatctgttccttttcttattttctttttgcctaagcagcgtgacgatttgtaggctttttcttcagaattatatacactgatccgggagtcgcaatttgcacaagttgtcattttagcaataaaggtatggccgtgcatgcgactgctcacctgcaacaagcgccgccccgttcatctcgtcgcacgtcaagaatttccgggccttaaccaaatgtttccctgcctctgctcagctcaacgatcagcttgatgtttgcgtatcaccagttgattacgagttaacaccagataattaaaaatgcgacgtgaactttgtgcacgaatctcaaagcgaaatagaagacggcaagagaggtgactagtgccgtagtgattggctgattgctacccactttgttacagaatataaatatttttagaatttagaatttatactataatacaagcatcagttttctcatttcaaccgatggtcatctttcccatttaatttgtctacttacttttcattttaaccaatacttatcttaatatttatttgtactaaagttttcataaatgcttgtattttacaagagatgaaatatttctgacccggcaacaataatatgagtagtcagaaactcagaatcatcattaaaaaatcacggctcactgctattataagtacttaaaattttaaaaaatgctttgtacttttgaaccgatggagatggatccaaaccgtttttggtgaagttaccgtcactctcatggtttaatgattatcgcaagatatactataattttaaaaactgagaagattaccgtgttttgtactttagaaccagtagagatggatctaaatttaccaaaccgttttgagtgaagttatcatcactcttttgatgattatcgtaagatatagtatgattttaaaaactaaaaagattaccgcatacgatatctgtgataaccgcacggatactaaacctggatagatcatgatggcagggtgcagtagcttcgcagcgtcaccccaacccagcgcgggtgacctaactccgtccacttccacactactactactgtctactgccacgccgccgtaaccaccactcaactgccacataccaagcagttacgactgcgcatgaatccacctgggccccactttatcagcaagcaacccccatccccgcgcctacgtgtgcgccatcgcctaccgcattcaggcacgtgcacgccgcccacccccgtaacaaactccccacaaccaccgtacctacctctgccactgacaccccgggcccgcagaagctttccgagggtgggcccgcgtcgtcagtgtgtgagtgagggtgtggttacagtgggttggttttttttctccccccaacccgcgtgtacaaattcgggacgccgagacgaccaggccccaatcgaggggaggc

SEQ ID NO: 3144 - DNA, 1501 bp, Oryza sativa
caggagcataaaatagcaagaaaacaattaaattaagcgtgaaaaaggaagggacgaagaaaaaggggaggaagaagagcaaagcggagacgaccaaccaaatccttgtcccgtccgttcggtcgccgcgtcgaggaggcagggagctcgcggcctcgcaccaccgccgccaccccgccatgacgagcgcctccgagctcttcaccgcccgccgcgcccgcgccgcccgcctctccgaccccgatccggacccggatccgcctgcggacgcgctccatgacccgcacggcctcgccgatcgccgcggccggcgccggggctgccgcccgcgccgccagctcgacgccgccggggacgtccgccagcacctgcacaccggggccccgccctcccgccgccgcgcttcgtacaccgtgagaagcacatccccccgcctcatcctctctagattttttttgttcatttttttattatttttgtgtggatgtgattagatcgaaatgatttagctcatactgataaaaatttgggaggattagggctcctaatttggcttgcgcaatcccgattggggtttggatgctttagattaggttatcctcgcctagtttatggtgaaatggggacaattgttagtgtggctagcctattctcttccatttttttttctgttactgcatcaattgtcacgttgagtactaatcaatatcgtcctggcaagtactagtacttgcacaaaagactgaaaccaaacccgatcatgctgtttggtctgttcaactgaggtgttcttctgctatgcacttgtagatcattacggtccccaaaggggcagtgataatatcgtgcagtgtatctcgagaattcgttgcatcctgtaaaggcttgattttcgttataaacattaagttgaaggagacccttatcttcatttccatagaaaatataacatatcaaaatggtgtgatggtgcctcatctttcttcactcactcctgaaaattgaaatggctaggatgtatgtttagaatattggctacgcttattagaatgtcaatactcagacctgtgcatttagtattccattgccttttcttcttcttctttttgttccagttccacttgaaattcttattatgaattgttatggatgaacattaaattatgacctaggatgcatagtggaatttataactgtacagcattctgatctatttatttcaactaagaaaacgtaaatttagattgatgtttgttgtttctggtgaatcaaatgaggatattcggtctcttttgttgtctacaggatcgtgtcttatcatacatagacaatagcaacattggggactctgcaactaggaggaaccgactggataggctgatgttcagaacaaatgagcggcttcctggtgctgtactgcaagcacaagcacgtgttctagagagactgagaggcatttctattggttcatctgtgtcaaggccatctatcacattggatg

SEQ ID NO: 3145 - DNA, 1501 bp, Oryza sativa
caattgcgtcaagggtttgaccttgtgctggtttctgatgtagtttcaaagttccgccctaagcacaacattgtctgagacagagtttctactccctgtgcattttcaattttgtctaaattcagaatatgtttcctcctaagttttagttttgaatccttccaatgctatttagtttagttaaactaaaatagatcacctgttacccacgagtcgacccgcgccaatctttgtcgatagctgtgctcctctattgtgcaagcttgtaagaaaaatatattatctattataatcatactataaagataactcagaaattaaccaccacgtttgcttgaaacactataaattcttgtattaagacccccccgtgagtttggccggaggagatggcgcgatgatcaagagcgtacttccgcttaagatctaactactggatcgctcaccagtttgtgtggaagacaatggattatataggtttggactaggaagcgtaacaccctactcctgtgtgtgggattatgatgagttcttacaagaagtcttgagctcctagggaaacctagctgttcttcctctagagctcaagctatcgagagtcgtccctttttcttggtgggcgatatcctccttttatagttcaatgggataccacatgcaccgtctatacctacccctccatgggagggggacccaccctgcctcgattagaccaccattcgtgccttcaaccggaagcaaagtggtcgctcgtcctcgggtggggccagtgccgtcccccgcctgacacgggggacacccctgtcattcatttccctttaaatgtatggagactttggtggctcaccacgggcggagggcgtccctggcagtgcatcgaccgcctaacacagggcgggacatgggggacactgccgcccgtccaatcacctgtgaccacccgattgacgtgggtcaatcgagcggcgccgcacgtccacccacaccgtattaaatgcggtgagggacagggcgccgcgcatttaaggcgttgagcggcgccttccgccccacccactctccccgccaccactctccccgccacgtggtggtcgggcgagggcctcgggggagcacgccccaagagcccgaggggtgtgacgtggcaccccgaggccctctggccacttcagcgctatccaaggggcgagggaaggcgaggctgcgtggccacgtgactagacgggaagggtactttcctttactgtgcgtacccccgggccatatcaccgacagtagcagatctaaattatagtgtagattgatcgatatatttgtatttacatataactatatatataatacaattttacatttaaatctaattctaattttcatatatactctttactggtcataactgaaacagatagtaagagttctttatgaaatccaaatctatttttagttccagataaaaatcttaattgtatttggagacaaaagataagagctacatatc

SEQ ID NO: 3146 - DNA, 1501 bp, Oryza sativa
ctcctccatcatactacctccgtcccaaaataattgtatttctaggattcaaaattcgtcccaaaataattgtaattctagagtactaattgccccatcaatcatctctcatttaaatttctccctattttaccctcaaccatcttcctactctcacataaacaccatttaatgaggggcacaatagtctttcttctcaaatcttaatatatgctaaacaacatagaattacaattattttgggacggaggtagtaaaacatttcttttgcgatcacatggcagatgtgcacgtatacgtactactatacatgcaacaccacactcacacacccacgaatatgcaccctaacaaatactcaaagagacgaaaatcaacggacattcctaatctcaataaattcctgttgaaagcacaattacacatgcgcaatatttgtgggcacttcattagtaaagtacttcactcatgagtcatggctccaccaccacatcactggtgctactccattataataataatagttgccctataataacttaaaatatatatctgcactagtaattactcactccctcccggtattcaaaatttatccaaaaagcttgttagtttagagtatattttgtcacatcaatcaccaccaatttataattttctctattctactctcaactatcaactatatacacaccatttgatggaggatattatagtctttttttctaaactttaatttttgctaaataacctagaacgataactatattggaacggagggagtaagcattaaggtctattctgactctgatttatttttcacattcctacgaaatttgaactcctatctgaaaatccagtgaagttccagacgtgggcatgaacagaaggatcggatgggatgagatgaacagtacatcatgattagaggattgagggagtggcgcgacgtacagaaggcgacaaggacgcatgattagccaagtgccgagcatgtcctgacccaataatcgactgaagaatgtggcggccgtacaggcaaattgagcgtatcgccaaatataaatcccgtgcaaaagctgagccgtgatgatttgattcgatcggcaggtggttactgggtactaagccaggactaaaagcggttagtgcatactaagacggtactactaaaagtaattatttttgtactaaaaagtgctttaagcgcgcacatgacgagcaaatgctagtggcccgtggccgctttccggatatagcaacctgggagcccaacttttcagtacagaatttacatttcttagcttagcctcctgtagaacagtagaagcatgcgaatagattatagtgaaaaattctggaaataattgggcggtatcacctttttatcattggttcttttgtaaaattgtatttgcagctttgatactaataattcatcaatacatcaacgtaagtcattgatcctccaataacataagcgccggcacctggcaacagt

SEQ ID NO: 3147 - DNA, 724 bp, Oryza sativa
cccccccccccccccggcccccgcccccccctcgtagcggccgtggctggctacgcatttcttcgcgtacggcaccagcgtgaccagctgcgacgactggtccggatgattcacggggtcacaggtggcgcgcgcgcgcctagccgagaggcgcaccgcgcacgcacgccggagctagtcggtcaccacgccgccaaccgcggtgttcgcgagggaagaagtacgtgtacgtgcgcgacatgacgcgacgcgacgcgcgcgggctcgagccaaagccaaagctttctcttgtcgcgcgcggcgcggggagcgattccgaagaataatgctcggagcttagcatatgcgcgcggcgttttctggtacgtggtaggataggaggctcgtgcgatgccgccagaggccagagatggctgctgattgattcgcgaacttggctgtgtgatgagttgtgtgagcttgtgctagtcgacgcgccaacagggtcgtgatgatctgggtctttggcggattggggactttgtggcaattggcaggcggacagagttggatttggacgatcaatgtcgtctcgtcgctgcttggttcaacaggtactacacgatttggacctaatcgatctgaacaatgccgctgctggcttctcgcttgctgtcaattaagattgtttctttattctagctagggacgtcagatgtgtactgcctacgtatactgtagcagg

SEQ ID NO: 3148 - DNA, 1501 bp, Oryza sativa
taaaaagctttcatatgctctgttgtgctactcacagaggcaaaagatcgagcacctgcgctgcgatggtgtggagcagcatccacgtggccctgccgacctcctccttggtcaggggcgccgccttcgaatccttctgccgcgcatttcacccccacaacaacacaagttcagaaaccccctccgccacaatacagcaacggagagataacgcaatgaaggcaaaaaaaaaaaaacggagggattaccttgaggacctccggtggcggcggcggcggcgacggcggggtgggcggaggggagagggagagggagaggagggggcggaggcgtgcttcgtcgggcgcggcgtcgggggcaatgaggaggcggcgggagaaggccgcgacggtgtggacgacgggctccagcgggttggagccccacccccacgctggaggcggcatcgcggctcgcgtggaaatcgtacgacgacggcgacggcggcggctgcggatgggtgaagccgtaagcgaggtcgacgtcgacgaggaggagaaactcgagggcgtgcggtgcggagggcgtgaccgcgtgagaggggggagacagctaggaagggaggagggaggggaaggcgaaaacggcaaaaccggtgcgtttccaggaggaaccagttgatggatttggacggtggtgttcccgtttcacgttggtccgtgggccgcccgcgggcctcgtttgtgcatgccgtgttgcgtcgaaaacgtgcggtgcggtttggcggcgattccggccccgatagaaagtttcggtgcggcccggtttcgacacttcggcacaaaacttcaaaactacgatatatttcatctaattttgttagatgaaatatatcctactacgaatctgatatgctaaaatatatctcatacaatcaaaacttcttgtattttggaacaaaaggtattttggaacaaagggagtattgtagagcagaaatattatttgctaaaatgtggtctggtagatattagctgacatagtttctcctctttccaacttttactccctaattttttgcgtacacgttttcggatctatactacctccgtttcaaaatatagctacgtctaccgtgcatagtctcaagatgaagttatttcttcacctatcatctcctctcaatcaatcataaccattctccaattgattttttttcacttttctcttctcaatcaatcacaacctttctcatttacacatatttcaatacccatagacaactcagaatcttacattttagtatggatgaaatatttttttgcaaaaaaaatctatatgaaaattactttaataaaatcatatgaatctaattttcaagttttcttagctaatacttaattaatcatgctttaacgagtcaccctattttttgcacgggaaaaataagttctcaacctcggctaacaaacacagcctaattccacataaccgtcatttttgctcattaagtgctcgtagg

SEQ ID NO: 3149 - DNA, 1501 bp, Oryza sativa
gttggtcatgctactaaggatcaattggaacaattttttttcacctaaaaccctctacttttaggtttgggaggaatttaggagaaatattggccatgtacttaggtcggggatttgatgatttgccatgctaaaccactcgttactgattcagagtcctgcgtgccattggcaaggacgcaaggtaatctgttgaggggcaaatttggctctaaaatttgacacaagctctactaatttccatgcagagcacaaacaaaagccacagtggatcgagtatcttttgtacactagcgacattatcttacgctgcatgtagatgtaggagtactttacaaataggagtaattttagcaattccacatgttacacatgtgcatgacgggattggaaccctgagtagtagacagaaacatgtacaatcatcatgggcgtctgattactgatgcttcccttgtctgatctcgtgcctcttattgacatcatcacacaccatctctagtcaaattgaactcaaagataaccaaacagtgctgatgattggggtggatttgtaaatccgttctagtccaaaatctgggggaatatgtaaatgtttatgactccgtacattgcatggctccatccatgcatgggaggatggaatctttcttggagtatcttgcttctaattaagtaccccccatttgtcagtggactattggttcactgtacttggccaaaaactgggctctgcctacatggatccataattagtgaaacaaagatgacaaatcatgttcattgttattgtgttctgcttctgcactgctgccccgacagagactcagcaggccaataggttaacgggtcagtgttttcgcactgttcatacagaaaccaaatgttcagttttctgaagaaaaaaaatcaaccgacttttcgctcgtgtgttaggaggggatcaaatgttcaattttctgaaaagatccatcgtttttttttctttgctcgtgtgttaggaggggctacgatttttttagtgtccaataaggtcgagccatgttgatccttcatgtggtttcaaaatgctcatgaacgttactgcgtgcggggttttcttttctagatttgttgtactgtaagatatctatctaaggttaatttttgttagaaacacaccataaatatagacactcacccatataaacgcacaccctacccctatgaagacctccgaaagactaggccgacatatcttgagatcgacgaagtcatcacaggtgcatggactggcatattttgagatcgacgaagtcaccacagacgtctcgctgtcgatggatatgtcaccaaccactgaaaaaataattaactataaatacgagtatatgtgtcaagtctttggacttgaatatggatggattggttttaaaaaaaaataaccaattaagttacgcttacttcgtaaggtggtttattttgagatggaggtactagatgaagcatccagcagaagcca

SEQ ID NO: 3150 - DNA, 1501 bp, Oryza sativa
ctcgacggtggtgcggccgccgaggtgggccttgaggtaggcggcgacggaggccgggacggagacgtcgcgggtggtctggacgacgacgcagggggcgcggaccatgccgagcacgccgcggaggtcggtcttgaagacggtctggcagacgtggagggagatgtccgggcgcatgttgaagagggtgcggctgaactcctgcaccgccgccggcacgtcggcgcccaccgccagaggcgcgtaccccgtcgcccacgccgagtagttcgcccccatcgcgtcgaacacctgctgtatctcctccagctcgaacccgccgtggtagtcgctgtcgttcaagaacctgcacacacatgtccgtgctccccgatcgcccccgatcagattcaattttaagagcgagaaaggattcacatcagtggaagcgagcgtaccggggagaggcgccgatgaggacaagcttggcgaagaggtcaggtcgtcggatggaggcgaggatgccgatcatggcggagacggagtggccgacgaaggcgcagcgcgggatgcggagcgcgtcgaggatggcgagcaggtcgtcgacgtaggcgtcgaggttgtcgtagcggcggaagtcgaagtggtccgggttgacgctgccggcgcagacgaggtcgtagagcacgacgcggtggtcgcgggtgaggtacggcagcacgcggctccacgccgactggtccgtcccgaagccatgcgacagcaccaccacccgctcgccgctccccaccacccgcacgttcaggatctgcagcagcttcgccccgctcggcgccgccgacccgctccctcctccccctcctcccccgccgcccaccatcgtcttctccgagctcgacgacgccgacgaccccccgcccccgccgccgccgctgctgctgctgctcgggctactgggcggcggatgcgtcgatcgcagcatcacaccagcgcggcggattggcaagccgtggcgcgctccccttttatatactactactactactactatcaccactggccatgggagatggtcttgactcttgcctcgcttcttctctctctttcttgctttgatttctctctctgctttattccactgtcttaagcttcgttgggtgcggtggtagattgggatttttgcagagaaggtgtgtgattgcttcagttatttaggggggtgtttgggttttgtctccatgtccaattatccaatccacagcagataaaaaggagaggcagtgaggcacctataattctctggatttttttttctcaggagaagtttttttttctcttatcgttttgttttatttttttttgacttcacaatcccaaccagagatgccactgcaattaatattactcgtagttgagagttttgacaagctaagaacgtcgctgttagtgtctgtaatgtagcgtttgattatcagcgttaagggaatttttgcagcaaacgttgtagacatattagatgatg

SEQ ID NO: 3151 - DNA, 1501 bp, Oryza sativa
ctcccggagacataacccatcaataatagcattaaaaaggaatggccatctatcatcataattatcattattcttttcatcagggctacgtacgtagaatattaaaatcaccaccaataagaattggtaaggtttcatgactgcacatattaactaattcagcaaggaattgatccttaaattcactttgtactggcccatacaccagaactaaagcccacttaaacttatcaactttattacataaatgaaacttaatgtagaaatctccctcatcaatcaaaccaatatcaacattaattaaattgatgcccaaaagcaaaccaccggacctacctctatgaggcttgcaatgccacaaaaattatttgccagcacacagatttttaagaacagccggactaaaatctttcttaatagtctctgacaaagcaataaaatcaaggtgatgttcctttgttaaatcagaaataaacttatgttttttcgggaccttaaacccatcacaattccagaacaaccctttcatttaaaaatattctttttttttctttccccttttagtctttttcttactattaggagaggtatctaaagaatataaagtggtctaagaataattatcatccacaccactaaaatccatcacctcctccattaattcaccacacaaatgttgaagtagagaattatcatccacctgatcatccaatatctcgctatcaacatttgaagtatgtacctgattaacagaagaactaacatattcacttaacatcttttcctctatactctttaaatcatttataacatcatctaatatgtctacaacgtttgctgcaaaaattcccttaacgctgataatcaaacgctacattacagacactaacagcgacgttcttagcttgtcaaaactctcaactacgagtaatattaattgcagtggcatctctggttgggattgtgaagtcaaaaaaaaataaaacaaaacgataagagaaaaaaaaacttctcctgagaaaaaaaaatccagagaattataggtgcctcactgcctctcctttttatctgctgtggattggataattggacatggagacaaaacccaaacacccccctaaataactgaagcaatcacacaccttctctgcaaaaatcccaatctaccaccgcacccaacgaagcttaagacagtggaataaagcagagagagaaatcaaagcaagaaagagagagaagaagcgaggcaagagtcaagaccatctcccatggccagtggtgatagtagtagtagtagtagtatataaaaggggagcgcgccacggcttgccaatccgccgcgctggtgtgatgctgcgatcgacgcatccgccgcccagtagcccgagcagcagcagcagcggcggcggcgggggcggggggtcgtcggcgtcgtcgagctcggagaagacgatggtgggcggcgggggaggagggggaggagggagcgggtcggcggcgc

SEQ ID NO: 3152 - DNA, 1501 bp, Oryza sativa
tgtttatttaggcagtaatttctactgctgctgtagaaattacccttcattttttgtacggttaaaacgtctcaaggaatcgtcggttgtgggagcggtagcagctaagcgatggcaaatcattgtcaacgacatgcatggcccatcttatcgccatttatatcgccgataaggaggttgaccctgccatctaaccgcagcctacggccccccagagaaatcacaagtcgccacgtgtaccaacctgattagtcaccagtagctttgtctgccccagttggccactactctctcggtcttaaaaaaatccaatctaatataaggacggacataatctagcacaacaaatctagatagtcttttgccaagatctagatagtcttttgccaagattcgttatgttaggttacgttacatctcaatcctagcacaacaaatctagatagtcttctgccaagattcgttatgttaggttacgttacatctcaatcctatgttagttttttttggtacggtccatacggaggaagtatgttcttgctgagagattcctatgctctaaccttacctacacctgccatctcaaaaatttggtagcctttcacacggataaaacgagatggataaaaagattgctctataaaataagagcgggtacaataatgaacggtattagtttcacgtaggattttgtgatgaattggaggagaggggggaagagagagcgcccacgactaatttgtcgccgcacgcgctgcttaaagaagttgtggggctcgcctgtagatgaagaagcattcctacatcagccatggtttgcgttggtgctgctcctcgatactccatggctaacgcccttgtccatcgtgtccattggactgtcaccctcggcttggccggcgccgactcccgcatctaccctagccgccatcgtctctcgcgttcaccagacaactgagctcgtctagcccagctgtcaccgtctttgcgtccgccgcacatgcaccgttaccttccgcctccaccacacagccgcctttgtcttgcacgacaaccactgtctcttgcgtccgccagaccgccgtagtcacctgcatccgccagatcaccgtcatcgtccatcctcgctgactgctcaagcccaaaatcgttgacgaatcgaaggtaagaaaaggagaaagagaataatacaggaaatgatgaggtatgaggaagaaaaaagatggtggatcccataaaacaataaaatatttatgttataatattcatattataggtattagttactatgcttactatagatgacacggtcagctaataacatgctatcttaaccttgctctaagtgaggaatatagatcgagacttgttgggactataattaagttaagtggtaattttttttatcttataagtaattggttgatatatttagaagaatctgctatatttttgaacggtctccgttaacgatgtaagtacctttaaaatttgtacacga

SEQ ID NO: 3153 - DNA, 1501 bp, Oryza sativa
tcccaaatcacaagcacaatcatatatccagtagataggaaatgcatcacgaaggttcatcgcaaatacttcgcaacattcatccattggtagcctgagacagttagtagtacgatctaagcctcggtaccttctaattaagcaacactagacgatagatagcataatagcatccctaagcaaacattgactataggcatcagtgatcagtggagttggccgttgacgtagtggcggtgggggtcatcggcgcggacacggtcatggagtcgcgggcgaggtcgtcgacgcggcgggggcgggggcggtcgatggggcgagggcggcgccgatcgtcgcaggggcgggcggcggcggggcgtcgtcggcggctggcgtgtcggcgggcatcttcgccttgaccttgtcgaagatcttagccatcgcagcctcctccttctcggagaacacgacgacctcatcatcgccctcgtcgtcgctcgcgatcccggcctggatgcgcttcttcttgtcatcgcggatgatcttgcgatgcggttttccctggacgccactgaaacgatcgaaacgcaacaagggttagcagcccgcgaaaccagatgagatctagagcgctcgcgcgcgcgcgcgcgaagccttcttaccgactctcggcgctccgggaccactccatcgcgactccggcggcggcggcggcggaagaatggaggcggcgcggtcgggacttggacactgctcactgctctccgtgtctccctgctcggaccagcaactcgaggtagtatatatagccatcgtattgggccggcccataaaccctgggctggaaatgttcgtatgggccacactaggcccaaattttgggcccatgaggcgatagaaaagcagcccaaccacgagttcgccggcgacatctgcttccccgaggatcgactccggcgagtaaccatctttctcctcccgttgtactccctccgtcccataagtgcaatcataagtttccatgtccaactttaatcgtccgtcttatttaagtatttttgttgttatgggatgataaaatatgaataatatttacttgtgacttatgtttttaaatttttttaaaaaattttcaaataaaacacacggtcaaagttggatgcggaaaaccgtggctgcacttaaaatgtaacggagggagtaataaaggatcgagttatccgcatccgtattcctaagctttaacagatttacgtatccctgagaaaaattacttataaccatcctggtttttgaacaaaatcgactatccttaaaggtcacactaacacttgcactatcacagagatgggtgtagtgcgcaagcaccattgcagagcagctactccaagtctccgaacactactacttgcccctccagaattgtaacagctggagtacgtagataagggagaagtgaattgtaaatggtccactcaagtattcaaatcccattagtatgtagataattgagaactga

SEQ ID NO: 3154 - DNA, 1501 bp, Oryza sativa
ttgaggatttaggtgcactaatatatgtacatgtgtatagggctatgtttggatcgaataattgaggatttaggtgcactaatatgtgtacatatgtatatattagaaatatacttgtttttcgataaaaaagttgggtattcccgggaatacccgggaatcatggtagctccgcccatggggtatacagtaccgaaaagaaaattatctccaccatgctcggttgcacttgcacacgagtgcagaaccgccagatcgaaagctagcgaacgtatgctgctgcgatggcaaacggccgtagtacactagcctagcaggctagcactactactctactaggcgtgccacggcctttgctacatttttctaccctggtgcacacgacgtatcaggtagtaccctggtgttgtttagattccaactttttttttcaaattttcaatttttttatcacatcaaactttcctacacacacaaactttcaacttttccgtcacatcgtttcaatttctttaaacttccaattttaacatggaactaaacacaaccgtaatagaatttgtgatatgatttgaatctttagttgtttaagccctactaactacttcatccgttctaaaatacggtatggctcattcatgtattcaggggctatttggatggaggctaactttaccacagtataactttatttaccataagcctataactgtgtcaagccatacaaagtgtttgttggccacaaccatggtaaattttggctagaaaataaaaatatgacgcgtggaccattgtgctaataaagtgtagcttaactcaactatggcactcaaccagccactagcctaagaaattgtggcgcgtctaaggtttggtgtagcaaactgcggccactacccaaacaacctctcactctttttattacgcacaaccacacaggtgaagtgggggaacctaggccttattagtttggaaggatttctaaaggaaatctcaattcctttggaataagcactattcatgccttcggtttgtaggatttaaaggaaaattttccataggaatactatgccaatcctccaaaaatcctccaaaatgtactaattccataggaatgaaaatatctactctatcctcttttgtttagctcagtgtaggaaaaattcctatgttccaatcctttattttgcacgtgcattcctacattatttctacgtttttcctatgatttgaaaatcctgtgaatcgaataaaccctaagtggttgcctaggattgtggactctttgttcactagtggtactatggctatgttctttatagatgattcgacatatatattatggatattttttgtatgattagaaggatgaatttaagctagagtaatgcagatgaccagtgtgttggagtgtatgtgtgtccacctgcgttcgaaccctatcagaggtcgtcgcatgtgttcacctctcttattcttttatatatatatatatatatat

SEQ ID NO: 3155 - DNA, 1501 bp, Oryza sativa
tcgactcgagttcataccgagctcgagcctgaggatctaagctcgctcgagctcggctcgttgacagccctacaccggagtttggaccagtatacttatcttattgtcagggccccaattggttttacatttcggctaataatcctatacaatataattttagatacacattgttaagactaagtttacatacacagccatacttgaacaaaatgttcctgtgggaagtaaattagtgtcaagaaaaatacaatgtagaaatgcaacatctcaacctagctcatacagattaaacactagactatactctatagtgcaacagctactgtttcatagaaaaggtacatccccaaatagaaatttcaccgtgaaagaacttcccttggctattggaaggaatcattcctcacctgagaggctgagagactcagactaacatacataaaacaatgttaattgacactactagcatcgaagtcaactaattaactagcacaaagtcagctaattataacatcacccgatcttagattagcaaagatgtgttaactaaaagagagaccgtcttatataattgaagaagaaagtgctctatcatagatccaactagtaggacaaaagcatatcattcaacaagggtgcaggaccattagctgaagaaaatgaactcttttatcataagtactcgaaaacatgggttggatatttgcatccctacaaaaccctttttccagaaatcctaacctattcggttcctaaagacaaaatgagaactactccctccttccctaaatgtttgacgccgttgacttttctaaacatgtttgaccgttcgtcttattcaaaattttttgtgaaatatgtaaaactatatgtatatataaaagtatatttaacaatgaatcaaatgataggaaaagaattaataattacttaaattttttgaataagacgaacggtcaaatatgtttaaaaaagtcaacggcgtcaaacatttagggatggagggagtatatagcagggtagtttaatcaatttcagatatgaaaagggtaatttcaggaaactgtttatagaagtctagagattatcttttttcgtttcctgaaaaagaaaagcagaaagagtatcaagtttcagttgagatttgctagttctgagcaatagcattggtttctcgttaggttcagatataggaatagatataagcattgtgcggttgttctccaatcgacttgggccaactacctgagcggcccaaaatccttaattgagcccattacccacatgggccgtagcccagactggaataacgcgaaccgccattcggccatcgattgaccttttcttctccaaaatgagggaaaaaaaacctgcgtgtaatcgcaactccatccggctcatcggcgagtcggcgtcgcgtcactcccgtgctccggcgacggcggaggaggaggcggagcggtcgccggaagccgtcccagcggcggcgggggggaga

SEQ ID NO: 3156 - DNA, 1501 bp, Oryza sativa
ccaaaagactagtttgatgggtgaggattgcccccaccttttaagtcgtgctctcccatcatcaattaccgatgtgagactaaactcaacaatctccaccgtcgtcacacatcgggcccaacaatctcctatgtcacattaacccatgtgaccctgaagacttgttacctggcctcccccatcatgtgacccatggaaattgttccaggttctaaacctggactctgatattacttgttagagtgcgcagcccagtccaccaaccatgggccacccggtcatattgggcctgctccaccacaggctcaaccagagccacaactttaggtctcaggcctacacaacccaaaaaactagtctgatgggtgaggactccctccaccttttaaaaagtgctcccccatcctcaattaccgatgtgggagtaaacccaatagacttcgcagtcggctccttgttctcggtggaagtcggatggtagatcaacgactgttggcggctgttaaatgtcgattctataccgccaacatctgcataaagttcggataataaaacatccaacatagtgataggtgcttaatctcacatattccacaagtgttggtgtatatttgtatgtagatgatataccctgatgttgggaggaaacctagactaaagtgaggagaattatatatctatacaaggaggggttgtgaacttcatcaaaacatcagtgaattaacccaaaactctgagaaatggatagagaagagcccagggagtccatagaccgaaggccaggccaggagggcccagcctaggttcgggcgaacccctctgatcgccgttgatcctagggtttggcatcgacgctccagatgctctcccaaagacggttgcggggcagttcggacatttccccttctcacaaccgtcatacctgtcctataaatagacctcactttattcactctcacacatacttccaagcttgagctgaattataagaggctctattgtactatattgtatactaaaataggaaggaagggagtagagtaggagtcggaagaattccggagttgtcagtaatcttcccctatttcttttattctgtttattactgtgaattcaatataatattcttcttgagtaatttagatttatcttgtgagaattatctcttggttagttccgaagtagcatacgggattattgttcactataatcaactaaaatataatgattgctttagtgagttataaacactaaagtagatagtaattgcttagacgtggtgtttaggtaattattatccagtaattgctgcgtatcccacagtatgtttgaggtgggtgtagaggtggtgacagccctcgagatcacttaagtcctccctgtccgggtacgtagtagagcgacatctgggaactgcgggttgccagtgcctgaaatattgcattaggattaaaattaagctttccctaacaatgtttctcactattaaatcctctctatc

SEQ ID NO: 3157 - DNA, 1501 bp, Oryza sativa
agtctttgccacgggtttcggcagatttggtcgaagggcctcatgccatccgccaacagtaaataaattaaagtgtatatcaactaagtaatcattatatctgatagctaacccacaataaagacaactcatcggctaacagtccgatgaaacgttgcatgaaaacctatcggcttagtagaaatagacttattagtagcaatctaacagatcgagcctaactaagatattttaagattgacgataacaagaaaaaaatatttagccaatagatatatatacaaacatgattgatacatcgatctatctaaaacggcaatacgattagaaaaacatcaacttagtcaaaatatcggacctaagtgagaaagtcctaactaagccgataccactctaaatagcaatgcagttaaagatataatcaatatatcagatagacaatgcttgcgtcaacctgaataaaatattggacttaaacgagaaagttgtagccaaagttaaatagtataggaagaggagattatttcctcgcgggaagttgacgaaacttacttcctcgtgggagatcgaacttaacaaatgcaaacctgctcaaaactaagaactcgccggaataaaagttggcaatgtaccgaaagtaatgtattgatatgtggaaatagattacaaagtctacgggtgtacatatttatacccttaggttgatattagtcctaatcggacaagatacaagtttcctaaagataaaagaaaagatataagtcctgatcggttgattgacttctttccttaactgaatcctctaaacaaccgtatcaaattttggtgttaacagcttgacgatgactcaacaaagaacgacaagcgatgctcacgggcaaagcaccatgatgacgacgagaacagaggcctacctggcagatcaggatcgatcccactcagggtgaagcgcgatgatcatgcagactatgaatgaaaaaaaaaacaggtggctgggccgtattagatcaacaaatgcagaagatgatgaaatttgaaggacatgaaaaggtcacagattaatcaaaatgggtacaattcagttgtttttcttagaataaatagaagtagccagctaagagctaaactacaaattgaatgcaagtgtttaagcttagcactaatgccaccatgcgcttcagtcacccagctccagtgttcccatctctgaaaaaaaatcgaacagcattggatcaattccaaaaagaatcaggaagacaagctttatcatctagaaaatggagctttaggaaatgactatacataaagttcagaaatcaacccagtactgaaaattggtcttaaaatcaatccagtactaccaggccaagggtatagggtcccaagaaggaggaggctggtcttctccaactctaattggtggacatgcaatctacaaagcagacacaatttacattagtaaaattaaaatatttctaaagtgcaaggccctatatgtgct

SEQ ID NO: 3158 - DNA, 1501 bp, Oryza sativa
tttgttgacaagttaagggacctcagatgaacttattctccccggtgggtattaaatcccggcctacaagaaagtgtgcgttcggttaagcccagtttggattctgtcccggcccatcccggcctttccccctcaccccggtccgggaaaaaatcatcgacccaagaggcgtggaagaaaccctcgcgcacaggaggaaactatcaacgcataggggaaagcagcggcggtggcgcgggtgcggattgagagtcgacggcgcgacggcgacgcggcactctccccggaggcggcgctctcccctccgccgaccgtcccctccgctggccactttctcaccggtgagtctctcttccttcccctctcttctccctatccttcctagggtttggttcttggtccaaggttcttggttaaagatggtgtgcaattttgatgtagctagcggatctagaggactgatggttctcgttggaataagcctttcttaggttattaatcagtgtcttgattaaacctgattttctgcatattggatggactgagcagcatcacaatttaggttgctccttgctctgcactgcttgattttgtggaataaaatgaaattaatgtcaatttgaacatatcatatgctgacaaaatgcaaaaattaatgcaaatcaactatggtggctcacctttgctttcaaaactttctgactttcactgaaatactgattaggatgattgattccagtatcactgagacaccatgtgctgcctcgaaagtcatcgtgcaagctagctatgtatttcatatcttagatgattcaagcaaaccaagtttggaagaatgtttattaaaggtagaattgtgaggtgcagtacctggttactgctgtttgtcgagttttaagcagtcaccagttaacgtggcctcttttatctttatccaacaaattagattagtatgatggttagagtacataccatagatgcacaacatggtaagttcctgacagattcaacgtcttttgctccttattgtatatctcatctggttatacatttatgaatatgattagtataggacaaaacagaagtcaagatttgatttttgcacaagcattttgatctacataattgtacctatccatgtccaatatgaacataattgaaaattctcggtttgatctcaattgaaaattatttcaatttttattggtactagcacatatagggccttgcactttagaaatattttaattttactaatgtaaattgtgtctgctttgtagattgcatgtccaccaattagagttggagaagaccagcctcctccttcttgggaccctatacccttggcctggtagtactggattgattttaagaccaattttcagtactgggttgatttctgaactttatgtatagtcatttcctaaagctccattttctagatgataaagcttgtcttcctgattctttttggaattgatccaatgctgttcgatttttt

SEQ ID NO: 3159 - DNA, 1501 bp, Oryza sativa
agcaaaccctaaaatcttagggagccacgtggcccaatcatatgcttgattttttaccttgaattcggtatattagataagatttgattcttttaatgggacatgctgctatgtggtctttcaggcttaaatctgaactactgatgccacttgaactgctgctaatttcctgaggttaatttatcaaggtcacaaactaattctaactaggtcataaactaatgataactattcctgtataaggttcatcctgtagggtcttcattagaatcttacatcatatatactagcttatgttgtcacacatttgcgcgactcttgttacgtgatacgtgagtgtcaatcaatctgttgtttttcttgttgctagtaaaatataatcaatctgttgtttttcttgttgctagtaaaatattgggtcaggatgagtcatagtattatgttggtaaagtagatggcttaatatttattgtaaattttaataggtatgagacatatgtatcaccctttattcttcacttattttctattagtgcgtacccttttgtgactcattgtcatatattttgtaggtttttaaggattagtttaatttctatttttaaatttgtgtgaaaaatcattaagcctatattcaggtgaccatgactcattattggaaggaatatgcatgtctcagtagcaattttttttctcaaatacattaacaacaaattgctagaaacaaaaataatcacatgaacatacattttgaatatgccctgaatagctcaatcttgactaatgaatatttagttaagggaatgagggtgccttttttcttccttcatttctttctttccacttctagtagcttcatctcctgaagtctcttgaatgtgttcttttgccatcatttaatccaatggtctaagattcattcactcttttttgtcttgtagtaagttcaatggctaatatttaccaaataatgtggctcattctcagtccactttggatgtcacttttcactagttaagatataaatagctgtgatgggctatgagataatgagatgtgagacggcgaatggaatatggagggtttgcatagggattggggataagatctgggcccttggattgtgaacctatgattcaagatttggaagattagagatccaatttattgtgaaatttatatcctctatgttcccaaatataagcaaattttaggattcaaattttatacacaaattgtttttataggactatgattccaatacatgaaaataaacattttcaaccaaatattccgtttgtccaaaaaaaaagaagtatgattggatgtgacgtaatctagtcctcgagccccgacatgatggtcagggtgggagacggggattgatagagaaaataacgtggagctgagacgggtggtggaggggggaggtgtgaagttgtttaaataaaaatgaaggggtcgagtgggctgaagttgtttgtagcgcatctgtcatctg

SEQ ID NO: 3160 - DNA, 1501 bp, Oryza sativa
gagagtttagggttatcaaccaatcagctcagtttcgacgagtttgacaacagcatctactttcctccaaatgaagcatctgcagcagctatgacaccaagttctactgccatctttataaatcaaggggcgttgcatcaatctttgttatacacacgctcgcatcaaggaaactactcgagcttcgatatcttctcagcagtttggtggattattgtcattgacatcatcaccagcacctctacttcatcggccctgacgtctccgccgttgctaatgggtgatcacatattcgcttctggttgcttccgtcattgccgacttgttatttcaccttcacagtttacctactacgcaaacactgatgagcatctttgccattatcattggctgctacaccgctattgactggatcaccgatatcgtcatcttcatcaacatcctgtcaagcctcttcaacatagcctattctactgctattgatgggaaacttcgtcatcatagttgatcatctctgttgttgctaatcgtcattaccatcggttgcgtttgccgtcgccgactattttcttcatcttcatgattggtgaatttcgccattgccactaataggcctcttcatcttcttcaccggctgcctcgtcaccgactgattgttccgccgccatggctatacaactctgtcgctattgctgggcgccttcatcttcactgttggctgacctgactgttgttgactggtttcttcgcctccgtagctgtgcgacttcgtcatctttgattggtgtcactgtctttactaccaccaatatatcttcatcatctctaatgggagatgtcatccccatgttggtcatctcgtttccatgccgactgcatatgctatcgtcaatggataatttcgactacgacaaaatgacaagctatatactcaggggcttaccagctcaaacacaagtatcataccttcaatttggacttgttctggatacatgcaacatgaattcatggtcatgagtcgatttcttatgctcaacgactggactattcattattctccatgagggctatcagccgagtacttgcgccagtcgggattcaacttcgcatctactttggtgcgtcccatgagggataactactcagatcataagctactcagatgagatgcattctatttacatcacccgggaaatttatcactcgagagcatattaataggcatgttatacacgtcacgcccaaaaatttagcccaaatttctagactattttgtgtattaaatccctatccaggaccagccagggtacacaaaacgacaagtaataaacagttccaaacgtaaataaagcgtaaaatacttacagaagaggcactttgtcctcacaccgaaacaaaagcagcagcagcggaaaaaggcgatcctagcggggcttcagctccactccacaggcaaaactcaactggggtctgagccttgatcctctaacttcgtcttcag

SEQ ID NO: 3161 - DNA, 1501 bp, Oryza sativa
attgaaggaagcatggaccctttgctttctaggggccagtctcacttgtccgtgtgtccgctttcgcgaaggccctgtatcgtcgtcggccttgtgggggttcgcccggggaggcagttcgccgtcgtaaacccggtccacccgaccagcggcctgtcgtgtgagcagctggctgtactcgatgaccgacacatcgccgatcatcctccgggctttggcatcggcctgatcgagagtcaacactgtgaaaataaaaggtgtagccatattaagcgtcgagccaggaaaaatagcgaaacacataagcgcatagcgaaagcgcaatctcaccgttcgtcccctcaggaagaaccagcttcggcaaaccgttgacctcttcatcttggtcaaccgcgacttgccacgaatgggagaggggaaaatgagaagcatacagaactcctccaccaagtcgcggcagctgatgcgggagcagaccttgcgcagcaaggcgaaccgttcctccatggcgccgtccacggcgatcttgggtttccggttcggcgcaatcgccctgcgccgacaccgaagggccttcgccgactcggacccagcctcgaaggggatggtgtgatagaaccacctcgccatccagtggcgatcccacttcgacatggcagcattcaccggccagagatcggagtgctcggggcgaacgttgaagttcatgctcccgaacatcgtcttctttgttccggccggggtcaccaccgtcttcaaattcacggtggaaaaaatatggcgccaaagagttcagcgctagattcaaacccggaggtccggcacgcccagtcgaagatggcgatccggactagcgccgacgggctcaactgtgggagctctacctggaaaaggcgaaggatctccggcaacaacacgttgcacgggaaccgaagccccgcctcaaaaaagacgatgaacaccaccgtccggttgtcgacgggctttggtaccacggccttcccagggcgaaagcctgcccctcaaccaacgccccagagctgaccaacttcaccagctcgccatcatctatgagagaaatcaccaaaaaggccgtggtgtcgttgtcaatccggccgggatcgggccctttcgccgaagcggggtttggctttcgaggagccatggcgaagggtgtgtgcagtggcaaacaaagggaatgggcgaaagatatgaggggtcaaggggcaccgtgaaaggaaagaacggtggaatagagtgcgcatggcaaaaatgacaagtgtggcggtgaaaagggaaaagagggtgagaatatatagcccacccaggcaacggttcgcctacccaccagtaataaagcgccacgtatcgcaagggtaggcgaaacggtaaattcccatcaaccgagccgcacagtaataagcccacgaagggaaagcccattactgttcctttcggcccaggaaaaataaaaaaataactccaccatccgcaagaggtg

SEQ ID NO: 3162 - DNA, 1501 bp, Oryza sativa
cgttgttcccggagttgttcccggagttcaaatccttgaggggattctactctccgttgaggagctcactaagagccgggtctctactaaccctttcctcaagaggttgcactaagcactcctccttccactaaggggtacctctttctttgcggaggcgagatccggccttcacaaacttctcccggccaaccacacgttgatcggtggctcgagagtgacacctagccatctaggagtcctcaacctccaagagtaacaaacaccacacaactcttggtcaaaccctagtgttcaagatcgagtgaaacacacactaggccctcaaacaccaaatccacaaccaccaagatccaccacagaaagaatgaggagggatttgagaaagggagaaagagctcaaagatcgaaagcaccttagcaccaagctcaacccaaagtgaatgtgaatgaatgagttgggtcaccctagaaaaagattaggtgggggatatttatagacccccccaaaatgtggccgttggaggggaatctttcatcccacgtcagatagtccgatacaagatcggatagtccgatattttaaacctccaagacaacgagaaacagagaacgaagttcgatgaaatttcggactttccaagacatcggactatctgatgttaaatcagagtgtccgatattttagaagcaaaaacttcgtcctcaaacagagactcaagttccatgaaatttcggagtctctgtaccattggactatctgatccaacatcggatactccgacacatagaaaaactcactcgaaagtatttttcaaacaaagacagagagtgaagttttgtgaaaaatcggatagtccgatacattggatagtctgatttcaaatcggatagtctgatgttgctccagtaaaaatgcaataactttttactccaaactccgatttcgaagatcttagactctatggaaagctagtttcgtgggctatcaaaaccaacataaaacatggtccaaaaccttcaagagatgttgaaaaacttgcaaagaaacctggtgtaagtgttgtgacaagtgaacaactcggaattgaaattttggcttaggtttttcaactcacacaaagatgaagcattttgagcactagtgttctaccaattatatgcatgtggtatccctcttaatagtacgacataatgcaaggtaaaagatacaatataccatttgatcattgccgcattgcatcgtgatgtcgcattcatggggtatgcatctcattacaacatgtcgaggacataacaaccttcacacttgtttgaataaaagtgttagtcctctctaatcgcattgtaatcaatcatcaaaatcattaggggcctagatacactttcaggccccaatcctccagtattcggaaggctacatcccacccaagtctatccacaagcaccgatccagccccttccgtcataagccacgcaagcgccagtatacttcaccagg

SEQ ID NO: 3163 - DNA, 1501 bp, Oryza sativa
actttttgggattgcaaattaagcaaacacctcaaggtacttttgtgcatcaaacgaagtatatgaaggatcttttgagacggttcaagatggagaactgcaagccaatttcaacaccaattggttctacagctgtgttggatcctgatgaagatggtgaagctgttgatcaaaaggaatatagaaatatgattggatctttgttgtatctaactgcttctaggtcagacatataatttgctgtgtgtttgtgtgcacgctttcaagcttctcctcgtgtttcacatcgtcaagcggtcaagcgaataatgaggtatttgaatcatacacatgagtttggaatttggtattctacttcatcttctatatgcttaagtggatattctgatactgattttggaggttgtagaattgataggaaaagtactagtggaacatgtcattttcttgttacatcattgattgcatggtcttctaggaaacaatctagtgttgctcagtcaactgctgaatctgaatatgttgctgctgctagttgttgttcacagattcttggcttttatctactttgaaagattatggtcttacttttgagaaagtacctctcttttgtgataatactagtgctatcaatattgctaagaatcctgttcaacactcacgcataaagcacattgatattcgttttcactttttgagggatcatgttgagaagggagatgttgaattgcagtttttggacacaaagttacaaattgctgatattttcactaaacctttggattctaatcgctttgcttttcttcgtggtgaattaggtataattcatccttttggtatggtttgagggggattttgtacctcatggttttatcgagcaataatatgacaatgagaaaaattgagaaaagagagctttgtttatacatatggtattttcttgtacatgctagcaatactttgaaggtttatttgtctctagcatagcatgtatgtatttttgtcttttcatgagatttagattttgtttttaagggagatgatgcatgacacttaaattctatacttgaattaagcaaatatgcaatgttgatgctagcatatggtttgatgtataaatgctatatatatatgctttattgactttttattcctcaaatagttttaattgctcattgtgaaaagataataaaaaatatgaaaaaaatgaataccgaatctttagaaacagtcttgacgattcgatgtgagcaaaataatgggtgccgaattcctggaaaaagtcttgacgacagggacgtacccggaataaaagagaaaaatatgagcaaaaaggctcaagaaaaataaaaagttaaaaaaattctcttggttgttttgtgctaaaggttacttgagaaagagtgataaatgtaataggtatatgtgtttagtgtttatttttcaacctatatgcttgttaagatgttgcattaaaaatcatatgaaatcatgaattttg

SEQ ID NO: 3164 - DNA, 1501 bp, Oryza sativa
gcgaccggctgagcttgcagctgcacgtgaggggccggatgcgctgctgcggtcgatggctgcccgacgaagtacattggcgcttgcgcgacttgtggcggaaggggctgggtcggcacttgtggatagacttggggtgggacataacctgccgaatactggaggattggtgctgaagcgaccttggatcgtcttgccgtctcgtatgcttgctgttgttcttgcatttggcgaagcatgtcttggagtcgtgtcatgttctgtcgcatggcttccatgttggcttcggtttgtgtttcggggttagggttgacttgggcttgcacagcggtgagcgcagttggggccgctgccgactacgacggagcggcttggggcaccagcagttggcttgtcaaaaggatctccgccctggtctggagtgcccttgccgccgcagccgccttcgccataccagccatgttcggcacctgcacagaggtggcaggggccgaaggcggtagtgatggtgcaggtgcggaagctgatggcgctcctccatcttcggcaacgggcgccgaagtctctgctccctcttcggtggccatatccgccctgacgtcactttcctttcgccttgtaaccttctccttcacgaccttcttcggtggcattcgctctcaatggtttcgcttggaggtccccacgatcgacgccagctgctgtcgaaacgacaaccgcatacgtcgaaagacgtggtcactcaacagtggttgggaaagaagttgtcacgtcctgataaatttatcccgaaataaaaatcattctctaaaaggaataatagaattaattaaaaatcgaaaagaaattgacaaacactaaaatacgtacaagaaaaattcgaatatggtccagagaatttttgttaaattctccttggtctaaaaggagccctcaaattttacttgaattttcagagcaccggaaataattattaagcaacaaaaacaattaacaaagtttactaaaaagaaaaactaaaaataatccccctcctccctttgggccaagtctggcccaaagtcctccctctctctctctcggcctgcggccaaagtcctcacttcctccctctctttctctccctctcctcctctccctccttctcttgggcctcctctccttcccctcggcccagccccctcctcctccctctctcccccaggtcgcctctccctcctctcctcctgggccggccgcccggcccaaaccgcgccacccagccgcccctcccgcgcacgcgcgttgcacgcgcgctaactgcgcgcccgaccggtgggtcccacccacccggtcgtctccttcctcccgcccggcatcctttctctcttctctctcccgtgaaacctagcgtcgattcctcccctaaatccacgcgaatcaatgcccttccttccaaattgattggggggaattaatccccgttccttccacatcaattccccctaatttcccccttgat

SEQ ID NO: 3165 - DNA, 1501 bp, Oryza sativa
cggagacaccgatttcgaccttaagaacaggctgctaactatagcataggcaagcccattctatggcaagcctaacgaggacgcaagcgctcatctgcagcacttacacggaaaagggtgtcagtccggacgccgttaggctatgtctgtttccttgctcactcctgggaaaggcaaagcagtggttctacgtgaaccgggcgacagtcaacacctgggacagatgctccaccgcgttcctctcaaaattcttcccgatgggatgatgccgcttattttctgcagtgatccatgtggaactaaatgaacagtagatagagcaaagggataagcacttgctggtagcaacttgcaatgatcaacaatattgttgaggcgcattttcacaaaacaataattttctagagtatggcatgaatcttggcacatctaaataagtgaaaagatagtcctttcttgcaaaactatgcatccacgccggtggcaaaatatagtccattggatatagacgatcagaaatttcaaccgttagatcatccacatcaaaattttataaagccccgattgagagacttctatttcagaagggtcctctgaccttcatgtcggtctctgttgtcgaaacgacaactgcatacgtcaaaagactggttacttaacagtggttggaaagaaagtagagtgtatataattgagaattttttcttgggatccccctgttacatggacctagaaggctatttatagcctcattacaggttcttactactagggtttaagttatacaggggaatttacatggttccccttatgaaaggggcatttacatgggtatacagtgtaattgaggtatatgggctcctaatgggccgtcaggcgatcgttggcccaaaggccactgggccttcgtgaggccgaacttgctatggcgaagttgtctcccttcgacatacactcttcgccttacatccttcgcccaagaggtctttggctctgcgaggcacccgagtgattctccgcccttcgccgtctttgatccatagtcttcgccatgtgggcttcgccccaactgatcttgacgtcttaggcttgaatccttactggtcgcatggtttcggcaggtttggtcgaagggcctcatgccaaaccgcgaactagcccctcatgggcaagggtgagataggagcttcgggcgagaccgtgcagaccatgtggtatggtatgtggcgccccctttcgaccgatgctcctgccgaaacctatcttattcctgcaaagaaagtgcgttgtgtcttttcggttggtattgttttgtagctttcacctcttgcggatggtggagttatttttttatttttcctgggccgaaaggaacagtaatgggctttcccttcgtgggcttattactgtgcggctcggttgatgggaatttaccgtttcgcctacccttgcgatacgtggcgctttattactggtgggtaggcgaaccgttgcctgggtg

SEQ ID NO: 3166 - DNA, 1501 bp, Oryza sativa
atcgagtcacctacacatggaacaaacaaagaaaccatattccgaaaccaagctatctccaacttgactcattagtagcaaacaacagtattatatacatctagtatccatctagaagtcataatcatgaaataatcacggatatccaaacaaacaacccgaaaccgaaatcgacacagtgtcggccggtcagaccgcgggctggccggtctgaccgcgcgcataccgccggtccgaccggctaccagagcccggtctgaccggtcacatgaaataatgaatcctgcgatcacctgtgaatccaatcatctccaaaaccacttcgtgaataaattccaaataacaaaaccaataatctctaatgcccaattgtttatcatagaataataatcaaaaacacctttgattttacaatctccaccttgatgaacacattggcaaacccataaaaaatgttttggtgtttggaaaaataaaaacaaaagtggtaaaaagcacacttcgtacaaatgtacacatcgtgctcaaaaatccaaaagaaaacttctccccgtttttaaaaagtaagaaattcccaattgaaccagaaacatgctcttctcaacaactctccaaaaattcatcttgcttctccaaaaatccaaaaattttcacattacttctccccctttggacaatgatttcatcaagcataggaattatgttcattaatgttcaagagtttagcatacatatagcatatcaagtcatgtgttgcaataaaaagaatataaacccatctataatataacaatcatgcattaaagtataaccatgaaccaaagattttacaattatgcttgaatcaacagtcaaaattcatgatttcatatgatttttaatgcaacatcttaacaagcatataggttgaaaaataaacactaaacacatatacctattacatttatcactctttctcaagtaacctttagcacaaaacaaccaagagaatttttttaactttttatttttcttgagcctttttgctcatatttttctcttttattccgggtacgtccctgtcgtcaagactttttccaggaattcggcacccattattttgctcacatcgaatcgtcaagactgtttctaaagattcggtattcatttttttcatattttttattatcttttcacaatgagcaattaaaactatttgaggaataaaaagtcaataaagcatatatatatagcatttatacatcaaaccatatgctagcatcaacattgcatatttgcttaattcaagtatagaatttaagtgtcatgcatcatctcccttaaaaacaaaatctaaatctcatgaaaagacaaaaatacatacatgctatgctagagacaaataaaccttcaaagtattgctagcatgtacaagaaaataccatatgtataaacaaagctctcttttctcaatttttctcattgtcatattattgctcgataaaaccatgaggtacaaaat

SEQ ID NO: 3167 - DNA, 1501 bp, Oryza sativa
acaggcggctggaggcggtggagtggtggcgacaccactggtcgtctgcgaggacgtcgctccgataatttcccgcgaaacggaggcgacgccggggaagaggaggcggctgcgaggccgctggcggcgacggcacggccagcccgcacctgagcggcgcggcagtggcggctggagttggccggcggtgtgggagagagaggagggctgcggggagaggtggtgaggccacgggagagcgcaggagggggctaaaacgatagaacggagcgagggtgttccattttatagggtaggagagggagccggggacgggagaggagggaacaacggcggaaaagccggccggcggccttggaaggtggccggggttggcgtgggcgttcccgacgattgggggcacgaatcaagggggaaattagggggaattgatgtggaaggaacggggattaattccccccaatcaatttggaaggaagggcattgattcgcgtggatttaggggaggaatcgacgctaggtttcacgggagagagaagagagaaaggatgccgggcgggaggaaggagacgaccgggtgggtgggacccaccggtcgggcgcgcagttagcgcgcgtgcaacgcgcgtgcgcgggaggggcggctgggtggcgcggtttgggccgggcggccggcccaggaggagaggagggagaggcgacctgggggagagagggaggaggagggggctgggccgaggggaaggagaggaggcccaagagaaggagggagaggaggagagggagagaaagagagggaggaagtgaggactttggccgcaggccgagagagagagagggaggactttgggccagacttggcccaaagggaggagggggattatttttagtttttctttttagtaaactttgttaattgtttttgttgcttaataattatttccggtgctctgaaaattcaagtaaaatttgagggctccttttagaccaaggagaatttaacaaaaattctctggaccatattcgaatttttcttgtacgtattttagtgtttgtcaatttcttttcgatttttaattaattctattattccttttagagaatgatttttatttcgggataaatttatcaggacgtgacaacttctttcccaaccactgttgagtgaccacgtctttcgacgtatgcggttgtcgtttcgacagcagctggcgtcgatcgtggggacctccaagcgaaaccattgagagcgaatgccaccgaagaaggtcgtgaaggagaaggttacaaggcgaaaggaaagtgacgtcagggcggatatggccaccgaagagggagcagagacttcggcgcccgttgccgaagatggaggagcgccatcagcttccgcacctgcaccatcactaccgccttcggcccctgccacctctgtgcaggtgccgaacatggctggtatggcgaaggcggctgcggcggcaagggcactccagaccagggcgga

SEQ ID NO: 3168 - DNA, 668 bp, Oryza sativa
ttagttttgtttaagtgccattaagttttaaaaccgcctattcaccccccctctagtcggcctccttgatcctacagagggaggtttcgctgacgtgtcacctatgtggtggtgctgatttggtctctgtcctacgtagtgcttatgtggtattagaattaaaaaaaatgtgagactcatttatcattcacataaggaatgttgtgggacccatatatcatcctctctttctcaatcccttcttcctcctccctccctctcccttctctctctttctctttctctcccccttggtcgtctacagggacagctagagcagcggtggcggtgggcggggcccagagtggcgacagcatgtcccgtgggtggtgccgctggccacattcgaggaagccggagacgagacgccgccgagaactcatgcccacaagatataaacggaaagaaaccctactccagccgacgcgccccagtctcctctctctctctctctctcagctcttatcggctccgatgacctaagcgcacacctcctatcgccgccgccgatgacgacaatgagagagatgccgaggcgctgctgctcgcacagcaggagttggacaaggcggcatcagcaccacgatgatgaaatgcgagagcggtggtgaacgaggacgtcgtcgata

SEQ ID NO: 3169 - DNA, 1501 bp, Oryza sativa
aatactttgaaggtttatttgtctctagcatagcatgtatgtatttttgtcttttcatgagatttagattttgtttttaagggagatgatgcatgacacttaaattctatacttgaattaagcaaatatgcaatgttgatgctagcatatggtttgatgtataaatgctatatatatatgctttattgactttttattcctcaaatagttttaattgctcattgtgaaaagataataaaaaatatgaaaaaaatgaataccgaatctttagaaacagtcttgacgattcgatgtgagcaaaataatgggtgccgaattcctggaaaaagtcttgacgacagggacgtacccggaataaaagagaaaaatatgagcaaaaaggctcaagaaaaataaaaagttaaaaaaattctcttggttgttttgtgctaaaggttacttgagaaagagtgataaatgtaataggtatatgtgtttagtgtttatttttcaacctatatgcttgttaagatgttgcattaaaaatcatatgaaatcatgaattttgactgttgattcaagcataattgtaaaatctttggttcatggttatactttaatgcatgattgttatattatagatgggtttatattctttttattgcaacacatgacttgatatgctatatgtatgctaaactcttgaacattaatgaacataattcctatgcttgatgaaatcattgtccaaagggggagaagtaatgtgaaaatttttggatttttggagaagcaagatgaatttttggagagttgttgagaagagcatgtttctggttcaattgggaatttcttactttttaaaaacggggagaagttttcttttggatttttgagcacgatgtgtacatttgtacgaagtgtgctttttaccacttttgtttttatttttccaaacaccaaaacattttttatgggtttgccaatgtgttcatcaaggtggagattgtaaaatcaaaggtgtttttgattattattctatgataaacaattgggcattagagattattggttttgttatttggaatttattcacgaagtggttttggagatgattggattcacaggtgatcgcaggattcattatttcatgtgaccggtcagaccgggctctggtagccggtcggaccggcggtatgcgcgcggtcagaccggccagcccgcggtctgaccggccgacactgtgtcgatttcggtttcgggttgtttgtttggatatccgtgattatttcatgattatgacttctagatggatactagatgtatataatactgttgtttgctactaatgagtcaagttggagatagcttggtttcggaatatggtttctttgtttgttccatgtgtaggtgactcgatgcctcgggagagtatttgcggtgatggaccgggagtcggcttggggataagacgacgtccgtggtggtcagagatcatgcgggatacttaggctagagttga

SEQ ID NO: 3170 - DNA, 1501 bp, Oryza sativa; identical to SEQ ID NO: 3164

SEQ ID NO: 3171 - DNA, 1501 bp, Oryza sativa
cggattcgcttggattcactcccgcaaacctcgccggcgccatcaatggcggccggatcctccgcgccggtttccatctcctccggccgccttccctcactcccaaccctatttaaaccacccccgtgccctcctccaccgtttccgccactcgccgcctctcctccccatcggaatcgagcccgcgccgtcgcaccctctctccgccgtcgccgccgagctccggtcagccgccgtcgtcgctccggaccgtctcccgccccgacgccgcctccttcggcttcgccgcgtccccgccgacctcggccacccctccgcttcgctcgccgaccgccggaacgtcgtcgaccccgtcgacccgacccgcgccgttgccttcctccgctccggccgccgttttcgtcgtcgccgtcaactcggggtgagccgtggaccgccgttcgttttcccctttccctcccctccctcggccgctgctccgccgtgccggtggtcgccggcggcgaccatcggggcgagggcgccgcctcccgccggtcgcgccgcaatggccgcccctcccccgggcgcaccgagcggctgccacgtggggcccggccgtcagccgcccgcgccctcgggtgcggctgacgcctggggcccacggcgccggtcggcgtgatccgcgtgcgcccggtccaccgtggaccgtgaggctgccgcgtgggccccactcccgtggacccggtccgcgcgccctctcccctcggctgacgcaataaatccgattttaaattaaaatttaaatgaagaaattcgcaaatattcatttaaagagcatataaacttcaaatggctataacttggccatttgaactcggaattggaccgttcaagtctctaatttttccttaagaagtcaagaacccatttttgtgatttgtttctgcttgttatatggagtttattagagtaaaagccttttcttttccgttggtcgtgtagacgctgcagcttcggaggatccgctcttcgtggaagttgaagccggcgtttgggaaagcgagcaaggcaagacacatcatccttgaacatattgaatcccaatttatgaaattattttgatttaaattattgcattatcgctttatttaaattcccgcgttatcactgttttatttagccatgcctatttacctttgttatgaccttattattattgttattgttattattaccttgttcaccctagaataaacaaaacccccaactagtggacactctacttgtggtatcactagtatgattttaggtagatgcttcgctaattaattaggtaacattaggtggttttaaaactctagactgtggtaatattcatatcacttggacactggaattgttggattattgtggaattggattcaccccgccccctctattcaaaactctcaaaatggttttaggctgggctcggggtgcatggttttgatagtcgcacctcggccatataaggaccggt

SEQ ID NO: 3172 - DNA, 1501 bp, Oryza sativa
agccccggctgtctttaatccggttggtaacaccaatcaggactaaaaatcataaagctccattgcccttttttatccaactaaaaatgttctttagtcccagttcctatttgaccgggactagtgtgattttcgccatcccggcaaagataacttctacagtagcgttggtattcgccataacagcattcaccggcgatcaggtgagattggattggggttttgctattgcaggaggaggagaagagacactaggagaagaggggagcttttcttttacccaaactatttattctgagacccagcagatttattaaccaataacaacctcccttctccgtgctagtgggcttaggtttagaaaatgtcatgcccagaaattcactagtaatttttgaacttatttgtgcataaaagcctcgtccaggaattagccgaggtacacaaactgacaatttaatatacaaatccatcataatgataacgttacatacttacaaaagtaaagaaaaaaactgcagcggaaaaaacggtctagcgatggcttcagctccactcccacaggcagctcaactggggtataagccaaacgtcttctctttctagatcctttttgttcaactgaggttgattgattattgcaaggtgaaaacatggaatactccgcaagccacacaacaaatatgcaagtgcacaaaaataccaaaggatcgcataatatagactatttgcaaaagcagcatttagcaaacatttagaagtagtaaaacagtagagtaattaatcatcaatattaatcaacactgaacagcacagccatgctgcacaggcccaaccatcctgaacaaccatacccggctgtacagatctaactccaaaccaggagctaagcaaattattaccagttatagcatcaataattattgtgagaggtgtgagactaatcacgaaaaatattactctggccagaggtgtaccactgtactcacaagacacagccccaaaacatgttaccatgccctcagtaccaccacggtacctcgaaacgggactgtgacaatacccctcgcacaacataatccacacagcgcaccattcctagatcataatcaccccctcaaaaacaaaaaaccagaggcatggactccccagcgacccccacggacttctcgccgcttcacagtctggtgccccgcaatgaaccatactatacaaaagctaaagccgttgcccacgctggcttgtggttggcacggttaatgtctcataacagtagctcgcgaaccgatccttaattgttatgagcacgaccttcaaaaccatgtgctcacaacccaccattgtcaagttttagttggcacgtaattaattaaccaatcacgattgaccatcgtgagctaccattaaatataatcataagtggtagtgtaacattagttatcccaatcatatgctaatgtttataagcatggctaagcaattatatatatatatatatata

SEQ ID NO: 3173 - DNA, 1501 bp, Oryza sativa
tgacattttttgccaaaatgtttcaggatctaaactaggcctaaactaggcctaagtaaatagttattaaaaaaattgaccaaatagattaatgtgtaatatatcacttgacaaatttgcaagttcaaaatcgacttctataaattgtaacaaaaatgacaaattaaactctaactagtataagtatatttatagtcaaatctgttattttgttacaaattccagtagttgaatttaaacttacattacatgtttgtagagtgatatattattattagtattctatattgtcatttaaagaaaaacataaccaattagttcatatgcaatgaacaagtactccaaatttgaattcttttgatactgcttgttatcactacttggacctggaccattttgttcggtcttgtaagatgtaggttagatgcaatatgtgttttgaattgggccacattaggtagttttgctctcaagcttgttctaaatgggccttttctgttacatcctgattttcgttttaggatttataaattatatttataatttatattaaatgttcattaatttacaagtgaagttagatgtgggaaataaaattttctaaatataaagcatgattggatttaatttttattaaattctccatgattaattatactctctgaaattttctcggatttttcagagctcaattcttaattttaataatacaaagagcatttcagaaattatttaaatattaagttagtaattaaatggtttgattataatcttgttaagtactttgagtgttcaattagtttcaggatttttcttgaaattatttgagcattggaaatattttaacaattcgaagatcattaatttaattacaaaagtaaattaaatccccttttccttttcgggctgaaactggaaaagttcacctttagttctcggcccattctcccttcctttcagctgcctttattcctcctccgaagtccatttcttgtccctccttcaatcgggctggataaaagaagcccagacaaagtctaattagccttcctgctacagtatcgtcttcaagcttggacagagcccgtgcagccgccgagccgtgtgtgccgctgccgattcctccgcccgatttgctcgattctctcagccgtttcttgaattagttgaggagatttgtttcccttatcctcctctatcttttcccccaaaaatcctattttatccctttgaattcgacgcgaatttggattcgttttcgagtttatctctccttttcccggcgcgattccatccgttcccgagccgatctctccctcttccggctataaatagcagctcctaaacctcctctttcgttttccaccctcgcccgagctcgccgtcgcccgtagcgccctagccgcctccaccctagcgccgccgccatcgccgtcgccgagtctccagccgtgccgctcgtcgccgtccatcgttgccttcggtcgccgtcgccaccacc

SEQ ID NO: 3174 - DNA, 1501 bp, Oryza sativa
cttggcatacccggctagcaggtctgcgccgtggaccttatctgtaaccgagggtttgaaagccatgccctcagcgacttcaggagcgaaagttggtggatcctcgccagtaggacacactgtgctacgccctgcatatgtaaaagtttgaatttaatattggaatgtgtaaatgtttttgattagatatggatcggataacatcaattacctctatgtggtccactgcagctagtggtgcgatcgggagacctggggccggcacctctgtggatgcacaactactcctacgctatgacagactcgcgtcgtgttgtgcacgaggagttggatgcacagcaggtgttgtgcctcggggtatattcatgtcggcgaggacgttgttaaccctttcttccaccctatcttccatgctagcttgtagttcttgaatgacctccaccttaagctcggccttgaaacgagcgtccctctcttcgttggagactttccgtttcctgtattgggagttgtactgcgagagtccgtgctttcagggcacatcgctgccaattccccgagtccggccagtatgttctttggttccgagcgcctttgtgaggatgtcatcttcgcgcctcttcggcacggactcaacctcgctttgtgaagcttgttcaccaaccaaccccaactataaacaacaagagtcgtttatacaaacttctacttcatacgaatggtaattagttaggttaagtagtgaactcaccaattcctgatagacgacgacatcacttttgttctgaaatgtgacagagccgtccgggttgaccttaccccttgcccgcgcccagttgcgagctctgtgttcagggatgtccgaaaacggggcagggacattcgctgctgcagtggcagcatcctcttgggcccatattggctccttgccgatgtaccctgcggtgcccagccgatgcgggtgctcattccgctgttgcagttggtgatgtttctcgcttgattccctaaactcttgggtgttcttcagagagcaaaattcttcccacacctcttcggttatttgagggtaaacatcgaacggcgtatgattgccgggcgggttgacaaactcggtgaagagcttcgacttccaattcttccaagctttgcccatcttatggaatgacttccgcttgagcctatcctttgctttagccttaaatgtgagccatttctccattgccgtccaagctcgctccttctcggcttctgtgaccttgccgatatctttatggaggatcccgaaattcacacgtgccgccagcccgtagcagttagaccatcttccaatgacagtcctcggcgccgtgggcctaccactagcgtcaacctctcttataacttgcgctgtggtcggccatatattttgtgtccggggggtttctactcgatttactcgtacttgtcccacccgatattgacgtatgttcttgctggggcgattctgcagcacacagaa

SEQ ID NO: 3175 - DNA, 1501 bp, Oryza sativa
  unsure (1)..(1501): unsure at all n locations
tccggcaatgatgtcatgccgacgtcataaagcccctttttcccttctaaaaataaatcttaattgtgtcataaatcgtaaatccttttccgtataaggctaaaatcagtttaatattgtaaaattcataactaattcatatgaagtcggaatgaggccgttcaagtctctaaattcatctaaaatcatgatctacatgtttgtttactttttatgtactgtttatttagtttttattagtctttttcttcgttttgtgtgttagcttgtcgtttccgtcgttgcgaaggttcgtgagtgcgtcggaagtgtttaagaagactaattgaagaccgattattgcaaggcaagtcacacagatcccaaacataatcctttgaacatgttgatctcatatttaaattctctatttatttcaactgtgcatttattttcaaatgtcaacgggtggtgtgaacctattcctttgttatggccaatttgcattgaataccctattacttgataccttgggtaataaattgattagcttgaaccttatatattggtttggtttagctaaatgctatatatatatatatatatatatatatatatatatataattgcttagccatgcttataaacattagcatatgattgggataactaatgttacactaccacttatgattatatttaatggtagctcacgatggtcaatcgtgattggttaattaattacgtgccaactaaaacttgacaatggtgggttgtgagcacatggttttgaaggtcgtgctcataacaattaaggatcggttcgcgagctactgttatgagacattaaccgtgccaaccacaagccagcgtgggcaacggctttagcttttgtatagtatggttcattgcggggcaccagactgtgaagcggcgagaagtccgtgggggtcgctggggagtccatgcctctggttttttgtttttgagggggtgattatgatctaggaatggtgcgctgtgtggattatgttgtgcgaggggtattgtcacagtcccgtttcgaggtaccgtggtggtactgagggcatggtaacatgttttggggctgtgtcttgtgagtacagtggtacacctctggccagagtaatatttttcgtgattagtctcacacctctcacaataattattgatgctataactggtaataatttgcttagctcctggtttggagttagatctgtacagccgggtatggttgttcaggatggttgggcctgtgcagcatggctgtgctgttcagtttgattaatattgatgattaattactctactgttttactacttctaaatnnnnnnnnnnnnnnnnnnnnnnnnnnnnnnctatattatgcgatcctttggtatttttgtgcacttgcatatttgttgtgtggcttgcggagtattccatgttttcaccttgcaataatcaatcaacctcagttgaacaaaaaggatctagaaagagaagacgtttggc

SEQ ID NO: 3176 - DNA, 1501 bp, Oryza sativa
cttctcgccacttctcagtctggcgcactataatgaatcacgctatacaaaagataaagccgttgcccacgctggcttgtggttggcacgataaatgtttcacaacagtagctcgcgaaccggtccttaattgccatgagcacaaccatcaaaaccatatgctcacaacccaccttaaccaggttttaattatcaattaattaacatcacacgattaatcatcgtgagctaccattaaatataaccataattaataatatagtacatatgattcatcccattagtgagctaatgtttctaagcattgctaagcaattatatatataacatttagctgaaccaaaccaatacataaggttcaaactaatcaatttattacccaaggtatcaaggaataggacattcaatgcaaattggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaagctaacacgcaaaacgaagaaaaagactaataaaaaccaaataaacagtacataaaaaaaacaaacacgtagatcataattttagatgaattatgagacttgaacggcttcattctgacttcaaatgaatttattatgaattttacaagatcaaatctaattaaagcccatttaaaaaaaattaaataaatttaattcaatttatggacaattttaatatgtagatctttattttagaaaaatttagcaacttgaaccacctgaaacggatctacggttatttagttatgattttccgaagatttaatctattaaaagaaaggaaaaaggaaggatgatgatgtcacgctgacatcatccatggcagccacagcacgggtggcgacctcgccggagctagggtggtcggccgggattttggagaacacctacgcgaagagaacgacgagacgaacccgatgatactcaccaacgcgacgaacgacgacggatgacggccggcgacgaagaagcgacggcggcggctcggcttgcacggtggcgacggctctacgggtcacgggagaggacgggagagggggcaaacgaaagaggaggactagggggtcctatttatagccttggattgaagagatcggactcctcccgcaagaaatcgatccgggaaaatcaaaactcggttttggagataaactcgaaaacgagtttgattcggataaaatacccaacgatttgctccgattcttgggggaaaagatagaggaggatgagaggatcaaaacccctcaaaaatccggaagaaacggggtcggattggagcggatttggaggcggaaggcggcgcaaggtggcggctcgggctcggcctggctgca

SEQ ID NO: 3177 - DNA, 1501 bp, Oryza sativa
caccgatgtggatgacgccggtagcgggcagtgatggcttgggtagggtggtcgacgatgatggcccagctgaggtggaggcgaaccccgtcggcgatggagaagcggtgtcggcgacggcttccaagaggcgtcgccgcgtcggtggcagggagatctggcggggggcggcggcagtggaggagtcggtggcagggagatccggtggcgggcagcgggagaacaggaaacggtggtggggagatccgccatgctcgccgctcgccgcacgccatgcccccgccatgcccatcacctgccgcgcccatcgccggttgctctcggcaacttctgagagagagagagagaagaggggagagagaagagagagaggaagagggggaagaggagtacgacaggtgggtcccatatttttttaataaataaaatgataactagattgccacgcgtatgccacataggacaaaaccgctctagattggttcgaggtggataatttgtccggtattgaaagttgagggtgaacgttgtctaatttttgggtttatgggggtaattcggttgaccatgatagttcagggggcgggggaataattcgtactttttccttaattaaaccatatgcattccctctagccgaagcctaccatttgttgttgtgctcggagaggattttgttgttagatatagacacacgtttcctgtgattcgatacccttgaaatactctaaggtgaagtgctacagaagtattcatggtcttacgtatttatctatgatagtagaaaataccaacaggtggccacaggagggctagaggaggcgctggtgctatggtggggcgcggtggtggagcatgcagctgtaatccacgcatgcgcgcatgatctgtgtgtcttggccctccttattccacacccgggagacaggagatgctgcctccttggtcttctctcaccggccgctggtcctctcctcaccggccgttggcctagagatcacctggaagagaggggagagctagacggagattgcacaaggataagacatcggaggaaaaggaagcatacattaagaaattgcacaaggataagatgaccgaggtagcgacatacttgggacgctctcgcacaaagacataaatgtcttaattcatcattatttatgtagtaatacatcattaataacaaatgaagtctctaataaatctttcttgtttgtagcgaccactatatcttattcgtagtatatacgagggactaatcggttgtagcactcgacccgacacactaaaacaaggaaaccttcatggagttcctcacaattctaaatttaccctctagaatttttaagtaactcaaacaaatattttattagcatagcacacttaggttttaccgcaaacatcacggggcagtaaaggatccggaaaggacaaagctacacgtcaagataggtcggtggtactgacatattccatgaacacaaattctttgaatgat

SEQ ID NO: 3178 - DNA, 1501 bp, Oryza sativa
cggaaggccgttgtcggcacctttgtcggaagaggaactaggcggcgatgcctcgtcgggcagtgagacaaccacgtgtggaaagaggacctcattagccagctgtgacgtgtgtggggaggagatcgtcggccggctgctcgcgggttctgtggtgacaccgccccttcccctttcctcaacaaccccatgtgccgctgtctcccaccatggctcctatcgctgccatcgatgtcaagacactgctgcctgctaggtcctactcctcctgttgccggccccaaccatgccctcccatggcggagaccaccgctgagctactggatttgtgtggctgtcgcgttttctcgtcgatccgggaggtggcgttggtaatgaccaggttgagctctgcaaatctcgacaaggggagcgaggtctccatctcctccctttggaccgacagcgatgagaggagccatctcatcgtcggctgcaacggcgatttgatgacccatcccaccaagaggaagaagaagaggtgactgaagaagctaatcaccaagaggaaggagaagaagctcaaggaggattcctcggaggtctcctcccatggcgagctcaagcagccagacaccggcaaggttgtcggcaacgccgccgccaagcagctgtagccatcgccgtcggcggagctgaccatagaggaggcaccatgctgtcctagctcatgagcccctcccccgcgcgtgctgtggccagcgagctcctccccccgtgcacaccgtggtaggcgaaccctcacctacacgtgcgccgcagccggcgagcctctcccctgcggtccgtgcctgcatccttctgcggtccacgcccctcttgcgcttttggtgcctcccctggttgcacgtcccttggtagaggtcgtgctttgtgcggggagagagatgggagaggagagaggtgagtggtggagggggaagaagagaagtgccacttatatgtgggccttgacatatttttttaaattttttcagatgacaaggctgcctcatcagtgaaaccactgtcaaaaaccaccaggggagtcatttttcactagttttacacttggggcaggcaatatacgttttgtggttgagggatcaagacatgaggaaggcaaaataaacttatctcataggtttctggttatgttttgtttcatggcccatgttttggtgtgggccgacacaataaactaatttcctgggtacgcatgcgaattggggttacttttgccattcacatgaagctagtgggaaaaaagcaccagattcatcccacggggagaagagaaacaagaaagtgataaatcgataaaaaaaaagcagatgggagagagtggatgaaaaaacattagttgcacaaatttatcactgaacttgcataaaatttataacgtcaactacaacatccggaagtgcaactagcatagctgcatgtctgcaactacaaattgtagttgaaaaaaaacctctct

SEQ ID NO: 3179 - DNA, 1501 bp, Oryza sativa; identical to SEQ ID NO: 3177

SEQ ID NO: 3180 - DNA, 1501 bp, Oryza sativa; identical to SEQ ID NO: 3178

SEQ ID NO: 3181 - DNA, 1501 bp, Oryza sativa
aaaattgtctcatgaacatatctgacgattgtctctaaatcgatcagttcgtcgccggcacgcagacgataaacacgctggcctttgtcttggacggcgtcaactctggcgccttcgactacgcctttggtgcatacttcatggcacgaacacattaacctttgccttaattaaactttttgaatcgattaaaccttaaaaagttaaaatggacaccatgtaactgacaatgcggcgatgcatcgattcaattgcaggtcggcgtagcggcggtgacgatcccgtgcttggttcttctctcgtcgcacggcgggttcgtcgggatctggatcgccttggccatctacatgagcgtcagagcatttgctagcacctggaggtaattgattaacactctaagatgtgcattcttgtgcaaactgtgttcgtgattttgcagtctgaataaaatcagcctgaattttaaattttgttctcgataatttggaagcaattttaagtttaactgcagcatgactgatctaattactgaatgttttatgaatttctgcaggatgggagcagccagggggccgtggaagtttcttcgcaaatgagcatatgatcagtatctagcgtagtagtattttttttgcatactgctagtgtatacacgtacgtatacgggagtagtagtatacataaaaccacatacgtgttgtacgtagtatgtgtcaatgtgtgtccactggaacgagattctctgcattactgtggctgacatgtgggctctatttgcttaagggtccgtattgcagaagagttgaggccatgcccagctgcccactgctacctccgttccataataagttaacttagtactagtttaatttattttgggatgaaaggaatagctcttttttttttggtgttttaataagcacaacacatataatagtatgatacaatatgacgtcacaacaaattggcattgagatttgtcatttgagagagtagtcttcatgtactactactatttgttggctgtgtaggcgagatccggccattgctgtactcagtcactcacagtgtcgcagtttgtaccatatatatatcacagattattcacagcattctcctgtttattttctatgctttcccctatatatacttgatagacatttatggatcattctcctttttctctctctgatgaatggtctctttaattttattgctgatgctgattaatctctcatgactgacagttatgagaggcaaaacgaataacagttaaaatcgctatatatatatttatatatctccgagatcacgaagaagaacaagagattacaaacacaagaacactgaatgattcgatgaaagaaaaaaagcctgcatgcatggcatgcaactgcaacaaatagagattaacaaaaaataattaaaaacacacgaacaaaattaatcaggaagatcaacacgaagccggactaagaatcatcagtttgatgcggccgcg

SEQ ID NO: 3182 - DNA, 1501 bp, Oryza sativa
aatgagctaacttgtttttagtgtaggaataagttactaaccatctattatattatcaaaacagttttgaaaggaggcaccacgttcgctgtagggctagaaattcctacattaatcggagaaaaagaaaaaaaaggagagtccaagtagaaatataatttaaaaatagctgaaattcggaattaaaaataagcaatattgaaagtttctatataagaacccaatacgagattaatcaaaattcaaaataaaaataaaataaatccaaaattagaaaagaaaaggagagtccaagtcaatttaaaaatagctgaaattcggaattaaaaataagcaatattgaaagaagtttccatataataacctaatacgagattaatcaaaattcgaaataaaaataaaataaaatctaaaattagaaaagaaaaggatagtccaagtaggaatacgatttaaaaatagctgaaattcggaattaaaaataagaaaaattaaaagaagagttcatagaagaacccaatacgagattaattaaaattcagaataaaaataaaaatgaaatctgaaattagcaaaaaaaagaagagttaaagtaggaatacaatttaaaattagctgaaattcggaataaaaaaaagcaatattgaaagaagaatccatataagaacccaatacgagattaattaaaattcagaaaaaaataaaaaaaatatccaaaattaggaaaactaaaagagagttcaagtaggaatacaattttgaaacaactaaaactgaaaataaaaagtaaaaatattaaaagaacacaatacgatattaactaaaatttgaaaaaaaaatctaaaattagaaaaaggaaaataagatttgagttaggaatacaatttataaataactaaattttgtgataaaaataaagactattgaaagaaaaagccatctaaaacacatgacgagataaattgagtaatagggcctatgaatgagtagagtggtagcggttgatacgatattaaaaaatattaataaaacactaaataaatcctaatgacgattaaaagagggacgataggcaggacgtgaagcaaatgagtaaggtggaagccgggacttctagaaagtaaaaaaaataaacccaattgataatcatattcgatttttaaaatctcaatgataataaaaatgagaagcagcgggtggggtgtataggagtatagttgtagagccgccgacggttgacgggacttctagaaaataaaaaatgaattccaacgatagttatgttagatttttggaatcacaatgacaataaagagtaggcggtggacgggctgtaaaggagtatagtggtatcgtttgacgggacttctaaaaattataaaaaatgaaacccaacaagataataaactctaaaaactacaaggtccaatttttaaaggtttggaacttctaaaaagtaaaaaaaaaacaatgataatcatgttcgattttaaaatctcaa

SEQ ID NO: 3183 - DNA, 264 bp, Oryza sativa
  unsure (1)..(264): unsure at all n locations
cgatgtcnaatcgcctatcattggtacattagttcatcaatacgtggctgggacacgtagttggatcaacaagaaagggtatgcatgcatgcgcgcaaaatctggtctgacggacacctcgttcctcctgcacaagtagaaagggatgaagcatctccagtttctactataaatacatcacaatattgacacaaactcaacatccagcaaaaccaagcacacaaacacatacatttgcccaaacttcaaccatggctctcaaat

SEQ ID NO: 3184 - DNA, 1501 bp, Oryza sativa
cactcgcatatgagtagtcctatttgttacggtctcacatgcgaatgatttagcttccttatactatactcttttcgtaacaaaatataataacctactactggaacataaaacctgtttagattcttaatacttgacggagcgtggggctcctcaccgggagaccgcgcgggcccccctttgccggttcggccgggggcgctaagtgaggttctaagcccttgatctgtggaatggttcgcgagagagtaaatgcacaagacacgggcgatgtagacaggttcgggccgctgagaagcgtaataccctactcctgtgttctggtggatctgtgtatgaaggagttacaaagagctggagagcaagagagttcgaactctagagaccctctccctactctttttcccagtcccctctttttcttttccccccgtccgtcagtccgtcagtccccccctcttggtaggcatggtcctccttttatatctcaaggggataccacatacaccatttctacctacccttcttttgggtggggacccatcctactttgaccaaaacttggcttgtaccttcgtctgacaccgggataaccctgtcctccctcattaatgggcggagatttgcaatggctgccgtccgaatggccctccgatgggatgggtcataccaacctccactccgccggaagcaggtgcaacgtggaagcacggttgtttgctgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctagccggggctgacgtgccaactccaggagtccccacgccggctccggctagggacgagtgcctggaggctctcatcattccgacgggacggggcgaggcgtgtgtcaggccgcctgttgccccctaacccgcgatctgaccggtctgtgaccggtcacacactgcgaccgatcacggactagataagcatgtgctacgctgcattaaatgcggcgtgagacgctcgtccaacccgcaataaacgcggttaggtgagcgccgctgtgctcatctaacccacacacgtggcgccaaaccctcagggggtcggggcgccccagccctcggggacgaaacgggagcggcccgacccctcggggagatagagggaggggcggcctcatcaccctcgggcccgacccccccgagggggtcaggccacgtgggtgaccgcggctgccccaaacctctagtcaagatatccccggtcccatgtcaccgacaatactaataagataaatcttatccgacacggaaagagatcctcttacctacttgttgtgcagttgaattactgatatataaaccacaacaaagtaggattaattcatatatcagtgacaactacacagttaggtcaaaggatccgcttccatccggcac

SEQ ID NO: 3185 - DNA, 787 bp, Oryza sativa
atgtgctacacaaaatatttttgttctttttttttgtaggagatttctctctaatgccacatagaaagacttttcaaaaaaaaaaaacatgcaggaaattttgaaacataaacagaaaattatatgttgtgtaaggaaactgcactaaagattagttacagcgatatattgtgcatgccaatattaatataacattagttgttcacaataaaatttatcaaataaaatgagtcttcattcatactccctctaccaaaaatataaggcacaaccacttttttcccacgtctcatgatataaggcatgcatacattaaccatcacctcttggttcttcaaatttgttttattttgaatcatctaccattaaatcctccaatcacattgcttgcatgtatgtatgtgatccaatcaagaaggtgattaaattatttcttggtctttgtgttacgagtggtgagtcttatattttgggatagagggagtatttctattaaaaaataatactggaactcatatatggatttgttatgtttgctaataagtattttttttgcggggatgctaataagtttttttaactttcgtaggcatcactttgggattttccttcctaattgttgttgttcttttcacgctagtgatgcaccaaaagcgaaaaatgaatgaatatttcaaaaagaatggtggttcagtgctacagaaagtggacaatatcaagattttcaccaaagatgagctaaagaaaatcacaaagaataattcagaagttcttggtcaatgaagct

SEQ ID NO: 3186 - DNA, 1501 bp, Oryza sativa
tgccagttagcgagccatagcttctggtccattcctgctcaactctatgatcttgctgcatgcaccaaaacaaagcaaaaatcgagtcaaaccaagagcacatagcatcaaaagccccagccactcaaagcctcaacagaagggatgaactgatgcaaggaatcaagttcagggacgtactccctctcctcaagagcaatctcatgaggagatcgggattaacagagagagatgggatctttccttgaccagctgcgcgattccctccttgcccgcatccaccgcacacaccggtccggcagggtccatgggtgtacctcctcattacagccccgaccttggatatcgatctcatgccattcatagccatcctcccggtgcagcggcgccggccgcctccgcctccaccgctggcagtgccaggatggcgacctggtggggagcaaagacggtggcctccatggtggctcgtctcaatggaggaggtgcggtggcatccgtaacccgtagtgctgggggcggggtagggtttggggatttggagcggcggcgcggcggcgataggcgaggggcaggggcatgccggcggtggggtagtgtttggtgattgggtacggcggcgattggcgaggggcaagaatcgcggcggcgatgggtgaggggaacgggcgagaatagcggtgcgcgagagagaagggggcgcgtgagaacaggagttagcgagagagagagaaggcgcgtccgcgcgtgggcgtgaccgcgtgggggaggagcgcggaggggagggggtctcatctggcacgttcgatcacagttagatgaatatgagccattggatttgatgaatgagtaatgtaggtgtaagagtgagttggtgaattatagggtagattatgcattgtatgcatataagctattcctccttcactgtgcaacattattaaacataatataatttaagtattttacgaaagggaaaatagcttcttttatctactataaaaaaatacccgtgtgttgcaatgggtgaagttatgttaatcttattattgttataggtttaactaaggtaaaattcattgtgcgattttgctcgattttcttttttataaaatcatgacccgcagttaggagtctgattttctcaagtttcatgcaagtttttttaaagagatttcttatacaactccttttgtattctcaaaagcgaataaacttaaaaaccgactaaaacacgaatgacgtatcaaagtaccggcaaaaacatcttcaatttttataatagtagagaagtgcgtcaggccacgtcgtacccctcccacttgctgtaccatcggcctaggcacgatccaatatgactcgtgctgtgccggaccagcctgaatgcatgaaggcccaccgtgctcaaccttggaaaaaaattatattttgcgttcctcatctatttgggccattggctagattaagtctattttgcgccgcagctatttgtgccatatat

SEQ ID NO: 3187 - DNA, 643 bp, Oryza sativa
ccttcggaaaatcataactaaataaccgtagatccgttttaggtggttcaagtttataaatttttctaaaatcaagatctacatgttaaaaatatccacatgtactgtttatgcttgtttttgtactgttttgttgattttgtttatttgctttagtttccgacgttccggaggagagcgtttccgttgaggaaggttccgaagcgtttgtggaagcccaaggcaagtcacacagatcccaaacacccctttgagcatgttgatcccgtttaaagctattattttatttcaactatgcattgttttcgaatgtcatcgggtggtgaacctttcccagttattaatggccgaagatgactttattttcctatgggttataatttgattagcatgaaccttatatattggattggttcagctaaatgctatatataggtttgcttagccatgcttagaaacattagctaactaaaaggggttaaatataaattatattacataattattattgttaataatggttatatttaatggtagctcacgatgaggcacatggtaacatgatgtggggttgtgtcttgtgggtacagtggtacatctctgatcagagtttaatctattcgaatagccgtacccgcggtta

SEQ ID NO: 3188 - DNA, 1501 bp, Oryza sativa
cgaaaataccctcatcttctacctctctcttctcttatcttctacctctctcttcacgttgcttcactactgaagaaaccatctttggtcggttgcccaaaatccaaaataatcccggtttaaataggaaccgggactaaaaaatatctttagtcccggttaaaagacctgacgtcactttttgatctttagtcccggttgggtaggaaaatagatacaggcagcaaaaaaacaataaataaataaaacagttgggacgtgaccctatatatctgtagtcccggttggtaatactaatagggactaaagatggatttttagttccggttatttcacccaggactaaagattcctatctttagtcctggattcctattctcggttacaaaaccaggagtatagggggttaggaactgggggtaaagaccatttctccactagtgcttcttgctctgccaccacgctgctcacgctccgccgctgctgctgcttgccgccgtgctgctaagcaggaagagaggaggaagaagaaaggggaagaaagaagaagagggaaaaggggtagtttggtccaattttttctggaaatgcatccgaggggtaagtagtggtatcttttaaatatgtgtaaaattataatgatatatttccaaatacatgaatacaagtggcatatttcgaaactgataaatttttattggcatgtatccaattaaccctaatgtatttgcctgatataaaaaaacaagtgacttgatatattttgcaaatctctcatttatatatatccatatacatatgcttcttcccttcaaagttaagttcctaatatttctcaatgtatatatgtactcattcctacctccagtctggtgaacgggtgcggactgcagtttgtatagtaagtacacgaagatcgagtcaagcgagcggcgtagaggtcatgtgtaccgtgtacttacttattgatgggaaaaggaattaattttgaaattataattttaaaaaaaataagaacgaactgcaattttaagattttggacacatttatttaccaatgcttcccattggagtatgggacctctgtattttggcctatactttcagtttgaccacttactaccttaggtacttttttgtactcctcaacctcgaacttatgttgcgttcttaagttcactttcccaacttcacctccctcgtttttcgagtgcacatatttgttttacttgttttgaaaaagcatgttacttgttttaaaaaaaattatattagatcaacgggtaggtgaagaattagttatattataaaacaaaatttgaataccaaatatatatagctataatatagtattttaagagggaaagagtagatcgtagcaggtggacaaacacagctctgctatctataaatacacgcgccacagacaattggagcttattgaagggaaactaattaaaggaagagctgcagctactcctactcatatatctaggaaata

SEQ ID NO: 3189 - DNA, 835 bp, Oryza sativa
ccggcgtgggcgtgcgcgcgaacaggcagaacagcttcagcatgaacagcgcgtgaccgtctgataccaccaaccccggctggttgatccttcacacgcggccgcatcaaactgatgattcttagtccggcttcgtgttgatcttcctgattaattttgttcgtgtgtttttaattattttttgttaatctctatttgttgcagttgcatgccatgcatgcaggctttttttctttcatcgaatcattcagtgttcttgtgtttgtaatctcttgttcttcttcgtgatctcggagatatataaatatatatatagcgattttaactgttattcgttttgcctctcataactgtcagtcatgagagattaatcagcatcagcaataaaattaaagagaccattcatcagagagagaaaaaggagaatgatccataaatgtctatcaagtatatataggggaaagcatagaaaataaacaggagaatgctgtgaataatctgtgatatatatatggtacaaactgcgacactgtgagtgactgagtacagcaatggccggatctcgcctacacagccaacaaatagtagtagtacatgaagactactctctcaaatgacaaatctcaatgccaatttgttgtgacgtcatattgtatcatactattatatgtgttgtgcttattaaaacaccaaaaaaaaaagagctattcctttcatcccaaaataaattaaactagtactaagttaacttattatggaacggaggtagcagtgggcagctgggcatggcctcaactcttctgcaatacggacccttaagcaaatagagcccaca

SEQ ID NO: 3190 - DNA, 1501 bp, Oryza sativa
aactcggctctcttgagttaaagccttttgaagtaattggcttacatctaagaaagtatgaccatctagcttttcttttaaatattcaagtaaaccagaataagccaaatctaccaagaccttatcagaaagtgttaaactataacatcagtttcttatatatataaatcttctaatgtattcaaaagtaggctcgttatacttttgtttaaccgaggttaagtacgacaagtttaattcggtctcaccactaattaaagaagtaatcatgatatttttgttctaactcagaccaatcatgaatacagttggtgcaagtgaaataaacccaaaaaattgcgcgcatcaccaaataaagacaatgggaaaaagcctaagtttcaaaatactactagcactagcttcttcgcattgaataataaactggtcgatatcctctaaagtagaccggccatgttctccagtgaacttacacaatgaggcaatcaaaacccttgaggatattgaacattatcgtagtggccagtatagagtttttgatatatacgccttttaaccctagtatctatgccgaaagcatttttgaaagcttcggcaatctcatcgctaagactcttgggttatgctcatgtgccattgactacaggatctgacaagactcttacttgttcatatcccatatgaactcctcaaattctacttaacaaaaaattgattgtccatataaatatatagcccctaggagagaagagcatcgaatcataagccatagccacaagtcacatcgaatatcaatcaggaggaagtgattaaattggcactataaacatgtagttttgtaataattttgttacttaatctatagctttgtgaccatatatttcaaatctttagttttgtgataaacttaacactatatgtacttagttttatgatataataccttaaatcaatagttttgcaatagtttgatcaaagtatttgtagttttttgtgaaatttactcatttacttacaaatagtatcaatcatgcaatttggttggaactgtcctatactacagaactattctcccttttcataaaacaggctagtagtactgtgcgctctaggagtaccagtcgattaaagcttaactttgcttgttaaacaccaccaatcggcggcaagagcatcaacagtcaccactgcatgcagtgtgaatgttcacagtgcctccatgaactgctagctgctactcttaatcgatcggtgtctgatcaaatcaaataaaatgcacggcgtgaatgattttaaacctgcaaaatcggcgcaaattgctaatcatgttgtactgtaatataattagctgacctcagatcactcccaactagtagcctttatcgatctatataaaccacatgcatatgcctgatttttcttcactcatcgacacacacagctctagcctcttgccacatagtccaaagagcaatagagttttctaggattgattcagcaa

SEQ ID NO: 3191 - DNA, 1501 bp, Oryza sativa
cacttgagagttgatctagactcatatttcgatcgacatgcagagaaacaatccacagatatgtgggaaattccgtcaacaaaagtgaccatggcacaaataaaagatatgctgtgtgtgtgtgtgtgtgattttagggtattcccaatgttccgtgacaataaatatagcttaccagataggataaacacctaaagtggcactagagaaaatgaggtgtcacacaaatgcagaatcgtgctattagcaccggttcaaaaaccggctagcactacccaacgagggaggtacttccaaatcgggcgtccgaccctctcaaaaaaatcggtaagtcaaatattgtcaaatacggcggttgaccaccagtgaaacattagtcaaatattgtcaaatacggcggttgaccaccagtgaaacattaagttatatacggtgaaatgaaaaaacagtcactagaacatttattttttttaaacacagctaaaacacacattgaaattaacatgttgctatgaaacattaagtattaacggactaaaacatatgtttttttacatcagaacataatcacgccatatcttgtcgtgaagatttaattacaacgaatataagagtgttatcggatagtatattagataagtagtttaggagaaaattcattttgaattcatgcatccatgcatggatagagaggagggagagtaggggaaaaaaaaactccatcagtcaaatgttatgttacagttaactaccagtgaaacattaagttatatatagtaaaaaaaatcagtcacagcaacatttaaacttttttttgaaacacagtgaagacatatgttgaaacatgttgctatcacatatgaaacaatgagtattaacaaactgaaacatatgcttttttttatcagaacataatcaggcgagattttgttgtgaagatttagttataacgaatatttaaacttttttttgaaacacagtgaagacatatgatgaaatatgttgctatcacgtatgaaacagtgagtattaacaaattgaaatatatgtttttttattagaacataatcatacgagatcttcttgtaaagatttagttataacgaatacaacggtattatcggatcatagattataagtagtttaggagaaaactcattttgaaggttgctaaatccatgcatgcatgcatagatagagaggagaaagagttggggcaagtacttcaataaattctgtgaaatatagcgaatgcacactttgaaacatgtcgttactacacaggaaacattaagttttaacagtctaaaacatatatttttattttatgaaaatataatcatgtgatatcttattataaagatttaattgcaacaaattcaatggtatgatcggatcataaatcgggtaggtagtttaggagaaaaaacatttaaagtgatgagaaaaaaagaaaaagaaactagttagtactcgtcttgcatgcatgccgtagcaagta

SEQ ID NO: 3192 - DNA, 1501 bp, Oryza sativa
gaacacgtgactatgcactcgcgcgcaatcttcgctgggcaagaagcaagctagctaggcatcacctaatgacttccttcttgggtatattcggtttgaagtaatttaagcgcataaaaatagaaaaagtgacgaataaatatatatatgtaaagcgttcgccaaatatatataaatatatatatatatatacatatatatggtttttttcagaaggtttgattagatggaaaaatcatatattttctctatctctattattataaaaattaaaaataattttaccggtattttggtacgtcatttgtgtttgagccagttttaaatgttttcgtcggtattttggtacgtcattcgtgtttgagtcagtttataagttcattcgcttttcgaaatacagataagtgtttaagttggattttaagctaatttgcttttaaaaatacaaaaagagtcatataaaaaatcttgtttaaaaaactctgcatgctaacttgagatgaaagtcggactcctaattgcaactcatgattttcttaaaaaaaatccaagcgaatttccacagtaaattttacctaaactaaaacgtataaaaataataagattacagtagcattcacccatacccgataaagataataataataatattacaatagcattcatccattacaacgcacaggtatttttctagtacaaactaatttataggatccttttcatatactttgtttctacaaaccgaatgatactcgtaaaaattaatcttataccaatcgaaattatttattttttcttcaagcccatctaatccttaatatactttgacggacaggtacttcaatactcttattatatgtaattgaagtcttgaagatgacaacttggaaagactatatatataactagctaattcatgatacgaaattaattattatacccacaaccctgttcctatcatatggcatactgactaaatgctaaatgctggctaaatgctgagctggaagagaaaagagaaaagagagaggagaagcgggctgtaaacttacagctagcttgaacaccagaaccaagaaattctgtgagagagacaagtggatcatgcattaattataaagagctaactattatataggtagattaagagaatgctaaaaaaaaccttatagccagcagatcggctatattattagcctcgctctaacacccctatcattaaaaactaactaccgcggatagtaattacccccatcacatgagatttgagctagactcatatttcaatcgacatgcagagaaaacaatccacagatacatgggaaattccgtcaacaaaagtgaccaacgcacaaattaaagatatgctatgtgtgtctgagattttagggtattcctaatgtttcatgacaataaagatagcttacccgataaggaaaaagtacaaattaaccccctccccccaactatcgtggtcgacggaattacccctgaaccttaa

SEQ ID NO: 3193 - DNA, 1501 bp, Oryza sativa
tggtgacgctgacgagcgggtagatgcacaccttcatgaccttgttgaacaccgcgatggcgacgcccacggcggcgatctccacggacccgatccggccgatgaacgccgtgtcgatcagcgacgccagcgggtcggccgtcagcgccagcgacgccggcacggcgatgcgcagcacctccgcgccgagctcgtccagcctcagcgcgctcctcgcgttcagcacgaacagatgcagccccgtcctcctcgccccgcccagcaacgatgtcgccgtcggcggcaagtggtcgccattatcgccgccgccgccgccggcagcatcagcattctcggtcgccggtggcgccgccaccgccaccatctgtttctgctgctgctgctcggtcaccggcatgtcgccggaagcagcagctgtcactgtcgctgtcagctggtgatccgcctccatggattcgggagctgatgaactcctcgccatgcaggtgttgcttagctcgtcgatctgcatgtagcataatgagtgccaaattaacaaggactaattatcatcagcaacttgctaatccgaatgaccgtacgcgcagcttacgtgcttgtgctgattaaggatgaaacagcgtgcttagtatcattaataatgtggatgcaaattaacaaggtagagaaagactaaccagggattaatttgagcaagatcacctagaggaaagcagcggttttggagccgtggtgggtggtggccaattggttcactcagctcggcttaaatagatccaaaaatcaggggagtctgtacgtgttcgtgcctgcactagatgtaacccgaccggccgtacgaaattacgaatggagtttgtatctgtggacagtggacacaaggagtggccagcagcaggcagcaagggaagcttgtatggtaatactcccaacctagtgccggatggaagcggatcctttgacctaactgtgtagttgtcactgatatatgaattaatcctactttgttgtggtttatatatcagtaattcaactgcacaacaagtaggtaagaggatctctttccgtgtcggataagatttatcttattagtattgtcggtgacatgggaccggggatatcttgactagaggtttggggcagccgcggtcacccacgtggcctgaccccctcgggggggtcgggcccgagggtgatgaggccgcccctccctctatctccccgaggggtcgggccgctcccgtttcgtccccgagggctggggcgccccgaccccctgagggtttggcgccacgtgtgtgggttagatgagcacagcggcgctcacctaaccgcgtttattgcgggttggacgagcgtctcacgccgcatttaatgcagcgtagcacatgcttatctagtccgtgatcggtcgcagtgtgtgaccggtcacagaccggtcagatcgcgggttagggggcaacaggcggcctgacacacgcctcgccccgtcccgtcggaa

SEQ ID NO: 3194 - DNA, 1501 bp, Oryza sativa
tctttctctcataaaccgggactaaaaatgaaaaatcatttttagtcccggtttttaatggaaccgggactattgtggatttgggtcgaccgaccaaagatggtttctctaccagtgactgggagttgttttttatgttaccggatacgaggatatatacggatacgcgatacggggatacggcatttttcaagaaacatatatacggggatacgtctatatatgtaataaaaaattaaaactaataaactctcttaacatattgtgaaaaccaatgcattcacagaaaaattaataaacttgcggactgctacctgctgattattcacagaaaaatcaatgtgctttctcctatacccgctcttgtctgccagactgccacaatccaccgaggcttcttttcattattatctagcagctgcactagtttttcgagggtaggatgttaggaaacgataggcaaataaacgataaaaaacaacagatcaatcacagaagacactagatttaacgtggaaaaccctcccaaagcaggagaaaaaaaactgcgggcgccagccagcaaaatatcttcattatatcggggtgaagttacgacgctaaatggtggcttacaggaggtatatatatgaaggtgaaaccttaaaaggataacgaatagtgaagatatttttcactccggcccaagcctccggcttcaaacggcctccgcttcgctccagcagaagctggcctttattatgtgcaaacaaatttggatcacaactcaacataggagcattggatgcatggatgcactagctctgaaacttagatttcagatccatcggatgactgctaaatgaatcactgcagtggagctacattcatcggcgttggtggtagcagcgcgctgttcatcggcattggtggcggcggcgctacaagcctgtaatcgtgtggggatgctgtgcctcgagcgagagcacaaggaagacggtcttggccccggcggccaggcagggcatgatgcacgatgggtgcgggtgttgtgtctggcggcggcagccctgcgcttggaaagggattcggaggtgggcgtaaaacgtatcagcgacgtatcagggtttgttttatttatttggaaattacgaaattgttggatacgtatcccgtacgtatcggcacatatggaaacgtatccatatctgttcacgtatctgatatggatatgccacttgactgccatatccaggtattctaggttgttttttctcttttcacatgtgtatatatgtattgggctaggatttttttgggtggtcctgggaccacccctagatctgcaaatggagctggtattttagctcgttacgggtaacgtgccagctcgaactggaatgtgtgttttacgagctagagtagcccacagctcagcaagtcacaacccatattcttataaggccctagaacatcaaaagcctagctcttgatccccttttgaccccttctcactctcatg

SEQ ID NO: 3195 - DNA, 1501 bp, Oryza sativa
atcgtaaaccacattaatttacttaatctgatgttatctagttatcttacacgttattttttttattgttatcatactaaatttccgcagtaatgcgcagagtttcatctagttattgaaatattcatgaagtaacagaaaaaggaacacctgtaactgtcgatctattattaactcaataaaacaatataaaagccaccatattcactctcatgacctagaatttcccatattaataaaaaagaaaaaaatagagtccaagtgtatagattaaaaatatctgtaattcggaataataataaaaggataaaagaagtacatgtagaaatgcaattttgaaaagaaaacttaaattcgtatttaaaaattaaattaagacaagagtcaacgtagaaataccttttaggctgaaaaatatgaaattcggattaaaaatttaaaataaatattgaaataaaattatatgtataaatataattcaatctaaaagtcggaataaaaattaaaactacaagaaatagtccatatagaaatacaatttgaaactacctaaaattcagataaaaagatagcattgtgtacaaaagagttcatggaggagttcatggggtggcttggacatgggctacccattttttgggctagatctagcgtctggctggagcattctcgtctttatctcagcccgtggcgttgtgtgttgcagagacgcaaggtgggtgaagaggtaaagaaaaaggcctagttgacatatgctcatgtcgggtcatgcatacaggttggcatctagaatatgcgctggactgccatggtggattcagcctaaggaagcaaagagattttctttttccattacatagacaagatgcacgtgtagtcggtgacaccacactcatatactcacgtacactacgttattaaaatagacgaagacacaataacattttacttaaacttatgctggcttcgatttctgcaaatactagtaggcagtatatgctgataaatttaaacaggtaattatccaagagccaaattaaccaagacagtaataagaaagcacaatagtatcaataatgcaatttggttgaagctgtcctatagtatagaactatcctcctttttaataaaacggactagtagcactgtgtactgtaggagtactactcgattaaagcataacttttgcttgtttaacaccaccaattggaagcaagagcatcaagggtgaacactgcatgcagtgtgcacgttcacagtgcactactcttaatcgatcggtactgcctgataaaatcaaacttacggcattaattttaaacctgcaaattcggcgcaaattgctaatcatgatgtaatataattagctgatctcagctcactcccagctagtagcctttatcgatctatataaaccacatgcatagcctgctttttcttcactcatccacacacagctctagcctcttgctacatagagtttgcgaggatttatcagcaa

SEQ ID NO: 3196 - DNA, 643 bp, Oryza sativa
agcttcacccaactccactcccagttttggtggagctgaaactgtttggctgactccagctccaggaggggtggagctggagctgtgccaaacaggccctaaacgggctcttagtgatggagaatcgaaattgtgccacggggtacttacaggcgcacaacggtagcccccattccgcacactgttttttactatatatatatacattaaagttatgttaatttatagagaattgacatatatattatatactacctccgttttttaatagatgacgccgttgactttttctcacatgtttgaccattcgtcttattcaaaaattttacgtaattataatttattttggtatgatttgttttatcattcatagtattttaagggggaattaatttcctatcctttggcttaaaattttggattaaaacaaatggtcaaacattggaaaaaaagcaccggcgtcatctattaaaaaacggagggagtatattatagttataatgtaattacattgtatacaatcgtattgtagttacgttcaaaagtttaaagagagttttttttaactgtatagctagtctccaattagggaaccacgttagacgatttgccaggatcagacagtattgtaccttacaattga

SEQ ID NO: 3197 - DNA, 1501 bp, Oryza sativa
aaattttggttttttcggttctgtgcaggcggtataatttgaccacacgggataatcgattatctcgtgcggtccacttaacacgaccgcacgggaaattgattatcccgtgcggtagagctgcccgcacgcgaaaatattgatttttcaagacacttgggtgcagacgggcaaatcctctgcacgggaaaatcatttcgaccgcatggaaaaatgttttttgtagtagtgtacatccgtcccaaaatataaaggtggaattaaagtgagaagatttgaatggtgaaaaatcatgattgaagcagggtaaagtggaattaaagatgaaggatgcaatacatttagaaagtacaacatgccaatattgcaatacatttagaaagcacaaccacactattattacaaccacatgcaaaaaattacaaaatgataaaagggacctaacaaagctagaataactcaaacactaaacatcctattattggacggccaacaattatttaagataaaaaaagtgcacctttatgatggttgtattaccactatcagtattatcactagtagatcgaagtgagatctcaaaccttgatttatcattactacaattaataaaaaaattctagtaccaatagtggcagtagtataaatagatacgagaaccattaaattaaaaaagatgaaaggcctatattgatctgtactaagagtaagactattgtaaaacatctcgctgtctagcttcaaggctcacaccaattatcatatgctgcaactttctcaagctgaagaataacgttttcctcacaccaattatcatatgctgcaactttctcaagccgaagaacaacgttttcctttgggagggcataaaatcgttttctttttgttgggaggacgaacatgcggataattcaatttagggccaagagcctacatatatgtactgagatgggccaaggaagaaaaagagcctactattcgttaattgaaattttctttgctcggtacgtccacttgtatttcgctgatggtttttggctgtcaaggctagttgagttcatggtagtgcaagtcacgcgcactttacaaggacgaaaaaaagatgctatcacattactcctaattaatcacaatgcattcatgtggacaccgcatagaaaggtgtatgcatcctgcgtataggtaccaaccggctgaagaaccgcgtcgtacctaggcaacgtcgtgatcgaatgtgacaaggatccagattggacgtacgtgatcaaaatcattcagtttggacggccttaattcgtagcatctgcaaattcggcgccaacttacagccgctttgctgatcatcgaccgatcgatcggtcgagctgtattcaactattgatcgatcatcgatgatgatcgatgagcacgagaggctaagcctatataaatcgcgcgttacctgtctttctcttcatccattcagagttagcaagctcttctaattcatatatagaactca

SEQ ID NO: 3198 - DNA, 1501 bp, Oryza sativa
acagaggaggagatcccaaccactttatccgaatgcatacttagacacttttgtaaagtatttactttcataagaaactaacctttctttgtcatgtaaaatataaacaaaccggcaaaatactaaatatataactgacaaagttaacttgaattttggtgaagcgatagatcgataactaccctctatattatatactccctccttccatttagggcatattcaatagtaaagacgagtatggtctcttaaacaatataagattatttagagaccgtgtctttacagtagttaagacgacaaggctttaatcattaactcagaaaatattccttttgttaatattctttccatttttttaccctcatgcaaccatatttccatattatagtaattaagagtcgttgttaagacgttgttatgcataacaacgatgtttgtctctccctctttctctttcttctatgttaacaagtattactaattagcaacgctaagagagcactattgataaccattgtacatgcccttatatatgatattggtttgaactaagcaacgtcatataaccaatttcatatataaatggaaggagggagtaccaaatctatttattatatactaaaagtccattaaactttctacaaacactctcaagccgccacatggcactctataaatactctcaagtcgccacgtggcactctaataaaatagagaaatctaaccattgattttcatttaaatcggtggacccattatttaacaccgttagatcctcccaccgtccccgcacgtaatgatttttatgccatttctctgttttcttatcgagatgcgcttcgctctcccactaaaaaaactgcacgaattttaaagataagtctaagattagaaggtgcttaacagtttgaaaatcaattagaaagggtatgttcgtcctcggagataattaaataatctcgcatgtgatatcggttccttcggcaccagcggccaatacgctactaccgttacttgatcatagcccagaccaagaatgcaaatcagaatataactggaagaaaaattaacaatgaataggatcatcaatggtcgcttgatggagcattcaacctgatatatatatacgcactcatatggggcaccatagtgcccgggcaccatgctatctaatgcacaaaatcactcaatttttttaaaattttcaaattgtgagtatatacctagttataataattcgattcatacttatacctatcaacaaaacaactcaaatttaactttatttcacagtccatgattacatacatatctaattatatgtatggatgctatatacctataatcaaaatctaacaaaaacaagttaaaattcagttcaaaattgctttgaactagttagtaaagtagttaatgttaatacctaagtaattgaaaaagtttcatactcatttgaattgggtatatactcaatttcaacaatatatatatatatata

SEQ ID NO: 3199 - DNA, 1501 bp, Oryza sativa
ctaccattttacggacaacatgcatgtagtcaccactaaatacagacaccacacttatacactcatgactgcgttccaaacatatgttaatagcgcagatatgttgatcgaactatcacaaaactacagattaatttagcatcaaatttatcagaaacctaaagaattaaggtcaagtatgacataactatatatttaatattggagttatcacgaaactacaaaatttggaggtcaaatttttagcactaccattatgtttgagctataaaagttgcatttttgtgattaaattggcactaaacctgtagttttatgataaacttaacattaaatttgtagttttatgatataacaccttaaatcaatagttttgcaatagtttgaataaagtatatgtagttttgtgaaatttacgcatttacttaaaaatagtatcaatcatgcaatttggttggagctgtcctaaattatagaactattctccatttttataaaacagactagtagtactgtgcgctagctgtaggagtaccagtcgattaaagcttaactttgcttgttaaacaccaccaatcggtggcaagagcatcaacagttaacactgcatgcagtgtgcacgttcacagtgcctccatgatttgctactcttaatctatcggtgtctgatctaatcaaataaaatgcacgtacggcgttaatgattttaaacctgcaaaatcggcgcaaattgctaatcataatgtaatatactccctccatctacttttgatagttatatttctaaatctaaaaaatttattttcgataggcatatttcaatccaataacttatcctcttaataactttctcggatttaatgtgtgactcaccattcttccatataagattggctgcataggcatcgagaaatgtaaatattaataaatcgtttgtttacgaggaatgactagtactccctccattccaaattgatctacatatttcataggtacaccaagaccaagaaaaactaataactctcttatactatctttactctagcaacaaactcaatgcaggcaccatccccactatttcctagccaatagcaaatcaagatattgcatgtgggttataaatacttgtgtgcatagatgcatgcatcaatgtccatttactccaatgtacaagcaacgaataaacctaatgaatgaacacaaatatgtagatcatttagaaataacctcaaaaatactatatgtagatcaatttggaatggagggagtagcatgtttgaatggatgataagtagaattacttatccttgatctgtgtgccaagatgaaaatataactatcaaaagtagatggatggagtaattagctgacctcagatcactcccagctagtagcctttatcgatctatataaaccacattcctggcctgctttttcttcactcatccacacacagctctctagcctcttgccacatagtccaaataacaacagagtttga

SEQ ID NO: 3200 - DNA, 1501 bp, Oryza sativa
cttatcgacgccgttgtccgttgttgacgacagcggcacgatcttggacggctcctgcccggggcacggcgtgctgctcgccgcgctgtgcagctgcgcgaagcagtcggcggcgccgtggaggtcgtcagcggcgaggggcacgctgaaggcgccgtcgccgtcgaggtcgccgatggccttgctctcgtacacaccgtcgctgttcttgcacttgatcgccacctggagacctgaacatcaccaaaaaattaatcaacgacggtgatatatcgttcgatcgaactgaccacgcaattaattagcgacgaacatatatatcatgatatatatacccttgaaagcatcctgcgccttcatgttcttcctggtgcactcgccgcacttggcctggccgacgacgatcgccgccgcctcgccgtccgcagcggcggtgacagccatcacgagggcggcgaagagtagcgctcgtgctacatctgccattgctgaatcaatcctcaaactctgttgttatttggactatgtggcaagaggctagagagctgtgtgtggatgagtgaagaaaaagcaggccaggaatgtggtttatatagatcgataaaggctactagctgggagtgatctgaggtcagctaattactccatccatctacttttgatagttatattttcatcttggcacacagatcaaggataagtaattctacttatcatccattcaaacatgctactccctccattccaaattgatctacatatagtatttttgaggttatttctaaatgatctacatatttgtgttcattcattaggtttattcgttgcttgtacattggagtaaatggacattgatgcatgcatctatgcacacaagtatttataacccacatgcaatatcttgatttgctattggctaggaaatagtggggatggtgcctgcattgagtttgttgctagagtaaagatagtataagagagttattagtttttcttggtcttggtgtacctatgaaatatgtagatcaatttggaatggagggagtactagtcattcctcgtaaacaaacgatttattaatatttacatttctcgatgcctatgcagccaatcttatatggaagaatggtgagtcacacattaaatccgagaaagttattaagaggataagttattggattgaaatatgcctatcgaaaataaattttttagatttagaaatataactatcaaaagtagatggagggagtatattacattatgattagcaatttgcgccgattttgcaggtttaaaatcattaacgccgtacgtgcattttatttgattagatcagacaccgatagattaagagtagcaaatcatggaggcactgtgaacgtgcacactgcatgcagtgttaactgttgatgctcttgccaccgattggtggtgtttaacaagcaaagttaagctttaatcgactggtactcctacagctagcgcacagtactactagtct

SEQ ID NO: 3201 - DNA, 1501 bp, Oryza sativa
ttttgtcttttttattacgaccaaaatataatgaatttgaagataaaatttcacatataggtgtaatattattcgaagtatgtgtataatgttttgtagaattttcgtggcatttgctagttggtatgcacggagtgtgcataggatatgttcccggttactagtgcgaatactttgctccagttgatccatttgtccattgaaactatccaggcatatttgataaaaaccctaacgatatgtgaaaaagcttccatatccatttctgaaaattttgtgtatgaaaaaaaaaaattcgaatggttcagctccctgccttttcatttcaaccaaccaattaaaaaaacaacggtgaattgcatttatctatcgaacttggcttaattaatttagcatttgtgtgctccacgcagtcctttaattttagagggctgctacaaaacgggatcccgttacaacgggatagacatattaactattctcttgcacgagtatcacaggtatcaggtcctaggtatcataggtaccagataacaggtatcgcaggtatcgggtaccatgtagttgataccacaacatgtatcaggtatatgtactgtctcatagaagagtatcccgttacaacgggataccgttgtctaggttttctctgttaattttatctatttgctaccatggatgtttcagccttttttggcctattccagcggcagcaaccccagcccatcgctgtcaactcggacgacaagaaggtgcttaatttcctggatggatccactgacagatatagatggccaaaaggcccgaggcccgatggcccagcccatggcacggtattttggcccggcccaagcacggcacggcccgacggaggccgggcccgtgccggcccggcccggcacggccgggccggcccggcacgatgggccggcagctaggcccgatacacaaaaaaataggggagtaaaaatagacattatatgccatgaacgaaagcatagggatctaaaatagacttttattatctatacatatgtcagccaaagaggagggacagaaaatagacttattttagctatacacatgacagcccaaagaggagggacggaaaatagacttattttagctatacaaatgaaatagcctagagaggagggaaaaaaaatagacttattttaaaaaggcccgatgggccacccatgccttcgggccagcacggcacggcccgacagctggtaggtcgtgcctgggcaggaggtgcagcccatgggcgggccgtgccggcccgatggctgctgggccgtgcccagccgtgcctgggcggggccgtgccgggcgggccctttggccatctatactgatagagaacaaagagatacagctgacttgtagggttcacgaggggtaagataaacatttcacacgtcttgtccaccgtgggagtgcaggctggcatgccatgcatgtcagcaaagagtgaaaaattacttatcataaaagt

SEQ ID NO: 3202 - DNA, 1501 bp, Oryza sativa
cgggccaaaataccgtgccatgggctgggccatcgggcctcgggccttttggccatctatatctgtcagtggatccatccaggaaattaagcaccttcttgtcgtccgagttgacagcgatgggctggggttgctgccgctggaataggccaaaaaaggctgaaacatccatggtagcaaatagataaaattaacagagaaaacctagacaacggtatcccgttgtaacgggatactcttctatgagacagtacatatacctgatacatgttgtggtatcaactacatggtacccgatacctgcgatacctgttatctggtacctatgatacctaggacctgatacctgtgatactcgtgcaagagaatagttaatatgtctatcccgttgtaacgggatcccgttttgtagcagccctctaaaattaaaggactgcgtggagcacacaaatgctaaattaattaagccaagttcgatagataaatgcaattcaccgttgtttttttaattggttggttgaaatgaaaaggcagggagctgaaccattcgaatttttttttttcatacacaaaattttcagaaatggatatggaagctttttcacatatcgttagggtttttatcaaatatgcctggatagtttcaatggacaaatggatcaactggagcaaagtattcgcactagtaaccgggaacatatcctatgcacactccgtgcataccaactagcaaatgccacgaaaattctacaaaacattatacacatacttcgaataatattacacctatatgtgaaattttatcttcaaattcattatattttggtcgtaataaaaaagacaaaattctgacacatttttaattacctagaaaactgtcagattttttttgttacggctaaaatataatgaacttgaatatgagactttatatatatgtgtagtactaataggagtaaatgtttaattttatagaatttttcgtgatatttgttagttggtgcgcacgagaaacatgtgtacatagaatatgttcctggtaaccatatatgatctttagtgagttacaaatatcctaactattttcatatttttcattcgtaggaaaaaaaacaattctttagcttttgcatgtcagtcgtacatgcataatatatataaacattacactgttgatatatagtaatatatattcatctcaagtgagcattcgttattattttctattataagttgataacaacaaaatcacaagtcaaatgtatttgttatcgttgctaatgagaacttatgatctttgtaggcataagcctgggattttctttcctgatagttgctgcactttttactctaatgatgctccaaaagagaaaaattaatgagtatttcaaaaagaatggtggttcaattctacagaaagtggacaatatcatgattttctccaaagatgatctaaagaaaatcacaaagaacaattcacacgttattggccaaggaggtt

SEQ ID NO: 3203 - DNA, 1501 bp, Oryza sativa
ctaggccgacgcacgcaccgtcgccgcgccacggcgccagcccggcttcggccgtcgcccgcggcggcgcggcccaccgcccgcccgccgacgccgcctcgacgcctcctggctcttgcccagctgcggagctgcccaacttgtctcctcccatcctcgacagcagtcagcaagacagcaaccgagcaacggtgagtcggtgagccggtgaggaaatactaggatatcgattaatgaattatgaggattgaggatattgcttgaatgcttgaatgaggatattgcttcaatgcttgaatgactaatgaggatattattgtttgaatgcttcttcagactgaactgaagtgtattgattatttgaatgattgcaagaagcaagatggggccagaatatttgaatgattgcttggttacattcattgaaagagatttcttcttgcaagttaagaatgaagacatgatcaatcattttcaaaatatcaagaaacgaaaagttctctctaaattgtaagattttttttatcattttgccattttatgtgctctataaatttgatttgttttgtcaataatagtttagtaatgtactctaatatgcttaacgcattcaatttatggtcaattctatctatttatgactttataaaatcatgcttataccgttacatattatacaactattagaccttgggttagaaaattttttctcttacaatttcgaatacccaagttgaaaaacctgggcccgcccctggcgccgcggcgccagggtggctggcgccgcccccctccaccccccgccctaattcgaaaaagtgtggcttctttgagaccacactcctaatttctgttggagtggcccaaatacaaggagaaggattttaatcacccgagtgaacgtccacctgttcatcacatgtcaactaaatagttctgaaaaaattgataaaaaggtagattaatatgtaatgcatcacttcacaaatatgcaagtttaaatttgacttatgcgcaagttataaaaaaataacgtattaaactttaattagtatacgtttatttgcagtcaaatttattatttttatttttgttacaatttgcagaagccaaatttatactagcatgttaatttatagagtaatatattcatgtcatttgtttaaaaagattttataatcatttagtcgatataaattaaacaattcggcgttcacccgtagcttaaaaagttttcccaaatagtacaacggtaaatttagtgtgttttagtccatgtatcgaagcagcttttctgggttccaatatggtaaacatattattttacacttaattgaccaaaaaaaaaagttcagatttccatgcaggccctaaattctggtcacaaccgtcttgccaccgctgccatgacttatcgtaagatcaagtaccgtacgtttctctcggccgagcccagtagcttgaatcaagctaaggtgaatgctaaatggtgaataatcag

SEQ ID NO: 3204 - DNA, 228 bp, Oryza sativa
aaatttttgcccaaaaaatacatatatgaagtatatattccatatgtatatataggaaaaaagaaaaaaaatacttatacccattcaaaaatcaaaagaagcccaaactgaaccctcccaccacccagcatttcaggcccattggcccaatagcaaagaaaagcccacttcctttctaaccctatctcttctcctcacctcccttcccatccccttcccattcccagc

SEQ ID NO: 3205 - DNA, 1501 bp, Oryza sativa; identical to SEQ ID NO: 3190

SEQ ID NO: 3206 - DNA, 1501 bp, Oryza sativa
gtcaacatgaacaatcttaaaaatacataaagagattacattacgtagaacacataccgcattacatatgcgaataaatagagacaacgacacacaggagcactctgaaacgcgcattatttttcacctgaaaggcaatgcttatgcactgactccaagtctccaacacatatatcgaccgatcgatctcacacacagtcacactcctctcacatctcacaacttttatttattcttcacgaacaagctgacctgcaaattaattaatcacgcaaccaagtgtggattgatggaatggatgatcgatcgattcagtggtagaccggcggagagctgggagacggcgcagctccgccactgttcccctgggcgccgccaccaccgtttcccgcaccgccaccaccaccgttcgccggcaatggcgttggcttgggatccggcttgggttcggggccttggggtttcttgtggaaatagtcgaagaaggggtgcttgtggaagtagtcgtacaggaacgccgacgtgcactccgctggcgacgtggaggagtacatcctcttgccggcgacggccacgaaggtgttagccttatcgacgccgttgtccgttgttgacgacagcggcacgatcttggacggctcctgcccggggcacggcgtgctgctcgccgcgctgtgcagctgcgcgaagcagtcggcggcgccgtggaggtcgtcagcggcgaggggcacgctgaaggcgccgtcgccgtcgaggtcgccgatggccttgctctcgtacacaccgtcgctgttcttgcacttgatcgccacctggagacctgaacatcaccaaaaaattaatcaacgacggtgatatatcgttcgatcgaactgaccacgcaattaattagcgacgaacatatatatcatgatatatatacccttgaaagcatcctgcgccttcatgttcttcctggtgcactcgccgcacttggcctggccgacgacgatcgccgccgcctcgccgtccgcagcggcggtgacagccatcacgagggcggcgcagacgatggcggcgaagagtagtgctcgtgctacagctgccattgctgaatcaatcctagaaaactctattgctctttggactatgtggcaagaggctagagctgtgtgtgtcgatgagtgaagaaaaatcaggcatatgcatgtggtttatatagatcgataaaggctactagttgggagtgatctgaggtcagctaattatattacagtacaacatgattagcaatttgcgccgattttgcaggtttaaaatcattcacgccgtgcattttatttgatttgatcagacaccgatcgattaagagtagcagctagcagttcatggaggcactgtgaacattcacactgcatgcagtggtgactgttgatgctcttgccgccgattggtggtgtttaacaagcaaagttaagctttaatcgactggtactcctagagcgcacagtactactagcct

SEQ ID NO: 3207 - DNA, 1501 bp, Oryza sativa
ttcctaagaatttgccagttaaaaaatattttatacgtggtttataatcctggacagccgaagccatcttcacacaggtgattttcattttgagttgcctgtcaagagaaaataaaaagaagcctaagcctacgatttttttttactagtgacagttgatctaacgactaatatatatgatcctttttatatgcacagacatcaacgagtgtgatgtgtccaacaagaagaaatatccctgctacggcgtctgcaacaacatcccaggggattatgagtgccactgccgtgtaggataccagtggagtggtgaaggccccaagaaacaagagtgcagcgcaaaattccctcttgcagcaaggcttgcccttggtacatatgcacctcagcatttttttaaaaaaatataaaataatatactatatatatgtcacattgagtttacaccaattcaatgatttcccattgactatgtttttaattgtttctacaatataccattcaaccaaacaaagaatttcttataatgcctaaaaatataagggttgacagttaattgaaaaaactaaagaaaaacaacaattttaaaaaattagcctcctagcacatgatataagaatataagtgtgtataagtttcatgctttttgcattttattattttttgtaaaatataatatgtctgttatttacatagactacttttctgcatcgtttgtatatttttatacaaatcatctttcatgtgctacacaaaatatttttgttattttgtttgtaagtgatttctctctaatgccacatagaatgacttttcaaaaaaaatacatgcaagaaattttgaaacataaacagaaaattgtatattgtgtaaggaaactgcactaaagattagttacagcaatatattgtgcacgccaatattaatataacattagttgttcacaataatatttatcaaataaaatgagccttcattcatactccctctacccaaaatataaggcacaaccactttttttccatgtctcacaatataaggcttgcatacattagccatcacctcttggttctttaaatttggtttattttaaatcatctaccgttaaatcctccaatcaaattgcttgcatgtatggatgtgatccaatcaagaaggtgattaaattatttcttggtctttgtgttatgagtggttgagccttatattttgggatagagggagtatttctattaaaaaataatactgcaactcatatatggatttgttatgtttgctaataagttttttttaactttcgtaggaatcactttgggattttccttcctaattgttgctgttcttttcacgctaatgatgcacaaaaagcgaaaaatgaatgaatatttcaaaaagaatggtggttcagtgctacagaaagtggacaatatcaagattttcaccaaagatgagctaaagaaaatcacaaagaataattcagaagttcttggtcaaggaagct

SEQ ID NO: 3208 - DNA, 1501 bp, Oryza sativa
agagaagagtaaatgatgccttctgtttattagcatacattctaataggaggagactatatcaaatggtgtgcgctgaattgtcctaatcagcgaccttgttactaaaaatagcaggcatgtcgatgggtacgtgccaaataagcgattgcatagggcctccaatttttttcccatataaacatgaggcccacttccaattgcccagctatagcttgcaactgccaatagcccaattaggcagatcgatcagcaaggtcatgctagattgccaggggtggggcactattggactgtgcgatggcctaacttggccctgctgctagctggctgctctgcgattctgattccgcgccgtgacaactgctgagacgtccatcccaattccatgcacagtgactggcgaggcggcgacacaacttgctgcttgtgattccgaggctccgagcggcaacggtgacggcaaaacagctgcctcgcctcggctcctgccttccccctcctcgtccgctcatcatcctcgactcgactcttgacagcttgacctcggaccggtaagattagacagtgattgagtacatatatgatagattgtaaattcataatatgcatcaaattaccatgagttcatgattgtagtttataatttgaatgatccattaaatcaaattacaatgtttgaataaaattacttgtattgtacattacaacacatattacatctatataattgagcgaaaatatgttttatttatattagacataactttttaaattatagggcatttgcatttcaccctagggccccaaatttctagagacggccctaaaaaatagtaccactgcacctttcactctctaaaaataataccgctcatgaacagatcatgcttttgaagttttccaacctaccaatttcatgtgttgccttggccaaagagcccacctacttcctaacacctaaacttcaaataaaattttctcttaaattactaatctgatatacaatcagattgtatcattatgttcattgcaacttaatttttataacaagatctcacataattatattttaatggaagaagaatatgtgtagtaaattacttttgtgtatctataaattacttttagattggattagattacttcttagacattctcataatattgtgaatatgttacttttattgttgtttttagttagttctataatttatgttgattcaatttaatttctagatagacacatgtttttaccaccacaactgatttactttaaattttaataccatgataacttacttttattttgtgttaagttacttttataatttgtgtgaattattttcaggctttattgaatttactttcataaatatctaagaagtaatttattcaaatctaaaagtaattataagtagttatatttagaatcatgcaaaattatcccacatcctttaaacatgtgccaaataatgcaaaagacatataaacaaaacaaa

SEQ ID NO: 3209 - DNA, 1501 bp, Oryza sativa
tgtatttgggcggggaggggacgggagagacatttcacccgcagggccccgggggatgtatattaaactcttaaaatgtagcgcataaaaggcccaatagaacccaatacaacaaaatagtgacatatataaacaaaaccctagctctctctctagtctctccccaaccccatctcccctcccgtctcacacataggcgacggcggcggcgcttcacaatgcaggtcgccagggcacggcggtcgccctctcggcctctcccatccccagctcccctcctctttcctcccctcctctcccctctccggttaccctctcccgctctccctccggtctaccgagtgccgacgacgcacgtcgcacgggcggtgcgcagggcacggtggccgacgagccgcgcggcggtcggcgcaacgcacaggcgctgtggtcggcgagccgcgaggggaagcgctgtggccggcgagccgcgaggggacaggcacggcggccggcgagccgcacggcgcacaggcgcggccaccgttcggagagtcaattatgtacaattatgctatttttgatggtgtgtgaattttgtaccatttttgttcttgccgaattgatagctgtcttgtatttcttatgctgatgggatggagattttattcaatgcgggccccagtcagggtgcggggccacggaggggtcggggacggggctagatttagccccgcatctccagtcgggaccgggggcgggggcagggggtgaagtcgggggtcgggagcggggccgttccagcccaacccggccccgccctgccccgttgccatccctacagacagtccagatttatagtagtaaaatgtactccatttaaccaaaacttcttatattttgagacggaaggagtagacccttggtggcgggcccaactaatttcagtacaaagacagccactccagatattaggtggtggtagtacttgtcagtactgatagctaaatacagtgacatatattaactatttctttatgtcttattcactcggctctaggcatcattggtattctgatctagacatattgtaaaaggaaaaaaggaaaaagaagcattgctaaggcctagttcgcgaaaagaaaatatttgagtgtcacatcggacgtttgaccgaatgtcagaaggtaatacacgaatgaaaaaaaataatttcataactcgtctgaaaaccgcgagacgaatctgttaagcctaatttagtgcagcacttatagctaatcatggactaattatgctcaaaagatttgtctcgcaattttcatgcaaactgtacaattaattaattagattttgtttttatctatatttaatgcttcatgtatatatctaaagattggatgtaatgttttttttgttaaccaggcctaatactgatattctggccttgaaatgtactagcccatgctgcacagtgcacagctagcacgataaaatataatcttgacacagctgcacgttg

SEQ ID NO: 3210 - DNA, 1501 bp, Oryza sativa
gtgattgcaaatttttagtcgttaatggcactgctcctcccacccgttcgtccggctaagcttttaattagcagatggtcttatgtttcagactcgcacgaatgtgtgcatcgtgcaactcgtgatgtatcctatcttactataaaattatcccccactaactccttaagcttaacatgcaaagatgctacatcatcatccactaacaaaatgccacatcatcatccaccaatccactaattaacaagatgccacatcatcatccactaacaatcgtcaccatttaaacatcatgcaaacatgctatatctttatagtttttataatgtaagagcttttcaaatacaaacatgttaaattatcatctaatataattcacataatgtttcaatgtatatttttattatgttttatgatatcctatatacctatgtagttcatccttacttagtgcttaaatgattaatctatggtccaaattatatttctcctttttccctctaattaagtcatattacatcaattgtttttagcctttagatgattaatctatggtccaaaccatttccctacttttctttttctataaagtcataccaccttactttttacgtttgaatcactattctacatactgtttaaatttaaattatcataaactacattaatttacttaatttgatgttaactagctatcttacacgttatttttttattgttatcataccaaattcccgcagcaatgcgcggggtttcacctaatattatatatatgcagcagcaaaacgggcaaagccagctagctatgttcaaattagcctcaaaacaatggatccctgcctttcaccgatcaatccactggcttcaattcgatcgtgatgggctgcaaactagtaattaataatctggtctatctaatttctggttgaactttggtgcaatactgcaacttgagagtttattgctagaaccattgattaattctcccaacatgaaagttaatttatagtttgttgcttggagaaggatgctctaacctctgtcctatcactgtactaacggtgcttcaaaagctgatcttgacgcatcatggttatgtccatggtcggtcttacatttgattttgacaccatgccacacaccatgggacattgcagctgtggcgttaatacgagatgtatttactatccctccatcacaaaatacatgtattataaagcttttcgcagggagcatagagaagaacaggattatatttgaatgattgtgattacttcaaatgaggtagcatgtaaagagagtaaatgagaattatcgtgattggttgaggtaagaaaatacagtgagaaaatactatgttctagaacaaaatttagacgatagaaattgtaatagtgggcatgttcagctgtcgggcgcgcgcactcactgttcgcagccgcagcctcacctgtttgcagccggtatgctgaacaggcccattttgagttgaagggagtac

SEQ ID NO: 3211 - DNA, 1501 bp, Oryza sativa
ttttctcttaaaaaaatatttggagggatatccttcccttcaaatatctgcatcgttagccgtttcaaaggcaaggctagaaaatagaatacgattaaaaaccatttaaattttgtctaagacggatagtaagcaaacaaagcggccggcatggcatcaaccaaactagctaacaaactaattaaggcggtgttagttaactaattaataaatcaatcaattgatgatgattaaataaagtgtaaaatgtgatgtacttgggcagtcggagaaggtggcggcgatggagcagccggaggggaggtccatggcgcgggtgacgttgatgcggaagcccagcgccggctcgtcgcggtccttgacgagcacgcacaggcacttcttgctgccggcgaccacctgcccaagcccggcgcagcaatccctcgtcggcgccctcgccgtcgccttctcctccacgtacgtcaggcacgtcgccagcgccatcagcttgtccgcgcactccgccttgtccgccgcgaagtcccccttcgccgcccccgccatcgccgccaccgccaccaccaccgccgccacccaccatctcgccgccgccgccattgctatcgctaggtagcttgcgtgtgtactgtgtgtgtttgcgacgtgatcgatcgatggaatatcggaatggatgcttcttgcgtgtggttatatgcgtctatatatagatactagctaggctaggagagtgggtgtgagcactggcgattggtcagcttaattagtgaagaaacataattactccattcgtctcattctaagtataataatgtgtttttatgttcaattttaatcatttattttatttaaaaaatttaaaacataagttacgtataaagtattatttatattttatcatctaataataataaaaatactaaccataaaaagtttaaaataagatatacgatcaaaattcgacacggaaactcgtaaatttaaaataagatagtaaaaagttactcgcttagaattggatggattgagtaacatttttgtcgaggaaaattaattaatgatgaagggtgattaatggtggtacaatctttggagggatcagtcgacgggtgatcagttaatggggttagttggggagatcgctagattgcgtgcgtgtgtgttgctggtcgtgcagtttgtggtgtttttggggtgcgtgggttttttttttgggggggggggggggggggggggctttttattttttgccactgtatcaaaataccattgctcaaatgccacttttctaaattcttatttctaaataccaccggacctatagagtaccaaatagtaagggtctatttagattgtagtcaaaataaaccttaccaagttttagcaagatggtaatatattgctaaaattttggtaggatttattattgtattgattaaatttggcaacaaactaaacgtatatattttcttgataactttaaggaaaatagtatggttga

SEQ ID NO: 3212 - DNA, 1501 bp, Oryza sativa
caatcaagaaccgttttcgtaattatcatttccgacatttccataccatactcacaggatagatcctgatcctgctagctaggagtagaagatgaagagaaagacagaaacaggcccgaacaaccaattaaaaccactccataattaaattaagtagtaagctggagtacaatccatccattgatcaccatgttgagagactattgcccaggtaagccaatacggcaataccacagccacacgcgcgcgcggagctcctaacgattgtccggtgaagaaattaactatcttctgccattccgtattttccgttgcttctcgttgcacgcacgcgtcacacgagcacggctacctagcctgccacgaccgtacattggcacatggattacgtgccgcttcatccactggcctccagacctccacgtcgtctcgctcgatcgatctcctctcttctccgctctccttgaaccttctttcttccatgatgagtacgagtacggcgcccagtgtgaaatgccccccacaaactgcgtgagaatttaatatttgccactctatcaaactgcctgagaatttaggacctgatcacttttatgacattttcaaccatactattttccttaaagttatcaagaaaatatatacgtttagtttgttgccaaatttaatcaatacaataataaatcctaccaaaattttagcaatatattaccatcttgctaaaacttggtaaggtttattttgactacaatctaaatagacccttactatttggtactctataggtccggtggtatttagaaataagaatttagaaaagtggcatttgagcaatggtattttgatacagtggcaaaaaataaaaagcccccccccccccccccccccccaaaaaaaaaacccacgcaccccaaaaacaccacaaactgcacgaccagcaacacacacgcacgcaatctagcgatctccccaactaaccccattaactgatcacccgtcgactgatccctccaaagattgtaccaccattaatcacccttcatcattaattaattttcctcgacaaaaatgttactcaatccatccaattctaagcgagtaactttttactatcttattttaaatttacgagtttccgtgtcgaattttgatcgtatatcttattttaaactttttatggttagtatttttattattattagatgataaaatataaataatactttatacgtaacttatgttttaaattttttaaataaaataaatgattaaaattgaacataaaaacacattattatacttagaatgagacgaatggagtaattatgtttcttcactaattaagctgaccaatcgccagtgctcacacccactctcctagcctagctagtatctatatatagacgcatataaccacacgcaagaagcatccattccgatattccatcgatcgatcacgtcgcaaacacacacagtacacacgcaagctacctagcgatag

SEQ ID NO: 3213 - DNA, 1501 bp, Oryza sativa
ttgagttgtagaactgttcttgtgtaattgtgtttttcttttagctaggtgatattgtccaactatcttgtggttagtattaatccatcattcacactagaattaaaaaggattttttttatttgcacgtttcccaagatacattttatgcaaaaaaaaatcctatatatctattatattattaaaaagccttaaaatgaggtaccacgttcgctgtgtgggctataaattcccacattaatcggagaaaaagaaaaaaaaaggagagtccaagtaaaaatacaatctaaaaatagctgaaattcggaattaaaaataagcaatattgaaagaagtttccatataagaactcaatacgagattaattaaaattagaaataaaaataaaataaaataaaatccaaaattagaaaaggaaaggagaatccaagtagaaatacaatttaaaaatagctgaaattcggaattaaaaataagcaatattgaaagaagtttccatataagaatccaatactagattaatcaaaattcgaaataaaaataaaataaaatctaatattagaaaagaaaatgagagtccaagtaggaatacaatttaaaaatagctgaaattcagaattaaaaataagaaatattaaaataagagtccatgtcagaacctaatacgagattaattaaaattcggaataaaaataaataaatccaaaattagcaaaagaaaataaaagaagagttcaagtaggaatacaatttaaatttggctgaaattcggaattaaaaataagaaatattgaaagaagaatccatataagaacccaatacgagattaattaaaatttagaataaaaaataaaataatatccaaaattagaaaaaataaaagagagttcaaggaatacaattttgaaacaactgaaattgaaaataaaaaataaaaaacattaaaagaacacaatacggtattaactattttttaaaaaagatgaaattagaaaaagaaaaataagatttcaattaggaatacaatttataaataactaaaatttgtgataaaaataaatattattgaaagaaaagaccatctaaaacacatgacgagataaattaagtaacatgcctataaaggagtagagtggtggcggttgatacgacatataaaaattgttaataaaacaccaaatagaatcctaatgacgattaaaaggagaaacgtcaggcaggccgtgaagcaaacgagtaaagcagttgccaagacttctagaaagttaaaaaaaaaaaccccattgataatcatattcgattttaaaatcttaatgacaataaaaaggagaagcagcaggctgagtgtataagagtatagttgcagagcctgtaactatagaaaataaaaaatgaattccaacgatagttatgtttaatttttagaatcacaatgataataaagagtaggcggcatacgggttgtagaggggcatagtggcatcgtttgatgggacttcta

SEQ ID NO: 3214 - DNA, 1501 bp, Oryza sativa
taatctaacattaaatgtattttgataatatgtctgttttgtattgaaaatactactatatttttataaaaagtttgattagaaaaagataaataatttataatatgaagcgagggagtgtgtttttcttctttttttttttgccttttcagtgataattaagacatatgaatgccatattttccgtttgccatatgcatgcaaaaaagtttcgtgggcgattgggttgcgtgtgcatgtctggcccggatccgttttgcgcttagctggataccatgctttgcattgcatatttgcatgcacacgtacgcgtatcacctttgacgatccgacacggttcacatgaaagtttgggttaataaactcactcatctggatttgaaccacaccaaactctctcggcaaaaaggtgctacaaaatttaccaatcccctcgatccttaaaaaaaaaaactaacttcggactatatccatctataaaaatcaattcccaataatataatcaaaagaatattcagataattaactctcgacaataaggtgttcgtgataacttcttcaccgtctgaccaatcggctcggacaccagaccgcttgtgcccgcccattctgtctcgccctaaatggaatggctctcttatcttagttacgctgtgccccgacccgagtccccacgtccgcttttatccgctcgcaacccggccaacacaacattagggccgtccccccattctatgctgacacaatctcaaaatatactgtccaatcttacagatatgctcgtagaggtagaatgtacgtgcatgtatttatagggatgagtgtgcacgtgttgtgagcgtctacgtttgtactttatttttaaaaaaaataatatctgctctctacaacttagttctaataataatgatttaaacattatgtatctccaaatttatcgggagaattgggtttttgagggagtagggatgtattatcgtcttggaaaccggcgtagaaatgcgagaatgagtatgacgtatgcagggcaatgacaggtgcctatccgttccagctacgcatgcacaccggagcgcgtgacgtggccccatgcaaccaaaaccagactgcccgcgtcgcgacgacacgtgtgagccccacaccgtggcacccccgccagcacgcgtgccccccccccacaccgacatgtgggccccacccgtcacccccacatgcgctgcccccgacgtgcacgaacagcgcccccgcccaccgcggggaatctatacccgacccgagtaagtacccgacctagcccatcgcgtctggccccacctgtctgcccgatggggcccacccaaccatgcgtcctccctgtctcccgggcccacctggcatactcacatgctagggcacgcacgcaacaactaactaaccgctctatataacgcgacgcgcaaccaaagcagcacgagacgacgaggtcagtgtcgcagcgacgaacgccgacgagctagctctc

SEQ ID NO: 3215 - DNA, 1501 bp, Oryza sativa
cttcagctcgacgcctttcgatttcgatatatatcatctcgcctcagatcctcgcattatccgcagcttcttgcaagaagagatgaacatgctgcaaaagcacaaaaagattcaaattagagacaaataaacacacaagattttccatggatggataattaacatgtgtgtgtatggtgcttactcccagggcacgtcgccggcgagcatgaggtcgccgtccttgtcctcataggcgacggcgaagtgggcggcggaggcggaggcgtcggcggaaaagcagccgaagagcgcgtcgagagcgtccctgagctccctgtagccgccgtacatccggaggtcgaccttgcggaggtatggcgccccgtccatgctcaccttcacgtacagccctcctcccttattcttcctcccttgatccgtctcgccgccgcccttccccttcgccgccgccgccgtcgacgacgacgaagactggaacgtgctcctcctgtacgaccccaccggcggccaccccaccacctgcactctgctcacccacacaagaaattgtaagattggctgcaaatcgagctggcacacatggcgagagagagagctagagctagaacttacttggacgccggcgaggcgccgtcttcgacgtcccgggcgccggcgccgccgcagcaggccgtgccggaggcctcgctcttcaccgtcgacgacgccgaccgccgcttcttcgccgccacgccgtcaccgccgccgctgccgggcagcccgaggcgcagctccgcgtcgatgctctccgcgccatggccatcgatcgagagagagagctagctcgtcggcgttcgtcgctgcgacactgacctcgtcgtctcgtgctgctttggttgcgcgtcgcgttatatagagcggttagttagttgttgcgtgcgtgccctagcatgtgagtatgccaggtgggcccgggagacagggaggacgcatggttgggtgggccccatcgggcagacaggtggggccagacgcgatgggctaggtcgggtacttactcgggtcgggtatagattccccgcggtgggcgggggcgctgttcgtgcacgtcgggggcagcgcatgtgggggtgacgggtggggcccacatgtcggtgtggggggggggcacgcgtgctggcgggggtgccacggtgtggggctcacacgtgtcgtcgcgacgcgggcagtctggttttggttgcatggggccacgtcacgcgctccggtgtgcatgcgtagctggaacggataggcacctgtcattgccctgcatacgtcatactcattctcgcatttctacgccggtttccaagacgataatacatccctactccctcaaaaacccaattctcccgataaatttggagatacataatgtttaaatcattattattagaactaagttgtagagagcagatattattttttttaaaaataaagtacaaacgtagacgctcacaacacgtgcacactcatc

SEQ ID NO: 3216 - DNA, 155 bp, Oryza sativa
cggtggtggagctgacaccgaggaggacgcggctcccgcgggcgtgcaacagccggcccaaggtgcctccccctcccccgcccccgccgcggcaggagcgggcgaggccgccggcgggggcggcggcgggggaggaggaggagacgacgccgaaa

SEQ ID NO: 3217 - DNA, 1501 bp, Oryza sativa
gttgtgcgtggagatgttggtgaagagcttccgctgccggttctgcaccatgacggcgcggccctggcggcggatgctcgggaggtaggtgttgatgacgagctcgcggtggcggtcgaggaagaagaggcggtagtaccggcgattctcctgcgcgcggccgccgccgccccagccgtagtacccgcctccatcggtgcgcggcggcggcgtggagtacgcgcaccaccagacggtgacgtcggtgctgtcgtcggcggcgacgacgtcggagacctcctcgccgtcgaccatgctgaggacgagcttgtcggcgtccttggcgccctcggcgcggaggtggcgcacgtcgcgcgccgacgacgcgctgaggtaggccttgacctcctcgtacgccgcgctccgcttcatcctgccgccctcgtactcgtggatggtgaccgacaggtacgggtcgacgagcgccgccagccgccgcgcgtgccggttcatgtgccgccccaccagcgtctgcagctgcagccgctgcagattctgccacaccaccgtccacagcaccgcgatcaggctcagcaccacgccggagttcagcccgttcaacaacgacgacgacgacgacgtcgcctccatttgtctcaaaaccaaattaatttcccaattcacgaacacgcagaaggattgatcagagatgtgatatgggtggatatggatatggaaagatgtggaggctttggcacttggcgcgccgtggatttataggggcgcggcggcgggcggaatgtgcttggaaagggggtaaggaatggtggtggtgtggtggtcgagtcgtcgttgtcgtcgcatctctcgcatgtgcagctgctgctcaagccgacatgaacgtttttgttctcttgtgatgtggtggtagtggactggatagactagtactccactgttgtttacttttgggcgaaggatcaaatgctaggcgtttcttaatctcgcgctctgcttgaattggtgacgttgtggggtgtgtcgtaatgccgacgacgacgaggtatggggcgggttttctttttctgttttttttccagcttttgaaatgcatacggtttttctttcttggccgcgaagggtagactgacgagcaggctgcacgacgacgacgtttttgggcgtttctacctggaatatggcgcggtgggcggtggcgttcaacgagacgtgttttggacttttggtagtagctcttactactactactttaaaagcagcaagggatgggcagtaatcccttccgcacggtaaatcggtaaatcgagtggtccattagtatgtgattaattaagtattagctaattttttttaaaaaaagatcaatatgattattttagtaacttctgtataattttttttcaaaaaatatactatttaatggtttgaaaaacatgagcgcagaaaaagagagaaataggttccgaacgcgcagacacaccatttgaaaggtgagaaagtt

SEQ ID NO: 3218 - DNA, 1501 bp, Oryza sativa
caaactttaaataaaaatttcaaagatcaataacttctcaaatgcttggttttagaaaaagaaatagtatgcatagatttgtcttaaaatgtatcaccataatattataatattgttaaactttattaagttaccctaatataaaattattgaacaaagtttaaaaagtttaacttaaagcttgctcctaaggtcaaatatttaagaaaaaaaggtactagtatattgtaccacttgcaatttggtagccgtaccagtacatatcgacttcgtttacctgcattctatatctcttcgcattcgctctttctttttgcatctctatcgtgaaatgatgtcatctgttgccaacgttgcaaatattacgtggatccatccgtcagcgtgcgcgatctctatctgaaatcggtttgacctactgttgtagattttagtgggaaatagctggtttggtaggtagtgggctcctaattaacaaactaattcccaagcttaaaacagaggattacgcccctaatggcctaatcaacgacgcacgacgtctcctgttacacacacatatattgtcaccacactaccacatatatccatccaagacatatatagataagcacaaactttcaatggcaaagtttcagtaatcaacttaattcaataatagtagttttgagaaaaaaaaaacgtgagcaaagggctaattacccctacaattaatcaaatgctgcctccatataacaaaatcctatatatctatataggtaaactttctcacctttcaaatggtgtgtctgcgcgttcggaacctatttctctctttttctgcgctcatgtttttcaaaccattaaatagtatattttttgaaaaaaaattatacagaagttactaaaataatcatattgatctttttttaaaaaaaattagctaatacttaattaatcacatactaatggaccactcgatttaccgatttaccgtgcggaagggattactgcccatcccttgctgcttttaaagtagtagtagtaagagctactaccaaaagtccaaaacacgtctcgttgaacgccaccgcccaccgcgccatattccaggtagaaacgcccaaaaacgtcgtcgtcgtgcagcctgctcgtcagtctacccttcgcggccaagaaagaaaaaccgtatgcatttcaaaagctggaaaaaaaacagaaaaagaaaacccgccccatacctcgtcgtcgtcggcattacgacacaccccacaacgtcaccaattcaagcagagcgcgagattaagaaacgcctagcatttgatccttcgcccaaaagtaaacaacagtggagtactagtctatccagtccactaccaccacatcacaagagaacaaaaacgttcatgtcggcttgagcagcagctgcacatgcgagagatgcgacgacaacgacgactcgaccaccacaccaccaccattccttaccccctttccaagcacattccgcccgccgccgcgc

SEQ ID NO: 3219 - DNA, 1501 bp, Oryza sativa
ggaagccattccaagtctgaaactctgaattgggaagcagttcagtggtcagttcgcatgcccattgctccacagtagtactgtatacagtactagtagaattcgtgcatgacagaatttcagcaagagacccttccagaggagaattcgtgcatgacaaaatttacattttgttgagagtgatcaactgaagtccaaaggtcgggtgacggaagcttttacttatgtcccataagattaccttgtaacacatttacgaattgcgatggcatgaaacaaattcgctgtgtgttcaaaatgcattggccactttcagtggctgccgtcaccgcttgctagcttgtgattctttttttgaaacctaagcttgcgagaaggaatcaactgctcctccttgttcagaagacactcatgacagcttggaagattcatcatccgcggcagcagcttgagcagttccttcttcttctattcaatttgcattttgaaagtgatcttgaagcttgcttccttggacaggttttttcattcttctcttcagcagtcaatggaaactggaatccgattacggaattcgcccaagttccgagctaacggtgactgtcacaaccggtgaagggatcacgtcggcggcagccagaaccacgagccagaatgccagatcatatggacgctaaaaggattgtactacggactagtagggagtaataaatcttgagggaattttactgcggacatatgctcttccaacaataaaattcaggtgtttcgtttttcttttttgagcggaggtgtttcgtattgatagtttgtaagtatacatcaacctgtatggtacctcaaataccaactgccactccggtgggtggattttctttgagggtatgttgtgaggcagtcggaacaagcaaaaattacaactcagatagggtttattggtcgaatctggaaatagttgaacacgggccaacacggcaatacagcaagattttggcgaacattttcttgggaaaaaacgcaaaaggtccagcagcttttctctctttgaatttcgtgtaccaaggtccaggagggtcgacgtcctatcgtgttcactgttcttccaaagcattcgttgccgacgcgccgccgtacgtgcgacgacggacgatggcggctgctcacgttcaatgtcgcctcacactacgcgcacgtacgtactccaggccaaactgccgccatcgcagccgccacggaaaccgacccaaaaaaagtcagagaaaacgcgacgacgaaacgaatgtggccagtccaaccgcaaggaaaggaaaaccggtgcgatccgatgcctcccgcggaagcaaacccccatctcatctccctctctcgcgcgctttccagatgcctccctccatccgcaccgcgccgcgtcggctcgcccacccatcgccgcgcgacacggctctcctacatcccgcctataataacgagccgcgccgtgacgcctctcttcttgttaagc

SEQ ID NO: 3220 - DNA, 1501 bp, Oryza sativa
aatatggacaagtccatttgcatgtactcctttcgttctaaaataaacaaatctaggatgtgatgtgacgtaacagtgtatccagattcattgtataatgttacatcattctaggtttgtttattttggaacgaagggagtactctcctaacattatttttgttgagtgtactcagctgcttgctgagtgctctcaaccggatgatcttgatatttcttttcttcgtctaatgatcttccctttttgttgtgcatttcagtggcaaaaacatttccatggccatacggtccataatctatggagagaaggtagcgaattgggtggaatgattggttgtacatttactccattcatttttttccctgtaccagtggagtacttggtaggatctaattgtcgtgtgtatatagcctagcctaaattaaattagctgaggtattcgcatgcaaaaaaagaaaaagaaaagaagaggagatatttatagttcatagttgagttttgagacctcaaaccatctatacggctatacccttcatttattgatgatcttttttgggggaaagaggttttcagaagtttatttctgatatccatggataccctatttctgaagactcggcagaattcagcctgggggtaatgaatctgaatctgcctgtatcagcggttctaggcgatttaagctattacgctttatcatgttctgaacttctgatcaagtagtggacaatgaacttctgatcaagtagacaataggcgtgcatacatgaagaaaagctcaaacactgatactactatcgcattcgcatcttcttgccgctgctttgcgagttgcgagcctgcgactgggatggataactgaatccgtgtcgtcgcaaagtgcgtgccgtcttctcctttccccttttccttttcctttcgatttctttttgttttctcctctttttctttccatctcaaaagagtgccgggacagaatactcaacggtagagtacacacaaacagagattgaatcgaacacctgccacacagcttaaagttgatcttgcattgccggacatatgtgtgctgtgtgctagcgtcgtttgcaatatcttgcggttacttcttgctgtagccaaataattttttagaactcatcaatatgttgtttttagaactcataatttttagctgtagccgtaatatcgtggctgcggtaactctcaccaaaaacgattatcaaaatggtaaagaaaaccctgctttgtgcagcacaatcgaactcatccacaagaccacaacggtttgggcagtaaattttgctcctgctcattggccctgtttaggggagtttgtcccagctgcagcttttcccaaaagctgcttctgttagaagctgcctcaaacagttcacaacttctgataatctgtagttacagattctgaaaaatgaactaagaaaccagaagttggagaagctgagtttcagaacttttacagattctcagaaactagtt

SEQ ID NO: 3221 - DNA, 1501 bp, Oryza sativa
ttgacactgtcaatacgcaaactttagtctggaagacagtgacatctccaagacttttctccaaatttatcctatcatatggtcatatgtacaaacacgggctattcgctaccactacggcactaccagactggtgacatactaggattaatcagctatactgatcaaagtttctattactttctttttttgttctcgtatggcaaaagtagatgctcctaactcctaacctgattattcttgctggtacactgagaatttagttgttcatcgccacacgaaagacggaaagagtgagcaagtgcagcgttgttctatcctcatgttacttaatcactaagtttattggtgggtttaggttatgtttgacacagctccagctccacctctcctggagatggagctcagccaaacagttttagctccatctaaaattaggagcggagctagatggagtaatctcacagaatgaataagtgatgtgcagctaggttttggctattccacaattctactccagacctacctcctaaagctaaattttaaagttagagatttacgaagcaggatcttattgtcgctgcgagatcggaactcaagctgtccggtagaccggtacgaacgatgctcgctcatcacgtgagtattggattgcacgggtgcaagcaacactgaatccgatggagatctcgtaggagtatttgggggcggccatgttgtggtcggcagttgatgacgcgccgccgtatttggaagggagctctatttggaactagtaggcgagactccaggtcaaaccaaacttatcagcagaagatgctacgaaggccgcttgaattgatggccatccacacctttccccgtcggcgcttaaatcctcccaagtacaacttcaaacgcgtgtgctctgctctgctctgccttcatgtttacttgacctcatagtagtaattgagctcgtaattaaaaaaaaaccaatgtttgcattgtactacatgaactaaaaacaacaatgcaagttgtcattcgatgaacgatctggtttgcgatcaaggcatcatcatcatcatcatcatcacgtgaggcacaacgaaatcgtcgtacaaggttggctaccaaagcagtaactactccagtttacatgatgagagaggcagtaatcaagcgaggtaaacggaatccatcgtcccgccatttccgcgcgttgccttctcgccgcgcgacccatcccaacgtgccggacacccgcaaccgcgagccagtcaaagtcgaaacccccgcaactgaccgacaggtgggctctcccccaaccgtggcccccaccggcagcgacgcgtcgtcccccctcattaattaatcccattaatccccctcctcctcgtcaccggccaactcaactcaactccacctcgtcgcctccgccgcttggagaagaagaagaagaagaagaaaatctctctcgcctcggagagaggaggaggaggaggagatccggcggcga

SEQ ID NO: 3222 - DNA, 1501 bp, Oryza sativa
tctggagtagaattgtggaatagccaaaacctagctgcacatcacttattcattctgtgagattactccatctagctccgctcctaattttagatggagctaaaactgtttggctgagctccatctccaggagaggtggagctggagctgtgtcaaacataacctaaacccaccaataaacttagtgattaagtaacatgaggatagaacaacgctgcacttgctcactctttccgtctttcgtgtggcgatgaacaactaaattctcagtgtaccagcaagaataatcaggttaggagttaggagcatctacttttgccatacgagaacaaaaaaagaaagtaatagaaactttgatcagtatagctgattaatcctagtatgtcaccagtctggtagtgccgtagtggtagcgaatagcccgtgtttgtacatatgaccatatgataggataaatttggagaaaagtcttggagatgtcactgtcttccagactaaagtttgcgtattgacagtgtcaagccatggcgccctgctatgcatccctgtatcattaaggccttaaacaattagcaagagaaagcagtccaaccagaaatatagtgtttagaaaattaggacaagacaaacagctcagcctttccacgtttgcatgcccttctttaaagtcactacatacatagaagttttttttttaaaaaaaaaagtgtgcgtccatgaactccaaatgtatggaaaatttcctaattatatacaaacttttaaggataaatatattgttatgcaaactttctttgaatagagttattatcttgaaaggttattggcacatccggttcgatgtagatgctggtttttacccattttgaagagaagaaaatcacaaaaaatcgttgtacgaacgtacatctgttggttcggtaagatagtactactagtggtgaattccatcacgcaggtgacattctggacgtggtaacaacccatcaaaacttgaatcacaaatactcctatgtggtttctgaaacgtattggagtcatcaaccaagcaccggcgttgaatgcggtccacgtcaaaagacacagaaacttggccaaatttagacaagggagaacatggtgcttgaaaagtttgtcaaatgcacataaccattcgttgtctcaaccattgttgttaccccttccatagcttagatcacaaggagaagaaacggtattgatggcgagaatagcataaaaggttaggcaaataccagaaaaacatcctaatctacaatatccaatgaggcaaacaccaattccacaagaaacatacaaactgagggcattaagacaccagtctcaacgcgaaaagaatacccaggaaaaccacgtcacgtccataacacgcaaccacgcaatcaatccaactgtgtcagtgcacctcgcagtaatcaaatgggtaaatgaccattcaccatcatggacaggccaatcacaggaagcagcacatatcgtacct

SEQ ID NO: 3223 - DNA, 1501 bp, Oryza sativa
cccattgaccttgaggaaaacatcactccgtcgtgccagaactggctccgattctcatacttgacaatagcgcccgactcgtcgtaggtgggattaacctgctccatggtgatcactggcgggagggccatctgctccctagtgactgggttgaggaggtgcatctcacacttatcatcaatggttaccagccaaccatctgatgacccaatcaggtatctatcacggatgggtggatccgggagagtaatcttgtaggttctctgctctgcaaggctgtagatacaccctacattcttaccggcagattcagaggtgtagaagaggcaaggtgtctggtgccgtttatattgtccaaggctgtgtagtgtggtgtatgcagagtgccaagaggagcagacggagctcgcacgcagcaagtcagggatctccaagcgggaaagtatttgtaccagcaaatcctccggcagatgcggcaattcagcctccaccatcgatggcagcacgccaacatgttcttcttcgatgtgaggaagagctgagagcttatgcaaagctcccaagattgcagagcacaaagccgtagctagcctgcctatgctcattatgctggctacgatgcaggtcgccatcagatcactgcttctacttgcaagatgaaaaaaaaaaagttgagttgggcttggccctggatagtgtatacacttataggcaacaaggcaaggacggcttcgaatccgaaattgaacgggaatctgaatccaagaaggaaactgctcctgtcatgcctgcctgcggaattctggtattagtgcacgggcgagctaaagcacttaaatagattcggaatcgggagtttgggaccaaacctgaaacctgttgccgcagagagtccgaatccgacgagtgttgagttcctctctccctgtgtcgtcggaagcaacagtagtagcaaaactgggccattccactcgccaggaggagccagccgacgagggcgcagcggcggcgcagttggttgggtcgtgcggctacttggcttggttgggttggccatggccgccaccccgcccgcatttcctctctctccgtcgccgctgcgccacccaccccgatcctccctccgccgccggccgccggcctcggcttatcgtcgtcgccgacacgagttgggctccgggcccaatacatacttgggcttaggccggcctgcgcgttggcctgcttgatgtgtcggcccaaaatggtggccggcgacgctgaacggggtggggtagtctgctatttaacctttctctcgccaacctgcccaccgcgctctcgctctgccaccgccattgcgccaccgctcgccggagaagccaccaccaattatcgctttcaaggataataaggtgcatcctgttcctcccttcttcagttcttccccatcccgttacagagtctttctttgcagacacgtacgccaagaagcgttcttggtttcttggccgcgcttgcg

SEQ ID NO: 3224 - DNA, 1501 bp, Oryza sativa
gtaccagcaaatcctccggcagatgcggcaattcagcctccaccatcgatggcagcacgccaacatgttcttcttcgatgtgaggaagagctgagagcttatgcaaagctcccaagattgcagagcacaaagccgtagctagcctgcctatgctcattatgctggctacgatgcaggtcgccatcagatcactgcttctacttgcaagatgaaaaaaaaaaagttgagttgggcttggccctggatagtgtatacacttataggcaacaaggcaaggacggcttcgaatccgaaattgaacgggaatctgaatccaagaaggaaactgctcctgtcatgcctgcctgcggaattctggtattagtgcacgggcgagctaaagcacttaaatagattcggaatcgggagtttgggaccaaacctgaaacctgttgccgcagagagtccgaatccgacgagtgttgagttcctctctccctgtgtcgtcggaagcaacagtagtagcaaaactgggccattccactcgccaggaggagccagccgacgagggcgcagcggcggcgcagttggttgggtcgtgcggctacttggcttggttgggttggccatggccgccaccccgcccgcatttcctctctctccgtcgccgctgcgccacccaccccgatcctccctccgccgccggccgccggcctcggcttatcgtcgtcgccgacacgagttgggctccgggcccaatacatacttgggcttaggccggcctgcgcgttggcctgcttgatgtgtcggcccaaaatggtggccggcgacgctgaacggggtggggtagtctgctatttaacctttctctcgccaacctgcccaccgcgctctcgctctgccaccgccattgcgccaccgctcgccggagaagccaccaccaattatcgctttcaaggataataaggtgcatcctgttcctcccttcttcagttcttccccatcccgttacagagtctttctttgcagacacgtacgccaagaagcgttcttggtttcttggccgcgcttgcgccaccgctcgccggagaagaagacaccaccgccatttctggtttcttggccgccctctgccaccactcgccggagaagaagccaacaccagtttcttggccgctctctgccactgcgcttgcgccaccgctcgcctgagaagaaaccttcaccatttttggtttcttggccgctctctgccactgcgtttgcgccaccaccaagcaccgcgccgcgtccaaagataataaggtgcatcctttcttccataacgagctcttcttctcttctctttctctcttcttccccttcctctcttctctttctctcttcttccccatcccgttacagagctcatctttgcagacacgcagggcaagaagcgttcttggtttattgcagacaagaatcgtctctccacgactgtatccggcgcaagagacagatgggtcccgactcaggtagcgtc

SEQ ID NO: 3225 - DNA, 1501 bp, Oryza sativa
gcgagcgcaggagcaatactcccaatcccaaccgagacaaggaggacaaggaaaagggaacaagagacagcagggagctcgctacctgaagcgccggcatggtggcggcaggaataaccgcggtgccccggcgaccaccgcgcgctggccccagccccggccacgcgagcgggagcgggagcggaagccgaggagaggccgccaatggggcgcggccggggacgtcggggaaggggaaggggagcggaaggtgcatgagagcgctcctgcggcggcggcgcccctctccatatcctcactttgatgcgccgttggcttctcgctcgccgctttgcttcgcaggcggcggcggcggcggcgcgtctctcctctcctccgcttgctgctgctgctggcagtcacgcacgcggcacgcgtcacgggcgagctgcctgcccgttagatgagggtgtgtttagtgaccttggttatttcataatccaagggtctggatctgttcagggaacttaaaattacgagaagttgttacttctaataatacagcggagcgattttttagtttatggtttctaatttattttctgaattttacaactacaacttatcagaatccgaacaaaaatctagaccgtttggtgtgtgtgcgcggggttcttgttctggaaaaattttcagctaccaaaagctcccttaaacatgtctcaaggctgttgtgttataaagttacggaaaaaaaataaagttgctgaaaaatgatatgcagaaccaagtttttatttcgaaagtagagatgatggataagatattagaaagttgaagatttaatgaaaaggtattattaagaaatgttgatgaagtttcattttttttttaaatggtgcctagaagtttgataagcatcatgtcagttgaaactactcttaatattgatggctcgattaacactagttttagaagttaggacaatctatacttaattttatagttgactagaaaatgtctatgttttgttatagataaaaaatatattataatatcatagcataatattattttatcaagcatgtaattgtttgcttatttgcatatatggtatttacttgaatcaaatattagaatattctacagtatcagaaaatatcaagcggcaatttataaaaaccgaagaagcacaagtagaataacagatttactcccatcaccatcgtagttttttatatggagtatatagttgtatgtaaatgaaactcgagcactcgaccattagttgagggacgtaaagtggacctttttgcacttaacgcaaacaggcccaaaccaagcatacaccgctaggacatccggtccgacaaaaacaatggcccattctaagctataaaccctagcggcctagcccaacaaaacctctcgcctcgtcgagtacgggagcttgttcacacgcctcctcccctacgacgccggcgatgggtaagcggaagcagcgcggcggcggcggcggtgg

SEQ ID NO: 3226 - DNA, 1386 bp, Oryza sativa
agagaagaaagaaatccaaagcaaagaaaagcaaacgaaccaacggatcgaaaagatcgaaaccctaaccctaatcttacctcgtcgccggccacggagggggagaggggcaaagaggcaccgccgaggagccactcgacagccgcgcgcgcacccgcgggtgcacgcgcgcgccggcgagggggcccgcggcggcgccaccatctccgtcgtcgccggtctctcactcttcactcgcgtggaggggtgagacggtgggggggagaagagaaaagaatagagggcgtggcggcgcgagagcgtctgccatggcgcgacggcgcgaaggctgccggcgtcggcgacgccgctcggcacggggcacgcccgcaagagaaaggagagggcgccgcggcacaaccgctcgacggcggcgcactcacccttgagtgagtgcgcgcatcggcgaaggggagtgcgacggcgccgccgtgtcgccatgccgccgccggcgctgtgctagggttccggcgacggcgtcgccgctccgtgcacccgcaagagagaagagaaggagaagctagggtttcggcggccggtcggggcgagagggggttttgatccccgttttcggcgcccgaccgtccgatcataaaccctaagatcggacggccggtggcggccgggccaaaaatggcccaagaagggagcgcgcggcggcggttttcccggcccaggcccaagttgcggcctgggaaaggggaggggccgctcgcccgcgcgcaaggcggccgtgggccgaccggcaaaggccgaaaaaaaaaattcaatttaggtccctcggggccgaaagaaaaagaaaagaagtttaataaaagtccctcggccgaaggaagcattttcaatatgtttaatgattgtgtttatttctaagcaatttgaaccaacgtgaaaattgtttagataacagataaatgtgagaaatgcttctgaacatgtattttgtatattttcatgcaaattacaatagaattttgaattgttcttacatgttttacctctgtttaaatttgaaccaacgggagaatttttacagagagtaaacaacagagttttgttattgtttatatgaattgtatatagatcttccgctgcaaacagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcagatggctact

SEQ ID NO: 3227 - DNA, 1501 bp, Oryza sativa
tcaaattatggagatattaggcttaaaagatctatctcgcaaattagtctttatccatgtaattagttattttttaacctatgtttaatacttcatgcaggtgtttaaacgttcgatgttacatgatgtaaaattttggggtgtgaaataaagagggcctgagttcaaattgcttcaaactgcacgcagagatgagtcctcgtagtggagtactagagtatacaaatatacaatactagtaatatttacaataagcaacgttaacatagttaggccttgttttggttggggaaaaattttaggtttgattgtcacatcggatataaggacacatatttgaagtattaaatatagtctaataataaaataaattacagattccgccagaaaattacgagatgaatttattaagcctaattaatccaccatttattaatgtttactatagcaccatattatcaaatcatggcgcgattaggcttaaaagatttgtctcgaaatttatacgtaaatgtgtaattatttttttttcacatttaatacctcatagatgtgtccaaacatttaggtggtgtttggatacagggacttaactttagtccctgtatttagacactaatttagagtattaaatatagactacttacaaaactaattatataaatgaaagctaatttgcgagataaattttttaagcctaattaatccacaattagagaatgtttaatgtagcatcacataggctaatcatggattaattaggctcaatagatttgtctcgcgaattagtccaagattatgaatgggttttattaataatctatgtttaatatttataattagtgtctaaacattcgatattatagggacttaaaagttttagtcccatctaaacagggtcttaggggtgtttgggagagaggggataaactttagcccctctctctagcccctctctcaaaaacataagtccctctcgttttgtagagaggggctaaactttagccccactttagtccctccaaccaaacaccaccttaatatgatgggtgaaaagtttttattttgagaactaaggcctcagtctcatgcaattccatggtaggcagtcacacacacccactcgcggtgtctcgtctgatcgtctcgcaaacagagaagcatgggtttgggttacccattgtatgcatggtcacagcctcacagcttgccagtattgccaacttaggccagcacgatcacccacccttttgcttttggccgcggtgtacgctgctcctgtctctgatacctgcagccgctgtcccctccccccacggtgcagcgcatcgcagcgccagagatgctttgccgtttgcggctcgaaccgctgcgtgcttcgcttgaccaccagtccaccaccaacccctcccctacacgctcctcgcctccgcggtttggtcgtagtcgaatgcgatattgcgaggttgcggcagcagcggcagcagagatttgcacaggg

SEQ ID NO: 3228 - DNA, 1501 bp, Oryza sativa
gtcattctcacactgtattgtacccaaggtgaaaatatcttcactcctaattaatggctaggtagttttaatcatgggtaagataaataatctatatactattaagctagctactctgtactcctgagagaggaactcgatcaatcatgatcgagtagaactttacactggaaaaacgatactatatggtgtgatcgtctatcggcgattcgatcggcatacgtgtcacgtttgaaaaactggatcactgctcgcccctctctctctcgctctgcaaagagatcgtatcagatcgtcttggctgcgagagccacccagcgatcgagccagaggcggtcgatggctgtagcagccgttcttccggtgaaagctgaggctatgggaacatgcagatgcgtccaagcggtcggcccagctcatccatgcatgtatacgttgcggcgcagactgcatgcagtagtcgaaaagcaaaaggaaaaaggtagagcaaaattttttgatcgtctccaaacccgggttaaaagtgtgtgtggactgtgtgattttaactgcagttaacattatctccaagcccgggttaaaattatgttctgtattctgtagtggctgctgacatgcggctcggtttttctgatcactaatataacctgcgagtaggaacattgcatgcagcaaattttactgtctctatcccggtccgttttttatcatagcgcagaacaaaatagaagaagagctgcgcagtgcatgcgtggtggactggtggtaaaaacgacgaggtgtgtacagtacacgatgcgctccttttcccatgccgcttttggcatcctcgcgccctcctcccctgtgcaaatctctgctgccgctgctgccgcaacctcgcaatatcgcattcgactacgaccaaaccgcggaggcgaggagcgtgtaggggaggggttggtggtggactggtggtcaagcgaagcacgcagcggttcgagccgcaaacggcaaagcatctctggcgctgcgatgcgctgcaccgtggggggaggggacagcggctgcaggtatcagagacaggagcagcgtacaccgcggccaaaagcaaaagggtgggtgatcgtgctggcctaagttggcaatactggcaagctgtgaggctgtgaccatgcatacaatgggtaacccaaacccatgcttctctgtttgcgagacgatcagacgagacaccgcgagtgggtgtgtgtgactgcctaccatggaattgcatgagactgaggccttagttctcaaaataaaaacttttcacccatcatattaaggtggtgtttggttggagggactaaagtggggctaaagtttagcccctctctacaaaacgagagggacttatgtttttgagagaggggctagagagaggggctaaagtttatcccctctctcccaaacacccctaagaccctgtttagatgggactaaaacttttaagtccctataatatcgaatgtttagacac

SEQ ID NO: 3229 - DNA, 1501 bp, Oryza sativa
gtgtcgtggggagagctgatcgcggtcgcgtgatgcggtgtgtctgcggcgtctcggtcggctcgcgtccggcttcacgctgtgttgttttctgacgcgatcgtacattcgccgagattttttttttgggtgtatcggcgtggtgggtgaggcggcgattttgttcgtctgctccgtatcatcttcgatcgcttgttccactgctgatgctgtgcgcgagcgtgtcctctatttcgtctgtgcgaatgtggatgagtccatttgagtttttggtgccatttttttcatgctccgagtagcatggcgctttgatggttaatgcggctggttttgttgtgcaggggttgcgaactcggcgatggatcagtgacccgccgtggtgaagcctgcagattctacctataaggtatatcgccccacccctcttcctcggatttactagtagctgaattgttgttgactggtgaatgataatcgagcggaagctgttcaggattttgcactgctgcttgttatgctctgtgtggccctctagtaatgtggctttcattaaatcagtggttgctgcaccactgttgaaaatgcattgcactatttacacattcaacaatctatgtggtataatactaatgagaataaagtgtttattacattattccattatctaaataaattatttaattttagtgcactgtagtacgttacacattcagcaatctatgtggggttgttaacttagcgcatttgtgtttgcacatgggaatgggatcaacttgtgttgtacactagtataactgtagcttccttatggagcctagctcaatatgctatagaaaccgtctgctgaaactaataggattctccaagaaggagatgatgcggtgatggtgtgttgctgttattattttctttttgtaaactgtttttgatgtcatacaaacttcttgatgtacttgctaaactcttgagttttgcattttggttcctatatttgttttgaacttctaattgaaatgcctgcttgattccaaatttacaggggagctatggcgaaaagtccacgttctgttgttaccacaggtcttcttctgtctactttgtaactgcttatctcactttcacataacatctcatgcatttatgatttaactaagttttagtcagatcgtaaggcagtttatgcagtgtagcttacagcttatttttaccattgtgagttactgaattcaactagagccacacacatatataattatatgcctgcatatatcactcataatcacttggagttatcatgtttgatcttgcttgcaatctagaatcttgcaatagctttctacatatacatgcttgacagttataagtaagatgctgatgttgatttacttgtttatatttttaacgtgcttggttcatctgatggatacatgcttgtatggtatccaattatttcaaattgtaatataaccaacaccattttgtctctcaggaacaaaaaggc

SEQ ID NO: 3230 - DNA, 1501 bp, Oryza sativa
ctacgtggaagcttatacataatcaagactacctccatcaacttaattcttccatacaatcagatgttacataagcaaataggtagaacaaggttatcaagaaatgtgtctgatcacgcaaatcaataacgtaaacaagtatagttaaacacaaaaatctaagctttgtgatacacagacaaggcaggctctgggcctaggcaggttgtgcgaccgcctagggcccaggccggtagagggcccatcaccatcatagtccatcagcatcccaggatgacctagttagccggttagcccaattgcagtgatgtcgttgccacgtcgattggcagggagggaggcacgccacgcacgcaatcgaggatcgagcccaaaccatcgatcaagggcgaaaccgtgacgcgtcggttcattacttcgttctagatcctcagcgttttctctcctgatcgcgatggccgacaggtgacggcgccacagcacgaccgtgacttcacgatctagagtccggcaacatcgtggcagcagccagccggatgctctcacgcccgacgcccatggcccatgccttgcccgattgtctcatcgtgactcggataaggttttcacttcttctgatcttctcaattttcatttgcatctatttattcctaaaattatgtttcggttttgttttgttctttttgttatttattttatcctatttgagctatttatactacttcgtttttgcacgggtttcttttagttgtctattgtactatgttttttaaaactaagcccattatactatcaacactatttatcgagaataaaataccaaattacaattttcaactacgtattattaatcatgttattttagagaatacatggttacaagtaaaaaaatccttagggcccgtagcacagagtttgcctaggaccttcgaaaatatagaaccggccctgtacacagagctaccgtcctaatcagcacatagacttctttttgcaggttgtcctaaaactaaagaagatctaacattttataggttcaaacttgagatagaacttccatctataccaatatcaataccactatataggaatgtagcatccatgatgtcccccgcaatctatccgctataccgatatcaatacctctataggaatgtagcgtctgcgataccacccgcaatctatccactatagcgatattaataccgctataggaatgtagcgtccgcgataccacccgcaatcaatccgctataccgatatcaaaaccgctataggaatgtagcgtccgcgataccgcccgcaatctcgccgctaccccgatatcaatccgctaccactccgctaacactatttggtacctttggatgaaagtatagattctaccaccaaaaacctagatttaagatctataatcgaagccaagctaacctatacacgcaccaaaatttcccccaaaacaacaaaaacctagataaatagataaaaggatcaagaaagg

SEQ ID NO: 3231 - DNA, 1501 bp, Oryza sativa
atcgactcttagcatttattagaaaattttttgttgcattgagtctaataaaagaaagatgactagtaagaaagtattttaatacattaatggttagagaccatattgtcttaactattgtaacatgatagcctctaattaacgtagagaccataccggtctctgcctttgtacttgccctcacatcagacacggagacacctcaactgaaaatgacaggctcttgcacttatctctcttctagattgtcatctagcatctgtctctagcttgcagtggcaatttaggcttttagcaagtcacacattttggaagtgctgtgcagctcctgtttctgtacttggattacttggagtacagtaattgatgaagggtggacacaatccatgaagtagtagcattaggctttgtttagattccaccctaaaatttttcaccttgtcacatcgaacgtttgaacacttgcatgaaatattaaatataggctaaaaaataactaattgtacagattgcgactaatttatgagaatcatttaagcctaattgctccatgatttgacaatgtggtgctacagtaaacatttgctaatgacggattaattaggcttaataaattcgtctcgcggtttactgacggattctgtaattagtttttttattagtgctcgaacacccatgcgacaccctatataatacccgatgtgacaccaaaactttacatatctaaacaccccctaaaagggaaaaggatgtgatgcctgtcattcactcatgagcagaaaatgcagtaaactacagtaatggcagtaggatctcatgtcaactccactattgtgcattttgtgaatcccatggagcatcagcatcagcattcagccgcatgcgattcaagaatgctattcaggagatgaaagataccttgagagcaatggaacaggccccaaaagtctcacagctcacaagttgaacagtaggaaatggaagcatgcggcacagctgcaacaagtctcctgagtctggactgctagtccacgcacgcgtgcagatgctcgtcggcactgtccacacgaagaaagaagaaactgttagtacaggataggtttagtctaaccaatcacagaagcagagtttaccagtcaaaagcagatctctgtttcattcttatccctgtgtgacaatgttgtgaccaaacatgggctctccctggctgcgggactgcagaaaattgttcacacctcacagtgtcagatgacctgtaaatgatgtgccgacaacgtcagatatcccagaatcagattgcaaagcatgctctagagtccacataaacaaatttgttgggtcttggaaataaagaggacaacaaattttggaacgttaacagcttatcagatccagtacaggagtcatagttgttgtcagtatcagtcgaaatggacacagtgataaagaccaaacgcctttgatttattgtggtcggagatacattcagtcattcatcgtc

SEQ ID NO: 3232 - DNA, 1501 bp, Oryza sativa
gctgtatatctgttcatcgatcttgatccaaatatgatttaaccaactcgaatctgcagatcaagataaggtttatttggttttgaaaacgccaagaaatgagtctatccatatgcgtgtccagttcttggtcgcccagacccacgatgaaccgagaccatgcagctaaccgatcctgggttcggtagacaaacaagtttcgaacaggtttgagttttttctgaacttgatgtccatctttgacacgttggaaacatcggtttgatttcattttgaagcaaaagtttacaattcgttagacgttctatgtgttggaattccaatttgaccagctcatgccaacacataagaggagtactgcaccttgtgcctactttgacctcttcctgcgcaaatcgattcgtcaggacagtaacgaaatctctcaaaaagttcaaaccaactcgtaattccatcacgaatccgacgcagaattcaaactgcggtgagaaaccgacggataaatatgagcaaaatttggatacatgaagaacaggcaaactcgtatcacctggtaggcagctatgctttccccaacggcagcaacgagcttttgattactcccgtgcagattaatccggtttccgacgtgctaatgcaaatgcagctgcagggtcgccgccgagatgaccggagccaccggcggaggccatttctccggcgagacggccggcggccgcgccgccgcgggggccaaacccggggcgaactcgcacaccggcggcgagagtgctccgagggtgtgtcagttgcgccgcgttcaatccggccgtagaccatcgaaacggcggcggatcggcgaggttccaggctcgccggattcccctgctagcctgctacatcttgaccccggctagccgggatgttcgccggagcaccaccgctcgccggccggaaatcccctccaaactcacacaaatccgccgcccagaccagtccggctttgccgatcaatatctcccagaatacccaaccaaatcgaacaaatttacactcgtttgaaagccatgctccgtgcctacaatctggaaaaaaacccattcaaattggtcgatccaattcggagaaaatcgggtgcaaatccggaggagaagcacacttctggatgggtggggatgaggccgggcggccaatccaacttgaggggggcagcaatccgtggcacgggatgaggggtgcacacgaccgttggatgggttcggatcgggcggctgagattcaatgtggggcgcgtggggtggcgatccgtggggaggccgtttcggccaatcagagcgcggcgttggcgtctccccgtcatcgcgaggcatcccactatataaccaccgattcctccgccccgacctcctcacccacccaccggcgagcagctgctccgacaagcgctctctctctctctcaactccggcgaggctcacgcgcgctccgaagcttcggatagcggcagtagtcagtgcattga

SEQ ID NO: 3233 - DNA, 1501 bp, Oryza sativa
ccacgcacattttcacacttcactctctctctctctctctctctcgtgcgccgcgccgcgccgcgcggcgagggtggtggtgggtgagcggcgagccgagccgggccacgggcggcgccgcgggaggcgtcccggcgagcggaggggaggggggcatccgagcgctgggggaggtagctcagcgggaacgggaacggggcgatcccccccggcgttctcctccccggtctctcctgtagctagctagctagccatggcggcgaatggcgagggtggcggcgacccggcggcgcggaggcggtgggatctgacgaacaagggtgccgagagcatgtaatggcagtggcaccagctgcatttcggtttgtttgtttattatttttttttttttttgggggggggggggggtttggctcgtggtgtggcgatgttcatggagcaatgttggtggcggagttcatcttccagctgggctgctggatctgctcgatttgtgcttggtttatgcgagtttttggtgatttcagatgggttttttccccttggtctacacggggcagctagggtttcgttacctggagaagatagattggccttagatactgttgttgttgttgttgttgctggtataaatctcaatacggtagggtgggagacggatttctgtaagaaatgagcttttccggaggcaaacgaaagagggatttcaatattaactagtggaataaaaaaaaattccctgttggggaggaaggatggggtagatttataggcatatcatgcattattgtcaaggtcattgcagtgaatttatgtgtgaactcgtattttaatgactcaacctttcttcttcttgagcatgctgaaccattcaaggattactgtgagaaatttctgatggatatgactttgaactttcctgcccaatttcatatgtactgtgtcacatccctgatacatttttaattgcagctgctgattctaagattttgagacattgcctgactcttagtgggcttgctgttaggattgtgctggttgactttgtgtggagatatcttatgatctgctgatgcacaattgtgatatggccattttttatgcaaagctttcgacttttgtttagattctttgttatccgtattagctatacttttatttttccagggtaatttagttttaagtgttcaaatcggaagcactgaggctgagagaaatgctgactagtttatgtacttacatacctaaaaagccttctgtgtatgtgcaatattagataatctgtgtgggcatcaacttttgtactatttaggttacaagccttatttttgcaggaatgcactaaatgctcctgttctgtagttattgtttctgcatgacctgagtactttagtgtttctatatattgtgtagttgcttgcatgctatttgtggtgaataacttatgaggttgtacttttgttataattgtggttaatgtactttaatccttgcagtccaa

SEQ ID NO: 3234 - DNA, 1501 bp, Oryza sativa
ttgacgattttgggggatttcaacctaatctatgagagaggagccaaaaaggaagccaaatttcatttctggatcaaggtaaatggtttcaagcaagtaatacaggaagcatggaacaaggctgtacaaactgatcatccagtaaacaagatgctcaacagcactgcaaaggccctgagaatttgaagcacaacacaatttggccaactacaagcttcggttcatatagaggctagctaggccttgcacaacaaacaagattgctgagtcctgaagaaaaggtatatatacaggaaatatttaaaagccaggaccctagtactagtagcagtgcccagggcaatgaaaaagcaatcaacaagaatttcatggctcaaacaggggacgcaaacacatagattttccacacaagagctacagccaggcctaggaagaaccacataaagcacaatgggagacagtattagtatacacatggcaagacacagcaagacaagtcaaaaagctattgacgatcactttcaacagattttggggagaaggtttacagatcatgcacaataaacgatcactttcaatagattttggggagaaggtttacagatcatgcacaataaataagttgggacctgattcacatgagatgagcagactccaaacaacagacaacaaacatggatgaggttttcggcgatattgtgacaatgtgaccaaacaatcaaatgatttcatattaggttctcaccctcgtggatccaggaagaaggaagcggtggaacatggcaaagttcaaaggcggagaagggcagaacagctgcacaaacaagagaaactcgtaaagtgagagaaaccgagatggggaagacggatcgagacatgcaacgcgagatccggcgccacgcgtgcacctcggaacccctcctcttcccggctgtcgcgatcaccttcacaaacacaagaggaggaacagaataagtgagaagagaccgagacgggggcggcggtcgtgatcagcttcacaaacacaagaggaggaacaaaataagtgagagagaccgagacggggagagataataaacctcggagcccgcagccatcttgagcaccttcttcgccgccgccgccgccgccttcgccatggtgagctctcacgacggaatcgaggccttggacttgggagagagagacgaagtgtggacttgggcgagagagagagacgaagtggaggggtgtttggtgatgcggattaaaccccagttctacttgagtcacccgaacccaagtacccaacccaaccccatcgcggcgtctggattttttttacttttaggtcccttttgaaaacctattttataaataaaccttttaaaaaacttatcctaagaatgttacccttttcgcggcccaacgggaagggtcaattcttgaaataagtattttagggatctatttgaaaaataatttttcagaaaggtctaaaatgtaaaaaaatccggtctcc

SEQ ID NO: 3235 - DNA, 231 bp, Oryza sativa
  unsure (1)..(231): unsure at all n locations
aggatggggnacgtagaacgtacggccccgccacatgagaagaaaccatcccgcacccttatcgtagattgcaccaatcatacgttttttatggtgtcctagcacaacatgaattagggtgagggcccttcattgtaatgaggatgagcataatatatccctgaaatgtgcatcaaggtgatcatctcatggatattatgattacagattcaaaaaataatgggcgaatca

SEQ ID NO: 3236 - DNA, 1501 bp, Oryza sativa
atactgctcgttcatattatgcgtgtttgtgtgtgtttttgtattcccttctcgtgatcggataattaagagctttaagacgtgacacggcaggctaaaaaggacgttccggaccggtcaaaaactatttttcgttcgtggggatggcattggctggcccatggaccagtctaaacagtgtggtacagttacacacatgggcgtgttgcgttaggcttgtgtacgcgttcgtgcggccaagcgatacgtgtgggagtggcaacggtttgatgtcgatattgttcgtacactcgtactaccgaacgcagcagtacggtgcaaagttgttgtttgaggactagtacgaccgcgaggacagggatcatctgcagataatgagaatcccataacgaccgcgaaacattgggtgctccaacacatggtttctgtctgagcatggttatctgatactccctatgtattttaatatataacgccgttgatttttcgaccaacgtttaaccacttgttttattcaaatttttcgtataaatatgaacgtatttatatcatgcttaaagaacatttaatgatgaatcgagtcacaataaaataaatgatagttgtataaattttttgattaagacgaatggtcaaacgttagataaaaagtcaacgacgtcatacattaaaatatggaggtagtactaggctccagtctggtgtttggatccagagacttaactttagtctctgtatttagacactaatttagagtattaaatatagactacttacaaaactaattacataaatgaaaactaatttgcgagacaaattttttaagcctagttaatctataattagagaatgtttactgtagcatcacataagttaatcgtgtattaattaggctaaatagattcgtctcgcgaattagtctaagattatgaataggttttattaatagtctacgtttaatgtttataattagtgtctaaatatccgatgtgatagggatttaaaaattttattcccatataaatagggtctcaatccatttataaatagtctacgaacttgaactcctaaaatatgaccataaaacttttgaaaattgcataccctctctatggacaacagcacaaagtaaatgttgagggatggcgagacggtgttagggtgggatagatccactcttctccaatgcggtttcttcatgatcgtggtcaaaaacaagtggatgtatgtttcaatagtacaattatgataagggatacgagggattgttgttgtataaggaccagttaaacaagattattgcaatattattggtggaaaaaaaataaaacggattcgcttaatatggtgtttccgttatatccggaagactgttgcaactggacgcacgtggtggagacgcctggcgcgggctgcgcggcgcccgatttttctcgggcccatcgggcatttgacgcctggcattttcgtgttaattgttattagtcgtagaacaaccaag

SEQ ID NO: 3237 - DNA, 1501 bp, Oryza sativa
gggaaatgttttaatgtcgcagtataagtactgaattttttaagaaatttaagaatgattccatttacagcccagttacagtttagatgtactgtagttatatatgtaacttttgttatttgtaactgtaactgactatagattgatagtttttgttacgagtttttctgaaaaagttacatacttttaactacttgatctaaagaaatttcctattccaagcacttttctccaaaagaaattcactattccaagtgcttttctccaatatttttacagaactgagttgtttttgtttgatttaaaagatgactggcagaatatggtgaagtcaatggggaaaggtaaaggtggattttgtgctaggtaatttgttacctggaagattatgtcttgttgatttcaacttcttgacctcaatgttcttggtaagaatttgcttcttcttctttttctcgttctcctcactgtctatggcgtgctcgatttgttttgctcgatctaggggatttgtgcgaactggtgtggtctccctgtgttattttgtttttttctaacctttattggatgtgaagttgatcattatgggccatgatgtattttgcagttatggcctgtataattttttgtattgttctatgggctagaattcgagcccatgtagttttgtgatctgactagtcagagaaaaaaatatgtagcattttttgtgtcctttggatcttaatctaacggtaggaaaaaatctgggtgattttgacccaaggatttgtcgacaaagacatagctagttcctttcccttgtagtattactccattattaaaaaaaaatggaaatacatggataacgagcgagtgcttcggtttcgtacatgatgggctctgtatgagatttggacattgcggaggggacaaagaaattggtcagggcatcaggcccagaaaagttagatgggctcaactataggccactctaaactaaaagtcaggtgggcttggcacagatttttccttttcgttttatgcttgcttggttgttctacgactaataacaattaacacgaaaatgccaggcgtcaaatgcccgatgggcccgagaaaaatcgggcgccgcgcagcccgcgccaggcgtctccaccacgtgcgtccagttgcaacagtcttccggatataacggaaacaccatattaagcgaatccgttttattttttttccaccaataatattgcaataatcttgtttaactggtccttatacaacaacaatccctcgtatcccttatcataattgtactattgaaacatacatccacttgtttttgaccacgatcatgaagaaaccgcattggagaagagtggatctatcccaccctaacaccgtctcgccatccctcaacatttactttgtgctgttgtccatagagagggtatgcaattttcaaaagttttatggtcatattttaggagttcaagttcgtagactatttataaatggattgaga

SEQ ID NO: 3238 - DNA, 1501 bp, Oryza sativa
aatggtgcacgtggacgacatgttgtggtgcaggttggtgggcgaggcgcacgccgtgttcaacgccggtcggggcagcctaccagagatgcacgagtacccgcttggctagcgtgatggtgctggagatggtgatgctgaggttgcggacatgctagagcgcacggtgcgcgacgtcaaggccaacacttacggctagcgtgcgctccatcaaggccaatacttatggctggctgttgtgcagcagcgcaggtggcgaagagcccaagacacgtcgactcccttaatgtaggtagatgcagttgcagtgttaattagtggtgtacggcgtaaaaggagatcaattttttgatgtgtttacaccttttttgacttgaaagttaaaatcaatcgtaactcccagccatcttttgaagtgttttccctgtactgcttattgcattgcaatgttgccacttctctttgtaacaggacataaatcttttttttttctgaaaaaaagaacggaagcctgccattagtgtaagagaaaatttcaagcaataatacagcacagaacatgataatattgtaaatttcttgattatccaactattagcacaggatggcctaatttcatagtatacgtcgtattatatcctgaacatcgatcgctattgacgaccatgttggtaatggtggataaccaaaccaaattgcacttccaccggtttactgtacccgtggtggttggataatgcagagtcacagggtgatctagaggttaattgtgttttttttatctccatctaagtaagaaaatttgaaacaaacggtctaatcttttcatttataattatacttatcagcgaaaattagaattttcaaccttaaatttggagtccatattaaggttttttcatcgaagtttatttttcagcctttgcttttagatcattacgaacacgtatataaaagttttatttgtaaatttttttcgtttgtaaatataccgtttggtttattcccggacccaataaaccatccgatggcctcctttgacgctctaaagtcatgtaatgaatatgtttttctcctacattcaagcgcgaaatgtttaaggagaaaagaaaattttgaaaatgtgtttgtttagatttattaaaaaaaagatgagtttgtttagatttattaaaaaaataaaaacatgagtttgtttagagttttgttaaatttctcaattgattcataattctttattagcatcaatagaaaatgagcttcaacttcaaattagtaaacgaaaagtttctgagttgggaaacgtctcttaatcggcttccagtaattacgggcgacttgagggggttagatgaaatttgtgtaagaaaacttgagggggaacaaattagggccctccttgcgatttcgaggttagggtcggggtcgatccgtcgcgggggaccatctctcggcatcgatcgatcgccgccggtgtcggcggcgaggggcggcgcgggga

SEQ ID NO: 3239 - DNA, 1501 bp, Oryza sativa
agctagggtggccacgtataggcacgagaagactagcgtgagctcagtaatgccggcgttagagtcatagagtgcgtaagagcaagtttaatagtatagccaactactagcttcaattcatctatagctaatctaataaatagcttatttatacaatagttatatactacactattaatatctggtcctacctgtcatacacacactgcgtcttggagtccgtgctacagctggctacagatctatagcccgctgctcttctctctcatcatttatcttcttaaaatatgtttgcaactggcttatagccttctattgtatctgctctaatcctcaccaggtgggttgtcgacatggggctcctcgcctttccatgtagcgacaaaacggtgttacctttccaccggttgacatcggtatttttttttgcatcttttgtaaaataaaattaggttgtttcggtaaaactgaagaactatcaacaggggatggatgacttcgcagtctccatatccgtaggctccgtttgttattggcttatgttgctgctcctgcccgatcttgtactcaagcaagaagaactgtcaacaggggatggatgacttcgcggtctccatatccgtaggctccgtttgttattggcttatgttgctgctcctgcccgatcttgtactcaagcaagaagaactgtcaacaggggatggatgacttcgcggtctccatatccgtaggctccgtttgttattggcttatgttgctgctcctgcgcgatcttgtactcaattgagagcgaaattacaagtcagtaaaacgagtaacatcatatccccgccaactagctttctcgccctctctccctatctagccataactactgaaagcaacgtgatttgcctacttgctcgcgacgagaaatggtccaaacggggcctggctgcggctccatgaccatgagtccatgatcgtcgtcgtcaggcgcggtgcgcacgcggagagtccggagagcgctacgcgtcggacgtacgacgcgagacgaaaaatcggatgcctccgcaaccgtccgatccatgcacaggtacaccagccatccattatgcatgtatcaaatgaattttaaactattttttctctcaaaatatttatccaaatcatgatccgattgcaccattaaattcgttgcaattaaatctttaaaacaagaccacacatgaatataatccgatgaaattttttttagcttattattaaattatttttaaatgttgcacgctgttgcaccaagtattggaattgtttcactaagtagatcgaaaatgttttattggacgccgtttcgccttatatgaaaataatgtttcagcgaatagcgaaaggatgttttaactcactgcaacatttgattcatacatagtgaaacatcatgagtacattaggtgaaacatttttaaattaaaaaaaaatggatggtcaaatgttgcagttgaccaacaagtaaaacatc

SEQ ID NO: 3240 - DNA, 1501 bp, Oryza sativa
agagggatgagcctaacccatctcatcttgtcaccagaccaaatacacgttaagtgattatgcccatgcaagcattctcgtttgaatccaaaatgtgccgtgttgaattgttagcactttaaagagtattttgttattgtttaatttgctattaagatgtgccgataatatacaccggtttaaaaaaatagcagtacttaaaattacctagattttagcactgcaacattttggtataatggcaaatcaaataaaccatgcatttggcggaatctactttccgacgaaggtgggagaaactatgatgctgccaagcatctccagcaataacttatattgtaaattgtaaagcccttaaaagatctaatggaggctgtccgaggatccaaaagttgacttgtacttcagcaacaacccccatttctcaggccacatttctcattctcttctattttgtatacactatatttatacctagtttagcaccaaaataattcaaacagaaatatttaaaacacatagaattcaatcatattcaaatttacaattttgaagaccacaattcaaattgaaattcaaaattttcaacattgcaaaatgcacaataaaattcaatttccacaatcacacacatatgcaagttcacaagcattatataattttaaaaataacatattctataaacataaatggtaagatggttagacgacaaccgtcggcgcaagaaaggagaagggcggggcggcgtagtgagggtgcaagtacaacggaaaaggagaagtgcgggggtgacgtagtgagggtgcgagtacaacgggaaaggagaagggcggggcggcgtagtgagggtgcgagtacaacgggagaagcgtacgctaggatttttcacccgcaccaaaaaaaaaaaagatgggtgttggtgtagagccccaggattgggggctagggagaggatttgggtgccttccaattttggggttttaatagggatcctgttggatctcgatttttatcccttcacactaaaaattgttccttcgctctaaaaactgtttgagagtttagtttagatactctgcaggagatgctcaatagtgaagtttcatgatgcgataactgccaaccagaaaccacttctcgtgcaattatttgagttattgagtctgagaggagacttgtggacgacgataccataattcagggaatgattttgtcggctcgtcgtaatccaaattagtccgatccgtttaccccgtcaagcactctcttgtacaccaaaatcaaacgtgctgtgctaccgtacactttgctcgaacgctgcactgtggtcacttggttctgaacataccagctcgttctctgacggagagtgtgagttcagtccacgcgtcgccatgcgatttccacaaccggtcaaccacgctagcgcgccaaaacgcttcacaaaagcgcgcgaaacgcctcgctcgatcgatcgtctcacgtctcgttctcgtcgtcg

SEQ ID NO: 3241 - DNA, 1400 bp, Oryza sativa
tggttggtatacttgcatacatatttatcatatatcttagttaatctagtttagcatcttaatttacttttgtatcagctgagattcgttttagggtttatgctgtatcggctaaattatcttgctaaattatattagctaagatatcaccaccctaaaaattagtcaaaatagactttatacttctttgcatactttgcgatgcatcatccatcgccaaagttgggcagagcaaggcgatcagtgtgtgttgggtcgtctcctatatatacagctaggcaggtgattgacaaatagctaatccttgttacatcgagaaagccagtccaattaagggggaaaaacacgaatattagagaaggatgtaatatcaaataaataaaatggatgaggcttcgaaaccaggctagctagcccaccatcttattaattaagctagccggaagacccctgcgtgtttctcaattaaggagagaaaaatgctacttcttcagttaactgtttttcctactctcttgcaaatttagtttataagccaactatttttctttttctctgttttctccgtgatcagagaatcattcaatcattcattttcgatgtgcatgttccattgttcctagatcttgatccacggatgaatgatccatactgttactgatcagtagggctttctgcatgtgtcgcgccctttcgaaccgtcgaaccgtccaattaatgtgctccaaggctgacaaatggtgtcttttgccgagctgcatagtctcgactggacacatatatattcatcagtatgttacatacatcattggattagtggtttcgggaatgtttttgcaaatacacatttcgccaaattctgatctgacgatccagcagcgcagatagatccacggatgcttccacaaaatattccattcctgcagtatatccagatctcaacaaaacgcaggtcgatcatcagtgtccactgaacaaaagcacatgccatgcatatacttgcttcatcgtaggcttagcagctcgctacagtgttgaccctacaatttttagaatcatgggttttcgcagcaacgttaattaagggcttcttggcagtagcagaggtagcaccgccgttgagtagaggtgataatagcattgtggagattatgggtaccccatacccacacggcatggttatccgactagtaataggggataacatatatgtatggaatatgtaacagatcatgacttgggtattacgtttccttttatattatggagcggcctaaagtcctgatttgataatattgtaaagtagatttaggaagccgataccgtgttggttaaggtttctatcttgtaatcctgccccccaccctatataaggtgggcaggaggccctctagggggca

SEQ ID NO: 3242 - DNA, 1501 bp, Oryza sativa
tcaagcaaccctccacttttgaaaggaattggaaccattattcagttcctaaattcagacaaagcaccatcaccatagctgatgggcaagatgcctagactattcattcatgtgtccatgcatgtctatttttcccaacccctcccccatcccaacttcctgctctagccatcattaatggcgcataattcctactcgtttttttcatggtggtagctagagcaaaagagaggatggaataggttagaacattgattgattgatctcatgacctagcaggggtggagcaatgctacaagtcacctacaccttgcccgtacttgcgctgaagccatcgtggtggggtttattcatgaactctggtccaatcaataaagtagaaaacctggtgttaagtaaaaacatgggcacgacttgatcgatccattagttgtgtgtaacatttgtcaatatatttttagttcaaagtgaaatgtgtactccaaactatatacctaaagcgaacatttatgatcaaatactaaggtcttaattagagattttatccaccattatttccatggatctcaagagttttgctaaatttatggctaaatatatagttttcaacattgctatccccttttctaaaatttaagatgttttagtttttgctgtaagtcagtttttttaagtttgactccaaaacaaccgcatcttacattttgaaacagaggaagtataacttgattaatttatttatagttttgtgaaagtttgcgccgttttactaaatttactccatgtcaacaaccacaaattctatccctcacatgaatatataaacacagccatgcatgcatgcacataaccaaagataatcaaagctggaaaggcaaaggcctgaccttgtaggctcctattcattttcaataattcatttattcacacttgttaattggcagagaattcacaagtcccatcaatcctggagattccccagttatgggagagctagctagctcagcccaaaagggagcatatgtagcctatagccagcaggcagctagacaagacatgcatgcatgcacgcacaatattactaccaacaacaacataacatgcagctagcagagatggacgaatggatgcttcttcccccggtgcgcggctttacttgggccccaactcaactggcctagctcatcacctaagctccagtgcatcaccaaaccctatataaaagcccgcgccacctccccttccaaacccaagcctccatccatccatccattcatcagagctcaagctcaagcaagcaagcttgctagctagctgctgagcagcattccagtctgctccagctagctcagctctctctgctctgctctttgctcgataacgaccatcatcttcttcttcttcttcttcttcttcttcttcttcttcttgtacattctatttgctcgatagatagatagatagatagataggtagatagagatggagacgaaggcggcgg

SEQ ID NO: 3243 - DNA, 1501 bp, Oryza sativa
attagcactcctaaaacctacatgcaaatatgtcacatgaactaattaagcacacaaagttcaacatacaacatgcaagtatatactccctccttccctaaatatttgacgccgttgacttttttaaacatgtttggctgttcgtcttattcaaaaacttttgtgaaatatgtaaaactatatgtatacattaaagtatatttaacaatgaatcaaatgataggaaaagaattaataattacttcaaatttttgaataagacgaacggtctaacatgtctaaaaaagtcaacggcgtcaaaaattttgggatggagggagtagtaattatatctacaatttatttcattctaaaattaaacatacacatggtaaatcatcattctcaaattatttttataatatttgaattcaaatcatttgatcatttcttcaacatttcttcaatatctctagtgcttatgaggacaattgcccctcttctgcttcccttacaaattaggaaaaagtacaccgaaggtcccttaacttgtcatcgagttataaaatcattccccaaccacaaaaccagatatccggcatcacttaactaatcaaatccggtcacaataggtccttcggtggttttgacaccggttttgtactacgtggcggctgaatcagcatgagacccacgtggccccacatgtcaggatgccacgtcatctctcttacccctcctctccattactcctctctcttctcttctcttctctcggacgcgaatggcgtctgcgtcgccgccgctagtgaagcggccctacgcgggtgggcgccgcggcattgggcacgcaggcggaggcggggccgggcaccacggcggtggccgcagaggtagaggcgggagtccggcggtcggcgacgggcgatgaggcggcggttgggggaggaggccggtggggcaaagcgggagaggaagcggttgggatgatgccgatggcgccgcggttgatgaggtcgacgacgggctctagcttccacaagtcctcgccgccccacttgtcggtggaagctcgccaagcatgcggttatggcacagtgccccggtgcggcgggcgtggcggagcggtggatggcgccgtcctcgatgtggcactagtctgggcttgcctctgagttgcggtggcggcctccgccgcggccagcatcctcgcgctcctcggcgcacccctcccctgcacctgcgctcgcccccacctcccctgcctcctcgacttcctctccgactacccctcctctaccctctcccgtctcgtcgagtattgttggtatttcttaacgacattactagaaatatattttccagcaatggcgcagaaatacttctggtatattatggttacagagttcatccccaatcgcacggatataccattgtagcatttcacccgagagtattccaaggatatcgtatttattttatcccgtgggaagatcatgtatagagaactcaactaataatt

SEQ ID NO: 3244 - DNA, 1501 bp, Oryza sativa
tttatgattcgtgcttacagctccgtgagatcaaaatcaacggctccaattatctccatctctctgtctccgtattgaccgttcttctgccttgtcggaaactgcctccatttcttcactacccctccgcgacacaatctccggctgccgcgctagttgattccccctcgccgtcgccggccacctcgccgccgccgccgccgccgccgccggggaggtccctccccacgccgttctctgcgcccccccagatcgaggccttgctcgatcgaagaccttagccggcgcagccgcggaggtggcgcgcggtgcctgattccccacccaaccaaaccctagagcccaaatccggagggcggggatttgcgccgccgcgggctggtgcgagtctcctccagggcgtggtccccctcatggcgcggcggcgcacgtgcgggtgagctcgggccaccaggccatggacgagctcaacctattgcggcagcaccagcaccagcaccagcaccacctggtggtgcgcggcctcggcgaggagatcgacctcgagatcggcccgggcgacgacccctccttccccggcgcggccctcgtcggcgtcacccccggcgcgcacgaccccgcggacgaccacaagagcctcctcatcccgtgctcgcagcccgtcgccgaggggcagccgcagccgacgccgccgcaggtggaggagcacgacgggctgctacggctgccggggcaaaccaagaagaagaagaaggtggtgaagaaatggagggaggagtgggcggacacctacaagtgggcctacgtcgccgtgcacgacaacaccagcaggatcttctgcaccgtgtgcaaggagtacgggcggaagcaccgccggaatccctacgggaacgaggggagcaggaacatgcagatgagcgcgctggaggagcacaacaacagcttgctgcacaaggaggcgctgcggttgcagacggcgtccaaggagaacgcgcagccccctgagatcgagaggccggtatatgtcaaaggttggtgttgttgcctcaagccctgtgattatgctgcgagttcgcctgtggtcttctataagaataggggatgtgtaccaaatccgtgcttacaattagtactatggtggtgtttagttgtttggcaaaatgtcattttactgattttaacagtgaaaaatgtactgggtgaaatagataacatgacttttgatgcatagtttgggcatatgttgttacatttatctatgactttgatattcgtcacttcatcccatcctgacagttcatggaggtaaagtgtgtctgtgctccgtgcaagaaaaggaatatagtgtaaataataagttgaagcaatttccagttctccactaaactgaagatgcttggcattcccttgcattttaactcctttatcagcgaatgcactccattttctattaatttggaagaagttaaccatatatttataaaagtacttaccttaactt

SEQ ID NO: 3245 - DNA, 1501 bp, Oryza sativa
ggcgaaggggtaagtcctacgttcggccggccctaccaattgtatcgactacattggtattgttcaaagctacatcgcttcgacctcttggatcgctctggtttggttggtatacttgcatacatatttatcatatatcttagtaatctagttagcatcttaatttacttttgtatcagctgagattcgttttagggtttatgctgtatcggctaaattatcttgctaaattatattagctaagatatcaccaccctaaaaattagtcaaaatagactttatacttctttgcatactttgcgatgcatcatccatcgccaaagttgggcagagcaaggcgatcagtgtgtgttgggtcgtctcctatatatacagctaggcaggtgattgacaaatagctaatccttgttacatcgagaaagccagtccaattaagggggaaaaacacgaatattagagaaggatgtaatatcaaataaataaaatggatgaggcttcgaaaccaggctagctagcccaccatcttattaattaagctagccggaagacccctgcgtgtttctcaattaaggagagaaaaatgctacttcttcagttaactgtttttcctactctcttgcaaatttagtttataagccaactatttttctttttctctgttttctccgtgatcagagaatcattcaatcattcattttcgatgtgcatgttccattgttcctagatcttgatccacggatgaatgatccatactgttactgatcagtagggctttctgcatgtgtcgcgccctttcgaaccgtcgaaccgtccaattaatgtgctccaaggctgacaaatggtgtcttttgccgagctgcatagtctcgactggacacatatatattcatcagtatgttacatacatcattggattagtggtttcgggaatgtttttgcaaatacacatttcgccaaattctgatctgacgatccagcagcgcagatagatccacggatgcttccacaaaatattccattcctgcagtatatccagatctcaacaaaacgcaggtcgatcatcagtgtccactgaacaaaagcacatgccatgcatatacttgcttcatcgtaggcttagcagctcgctacagtgttgaccctacaatttttagaatcatgggttttcgcagcaacgttaattaagggcttcttggcagtagcagaggtagcaccgccgttgagtagaggtgataatagcattgtggagattatgggtaccccatacccacacggcatggttatccgactagtaataggggataacatatatgtatggaatatgtaacagatcatgacttgggtattacgtttccttttatattatggagcggcctaaagtcctgatttgataatattgtaaagtagatttaggaagccgataccgtgttggttaaggtttctatcttgtaatcctgccccccaccctatataaggtgggcaggaggccctctagggggca

SEQ ID NO: 3246 - DNA, 1501 bp, Oryza sativa
aataaaacaaaaaactcaaaagttcaaaaaactttaaaatatgtatatcatggtgaaactctcatatctaggaagtgggaggacactacctagctagtccttattcaaaattcagttagcgatgtgaatttaacagaaaaaaaaataatttactccccctaactatttcattttatcacttaaccccctaaactatttttaagcttattttagctcttgaaatgttaaaaatagttcaattgactggttaattacatttatcttctttatttctctttatacaagtcatattttaagcttaaattttgtaaagtcatatatgacaccattatcgaagttccaaaatagtttaaaaatttttcatgactttttgcttgaaatttaaaacctctgttcttaaattagtctcagtgcttctaacctatataagcagcgatttaaaaactcaaaaaatattgagaggtaagttataatgcatatatcaatcctatcaaatttcattgcaaaatatgacctatatagagagagaaacgaaaaagacaaatattgttagagagtaaggtgtgaaccatttttaatagtgtgggggtgtcaaaattaaatgagtcgagaaattgtctaaggggttaagtgctccaagggaaaaagttagaaagagcaaaatggacttttttttcttattaagttataatagccttcttctgatttctctctttttagagccacaactgatcgacagcattgctcaataatacaacaaacgtatactaattgtatctgctaatgatctgcacctagcaagtgcatgtgaaaaattggaaaagttggacagaacaacaagatcaaccagtgatcccctgcctctgtctatcagtatttatatatctagttttgcattattgtgagatcactagtgggcatgagatgagagggcccatgcatatgtacacaaacagaatgcagctgccgtagtagctgaagctcctggaacattccccactagagaggggaaaccccaacttcaattcctcaccaatctcatctcatctcatactagtactacactttatctcccccagttgatgctgctcacttttcttagtttccacgtcgcagtttctcttctctcctctgacccctttgtgaccgtccaacgacaacgcatggaggccgggttagcttagcttaattaagtgctcctacctgctgatctgatctgatcactttcttgtgtgtgcccttatgactgacagatcgatcatatagtctgaatatatataattaggattgttatatgcataggtttgcattattgtacccatttcctgcccccaccaccatttgcatgtgtgcagcagaaacatcctgcataaacagggattagaacgtagtgcaagtccctttcgacgctaattaatgatgagtggttaagttaatttgatggtgtttgtgcatgcccccgtcttggcgcctataaaagggtgagatcgcaagtccacga

SEQ ID NO: 3247 - DNA, 1501 bp, Oryza sativa
cctcgttgtcctcctcggtgcccaccacgacgacgcggaaggggccctcgtggcagtcgaggtggtcgcagccggcggcggcggcggcgcagagcaccgcggcgttgtagtacaagaggtacgggacgtcggggcggggaagccgccgcagcaggtggcccgtcatggggtgccacacgacgaggtcgatcctggaggggtaggcgtcgaggagggcgcagccatggcggcagtcgagggccatcccgcagtggagctcgggtggcggcggggggatcgggagggcggtggtggggacgaagcggtcggggtggtcggcgttgtcgaggttgtggaggaaacccagcaggggaggcggcgcgcggcgtcggcggcggaggaggaaggcccggtcggagaggaggcggcgccagcgcttgcagacggcggaggcgcgggcgaggcaggcgggctcgtcgggggggaggcggaggaggatctcgtcgacgaggtcgtccatcagctccggcggattcatccttctccggctcgccgcctcgccggcttctgcgtttggggttcagagtagaaatttgggattatctcaccagaaggaaatggaatttaccattctcaatcaacttaacagaatagtacattttctcctcctatcctaatacattattatatgattattttataaatatatttatagatccatgtttttctaaaagaataatcaaattgttttagactctaaattacctgccgttgtatagtgttatagttagacagtaaatttcaaaacttacgctataaaacaatatttgcattgtaatttttctaacacacaatgtacaaatgaattaggattgaaagtaatttactactaccttcctttcatgttataagattttctagcattcccacatttatatagatattaatgaatctaggcacacatatacatctagatttattaatatatatatatatgaatgtgggcaatgctagaaagtcttataatatgaaggaggaaatacatgcttggaagagaagatacgagatagaaacatacttgcataacatataagagagaatacccacgtaggaaaaacataactgaaattaagtaaaaaaaaaaaagacgatctacttgccatggcgatgatgacgaaaagatgccacatgacccacacctctctttttttcctacacaccttactctcactgtacttcacatcatcctaccctcaccgtacttttagagtatctccaacaacatctccatatcaaactctccaaacacccatataaccaactctccatctgatttagctagtcaaactagttactcgctccaacagcctctccatctaccatctccattataagtctatgacaaatgggacccatgtcagtctctgctaaccttcttccttctcttccaccacatttttccccacccatacatctctcttcttcctcatgtactgctgcctcctccccacgccctctacct

SEQ ID NO: 3248 - DNA, 527 bp, Oryza sativa
cccccccccccccccacccacgtcgccgtccccacgcaatcaaaccgccacggatcaatcaccccccgccccgtccgtacgtctgcgtctgcagccttccgtttcgttttcccattttccccctccctccctccctctgcgactctgccagtgcattgcctatctctatatatccatccacccatctcatcttttgtctctttctgctgctggagtagtattgttcatttatacatgcgataaatatcgagattaagcggaaactaaacatatataccctcgaatgaattaatgaactgaatccgtaaaatatgtatggtagatcggtagtacgtgtttgttccttttttttatataaaaaaaataatttgctggtgtttgatgatgcgaaggattgcattacattgatgatccaataattcgctcacgacgaaaccgcataattgcatttgtggttttgtttctcctcctcggctcctccctatatatgagctcgccactgctgccgcttctcctcgtcctgtaca

SEQ ID NO: 3249 - DNA, 1501 bp, Oryza sativa
ggtgggtggcgagccatggctgtctatgggcggcgagagggcgaggtgatgcccacggtggcggacgggcatggatgtgtgcggacggcaagagggaaaggcagtgatggcgagtggtgagccatggctgtccgcatgcggtgacagggcgaggcgacgccggcggtggcggacaatggctgtgtgcgggcggcgagagcaccgttgtcgatgagctcttccttcaaatcttgttcctcctcgtcagcgatgcccatgaaatcggcaaggagtagcttgggcttgccagtaggatggggagtctgcttggggtgattgggctcgtcgatggcttcatgcccacgaggctaccgattcactccccaactagagctcggcgaccccagggggaggagcatcttcggcactcctcaaccgagatggagaagcacaaggttgacgatgcgtcgtgggaggggatcaccggcgcgcagagagagagagagggagagagggagagagaggggagaggagggagaggaggaaaccaccagccccatcctcgatggtccggagtccttgctctctctttatcgcaccatccttaggtggtgtttggatccaaggactaaactttaatccctgtcacatcggatgtttggatactaatttggagtattaaacataaattacttataaaactaattacataaatgagagctaattcgtatgacaaattttttaagcctaattaatccataattagcatatatttattgcagcatcacataggctaatcatgtattaattaggctcactagattcgtctcgcaaattagtccagagttatggaatgtgttttgttaatagtctatgtttaatacttataaaatctaattccttgttggctgggaagaagaagatagggtaggctaggggaatttcgaccatacgaaaatacagtacagataaaatgagataaaacaagtcttctcaatttcttatttttattttctgatgttttttattttaaaatttcctcaatttgataatgtattgaaaccgggaaatattatcatctctattggtgttcttttgagccgcgctcagaatttcaaaccaggaaatatgctcatggcatcgctgctatcaccggcgtcctgcacatgggctgggccataatcggcctatccccagagatatgatggccagggaatcatggccgggcttgccaaataaggcctgaatacatcagaaagagagaactaagaaacgaaacgaattcacagataccttggcaatcgagttggagtctcctcgtgtagccaaacttgaaatccgccatgcgatcgaggatatgcatctcgatttactcacttagtccatagtctaatcctatcatcagctcatcattaatttcgatcgaggaaatgtatcgatctttcgaccggtttaacttctcagttcccaccgctacattactaaacataaacagtggcaccgcaaaacatttcctcatctg

SEQ ID NO: 3250 - DNA, 1501 bp, Oryza sativa
acgtgcattgcacgtgcacgattactagtactattcaaaactatcaaatgataggtagggcaagaattggccccaatccaaacaggccataagttgtcttacgatctagattaagttttaggtgttcgcatttataattctgacacaattcaacactcattttcccatgcgtttggcatatatccaattgtttttcagtgtcttttgataccacttgtttttcttcatccttgtcaccaaaataggagtatcccacaatattcccatttgaatcttcgatggtatcatggttatttcaaggtagctttaatttaatttaagtcactcctctaaactttgagcttttaggctattaacatcgtactcatatatacatcgtcacataacatatctctattgacggaaataaaaatttttacgtgaccgcgtgcttctcacggttaccaattgagttgagtgagaattttttttaagcaactgggaaactataggcctcatcttttctcttatacttatacttatcaaccaaaatttaaaatttcaaccttaaattcagagttgattttgaattttttttaaactttattttttaagatcgctaggaacacacaaataaaatttttattcacaaattattactccctccatcccaaaaaaaagagaaaccctggtttccatgcccaacgtttgaccttccgtcttatttaaaaaaattatgaaaaaaaaataaaaaagacaagtcacgcataaaatattaatcatgttttatcatctcacaacaatgaaaatacgaattataaaaaatttttatataagacggacagtcaaagatcgacacggaaaccaatgtttacctatttttgggatggttggagtactcgtttgcaaatatgcaaacgatggagccatcattacggtttcctaaacctaaactaattacccacaaacggcctcacataggtttctaattggcccaattaccacaggcccacacccttttcttcacgcgtatttgcagtctcgcagagagaacgaacaaacagagggaaaactaaaaaaaaaaaaaaggaatcctgagaaaattgaggaaagtgaagcaaagcgagacggagtcgtgggaaatatcgactccgcccgcggtggtcgtcgcgtcgccgtctcatcacatctcccccccctcctctcttcttcctcccctcccacggcgactcgccgccgccgccgacgccgacgccgatccggtctccgctccaactccggcgaggtaagcatctcccaacacggtcgcgcctcccaatcatccgatgcggccgatttccacggctcgttcggaaatcggaatctgattccccccaccttgttgtgcgaatcgatcgcttctcagattggatttgggggcggagccgatccgatcggggtccatcgcacggaggaggaggaggagggggtgactcgccgtcgcgcggccagatctgcggcggctgcgcggggggaggcgcca

SEQ ID NO: 3251 - DNA, 1501 bp, Oryza sativa
gcggcggatccgggggcggccgaagctgccacaccggaaccggaggggttccaggtccaggcctcctccttacgagccactcggtctgcgagctgaaaaagctccgcggtagtctggggctctttggaagcgatcttttcgagcatgcggttgtgccgcacgccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcctcacgtccatgtcgaggtgacactctggacgaagaggcgtcctccgttgcgcggggagtacgccggctattacgccggcgctcgatgttgaggcgggcatccggctccccatgctgatcctcccgagtcgaaggtgtcgacgagggagtggcagccgaatgacgtgcagccgccgccgctcgccgcgccctccgccttgacgacacggagccggtggtagcggcgccggaggtcttggtggtggcggaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcggcgctccccatcttgccgtcctcctgcaccacctgcaactggtgatgccacggatttgtcgaccttctcaagcgcctccccctgcttagggctttggcgcagaggaggtgggggagtacgagctcgacggcgtggattcggctccccgtcgtcgccgctcacactcggagagaggtcgtgcgcttctccttgctcggccattaggctgaacaagaaaaacttggcgcccacggaagagtctgagagctcagaaaacacacgctgagccccctacctggcgcgccagatgacggagctcgtggctcctcaccgggagaccgcgcaggcccccctttgccggttcggccgggggcttagggtgagatctcaagctctcgctgtgtgtggaaagatcgcgtgccaggaagaaacacgagacacggacgatgtatacaggttcgggccgctgggaa

SEQ ID NO: 3252 - DNA, 794 bp, Oryza sativa
ttttgactgacaaatgggtcccgttaaaaatttttcctttttctttttttcttctctttttttccctttcttctcctttctctatgacccgagcagaagaaaggaaaaaaaaagaagaataagaagaaaacgaagaaaaataaaaagaaaagaagaaaaaaaaagaaaatggcacgtcatccatgtggcatgccacatcagcgccacgtaggatcctagaggggatgtgtcgatttgggacctagatgatacacttttacaagttctgggacctggatatgcattttgagagtttagggacctatatgagacaaccatacaagtttaaggaccgccaatgcactttactcttcattttttgccggatgaaactgtggattccgttaaacttaaatttctggtaatggaatcgggggaggggtctcctcccttgctcaaaagaaaagaaggcatagtgagataagacgtgctaaatcgtattagacaatgccctttactagcgtgtcattcaaaagaaaatgtgtataaaattgtacgacctgttattatctaggaaattggggtttgttttgtgctttatgaaaaaaaatcatgattaactgctggtgccttatcgacatgtaatggaagcttgagtgatacacagtaagataatatgttctgaggtagataatatgttctatctagtataagagaatcaaagtgggtggaattgtgcaccatctgtatctgctagatagaaaaaaaaatttaacttacattattctttcccttttcttgtctgtcatgtaagc

SEQ ID NO: 3253 - DNA, 1106 bp, Oryza sativa
gatccgagccgttggctcaacccctctcgtgctcccctttgtaccggtgaactccctctcgatcgaatcgctgcgtcgtgctccagtgaaaccccgccgtcggccaccgttggttggagctcctgttcttcttcctcctctctcccggcccgcgtggctgccacgtaggcgccacgtcggcgccacctcgacgcgaccgggtcaaagctgacctcggtcagccgcctccctccgtcccccaccctcgcgcgcggtccacggagagccaacatgctgcgcgtgggcccgccgcacaccgcgtccacccgcgggccgcgcgtggaccgcttcccccccgaaccctagcgccaccctcgcatgcgcccatcccaccgtgggccgtatcaccgacaagtgggccccaccgggaccccgcgcggtggaatcggtccaccgggccgtctctctctcccccgcgccccctctgttgggccgcctccccgtggccgcgcccggcccaatggctcggccgagcctccttcaaccctttgggccgcaccaatgccacccgagaaaagtccaaatcacatccctcatccctttaattttccaagggatttaataaatccttttcctttgtttcataaataaaattctttattccaaaattctatgaatcattttcctttggtcccgcacgtcagtgactgtcaataatattcttgagaatattatttctataaattccataaaccatttctcgtcttccagaaattccaattaaacttccaaaattcatatcttcccaaccgctcttccgattgactccgttcaacttctagtaattccgtaaaattgagatctatttaatggcactattattcagtctaaatagggtctttttcttggtcttttgtttaggtttttgtttgtttgcgtatagttgcggttaccggattttcgccgatcgcgggttttctcgaagattcgtgaagctccgtgaagaccttgagcaaggcaagtcaccccttcaaccaattgctcctataattggaaaatcattattattttgtttgcaacttgcattattagaatcacacacttaacttgcttggcctcggtttgcg

SEQ ID NO: 3254 - DNA, 1501 bp, Oryza sativa
ctgtcacgcccaccacttacctggaaaagacataaacaacacttgttggaacaaaagagcaatcttattaaaggacagcatgccacagtagattatgccagcataaagtcatttaatgttgcctaaaaggtagtacaccaaatatctgaagaaagcacatgttttaatcagtctgaaatttggtatgggcgttttgggtaataatattcctgcgtactgggaaaaacttttcatatgaatatacaaaaataccccttatgtgcatggataagagagtaacgcgaaattagcagtaaatggaaaacaaatggcttactgtgcactggtaccatgcatattcttctcctaatggacctgaaaaaagtacatgagatcttaatgcttgaaatgcaaatggagattcaggatgagtggttgaattgcacctttattggacacctttacagttttgaattgcacctcttccggattcttgacatatactcttcgagggtcaatacttacaacaactgcctaataagagaaatatcatcactgcaattagtgattgacaggttaataactataatagtaggacatgaatagatatatggtataccaatgactaaggtgaatgctatataacaaggttgaacataagtaatcacaccaagtatcttgagcaaatgcagaagatacattatatgtttttattcaaaaaacttatcagtcaccaattcaatataaatagcagagttcccaacaatggatacacctctgaaattagtggcacatggatggaagaacaaaaacttttttgtgatattttttaggaagaaaaaaaggaggaatgttttccatatattatgaagattagctgctaacatgaatactaaaaataatgttttggttgtatacggtaataaacaaattgtaactggatttctcgtggaaaacctggttgccatatactctagagatttgctccaagctgctttttcctgtctttacctgatacacaaaaagaactgtataattgggaaatagatgaagattgtatggaaaaataaaatacatacaccagtctgcaaataggcttcagcagcaaaaacggcatcactaccaattgaaatcttgtcagcaccagacctgaagtactctgacgctacttccaaacttgagtagtatctgacaagggaagaatacataattactctgtctgtccttttccttctcagtattgactattgacaaacaacaaataacacctcaaaaagatgggggagaggcacttaaggttgtaagattgaacatcagaacataaatatgcagagttgcagggaaaaaaacgaaaaagaaataaaataacaggctatcttaattcctaagaaagatcgaatacaaaaaaaaaaaagtctgcctagagaaggaaaaggtactttgggaatcatttgcagaaaaaactatctcatcaagtcagtaagagaagggattgcttggcagaaaaacatttcgatccatg

SEQ ID NO: 3255 - DNA, 1501 bp, Oryza sativa
gtactcacaatgtttcactatgtatagatctaatattgcagtgaactgaaatattccattgcaaccaaaaatccgcatattttggaaaccccctattaagggaattcgttttatttttttgttccactgaaaaatgtttcacctagtgtacttataatgtttttctatgtatggatcaaatgttgcagtgaactgaaacattctttcgctatttgttgaaaattgtttttatataaggtgaaacaacacccgatttaaatgagtgaaacattttttatctacttagtgaaacaattccgatatacctggtgaaacatcgtgcaatatttaaaaataattcagtaataagctaaaaaaaacttccgtcggaatatatccatgtgtggtcttgttttaaagatttaattgcaacgaatttaatggtgcaatcggatcatgatttgaataagtaatttaagagaaaaattagtttaaagtaattttgcacgtaaatcgggcgctgacgtaatgctgatgtcagcgcccgatttccccggccccggatcgggtgaccgatccgtaggcgcgtccgaacaaagttgcagtgcatagccctacaatataattgtaggcttcaagtgcatgaaatgatatttagaaaatccaatttctatatttaagtatattgcgtctctcatatgtatctcctacttattgacattatttcttatttttcttgtgtgttaaataaatgcatgatatttattgtacaagatatatagtttaccgtgtaaatacatgccggaaatttaattaatttttataagaattttgacacaatataaatatagatagtcccactcttaactaataaatagggacttaatatattctctctttcactttcgaaggccaaaagaatatatacgatcgaaaactggacgcacatacttaatttatattcttataatcatattttgcacctgcacatacctaatatatattctcttaactaaacagggagtaccaatcacgtgaacgctggggcgctcgcctcttctactgctatacgcatatctatatacatctctaccaaaccatttaaagtttggagataaactaccgtacttggtgataagctctcatctcatcttggaaaccatatactactaagagcaccgtacatggttatacctcttcttatttattaaaggagatctacatccgacttcatatattatatatacgaatctgctatatatatatccgcctgcactgcatgcgcaagatcgatacccgcaacaacaatggcgcaggtcgaggacgacggcgcgaggagcttcaacctgcacgtccgcatcgagcgtccgaagtacgagcgcccgatctacgaaggctctgaaatccgtgtttctagcgacgtctggccgtcgcgctgcgtgctgcacgcgtacgtcggcggcgagcacctgggatggtgcaggcttcccgagggccgcgaccaccctctccgcgtagaagg

SEQ ID NO: 3256 - DNA, 1501 bp, Oryza sativa
atccgcttacactcgggaagcctagtctatgatgcccacagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttcccaagccgacccagggatacctcatgccacatagaaggatcaaatcctcacataaacataggccattttaggcgttcacaaatccaactccaaccacctcgatcggtaattcaacaagcttctcgttcttgcattaccaggaacccggtttggctccaaccgaccccgccccggtgttcccaactattggcatgcgaggtttccctgaaccgactagttacttagccatggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacgcgctcagagagcacgaataccgaggtaccacaagggtggagcgacaaggaatcagggtagtacgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagagaacccgcgatcaacgaaaaccgataaccgcaactatacgcaaacaatcgaaaacctaaacaaaagaccaaaagaaatatcctatttagacctattagtagtgccattaaatagatctcaattttacggaattactggaagtggaacggaggcgatcggagctacggatcgagggatatgaattttggaggtctaaatggatttcctggacaaggaaaaggaattattaattcccttggaaaagaaaaggaaggagggatcggatttagacttcctcgggcgacttaggcgcggcccgagggattctcaaggcttggccggccattgggccgagcgcggccacggggaagcggcccattagggcgcgcggggagagggggaggcccgacggggtgggcgcggtcctccgcgcggggtcccgagatgggcccacatgggggcggtcgggtgtatggtgggg

SEQ ID NO: 3257 - DNA, 1501 bp, Oryza sativa
ggggaggattggtgaggagtagcaagcgtggttcttttttcgggtgtgaggaaaccgggactttaataggatgcacaaaacttgcaaagacacgggactcacctccttttctcctccacgtcaaggtttggcgtagctagaccgacgaggttactcgccacgcaagcgccctgtgaagggcctcatgctagcaatagttgcagtggtaaagcttcaaaccaagaaagagaccaagagaaacactacctctacaaatttgataaggtattttgacagttagtaaatcaaaaacacatatacttctttcatagtcagaaaccaaaccttgcattccattacattaattagttaatcaagaccaacaaaccacacgttacaaagtagagccagatacattttacatccctgacaactgcatgcatacgtagttgcataccactgctgactactgctcgatggcagaagctttagccagtactccagcagctagccatgcatgctcttccctctctctcagactctcactacataacaaattaagctacagctatcaaggtagatgcttccaatatccaaagccgtagaccacattcagatatgtatacgtaaatacacatatatagcacacataatatgcatatctcgtactcttgttatctttacgtgcttgttgtttgttgacacacattcatttctccgtacgtcatgtctgcggcccgttggctctgcatgcacaaatgcattatataaaatcatgagagacacctcgatcactactagaaaaatgatgtttcataatattggcttattatttttattggtggaaaaatttaaaaaccaccagcaaactcgtaacgagagggtgaggggcaccgaccatcagcaaaatgaattttcactagcgacctatctaatgcagccgccagcgaaaatatgtcatttttttcgatcgatcgaaatcgaaggcgatatgatcgatcgctgatcgatcttgcgtcagtaatttttacctgctctggcgcctgttcgtgttgccgtcgttgttcttgtccctgccattgccgttgccgttgccgctgccgcggccggcgccggcgccggtgccggggtagccgtagtttccggactcgatgctgccgcagtcgtcgacgaggaggtcgaagtggcgcctcacgtcgtccgccgtcttccccccgccgaccaccgccgccacgcgctcccaccggcccggcgtgtcgcggtcgtacatggccagcgcctgctcgaacctcgcgttctccgccctgctccaatccatgtacacacacacgcaaacccttcttctttctactcctcttctcgccggccgaccgatcgtttgtacgctcactgctcagtgctctagcttgctggctgctgctgcttccaagcgagcactcgactgagccatatttataggggagtgtaagctatctaattagcctcttagctagtttgtcgcgagctgctgcaaatggtagtg

SEQ ID NO: 3258 - DNA, 1501 bp, Oryza sativa
taaaaattaaagtgtgataattattatcaatctgatggttataacacattataaatattgtttaagtactttttaccgtctacatttatatgtttgtttagacgatttaaaattgccgatgagttataataagtcaacttgtaatttatatataactagcaaattgtttgtgcgttactacggtttataaaagaacaatgatacgattgaagaccttttgctaaccttgtgcacagtgtaggaagaacattaggaattttcagagttgcaacaagtgccaaaccctaagttgacacccttgcttgtggaattcaagttgcatcaccggaagcttgggtttaaaagaaactgacatggatgggtttggaacattcaaagagtcacgaaccggtttcataattgcaaacctaggttaatgggcaataaaccgattgaaatcagagaggaatattttctcaataatagaaagccagctaaactgaattgtgttcattgtgttgaactgatccagcaatgggaccgacggcggttcaccggcatcgacgatggaggaggccatgacaggggcaggggcggaggtaggcctagggtagttatggcttgactccaaaatcatgttgaaatttcttaaactagctgggtggcccacgcaattgcgtagctagcacataacaatcatatattttttaagtatgattttacttaaaatttattaaatagatgtctcattgttaagactttaaaagaccaaatcttatcatcctcatgtttttaattatatagtttttaaaaattacaccaattgctaccccttatgtcatctccttctttatttgcttgctcgatctatcactatttctattcattcttcttggaacctttaaaaattggatttttacagtttttcgagtttattgtcacgttgggtttcgtttttataatttctagatgtctcgtcaaatgttgccattatactcctctatgtctcgtccactatctcttctctttattgtcattgagattttaaaaatcgaacgtaattatagtttaggttcatttttaatttctagaagtcccgccaaaccgtcagcggttttgccattgtactcctctacggctcgcccgctgtcttccttctttattgtcattgagattttaaaatcgaacatgattattattgtttttttttactttttagaagttctaacattggacttgtagtttcattttttattatttttagaagtcccatcaaacgatgtcactatatccctctgcagcccatccgccgcccactctttattgtcattgtgattctaaaattcgaacataactatcgttgcaattcattttttattttctagaagtcccgtcaaccgttggaggctctgcaactatactcttatacaccccgcccgctgcttctcctttttattattgtcattgagattttaaaaatcgaaaatgattatcaatatgttttttcttttttactttctag

SEQ ID NO: 3259 - DNA, 1304 bp, Oryza sativa
tctcccccatctgccatcacgcccgctcgactacttgagagaatcaacgacagaagagaagagaaaaaaaaagaaaagtgaaatgtggggcccacaccattttctctcacttacatgtgggccccacatatcaattttattattttcctgactaggatgtcacgtcaacgaaaccaggcatctatactgtcccgggaccttttttttttacgattttacatagtttagaagtatacatttctggtattgcagttaggggaccttatacagacttgacgtaaagttgagggatggccggtgaacttattccaaaactttacagccgttttagcatgtaaattaaccgcagatggggcacaaatttttatccgtccgatatcgaacctcgcagcctcgactgccgtcgagcccgctactccgtgacgctccgtgctctgccccgccgccaccgcacaccactctccgcttcgtttcgttgttgccgctgagtcgccacgtttgcgccgccccatcgccggcgccgccgcgatccgttccgcaaccatctctactactctgcgccacttatgcaaaccggcctcgatcctcaccaccatctgctgcaccagcgtcggttcacgccgggtccgttgtctacccaccttcgctatccataagggaaggaagagctgatacaagcggagagggaatctagggcgagaacgatctgcgccgtcgcctcatactcaccggtccatactctgcctccgaccctttatctctcgtcccagcttctcctttctctgtacattcagcccacatcattggctcattgcttcaacaccctgcgagagattcggcttgcctaggctccgtatcgatatggctttgtgattcagatttgggtctattcatctttttccccttcgccatgttcgttctgtttcagagttcgtttttgttgcaatgactagccagatagatgtcttacccttaccaaatacccaaacggcctgaaaatttttgactgtatgaatcctcggtgttcccaagaataaaagtgaaaatattttacaggtgaaaaaaaaactgtattcccaagaaaatcttccttcaagaactgttggtaaaaggaaatgtgcgaatgaaaattcatttgcagctggaaaatttctgttgtctcagcaatagtttcaagaaaaatctaggtcgctgctcggtgaacccgtcgatttgttcagcttaaggaaagaaaacgataagtgacagaacatggcttcaaatttcaagtcttgcaatatctgacagttctacttctaacttgt

SEQ ID NO: 3260 - DNA, 1501 bp, Oryza sativa
gctagtcaagcacagaacctctagccgacaacgactagtcgtcagaactctgaagaccactcgccgatgcatgctacagagaggctgacgaatgacaatgtccaagttgaatcaaatccactgccaccatcaccacagaaacaatatatagagattagagcctattcccttgatgccaatatgctacctggtgcgtgattatctcaggtgtgcaaccccaaagcagcttagcattcatccacttgggctagctgtgttttgtgcagtttttagtgtacataatgctggaggaggaatcatctatggcccccctcttttgtgcacttgtgctagacgttccatattaacaaatgaaattattccttatcatttgctttttgttcatgatctccaaacaagtgattttctaattcctctgagggacctaaagcctggtgcagtatgcatgtatattggtgttgggcataaagtctggctgtcaacttgactatttttcttatctgatggaacctaaatgtgctagactgatagtcatgggccatgccaaatatgtgagatcatatatgattggctcatctcttttcaatataaggtaaaagagatccagagtgcaaatctagcttgttggagcttttgctttaattactctgcgcctaagaaaagtgaaaaattcttttcagagaaaggggggaaaattccagactatccagttcctgaacaatgtacctgcatatatgttctagtggaagcatttttcaggccgactgctcacagctatctctttgtgttaatgttgatccacataacagcgtcaaataacaacacatacagttaaataaatattgctgtatttacgagtaaatagtatcttcagcactcaaaatgacactcgtgtttcagcaagtaaaaaaacatatgtcaaagtacatgtgcatgcattatctacctttcagaatcacccaagtataactggattttatacctcactaaccccggcacataaactaattaatctgtcgactgatgcaaaatggaatcgatccggcttatgtggcgaccaattaactccctggaacttaaaaaaatccaagaggccagcggggggtaaaataatggattgatttgatcgatcatttccatccagctaaattaaagcgtcgatactttcttacgtctgtcgaataaaacgccctccaatcgctcgtcgcggccgctgttgagctattctccgatcctctcgtggcaatggccgccgatcaggctgcatccttgcagcaatttgcagtttaattctcctttccattaagctttcatctttagcaagtcgcctcttaaattagtgcatatatataatctgcactaccatttgcagcagctcgcgacaaactagctaagaggctaattagatagcttacactcccctataaatatggctcagtcgagtgctcgcttggaagcagcagcagccagcaagctagagcactgagcagtgagcgtacaa

SEQ ID NO: 3261 - DNA, 1501 bp, Oryza sativa
tgttcatattctgtaaaatttatatggtaatctatctatctatctatctattatattatattattaaaatagccttgaaaggagacaccacgttcgctgtaggggctagaaattcccacattaatcgaagaaaaagaaaaaaaaaagaaaaggagagtccaagtagaagtacaatctaaaaatagctgaaattcggaattaaaaataagcaatattaaaagaagtttccatataagaacccaatacgagattaatcaaaatttaaaataaaaataaaataaaatccaaaattagaaaaggaatggagagtccaagtagaaatacaatttaaaaatagctaaaattcgaaattaaaaattagcaatattgaaataagtttccatataagaacccaatacgagattaatcaaaattcgaaataaaaataaaataaaagccaaaattagaaaaggaaacgagagtccaagtaggaatataatttaaaaatacctgaatttcggaattaaaaataaggaatattaaaagaatagtccatataagaacccaatacgagattaattaaaattcggaataaaaataaaaataaatcctaaattagcaaaagaaaataaagaagagttcaagtaggaatacaatttaaaattagctgaaattcggaattaaaataagcaatgttaaaagaagaatccatataagaacccaatacgagattaattaaaatttcgaataaaaaaatataataatatccaaaattagaaaaaactaaaagagagctcaagtagaaatacaattttgaaacaaatgaaattgaaaataaaaaataaaaacattaaaagaacacaatacaatattaactatctttttgaaaaaataaattctgaaatagaaaaaaaagatttcaattaggaataaaatttataaataactaaattttgtgacaaaaataaagactattgaaaaaaaaagaccatctaaaacacatgacgagataaattaagtaacaggcctataaaagagtagagttggtggtggttgatacgacttataaaaattgttaataaaacaccaaatagaatcctaatgacgattaaaaggagggacgtcaggcaggccgtgaagcaaacaagtaaagcggttgccgggacttctagaaagtaaaaaagaaaaaacatattgataatcattttcgatttttaaaatctcaatgacaataataaaaaggagaagcagcgggcggggtgtataagagtatagttgcagagcctccaacggttgacgggacttctagaaaataaaaaatgaattgcaacgatagttatgttcgaattttagaatcacaatgacaataaagagtgggcggcggatgggctgcagagggatatagtgacatcgtttgatgggacttctaaaaataataaaaaatgaaactacaagtccaatgttagaacttctaaaaagtaaaaaaaaacaataataatcatgttcgattttaaaatctcaa

SEQ ID NO: 3262 - DNA, 1501 bp, Oryza sativa
aggcctgtgttggaatgaccaattgcagtgttccagtgtcatcgaataactttggagatccatgcagtggggtcacaaaaagtctagtggtggaagctgcatgctcctgacaggtttgatagtgctcgttagtaggaaacaaaagtagtttgagggggtgaagcaagaaaaccttctgtgtagaaagcaggcaacaaccaacaaggaataaatgttcccaaatgcaggtggaaaaggaataaataataccaaattgctttggagccttgcaagctgttagatcgtacgtttagattgagttgtacttgttaacatggtgaatctctacaattgtacaaggcaatgaatcttttgtaattcttttgagatatactttgtatttcaatcaaatataaagcacaccttcatctgttgaattgtaagtttgctatctagaaatgcacctgaaactctgatgcacttgtgtgaagaaaagcatctgaaactcttgaagtctgaacagaggtatcttgcacgcagcgccaccttaaggaagtccataagattgctgttctgttgctgcataaataacaaaatgcaaaagtttttactcattgaatagatataccccttgaccccttgtgtgaacagctgaagaatgcactttgctgaaagtcgaaaactttcgtaccccgtgatgtttgcagcattattgtttattgtgaaacacttgcttcagcctgtaaaggtgactttctttggttccctgcaggaccagaatgatccatctttcatcactttccagattgcaatgttctaagaactggttggtttggacacagaagttgctaataatagtagctacggagaagccaaggataacgttagtgttcaatgaccattgatctgcaatgttagcttttaggcatgtgtaaaataggaagctagcagccagcacaactgcacaagcaataacaagacctgtgttcactgaaaggtgaggatgtgaagcatatatctacaaaaaagatacatctaacattgtctataaacaataaattaacttgttccctttagcatcagctaggagtcctacaaccaataccctttgttgaccgaacaaaagcaaggtgcctctgctaacttataatatacttctaccttgcaaacacatatgaccaagttgcgtcatcatcaaaatgagttttaaacatgaaacggcatttgacctaccaataagtgagccgctaaaaaaagcgcccttcacactaaagtactagtgcatctaaaccatatgacaagacacaaagatgtacgacaggtgtaaaccaaacatcagtcaacactcatgaacatgcatcagctaacctgtgaagctagagatatcacacttttgatgtaccgggtgacaagaaaaggttgttgcattctactatcttatgtacaagacaatagcaagtaattgctacagctgccgaacagagaaggatacaacaacaaagctaccagcactgcaagatta

SEQ ID NO: 3263 - DNA, 1501 bp, Oryza sativa
tgaatatgacatcccctcacttgatacaaggtgacaccagagtggatatgaatatggtatctactgctcagaatggaatgcactcttttgatttggtgaatgtgaacctagaaagtggtcctttgccaatggctgcaactgatttcatgcaaatgcatcagcacccacccgtttaccatccaaaacaactcctcaatatgagagatcaggtgatggacacaaataagaggcccaatatggaaacaaacacatactttatgggaggtggaatgcatgtgggatagtttcttgtctagagacccactatgtaatcttttctgtttggaaaggagatgcctttccttattttatattgatatgtatgttcctacagcaggcagcaactaatcaattaggttgtagtaattgcagattaatcttgcagtgctggtagctttgttgttgtatccttctctgttcggcagctgtagcaattacttgctattgtcttgtacataagatagtagaatgcaacaaccttttcttgtcacccggtacatcaaaagtgtgatatctctagcttcacaggttagctgatgcatgttcatgagtgttgactgatgtttggtttacacctgtcgtacatctttgtgtcttgtcatatggtttagatgcactagtactttagtgtgaagggcgctttttttagcggctcacttattggtaggtcaaatgccgtttcatgtttaaaactcattttgatgatgacgcaacttggtcatatgtgtttgcaaggtagaagtatattataagttagcagaggcaccttgcttttgttcggtcaacaaagggtattggttgtaggactcctagctgatgctaaagggaacaagttaatttattgtttatagacaatgttagatgtatcttttttgtagatatatgcttcacatcctcacctttcagtgaacacaggtcttgttattgcttgtgcagttgtgctggctgctagcttcctattttacacatgcctaaaagctaacattgcagatcaatggtcattgaacactaacgttatccttggcttctccgtagctactattattagcaacttctgtgtccaaaccaaccagttcttagaacattgcaatctggaaagtgatgaaagatggatcattctggtcctgcagggaaccaaagaaagtcacctttacaggctgaagcaagtgtttcacaataaacaataatgctgcaaacatcacggggtacgaaagttttcgactttcagcaaagtgcattcttcagctgttcacacaaggggtcaaggggtatatctattcaatgagtaaaaacttttgcattttgttatttatgcagcaacagaacagcaatcttatggacttccttaaggtggcgctgcgtgcaagatacctctgttcagacttcaagagtttcagatgcttttcttcacacaagtgcatcagagtttcaggtgcatttctagatagcaaacttacaattc

SEQ ID NO: 3264 - DNA, 1501 bp, Oryza sativa
gccggcgttggtggagaggaagacggccggatctggctccttgcccagatccggcgcgtcctcgggtgggaaccgagtctggtcgtcgtgcaggtggtgtgaatatcgcaagtatcctcggtgtgcaggtgacatttggtggctcccgtcgtggatgctatggttgatgggtgctccaaggcgaaagtcttgctccgctctcggtgctagcaacggcgacgtccttgggcgccgttcaccttcttgaaggcgttgctactggagccctcgttcaacttcacttcaagagttttctccgggtgaaaacctagattcgttaggatcggacgatgtcgccgttgtcggcataaccttcttgaaggcttcgttttaggagtttatctcatgttggacggctgtacttaggttcagtttgtcaatgtcggggtttttgccggttttcctttaattaaccgtgctgttgtaaagtttttgggtccggtttcccttataaattgaatcaactctcttcttctatagtgaattgcaggagctccctgcctgtcccctcgaaaaaaaaacacggagcagaagcaccggctgatcaatggccactccactcgatgcaattgcaaggtgaaaaaaaaaaagaaatggttggtagtagttacagttgtgctacattgaccagttaaaactttgtgagattaaagtcgttcgaatcgtcttccatgatattcctcccaaaataaaaggctaccatattcagtgcagaatatttggttgttctcgaccactttgagcatggatcgattcaggctggcgttcatccgacgcagctctagtcagcttgagactcaagttaatccctagtgatacaataccattttatacctccagaaaggaagaagggagagcccctttacagctagaaattttaatcagtgaccggtgactaggcagctgcatggtgtcgaaacatggattcggcaataataaaagggggtagcgcacgagacctaaaagtggatggatgcggagacaaaggatttagacaggttcaggccctctcaatgagaggtaataccctactcctgtttggggatttgaatccgccgggtgtgtattgatctgatgatcaggttatgtcatctgccccctagagggcctcctgcccaccttatataggatggggggcatgattacaagatagaaaccttaaccaatacggtatcggtttcctaaatctactttacaatattatcaaaccaggactttaggccgttccgtaatatacaaggaaacgtaatacccgagtcatgatctattacatattccatagatataagttatcccctatgactagtcggataaccatgccgtatgggtatggggtacccacaatatccacacatggtaatatatattagaggatataagggcccctttgaatcgtaggattgaaaaaacggaggaataggaaaaatataggattctgataagaatgcaagtataaaacaga

SEQ ID NO: 3265 - DNA, 1501 bp, Oryza sativa
tatgtgggccttccaataggccgttatatgccttaacatctcgaattgcattcgacccaggtaagatctggcctggcctggcctggtcaacaaagaactggagtaacaagggtcttgttcgtgtgcaacggcagtagttccaatcaaaaaacaacaacggcagaaacggtttcttgcgaattctgattcttggaggcttttatctgcacttctcattccgcataataaatttgacaggatatactttcctattagctcgttgggtcactccaacgtctatgttctgatcaagcagggtggtatatcatctttactataaaaacccaactcctgacattgaagtataaaaacccaacttctgacattgaagtactgaagtactccctccgttccataataaatgcaattgtgggttttagtgtctaactttaaccatccgttttatttgaaatatttttatgattggtatttttattgttattagatgataaaatatgaataatactttatacgtgacttaacttttcaaatattttcataaattttttaaataagacaaacggtcaaacgttatacatggaattatagctgcagctataatgggatggatggagtatacctatgtcccaatataaatgcagttgtgggtttccgtgtctaacgtttaaccgtccgtcttatttgaaaagaatattattagcatttttattgtaattacatgacaaaatataaatagtactttatgtgtggcttttttaaaaaaaatataattttttcaaataagatggacgatcaaatattggacacggaataccataactgcatggacgtagtatatgtctaaaggaaataattggtgcaatatctgcggctgatcaatgatagtcctcttgatcttactgaagccgataaattcaatctctcacgtcgcgtaaaaatacagtgtactcccaccatagaaaattataggacgtattttatttttaaaaaatgaagtctttaagacaagactttgattactgactgtgcataaaatttattcataatatctacaaaaccaatgtttcatgaaagctctttgaaggatgaatctattggtgtaacttttttatgcactaaatatacttataatctggctaattcttggtcaaaatttacaaagtgtaactatttcgaaatagtactagtgtgtgtccagcaacagattggaaatctacaacaaccgattggaaatgatgaccttctagccaaggaatgttactatccgtcgcttgaagggaatcatccaaatcaccatccctgggcacgaagactagacgagttggtggaagctgcagaagtaatacgccagtgcagatgtgtcgctcctgtgcctggtctggtgaagactgaagagtaggagactgcacaagtagagcggcgagcaatatattcaccatcaatctgaactctctgaaatctcccatccatttctgaacatcaatctcaagccatgcgtctg

SEQ ID NO: 3266 - DNA, 1501 bp, Oryza sativa
ttgttctgtttgctaaccttgctcccacgaatgatagcgtgcatccggccgtcctggattcgttttgtgttgatgcgtgtgtcatcttctggatggatggagcggtctgattaaccgccggtttatttgacgcttatttatgtgtttcttgtctgatttggatcggtttattggcgatttggacttgcgagaacgatctgccatgttttatacggattaccgtctgcctgtaatagttttctacagttattatcttggtctatatggacttttgtggtgtgtgatgtaaaaactaaggtgcaataattcattatcaatactttgctgcatcgacctaaccacgaccatgccgtaaagacgttccactttcagtattttctacacctttttctagagtactagaattcatgagttcatgatacatacttattttctgcacctgttttttttctagagtcccattgacacggttgagtgctgaacttctggttttagtgattaccatgagagggaccggttccaaagtccaaacgcaggattcctgaaaatcaacttcagtacaacttttgcaacgccccctgtccttgctttgctgcagtacactccatgaccacagcaacaacacgtcaaacagccaaaactaatcacaattacgtcgtggatgatcgaacgatcggtcgagccaagtaggcgcttgtgagaagcaacggtgaaaggaacggcaaaggactaaactaagtggactaatgactgttaacgcccatggccgcccttcatgggccatgatgcttcacttttgcctagctaactgccacccatcagaatccctcgaatcatcgaagagcacctcagatttttaggccccatttgaattggaggataaatggaggaaaaacaaaggaattgaaatcctacactattcatacctttgatttgtaggaatgagaaaaggaaaaacgtaggaaactttccttttcctacgattctagaggaaaaacgtaggaaatttaacatccactccaatttcttggaaaacttctcttgagtctatctctctcatctgaatcctgcgtttttcctgtggtccaatcaaacggccattcctgtgtttttcctgtgttttgcaatcctctgttttatacttgcattcttatcagaatcctatatttttcctattcctccgttttttcaatcctacgattcaaaggggcccttatatcctctaatatatattaccatgtgtggatattgtgggtaccccatacccatacggcatggttatccgactagtcataggggataacttatatctatggaatatgtaatagatcatgactcgggtattacgtttccttgtatattacggaacggcctaaagtcctggtttgataatattgtaaagtagatttaggaaaccgataccgtattggttaaggtttctatcttgtaatcatgccccccatcctatataaggtgggcaggaggccctctagggggcaga

SEQ ID NO: 3267 - DNA, 1501 bp, Oryza sativa
ggggagaggactgcaattgggagaagagagagaagcaattaaagaaaggagacgcgacgcgagtgggggaggaggagaggagacgacgaggcggatgaggccggatctccgaggcggagcccagcggacggcggaggatcgcccgcgcggggtgaagcggacggcggaggatcgcgtgcgtgcgtgtatccacccccactgtccaagtggataaacttaggctctgttcggtgataggggagattgagtcttgttttccgcgcgcacgcttttcaaattactaaacggtgcgtttttttaaaataaattaaataggaaaattgttttaaaaaatcatattaattcatttttgaaatttaaaatagttaatacttaattaatcatgagctaatggctcatcttattttacgtatcttctcaatctactcaatcccattctcctcctcagacacacattaaagtacacttggagtgatgctgacgtgggagagcagggcccacctgcaggagaagggggacgaccttgaccgtggccattgcatttgcattccgttcccaggtggggcccactccttttttgggatcgcggttgggctgggcccaattaggccctgagagtatagggccatctaggacgaggaggaaatcggaaggaaattacggaagtaccaccaccaccctgcgcagcgttctcctgtaccctcaccgacgcgacaccaccccgcccccccttatccacggaggcggcctcctcctccgcccagcgccgccgctcttggtccgccggacgcgcgggtcacctcccacggtaaggctcctcgtcttcgccttcttgaccccgctcgattccggtgcggcgccggtgcaccgatggttaggttaggacaggttaggttagacgccgggatggatgctgatgcaggtgcagggtccgtgggttgtagggttggtaatggcatgtagggttccggtggcactgtgtggtgaatggtgtgaatttttcaggctacacaccccttgatttctgagggtgacggtcggttggctgctaatcgctcgatatgttcctccttgtctgaattaattgctttcttatccaggttcctaagttgtatattgtgatgattgtactttttttaattaatgggtgtgggtaatctgctagcgttcggttgtgtatctttgtgcatggcattggttttcctttgctaaatttgttctaggtgattgatgaatttactgttgttgtgcttaggaggggaaaggcctcaatttaggctgttcaactattccttgagatgttggcacatagtctagcaatcaatccttcaagggctgctcgatgtccggttacttcgagggcgtcgagtgcacccttgggacttgtctcttcgttggccttcagcaggggacgtaaggaaagtgttaaacttttcatcaatgtggataggtattgtatcttgtgcttcttctggcctcatcaactctctgccaaagattt

SEQ ID NO: 3268 - DNA, 488 bp, Oryza sativa
aaagttaaaccgcgcaacgccaggtcaaagcacgggagcggaggcggatctggaacggcgaaaagatcgccggagcacggggggaaacgaacaagaagaggcaacgtcgcgtacctgcggcgagagccccgacaggggaaccgccttacccccgtgcggccgcggcgggtcagggagccgggggcggcgccgccggtcgccgggctgcggctgcggcggcggctggggtggcgtcgcgtcgtcggtgagcttcgccggcgacgagacgagacgaggacacagctctcttctggtgggctttagccacatacaaacaaatgggcccaattgcaagcccaatgggccgagaaaaaagcccatcgtcagctggggatggtttctgaccgtccgatcaaagatggacggtggagattcacccatggcggacgcgtggggagcagggagaggtattttggcttctcgggttgttgggtttccggttcctcctc

SEQ ID NO: 3269 - DNA, 1501 bp, Oryza sativa
tcccactgcataaactaaagaaatctttggcagagagttgatgaggccagaagaagcacaagatacaatacctatccacattgatgaaaagtttaacactttccttacgtcccctgctgaaggccaacgaagagacaagtcccaagggtgcactcgacgccctcgaagtaaccggacatcgagcagcccttgaaggattgattgctagactatgtgccaacatctcaaggaatagttgaacagcctaaattgaggcctttcccctcctaagcacaacaacagtaaattcatcaatcacctagaacaaatttagcaaaggaaaaccaatgccatgcacaaagatacacaaccgaacgctagcagattacccacacccattaattaaaaaaagtacaatcatcacaatatacaacttaggaacctggataagaaagcaattaattcagacaaggaggaacatatcgagcgattagcagccaaccgaccgtcaccctcagaaatcaaggggtgtgtagcctgaaaaattcacaccattcaccacacagtgccaccggaaccctacatgccattaccaaccctacaacccacggaccctgcacctgcatcagcatccatcccggcgtctaacctaacctgtcctaacctaaccatcggtgcaccggcgccgcaccggaatcgagcggggtcaagaaggcgaagacgaggagccttaccgtgggaggtgacccgcgcgtccggcggaccaagagcggcggcgctgggcggaggaggaggccgcctccgtggataagggggggcggggtggtgtcgcgtcggtgagggtacaggagaacgctgcgcagggtggtggtggtacttccgtaatttccttccgatttcctcctcgtcctagatggccctatactctcagggcctaattgggcccagcccaaccgcgatcccaaaaaaggagtgggccccacctgggaacggaatgcaaatgcaatggccacggtcaaggtcgtcccccttctcctgcaggtgggccctgctctcccacgtcagcatcactccaagtgtactttaatgtgtgtctgaggaggagaatgggattgagtagattgagaagatacgtaaaataagatgagccattagctcatgattaattaagtattaactattttaaatttcaaaaatgaattaatatgattttttaaaacaattttcctatttaatttattttaaaaaaacgcaccgtttagtaatttgaaaagcgtgcgcgcggaaaacaagactcaatctcccctatcaccgaacagagcctaagtttatccacttggacagtgggggtggatacacgcacgcacgcgatcctccgccgtccgcttcaccccgcgcgggcgatcctccgccgtccgctgggctccgcctcggagatccggcctcatccgcctcgtcgtctcctctcctcctcccccactcgcgtcgcgtctcctttctttaattgcttctctctcttctc

SEQ ID NO: 3270 - DNA, 1501 bp, Oryza sativa
agagcaagtccggcccagcccaccccatgatggatctacttttgttaagcattttttttctagcatcatggtgcaaataattttaaaaaaccatacatgacatcagagatattgttcttaaaagcttttctttttggaatttgactctccacaagtagtaatacaatagcattacttgttactactgtgcgttactacagttctatcacaacgttaatataagagtctagtaaagacaataagctttgcagtaacaaagtgtcttgcatttcttgaatagtattactacataaactaggaattgaaacaaaaatatatgggttaaagcctcacatgctaaccgtatacttgttactacacaaaagtagaagtgttactacataataggtgcatgttaccacttctaagtagctatgttactgcatgataaatgcagtgttactgtgtcatttttacgagatgaagatcaaataggtgggccataggtaaagtctgtaggtggctttgagcgatgtctgattgatgtaggagtgttttgaacaattttatacatttggtaaaaccatgttactgcatgtatatacccctgttactgtaaattacacattctgttactgcatgtggagggctaaagttcaaaatgtcaatctttgaaaagcaatatctcacaagatatgtattattttttaaaatcgtttccaccatgatgttatagtgttactgcatgtgaaggattaaacttcaagatgcatctatatactcccctcctcaagaaccgttcttcctccctcttctcaagaaaattggtctcctccctccaatatagcgttactgcatgtgtaagatgtgacagtaatattgtggtgaattatagtaaattaggaattgaaacaaaaatatataggttaaaagtctcagatgctaaccatatacttgttactgcacaaaagtaaaagggttactgcacggaaggtacacgttatcacgtgtttatgcagtaacactacccaaaaaatatagtaaaacgcagtgtagtaacatcgtgatgtgattgtagtaacgtacaacagacaagtaataacaagtaatagtatagtattactacttgtggagaaacaaattgcaaaaaagtcaagctttgaagaacaatatctcccaagtgatgtaaggttttttaaaaccgtttacaccatgatgttagaaaaaaagagcttatcaaaggtagatccgtcataactatatttcaactatattttaacgctgttactgcacgtaagacacaatgttactgcacagtggtcgtcgtgttactgcaccatcctgggacgagagctgagaagaggtgggtggtggggggagttagtaggcgggtttgatcggtgggaggggcctttgaccgaggtgggaggtgggttttaggccttggtaaggagggggaagtggatgtgaccgttgggaggggggtatagaatagctattctatgcccgggtgtagaatagt

SEQ ID NO: 3271 - DNA, 1501 bp, Oryza sativa
gaccatatgcatcccaagtttccacaccctctttccacataatctcaaggtcatcgataacaggctccaagaacacatcgatatcattgcggggttgtctcggaccttggattaacaagcacaacataatatatttccttttgaagcacaaccatggcgggaggttatagttcgcaatgagaactggccaagtgctgtgagaactgctcatgtctccgaaaggattcatgccatccgtacacaaacatatcctcatgtttctaaggtcggcagcaaagtctttgtgctttcgatcgatattcctccattgaatcgaatccgcagggtgtcttagcaaaccgtcattccttctctctatggcatgccaacatactaactttgcttcattggggttggcaaattttctcttgaaacgatcaatgattggtagataccacacaaccttcgccggaccaccccgctttgacttctttccctcccccgcacagccgcgctcttctttcgcttgtatcgagaagccttgcagacaggacaagcatctaagtccgcgtattgtttgtggtacaatatgcaatcgtttggacatgcgtgaattctccggacctctaaccctaggggacacagaacctgttttgcttcatatgtcgtctcgggcaatgtattctcttgaggaagtatgtccttcagtattcccaaaagttctgtaaaactcttgtctgaccatccactactagccttcaacttcattaggtctaatgttgctgataatttggtgtgctttggcttgcatcctgcgtatagaggagtgtccgagtcactgaccaacctgctgaacttcatggaatctctctcgttcatagttgggtcatcaacgtcacgtaacatgtcttgcagcatatcagggtccacatcaaccatttcaccgcccaatggagatgggacaaacatgtcatgctcttcttcatctccttcttcgtgattgtctgcaccacttctgtctgcagttgcaccatcagtacccagatcttgctctccatgcttcacccaacatgtgtgtctctccatgaatccccggcgtatcaagtgagcgtgtacttccttttcatcgtccaacaaaatatcattcctgcaatcgttacatggacaacacatgtacttgtcgtttcttcttatcctatcttcctctgcggctttcataaaacttaatacgccatctctatactccttgtactgacgcctcaagtcagtcgtgtacatccaacttcgatccatcgctgaacaatgaacaaaatattagttaacatctcatgacataagtactactaaattaataggaaatgattagtacccttttgtttacacccaaatttggcacctaggattaaaataggaaagattgccaaaatttggaagtcaaccggtttcctccgagtgggccggtctgaccgccgtgtgttgggcggtcagaccgccggttgagggtcggccaaaccggcggtgt

SEQ ID NO: 3272 - DNA, 1501 bp, Oryza sativa
atcaagcaatctatcatatgcaatgttggccaaatctttgtcagttattttcaaactaaaacatcggcttttaatatctctaaatctttcaatataatcaacgacagattcattgtatttttgcctaaccaatgttaaatcaaacaacctaagctcagttttatcagtgcaaaaatgatcatggaatttttgttctaattgaacccaagtataaatagaatttgccggtaaagaagtaaaccatgtaaaagcagtaccggacaaagataaagaaaacaagcgcaatttaaaagtatcactattagcctcaccacattgcgccaaaaattgacctacatgctctcatgtggtcttactatcctcaccactaaacttggtaaattcgggaactctataattacggggaaacggcacattatcataataatcaggatacggctttttgtaaaccctagcatgattcctagtttcaatcccgaatctattcctaataatctcactaattatatcctccatattattaggcccatgttgatttggcggtgaattaggtggcctaataggttgtgtttgtggcgcaatatgattatattggccttgtctagtatcgggaggataccccctagcaacgtcattataagcattaggaacacgtgggggaacttggggactatttgtagtagtagatataggaggatcaaatgttttaaagtgatacaaataactagcattagtcatcggatctattccctgtattggaacaattgcgccggtctgaccggcccagggcccggtctgaccgacatccagaggtgcggtcggaccggcctgagtgccggtctgaccgccggggtaatacccggtctaaccggccgtttggccggtcggaccgacggctaagtcccagtttgaccggccgtcaggcctggtcagatcgaccgtgtgcgccgctccatcggttttactacccgtttgatctataggaggttggttagcagtggtagaggctttatcctttaacgtgtaatcgtccataagagggccgaatttaatccttaaaaactcatcagatttacccttaaaagttgcatctaacttatttttaaaaacaatcatagatgaatctattgtagatgctatttgttgttgggtagattgtattacctcatcattacttaccaagtcgggagcgagcttaggaagtggctcgggcttaatgatcacgccttgacgagtcctagtgcacgccctcatcaacgcttcctgtgtcatctccttgatgtactcctccatggacttgcggtcttctccttcgaaatcatccaatgagatcggcatgatctcattcccgctcatcatggttgatgaagaaattccttgattaatttcggccatatagctcatagctgaaatatttgaccgaataaattaatatacggtcttcttagaaaacagccgaaacaaatgaatcagctttaatatttctttttcttaaaaatac

SEQ ID NO: 3273 - DNA, 1501 bp, Oryza sativa
cactaaaaaccgccggttagaactttacgccttctatggggacgttcgcggtttactggtcccgacgtcgaaccgttggttgtaaagcccaacaaaatcctaacacaagatcaaagtgctgctcttggcaccccacacctctacaacacgccgcacagttagctctcaggctctgtgtgatcctaacagctccgccaccactcacggttgtcggagtaacacttcctgcacaaacttcttatttctctaaccgttatactgtccattgacaccgactagagaagatataaaacctaatcgttataatacccaactttagcatcgactagcacatagccaaatcctagtcgataccttgctagtcaaattccagtcatcatccaaactccatatcagctacaatactacctctataccacttcccataatcttcctcacctccactatatattctctacctacctagaatctgtacataaaatatagagcctagccgatatattgtcatgctccacaatcggctccaatataattaaaccctaggtataatattacctagagtaaattccctgtgtacccctgaaaactcactcaatcccttccatacccctgaaatttacccgatcccttctatgcccctgaaatttcagtttgatcccttccatgcccctaccgttacattttccattatttcactgttacgtttggttgcaaatgtcctttttgcccttgatgctttaggtttaaatgtaagcttcaaaaacaattgaaaattttgtttgattgcacagcatgtgcattttataaaactaatgagactaaataattagtgcagaaaattttgacataaattttgaaaataaaataaatgtaataaattaaaatttttatttgaaattttaataggataatagattttttttatcgggagcatttataaaaaaaatgttgtgaacattggtagtcctatctttatttgaatgctcctcatttttatgacttttttataaaaaaaataaatatgtattttttattttattatctaaaaatattttttgggataaataatgcattgcacaacaaactcataagtataatagtctcatgcgagaagcttttatatttttaataatgtaattcatgaatttctttgttcatccaaggttaaaatggtcatttttatagaaaatagacggtcaactaatggtcaactgacgggaggggtattgtcgtaggctctccggaccttccattataattgagagatgaaatgtataattcaagtcatcaaacaagtataatgaaatatccgacgcctcgagagaggaatattggagacattgccgggcctttagcctgccagtcaacttcagcctgagatgtgcccgtcaaaccactcgaaggcggtgaccagatgtgttacacattcaggagacttgacaaaaatggctaaagatctacaacatctcaaatattcttaactcatactcatgtgaatcta

SEQ ID NO: 3274 - DNA, 808 bp, Oryza sativa
tatatatatatgtatgtatatatatatatatatatatatatatatatatatatatatatatatatatatatatatatatatatgtatatatgtatatatatatatgtatatatgtatatatatatatatgtatatatgtatatatatatatgtatatatatatatgtatgtatgtatatatgtatgtatgtatgtatgtatgccagtgcatagacttgtgaggtgggtatgatttactacgtgaacttgtaaatcgtttattttggtgtataaacttgtctagtatgtgtaaatcaaagccaaaacatgtggtaactaattacactatgttggacgttgaataggatgttatattggcttacatgtcaagatgatattattgaatcaaatatataataagtcctgttaattataaaattaaaaatatatatagagggagtatataatggatagaaaataatagaacaaaataactacagtatgcataatggttgattttttactcatacgacatatctcatatcctcatgtgtgagtgacatataatcatactaagtcaacatgactggtcacaatataccgtttcggactaggtcgaatgcactagacaagttcgtgcaacataataagcattttacaaatttatatactaagctacgtctatgtgataagtttgtataccaccaacacagcatacttttttagatttgtatttatatatgtttgtgaggaagttacgaaaatatacgcggctcacagcacggcgatgcgggatagctgagccgcgtatattttcgtaatatacagg

SEQ ID NO: 3275 - DNA, 1501 bp, Oryza sativa
ctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttagcataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcaaaacacttccgctcgcggttccggaaaatccttccgaagctgtctccgcctgaaccggtacctcctcaacgacagtcgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaattttttatgaattttttagcctcccaacagttaatttcaaatttgaacggtcaaatagccgttagtgccacgtggcgccttcccattcgaccgccgcccgccctgtcagtgcgccgctggcgctttcggcctgacgggccgcccgggccgtgccgtgccggcctgctacagtagccgtgccgtgccgtgccggcccgcgggctcggccagcggcccaagcacggcacggctacacgggccgtgccggcacggcccgttactgtagcaggccgtgccgggccgtgcctgctacagggtcggccgtgccccgggccgcccgtttggcccggcccatttggccagctatagtttagccaatgttaaagcccacaggaaaaagtgcaccgaaggtccctcaacttatcatcgggataaaaaacgtcctcaaacaataaa

SEQ ID NO: 3276 - DNA, 1501 bp, Oryza sativa
aatggactgaacactctcaattttgtctgagaggaaccttccggataagattagcacacgtaattgatgttcatctccaagaagagtgcaagggatttattgaagcaacagcagtagaagaaaatggcgtttatccatgcatgcttgctgtccctcctgcaagttgctttttcttgtacacgcctatgcccaagggaacgaatgaacatgaaagaagtagctaacaggttacatgcgattaaaatgtcatatgatgtaacggccaaccgaatgcaagctagccaggtttcaccaatcaccgcagtgataccatgatctgagccagtatcgtaggcataggcataaacatggtaattctctcacgttgagagagataaattgcgccgctattttactgctacatctggctatgattgcataagctactaagctctccctggtgccccattcagaatccaaaagttctatactaatggctcgttaaggatcgtttcaagtataggcaatttgttttggacaaactgtcgtggggctaaacaaatatcataatcctgatccatccatccaggcgtcaagtttcatggataaaaaccttagcacaatttcaaccgaacaaagaccaggttcctgatccaaatcccaaactgcagatacgcatcggctatcacaaatgagatctaggagtccaggcctcacgctccgccatctggcgacggggcgaccgcgcgcgtcacagcctgcaaacctagatcgagtgcggtggtcggcggcggagcttggtcaggcaaagccgtcgatgaaggtaggcagtgtccttctgggctgggcgatgctgcagcgttgctcccttgatttaattctgattttctgggccgttttgtcgttaatctggcccattcttagtcggccgttcgtcggccgggcacgggccgtaagatacaacaggccgcatgctgaaattctctaggaaaaagtccagttttcctgagtgaaccgcgggcagcgcctgaagagtgaagacagtcggcagtggagtgccacggctgagtggctgacactccgcatcgcgtgtagtaaaattttggaaagcggacggaatactggtctactgctactggagatggaaaatccgagtaataccggaggagtaggcatcttcgattctgatcagtaggagcggtcaagacacggcagagcagagcaaggcgctagatgtgtgacactgctgaagacttgtgtttttaaggccattgtccaggggcccaactgcccaagccggtggtattcatcttagccaaaacctggccacgcgttgttcgagctgagtaccggttatcttcgattcttcattggtagtatgccctatgcactgcagcactggctcagcgatgttcatcttatgaaaatggacataatatccctgttcattcttactgttttgcaggtgatatgtgttccgagcaagagcaacccacgaaactcgccgtgttcatacaactgg

SEQ ID NO: 3277 - DNA, 1501 bp, Oryza sativa
tgatcatcaacgcgcacaattctaccagcaggtgaagaagatactactagtatgtttgcaatgcgaaacagccatcggatcgatcagtagtggttggcggtggggcagagaggtggaggcaaccgtcaatcgccctgagcaatttatcctccacctctgggtgcttggcgatgaggtagaccaccggggagatggtgaacgacgtcgtggctgacctgatgagggggtgctcgtaggtgagcatgctgatgtaatccgacgtgagcagctccctcgaggatttgttcgactctctcgccgcgagcacgacggacaggaagtccttgcgcttccgcagtgcgccaggtcgcgctccatcgccgccgcctgctcggcgacgagcggagggtccatgcgaagcccatcgccgcggcggcgaacgggatcccgcctccaccttcgcgcctaccgctgtggcctgcggcacccgacctgccaccgccgcatcgcccatcgccggcctccctttcccgccttgcctcgccccgccggccaacactatgagaaaagtgaggaagagagagggagggaggagggagagaaggggggggggttgagagatgatgacgtggtcaccctgacatgtgggacccacgttgactcagctgccacgtaggaccaaatcagggtcaaacccgctgagggatctactgcgaccggttttatatagttaagggatcccatatatcttttattgtttgaggacgttttttatcccgatgataagttgagggaccttcggtgcactttttcctgtgggctttaacattggctaaactatagctggccaaatgggccgggccaaacgggcggcccggggcacggccgaccctgtagcaggcacggcccggcacggcctgctacagtaacgggccgtgccggcacggcccgtgtagccgtgccgtgcttgggccgctggccgagcccgcgggccggcacggcacggcacggctactgtagcaggccggcacggcacggcccgggcggcccgtcaggccgaaagcgccagcggcgcactgacagggcgggcggcggtcgaatgggaaggcgccacgtggcactaacggctatttgaccgttcaaatttgaaattaactgttgggaggctaaaaaattcataaaaaattcgaaaaaattccaaaaaatctcaaatttcgccctataaatagggcatgaaccccagccatttctcctcatcccacactcctcatcttgtgctctcaagtgttttaagtgctctctttgttctcaagtgtgcatttttttttattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaa

SEQ ID NO: 3278 - DNA, 1501 bp, Oryza sativa
aatattatgaatttgtgaaacaaccaacagaaatatgcagtgcacacgtttcattgatgacgaggctagcatcttattatgcatctgtttgatagatcaaaaatagagagaaaatagtgaacaaaaaagaatatcaaactactccccaggtttcctcacgtgacaaaatagttcaaacgattgaatggcatctcattgttctaattgctcctctatttaagtatcttaaaaacaagatgcaatggagtgagacactcaactttcgagtcctgatagtacatctcaagaattttagaacaatagtaaaagctcgaaaattcagcagtaaactttcaagtgtacagggcatctttagaaattcatagtgatgataaaaactcagcataggagcttcatgtattctgggcttcagatgcacaagacttcaaagctcctatttctgtatacatgacaggagatcgacaggcttcctacagcttaaatgctaaattattagtgtgtaattggtgccctcatagacccattgagaaacccttcaaagatgcctgcatgttgccaatgcagattcagaatgttgacctaaaaagagaggtgttctccatttgagttcagagtttgtaatcgcaccaagagtcttaagactgaagctaagttcattcaaatgctatatatatatgacattccctaatcactcaaggccgaggacttattgttcatgtttagataggagtttgaagagatcaattagctaaaggcactttcttacgtatgtttgctgattgcaagaagtggcagatccgacaaagaagtagcagatcctcccaatcactctcctagtctccttatcctgcaaatcaagaccatatcattacttcgttagttgtgcaaggacaacattccaggttcctaaactgaccattccaggttgcaaagaagaccatatcagcaagaattttttttcttttcagcaacagagaatatgtcagtacagttatttataggacagtcagcaatggtcccaggggaatggttaattaatcaaactgaagacgaaatgtgatagcatcaaaatctacacgctatgccatatctgttccgcaaacaatagatacagttgatcctctcctagcgatagtgtatatgcaaacagtgaaagtattcagagcatagcaaaagtcttcgagctaagaacagtacagagcttagcaaaagtattcacgaaacatctgcttgtaacacatggatggatcttgactgcaatttaaggccagttcatgaaccaatcaagcattccatgcattaattatatctagctaaggaccagtcatgacacaaagtatttgtcacacacaattaagatgagagggaagaaatagaataatatttatagcctttcaatgtgaagcccagtaattttctggcatcgtagaattaataactgatctacatggtacccaaaatatataattggacatgtcacaggacactggatcaaaggtct

SEQ ID NO: 3279 - DNA, 1501 bp, Oryza sativa
atatacactatcgctaggagaggatcaactgtatctattgtttgcggaacagatatggcatagcgtgtagattttgatgctatcacatttcgtcttcagtttgattaattaaccattcccctgggaccattgctgactgtcctataaataactgtactgacatattctctgttgctgaaaagaaaaaaaattcttgctgatatggtcttctttgcaacctggaatggtcagtttaggaacctggaatgttgtccttgcacaactaacgaagtaatgatatggtcttgatttgcaggataaggagactaggagagtgattgggaggatctgctacttctttgtcggatctgccacttcttgcaatcagcaaacatacgtaagaaagtgcctttagctaattgatctcttcaaactcctatctaaacatgaacaataagtcctcggccttgagtgattagggaatgtcatatatatatagcatttgaatgaacttagcttcagtcttaagactcttggtgcgattacaaactctgaactcaaatggagaacacctctctttttaggtcaacattctgaatctgcattggcaacatgcaggcatctttgaagggtttctcaatgggtctatgagggcaccaattacacactaataatttagcatttaagctgtaggaagcctgtcgatctcctgtcatgtatacagaaataggagctttgaagtcttgtgcatctgaagcccagaatacatgaagctcctatgctgagtttttatcatcactatgaatttctaaagatgccctgtacacttgaaagtttactgctgaattttcgagcttttactattgttctaaaattcttgagatgtactatcaggactcgaaagttgagtgtctcactccattgcatcttgtttttaagatacttaaatagaggagcaattagaacaatgagatgccattcaatcgtttgaactattttgtcacgtgaggaaacctggggagtagtttgatattcttttttgttcactattttctctctatttttgatctatcaaacagatgcataataagatgctagcctcgtcatcaatgaaacgtgtgcactgcatatttctgttggttgtttcacaaattcataatatttgatctatcatctcatttattttcagaaatggttaagattgttgggggctccacaccatcaagtacaaaatcaggttagccatgtgcatgttattgactcaaatgatgcactctttgcatgctaatttcgcccatgtcttcctttcttatgccctcttgcaaatatataatttttttgagaaatttaatgatttactattaacaaacgcccgattattttttctttttttaaaacgtgatcattttgctcataaaatgtgacctattttaagcaagccatgctttagttcctttttaaaaaattgcattcaaataacagtgcattagcacaaaaatgtgccgttgtttgctgggctatt

SEQ ID NO: 3280 - DNA, 1501 bp, Oryza sativa
cctgttgctgcattgtttatatatatatatatatataaaccatgcatatatatgtttcaatacatatatatgcatacatatatatatgtatatatatatattatattatattatatgtatatacatgcataatatatatgtatttatacatatatatgttatgcaaatgcatatgtatatagatatatatatgaacaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgtgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgatgagtaaaagcacccagtggaatctgcaatgtgcgtgggatgcattacatatgaaacacttagcaagttcgtacgggaatgaaatttggtatgtaggaagacagtgaaattaaactaactctgtgttgtatggcaacagtatgaacgtcttgtaatgctgcgccttcaggagatggacgagattgtcctctgtttcttgtggatattggtcgagcattgcgacgtttactttacgagggtcgatgaatccagtatcgaaaaccctccgccgtcgggccctttgaatctccattctacaacgataaaagggagtatattattttctatggtctacttacatacaaggacctaattaattaaaggagacgtatagtaagaaatctaactgaacgatatacttacaaaatccagcaactcataatagagacgtcgagggagtccagctggtatagttcgtagattcccctgaaattgatccagagaatgtcatctccttgcaagaagttaga

SEQ ID NO: 3281 - DNA, 478 bp, Oryza sativa
agagtgatccagtggtggcgcaagaggagcaagggggtggagcttgagacggcaggggagagaggagtaggtggcggcggcgattaggtttgccccggggagtggggcggcgctagtggtggcatgggaggtgatggcgcaggttgcggagcgcgtgggggaggaggagcgatgtgagcggcatgattttcggcgagggaatacgtgcggaggttgaagggggtatgtgggacgatctgaggcgttagattagatgattttcgtccgttggatttcatgaatgaagtatgaagtatgtaaggcccagttggttaatatttgagtggcacagctataaacagacgaattacatcatttatttgaatagacatatttgcaatggcatagatcaaattaaccctatacacacagtaaattaggatatgtgggctctaaaaggcatgcaccaaataaatcattgctaggtagggggtgaaaa

SEQ ID NO: 3282 - DNA, 1501 bp, Oryza sativa
gaataactcatcaagatctaaaacttttattttggtcatttcttcatctgataaaatgttagtaacattgttaacaaattttacatatatgcgtatattttataaattagataggagatatgtcaattttgtgaacaatattactatcactttatcagatgaataaatgaccaaaataaaagttataaatcttgatgagttattcaactttgttgttgataactttttcaattgaaatcatttagtgtttgaaaatgttgtttgaagttgtcgtattttctaattcaaattcaaacggttcaaaaaatgttatatagaaaaatgaccaaaataaaagttatagatcttgatgagttattcaacttggttgttgatgactttttgagttgaagtcgttcactaacaaaaaattctatttgaatttctcaaactttgaatttcaaatttcaaattttttaaatagagtcagatggagaaatgaccaaaataaaaattttgcacctcgatgagctctacaactaactttggtttcggtgacttttccatttgaaatcatttattaaccctaatttttcttcgaagttgtcaaattttgaaaattcaaaatttgaattgttcaaataaacttatttgtacaaaggaccgatagatctcgatgagttatacaattttgttgtttatgatttttgatggttgtgtatgtgaatgaatgtatatgaatgggggatgttggggtatgacatatcccggcctaggacttaataggattaatagaatactcataccaacaagttacaactactcttccggaagccgatctccaaagaactttgtagtgaacttcccgggtgcacacgagtaaggacaaaaaaaagattggcctgagaggggcgggacggcatggcaaggctagccaaaaataaaatatttttttttgggattatactcatctgtgacggacattaacttaggcccgattgagatgactcatctgtgacaggctatagttaatgcccatcacagataaggatcatctgtgacgggctatagtttaggcccgattgagataggtcattcgtgacgggctatagtttgacatgtcgtctgggtcaagactatcactccccgattgagataggttcatccatgacggccatttgcccgattgagataacttttcacatagtgacttctaacctgtgacggacgccgtgcccgattaagatgggggttgccgcccgattgagatgatggtatccgttctagtgtctatatctctatctattctattctctactatatctatatctatatctattctctatccgtgtatgagtcgatttttaagttcgttcgcttttgaaaatatatatccgtatttgagtcgatttttaaattcgttcgcttctagaaatactaaaaggaatcgtataagaaatctatttaaaaaaactcacatgctaactggagacgatcggactactaactacagctcatgatt

SEQ ID NO: 3283 - DNA, 1501 bp, Oryza sativa
cattttcagcatttgtggctcgtcacttttatatctccagaatcatggcagcaaatagggtcattcttttcacccatgttcttcttgaaaatgtgacatgtccactgtgtttaccccgtgttctgtagagcatgttgcatatgcatgtttattcgaatcttatttgcatatttgcctcttatcgatagattcggagaattcggagtatgtggagcaagactctgaggttgagtgtgtttccacgcagcagcaaggcaagcacctaagcatatagaacctatgctttctctaaaaatgatttggttgcaatctatatgtatatatatatatatatatatatatatatatatatatatgcatgtattgcctagatattaatattgtcggtttatggtgtatgggtagaacctattaatgcatttagttcttgtgatatcgttgtcttataccctattaccactggttgggattacttgggatgtcttattcattaatgcttagccatgcttagtgctaatagaactatagggatagacagtgcttaatagtggtatatagacaacttgcattattgggcataaaacttgagcacttacactaaataatggttgatgaaatatgttggacttggacgggtgatagggcgatgatgggaggttggtttcccctgatgcaagtagccccatctaggtcgttaaggaccgaacattttgacatctaatcaagcaccctatgtacttaccacatgccttatttgggaccggcttgttcttactagttctactgtgatcatttatactacgttggagagtcgtgaggcaggtagcctttggaggttctcgggtgcctaggtttggccgggggtgcctcccgcgtggcgcgcccgccttggtcacatcatgcacgcacgtgactgagtcgtcgggaaccccagcgtagtataggtggttggggtggggctaagaaagggcatgtaatgagcttgaatcacttatgtaccgcactcgacggggtgtgtagcatttgatatttgttcatttcgtgtgggtccagttgtacacctttgatcagagtataatctattcgaatagccgcgtcctcggttatgaacaatgcttgatgtgttagtcacttatgttagaatcaaatgtggattattatggatgggattatgtttgatggtggtgttggcatgttgtgccatgttggtatggactttggtagtccatggttgatgatgagagcgccgtttgggctcatttgcttatatatttcagaattatatacttgctgtccataaattaaaatgatgctagagttacttgtccttacttattttactcattaatttctcaataaaattagctttatgcaaacgttgaacctagagacccactataggctagaaagcttgcatacttctctctcccttatgtatatataattttgggtaagacttgcgagtacaatcttgtacttaacccggtgtctgcaatttcag

SEQ ID NO: 3284 - DNA, 1501 bp, Oryza sativa
tgtggaggttgtattctctgattcggccatcgatggttcctcatgtgtatcctcgatttccaggatggtttcgcaatgaacgaaggaagtgttctctatgatatgatccaagaggtccctaccttctgacattgtaccatcctgaagttttaattaatcaacttaagtggaaatcggggtatgtccttagtaaaagttggaagttttaaagctatttgggttcaaaacctcatgcggttaatttgtgtataaaaaacatgggtagaaattgaaaccattttcccaaactgttggtttgagttattaagaaactttagtgatcattataggtagactaatgaccctacaaccttttgctagataaacaaaaactttttttaatgactcatccatcgttcagagagtgttttggtgctaataaaatctaccaacagtttcgaggagtagctagactaatttttgttttcccttccacaaggggaacaatgtttctagagaccaaactgactgaatactagataatccatgaagctctagtgtttggtctggtgtttggtgtcttcttttagcttctaagctttgtccaagcctctatgtatataaccaaattaaatggtcaagcggtagttaagaaacgttgtagtatagttgttaatctttcgctctttggataatctacctgaccatgcttcgcaattggctagtagaattagtaacaagtgattgtgtgcttgtgtacttgtttgtaatgatttttatgtcgttcataattggttgatacatgttaaataaacatagagactttatataacaaatctaagcaacataaaatccatgaagatcctcatgtcacttagacaacctaagatgaccactatgaaggtttcataattttatcattctttttactacctcaaatatatcagtcaaatatagtcacacttagttaatagaaacctaattggcaaaatgaagcaacttctaaatgtgcctaaagttgaactgaaggatataggttttataatttattcaaatactagattatttattatgagttaatataatttttctagaatttttacactcagttttgacctcattaaaattcaatttagttctcagcataccccatttcacctttttgccagaattaaaatatttcaaatttttgagtgaaactttgaaaaatggaaactacgtaactcaatctatctccatgccagaacacacatttttgactctcttttagctaggacaaactagttacccaagaaggagagaaggaaaattcttgaaaactcactattttcaatgtgtatgtaaggttctaaccttcctttatctgtcccatgacccagctcaacttggccccacctttcactgacctaggctctccaccaagccccatcccacctccaggtcgtccacccacctcaggtccataagactagcaagaaaccctttcatcttcttccttttttctttctcccttgcttgttct

SEQ ID NO: 3285 - DNA, 1351 bp, Oryza sativa
tattattataacacatgtcagccaaaggaaagcggaacaagcctctgctgtcataaccttttccaataaaagttgcaaatttagataggacatattaattggattcaaacacaagtctaaaaccttctctacatagtagagacgctaactagattcttctttattaaagggacatgttgcacgttcttcagctgcacggtctttcccgaagtaaacttcagatcgaccgtaccaacaccatgaacagccgcaagtgacccgtttaccatcaacaaggaggaacttctcccgacctgataagaagaaaatagggaaatatcagcacatacatgaatattagcaccagtatcaacccaccaatcaggtgaatgaaaaacagagagaactgtaggtaataatttaccgtaccccgatgttcctccgccctcgctaatgactgtcagggctatggataccacatacctaatagtagttgactaaatctcagcaggacccaccacataccatgtcctatacggaaacaacctgcagatataggaggagttccggataaggaaagacaaccagagttctacatgggaacgacaaggactactcggattgtatccatattggtttccctagttctacttggacaaggggacacccatgggtataaatacaaggccccctaggaggagagaggacacgatcacaatcaacacccaccacaatcaacatacacggaacaatagatcaagacacaagatccacatacaagccaacatacgcctaaacaagacgccggatatcgacttcagagatagacacggctagtcccctacggtttctccggatactgataagagagacattgcgctgtctctgatctcactgggcacgaactcgaggagaaggactaccctgttgtcgactacgagtcagtccttcagaccgccatggcgacaacagttagataggttaccccaaatattgtactggtgtgattatggtgaataagagcaataccagcttcggccaacaggatgtagggttattacctgacaattcaggggcccaaacctgtataaaaatcctcgtctccatctcttttacctcagtctcgtctcgtgtataccctggtaccaacgatccccatactatgcaaataccagaatcgcgacatcaaacgtcgacaatgaccatgttggcagacttcctgtctttgcgctcaggacagtccttggcccaatgtccagacttgccacacacaaagcagtctccctttgcctttcccttgcctttcttcttaaaattggttgtagccttgggtttgacatcaggcttgactttcttgttgttgtgaaatgca

SEQ ID NO: 3286 - DNA, 1501 bp, Oryza sativa
tatactctgatcaaaggtgtacaactggacccacacgaaatgaacaaatatcaaatgctacacaccccgtcgagtgcggtacataagtgattcaagctcattacatgccctttcttagccccaccccaaccacctatactacgctggggttcccgacgactcagtcacgtgcgtgcatgatgtgaccaaggcgggcgcgccacgcgggaggcacccccggccaaacctaggcacccgagaacctccaaaggctacctgcctcacgactctccaacgtagtataaatgatcacagtagaactagtaagaacaagccggtcccaaataaggcatgtggtaagtacatagggtgcttgattagatgtcaaaatgttcggtccttaacgacctagatggggctacttgcatcaggggaaaccaacctcccatcatcgccctatcacccgtccaagtccaacatatttcatcaaccattatttagtgtaagtgctcaagttttatgcccaataatgcaagttgtctatataccactattaagcactgtctatccctatagttctattagcactaagcatggctaagcattaatgaataagacatcccaagtaatcccaaccagtggtaatagggtataagacaacgatatcacaagaactaaatgcattaataggttctacccatacaccataaaccgacaatattaatatctaggcaatacatgcatatatatatatatatatatatatatatatatatatatacatatagattgcaaccaaatcatttttagagaaagcataggttctatatgcttaggtgcttgccttgctgctgcgtggaaacacactcaacctcagagtcttgctccacatactccgaattctccgaatctatcgataagaggcaaatatgcaaataagattcgaataaacatgcatatgcaacatgctctacagaacacggggtaaacacagtggacatgtcacattttcaagaagaacatgggtgaaaagaatgaccctatttgctgccatgattctggagatataaaagtgacgagccacaaatgctgaaaatggtcctatgccaaaactgaatataaactatgggtcatttggtgatccccacatattctagcaaattttcatgggtgaaacttgctccatacaaaagagtataatttactggtgataggaatagtattcgattatttaatttggagtttgaacaagatagtaggtatatatgaaacctagagagtgagaaaaagaaaactgctgcctgcagcccttgtgcccaagatttgattcgaaagtttactttacaaatgctcagtgattgaggaaaatgaagaaggcatgatttagctcagctattggttttgtaaatacaatttttacaaggtgctggttagtctatgagggattaagtcgtaacatgaagtttctagctggcctaagaacttatgatgctgaaaggtagcaacttgcttccaatggcaa

SEQ ID NO: 3287 - DNA, 1501 bp, Oryza sativa
gtcctcaacatgttgtaatgtgatgcataccccgtgaatgcgacatcacgatgtaatacggcaatgatcaaatggtatattgtatcttgtaccttgcattgtgtcgttggaaagctgtactattaaggggaatgatgcatagacatataaggagtgatgcgggtgctcaaaatctaattttcttggaagcatttctcttattggagtgttctgtaaatttttggatgttccaaaaataattttcggaagttccgaaaatacacagaacaatttttggcgttctggaaattttcggaagctctgaaaatgcgttgacttcgattatttctaagatctggaatttttggaagttccaaaaatgtttgtcgaaagttccaaaaatcacttttattgcacaccaacgggcagatttgtgatgtgggtataaatacccacctcccctcacttgtgagggctgctggttccatttgcaatcatttgtgcccttggcttgctctctcttgttagaataaatgggcagcccataataaatgttaaggataataataccaccctgggaattaaatgaggagtatctcaacttaaatagggagttattggaggctccctgttgaccggttgaggtggggattggaaagccacacgcgcgcgcgcgccgggccgggggcgtgggcgaggcgggcgtgcgtgcattgcattgcgttgcgcctctctgtatccttttgcaacggaccaaccccgagattgcctccgtaacgggcaggcgattcaatacccattgatctcgcgtcgttactacggcaacgggcggatatctctcctgcgctataaggaaagaggcaacccgatcagatctgctcggttactttgcacgctactgttctgcttccccgcttctgattgcttgcgcgcacgagagatcggagcgagcagggcctccggaaccacaccttcgcctgagatttgcaccgggtaggcgggtcatcaggtttttggggagtgcttccgcacgactgctcctcgtcttcgaccgtacgtccgtaccatgtctgccgccgctgccgaacctagagatggcgcgccgggagctggatctggcgctgcgaacgacaacaccaatggaggcatttctgcctcacaatccagcggagggacattcacagggtataaccttctacccttactgttatttcggtttttgatatctttattagtcgcaattctattgcgttcgatgtatgatgatgatgcttattatatcctaagcatgcttctggttatgtttgattttatcactagatcacctcacattgttcatgccatgattattgtcttaatattttggattaaaatatgctgatatatgactatatttccaacaatccaaaaacctgatgggtcattttcgttagttggctttactactgtacgaaaccacatgcttttgatggttctaattataagaggtggaaagcacatgcacctctgtggttgacagcga

SEQ ID NO: 3288 - DNA, 647 bp, Oryza sativa
ccttaaaccccgtgggccccaccacctttctcctccccactcccattttcgccattcccagcccgagcagcgagctgctgttcttctccctctctctccccctcacctctccacctcaaatccactcaatttgaagccgtttttcgcgggatttgttgtggaaatcgaagagaaaggtagactccttcattcccccttcttttttttcatttttattggttgaatttgtagatcggtgggtaaccctagaaccccttttttacccaaatttgtgatttttagcatttgttcttaggattggcttgttgtagtgctacatgtttgcaatgtactcattggtgtcatgatttttttaaccatatatgtggtaatgttaatttttggatggtttggttggatggatggatgaaaaattatggttgaggcatgatggaggtttgggttgtatgatagagtatttgtaatatttcgatgtgtaatgtagtagtaaacttgttgatagttgtaggtggattaaatatttttttggagtagtagctttgggacaatttaagttatgcattggttataatatgtcggtttggactacgtttaggaatgaagatttaatttttgttgcaaagttacatttgattttttggtgtaga

SEQ ID NO: 3289 - DNA, 1501 bp, Oryza sativa
gggcatcagatcaatcggattgattgttcacttgaatatgttggttacaacttacaaatagaatttgatacgcaaaatctaattgatgctatgttatcaatttgacaacatggcatgcttagatttggaattccagagctgcatatggtcggtgagctttcgtttcctgtgttccccagtccggtcctgtatataaaggccacctggccacccccgaaaagaaaagaaaaaaaaagagaagaaaaccaagaaaggcgagagatacgcggagagcagccaactcctcgccttcgccttcggcttcggctcggcgccgcccctcccctctcggttagctgctgctcctgcacctgctgctgctgctactgccaatctgccattctcccccattcgacctctcccccgtttcctccgatcgactcgcttgcgcgcgggggaggtgtgatcgatcggttctctctcaccgcattgtgatcgatcgtctaggtcgtacgggcgctcgatctgcttcgaatcctccatttggttcgtagtttttattccccttgatggcccggacgacgcatggtttggaatttttctgctctaggctgggtttagtgtgggggtttggggtttttgttttttggttggggggatagcgtgttcgttaggtatttgcgctgctctgctcgttcggtcggtaaacgatttcaacggggtgatgcttcggtgtgttagttcacgaagttgaagcgttcgggttgtcggttctactaaattaatttattttcgcaatgaggctgaacaaacgcttcagtttctttaaataatgttatgttttgttcggatggggattttcttgttggaatactttagtttataatccttatgttggaaataaagaacctgcataatcaatatctgaagttaccacgttgctgaaatgtagcacctatcaagtggatttactactgtctactgtactagatatgtacccttttttttctaaaaaaaaaatctcgttgctaccaatgtcttgtgaaattgataaattgattacagtttagtggttcttaagaaatagggattgatttatcaattgtcattcctctaatttgatttaatgttgatttctgcagctatgatgagctcttcttcgtcctggtctaccccaagctttgggttagccagggaatcctcttcattgttgtttacacctggccttgtgcaacacatgggtcctaatccatcgtcatcttggtccacccctgctcatccagtctctgatagtcccacgttttctttccccacgccatttttctgtaagcaaccttttctttcatctttctgttctccctttctttttgtgctctttcatacctgccaactttataaaaaattaacaacatgataggtgcaagttcttacctacaaacagctcattttcctgtttatgcgtgtttgtgcttgtgaattcctgttcttctctatagtacaaatttctattatgtgttctaat

SEQ ID NO: 3290 - DNA, 1501 bp, Oryza sativa
ttaaaccctaattccacattagggtgatctacaggattagcatatgttttagtagatcgaaaatctacatgggtgcctaatggcaagttttatagtaggggtagttgccaataattttatccatgtaggatatgaggtgatatatacaatacaccacatctatactacttctagcatactaatccaaatggttttattttattcgtgtgtccaatcccttctttctttcatctttttttctttgggtttgttagaggttgccccttgcataagggatgggtcgtcttctctttcatcacttatttcttacacctcatcatccaattatatgtggcaattttagaggcaccacatcaagcattataatcactgctagggaagtggtctttagtcccggtttacaacccctcctttagtcccgggttacaaaccgggacgcccaatccggaactaaagatggcagcaccacgtgttttgcgctaccatctttagtcccagttggtgttatcaaccgagactaaaggtttttttttcttttttttcattggtttttactgcttgcatattgatttcctcaaattgagttgctccctacatccccaagtcacatataacaccacatatcacagataacatcacaaattcacagatttacataataacatatcaaatacataaaaaaattcacagattcacatcatagatcaaatatgacagggttatggataccacatacctaatagtagttgactaaatctcggtaggatccaccacataccatgtcctatacggaaacaacctgtggatataggaggagttccggataaggaaagacaaccagagttctacatggaaacgacaaggactactcggattgtatccatattggtttccctagttctacttggacagggggacacctatgggtataaatacaagcccccctaagaggagaggggggacaatcaacacacgaccacctcaatcaacacccaatacaatcgacatagaagccacaacatagaagcctacatacgccaagacacgccgtcggatatcgacttcagggataagcacggctagtaccctacggtgtctccggatactgtcaggagagacgaaagcgctatctctgatctcgccgggcacggattcgaggtggaaggctaccctgttgtcgactacgagtcagatcgtcagaccgccatgtcgacaacagttagataggctaccccaaatattgtattggtgtgattatcatgaataagagcaataccggcttcggccaacaggatgtagggttattacctgaccgttcaggggcccgaacctgtataaaaatccctgtctccatctcttttacctcagtctcgcgtataccctagcaccgacgatcctcataccatgcaaatactagaaccgtgacatcaaacgtcgacagtggcgcgccaggtagggggattttggtgcttcaaggtttcgacgagatgggtttgagaga

SEQ ID NO: 3291 - DNA, 1501 bp, Oryza sativa
tttccatataagaacccaatacgagattaatcataattcgaaataaaaataaaataaaatccaaaacttgaaaaggaaaggagagtccaagtagaaatacaatttaaaaataactgaaattcggaattaaaaataagcaatattgaaagaaatttctatataaaaacccaatacgagattaatcaaaattcaaaataaaaataaaataaaatccaaaattagaaaaggaaaggagagtctaagtagaaatacaatttaaaaatagctgaaatgcggaattaaaaataaggaatattaaaagaagagtacatataagaaccaaatacgagattaattaaaattcagaataaaaaaatccgaaattagaacaagaaaataaaagaagagtgcaagtaggaatacaatttaaaattagctgaaattcggaattaaaaataagcaatattgaaataagaatccatataagaacccaatacgagattaattaaaattttgaataaaaaataaaataatatccaaaatttgaaaaaataaaagagagttcaagtaggaatataattttgaaacaactgaaattgaaaataaaaaacaaaaacattaaaagaacacaatagggtattaacttttttaaaaaaataaattctgaaattagaaaaaagaaaaataagatttcaattaggaatacaatttataaataactaaactttgtgataaaaataaagactattgaaagaaaataccatataaaacacatgatgagataaaattaagtaacaggcctataaaggagtaaagtggtggcggttgatacgatatataaaaattgttaataaaacactaaatagaatcctaatgacgattaaaaggagggacgtcaggcatgccgtaaagcaaataagtaagacggttgctgggacttctagaaaattaaaaaaaccatttataatcatattcgatttttaaaatctcagtgataataaaaaggagaagcagcgggcggggtgtataagagtatagttgcagagccaccgacggttgatgggacttctagaaaataaaaaatgaattacaacgatagttatgctcaatttttagaatcacaatgacaataaaaggtaggcatgagacgagctgtagagggacatagtggcatcgtttgatgggacttctaaaaattataaaaaataaaactacaagtccaatttttaaaggtttagaacttttaaaaagtaaaagaaaaaaacaatgataatcacgttcaattttaaaatcttaatgacaataaagaagggaggcagtgggcgagccgtagaggagtacaatggcaaagctgctgacaatttggcgggacttttagaaagtaaaaatgaacccaaatgataataatctttgatttttaaaatctcaatgacaataaaaagaagagacagtgaacagaccgtagaggagtataatggcaatgttcaacgggacatctagaaattacaaaaacgaaacccag

SEQ ID NO: 3292 - DNA, 1501 bp, Oryza sativa
aaccatagctatcccactctaacagatcagcaggttctccacaagcatcttcctcatgatctgaacccatttatgagtacaaaaggtactcagcaagacatgcttatgataataaatacaataattgcaatataaaacatgcagtatcgagagctagaaggtttaaaccctaaccttaacagttatttcatagagcctaacttaataaacatttgatataaacaacactattgaacatttaatttaaacaataataacgagcataacaatataaatgttacttataaataacttgaatagaacgtcaagtaataaataagttaaccatattaattaatagccatttagtttaacttgtgcccataatctggaatcacccatagacacatctccattaaccgggagcacggcatattcgaatactcaacgactctgcagtgcctgcccagctttacccacatgatacccacagctggctaggctgaaaagtaacaaggtgtaatattgctccatatatctctcccttctaccagtaagttaaaggatgctcgggatgttgctcggagtgatccggtccgaggtgtgtaccaacctacctccgcatccacttatcattgttcgttactcgatgggcagcccagaacttcatgggcccatagggcagttctgaactctcggggcccatcgagcccacatatataaatcatataaacatgaaacatgtcactttgcttcacacacttgaaagctaatggccaatacaccgaaaggcatgcagaagtttaatcaattggagcaatatacggccaggttcgacaaatcgattgtgtggatgggcgaaactatgtcattcttcttgacacaagggggttaattattatatcaattttaaataagaaataaccataaatatatcgatatacccattatgaccataaacaggtccatgaaaccaaacacatgaactctatcatgtgttccacccgctcatatgcggtgtcaacaattcttagcatatagccataaatagttccataagcatgttttcatatgcaatgataataatatccatattaaatcgatagcatgctaaataattaacattttgtttaaatgtttatcaaattttatcctaagcttgttagactttaaggctcattaaggtatttataacaacaactgaaaatataatgcaataatagcaatataattaatttaaaagaatttgtgcagtctatcgtactccaaaggacaagtacgctactaaaataactctatctaccgggattaaattgttcaagggagggtgcatgtcttgcaaccttcgggcttgatgtagtcgtacaaaccgtctccttctggcgtggagatttcactcgtttcgactaccggaccaacgtcagcgttttctatttatgcaacaatcatcaccacaataaataatagaaaaacaaaaataaacaaaacaaatggtatcacaaagtgcaacaatgggtgaaaa

SEQ ID NO: 3293 - DNA, 1501 bp, Oryza sativa
cctgtgttttggtggatctatgaatgaaggagttacaaagtgtgagccaaactctcccttcttctttgttcgtcaatctccagccccccccactctaaatgggcaaggtcctccttttatatctcaaggggataccacatgcacccctccctttccaaactggacttttcttctcttcataaatgaagcggagatttgcatggttgccctccgaacgtccttctgacgggacggcacatacctaccaccacttctgccggaggcaggctcgttgtgagaacgaggctgtctgctgacgatatgaacagtgtcagaccggtcacaaatcggtcattcttgtccaccacgcgtcagctttgcaacatgtatttcgcccttcttcgtgtaacatcttgcctgtaatggttgggatgaagcctggtattcatctgaccagggctaacgtgccatctctaagaagtaacacgctagctccggctggagacgtgtgcctagaggctctcgtcttgacgggacggggcgaggcgtgcgtcagaccgccagtcgccacctaaccgttgatctgaccggtctgtgactggtcacagaccggataaaggaacgtgctgcactgcgctgcatgcagcatgacgtgcctgtccagtccgcaataaatgcggttaggtgagccctgccgtgttcacctaacccatatatgtggcgcaaacttcattaggggtcggggtgcctcggccgtcggggccggggcaggagtaacccgacccccctcggggaaatcaagaggagggcggacacctcaccctcgggcccgacgtccccgagggtgccgggccacgtgggcgattgtgtctgcctcaagcctctggtcacgatactcccggtcccatatcaccgacagtagcccccggcgttatgccagggcgatcgcccttctcaagggaagcggtcgggcgtgacgccactcctaaagcctggtgacaggtgggaccggtctccatggttgggcagaaacccaacggtctcaaaccatgcacatcggtcatggtaacttggctgtcaataatgggcggtctcttcaagactgccacatctcttgagcagcgcacgaatctgggcgagccgatttgctccgcctggagacatggcaacgtcacttcgatcgacgagcgtgattaacgcgcgcacgatacgatctatctcgactgccgcaaccgcatatccacctcatgcgccgcaagcgggcgaatgggattagtggaagcgtgggcacgagaaacgagggagcgagatagcgagaaacgagggagcgagatagtgggcgcgagaaacgaggagccgggcacagcgatggcaagggtataaagacaccgtggaaaagatttgctcccttcctttcgccattattccccttgccttcgccgcttgcgccctaactctctctctgctgcgcctcaccttcgccacacgcgctcgttctcaatcatcccttcctccggcgcca

SEQ ID NO: 3294 - DNA, 1501 bp, Oryza sativa
cggacttgggatggcgggaggaacgcgtcgggatatcactgaagcgggagaaaaaaccagaagacagacaagatggataagagagaacttgcttttgggataaagggaagatggttgcaaaaggcgtgaaacgaacctgcgagggggtcggttaaacgaccacattggaggggaaatcaggtttccccgggatggttccgtctcccccgtcttgcggagccgcttcttcttgcgctccgtctcgggctgtgatgtcggcgcggccccctccgggcgcctgctgctggcacgcaccgccccgccccctcggggaggagatgggggaggtgttcctcccagtttcctcttcccccgggcgtcggcagggcggctgctccccgagcccccgtcgcggggcccagaagcacgaccccctcctggggtagattcttcccggcggctcccgcccacggcatcgtggcccttaggagcctcctcctctgaggccccgacccccatcataatggtcaggatggaggcgcggtctggatcgatgcaaagggggagaactccttgaggaatgagggatgcttccacggagttgagattcagcacccgttggaccaatatcttgaagtcctcaggagcccagtcccatttgactccctggtgggtcctcatgtagtcctcggacccggtgtactcccatgcgctccgggcgcgccgctgaagcggcgcaatccggcgacggaggtagtcgccgtacaccatggcccctgtgagcccctgggatcgcaggcccgccagacggtcgaggacggcgtcatagtcatcccccagatctaccggcgcccgccagctggagacctgcgccgggggctggcttggaagtcggaggcgcgcttcgttggcgaggggggtgtagaaccagtcgctcttccagtcgtcccacttcttgcggagggcgcaggggatgtagcagttcagcaccggcccccgcggctggaagtagcagccaccaaccaccgacggcggcgataccgactgcacggtgaagaaccaccggaacagccgaagagatgggcgcaccccaatgaacatctcgcacagatgcgcgaagatggccaacgtcatcaccgcattgggggtgaggtgcgccatctggagatcgtagaactccagaacatccataaagaaagaagaaaatggcggaaccagccccgccattgcaaaggggaggaagaagacggaccgcccagggtagtcaggtgccgggcgtccctcgcccagcatcactatctcccggccggtggcagactccggcatgaagcggcgcggcagccccgcctgcctctcgctcacgatgcgagaaggcggtagtacgctaccgtcgagcagagcagagccccgtgccatggcgccggaggaagggatgattgagaacgagcgcgtgtggcgaaggtgaggcgcagcagagagagagttagggcgcaagcggcgaaggcaaggggaataatggcga

SEQ ID NO: 3295 - DNA, 1501 bp, Oryza sativa
ctggtcagatgaataccaggcttcatcccaaccattacaggcaagatgttacacgaagaagggcgaaatacatgttgcaaagctgacgcgtggtggacaagaatgaccgatttgtgaccggtctgacactgttcatatcgtcagcagacagcctcgttctcacaacgagcctgcctccggcagaagtggtggtaggtatgtgccgtcccgtcagaaggacgttcggagggcaaccatgcaaatctccgcttcatttatgaagagaagaaaagtccagtttggaaagggaggggtgcatgtggtatccccttgagatataaaaggaggaccttgcccatttagagtggggggggctggagattgacgaacaaagaagaagggagagtttggctcacactttgtaactccttcattcatagatccaccaaaacacaggagtagggtattacgcttcccagcggcccgaacctgtatacgtcgcctgtgtctcttgctctttggataggccgcgatctttccacatacagagagagcctgagatctcaccctgagcccccggccgaaccggcaaaggggggcctgcgcggtctcccggtgaggggccacgagctccgtcaatctttttttcgaatggaggagtatctttcaaagtgtgtcatgtcatcatgatctccttctgcttaggtacgttagcattttttttaaaagaaatccaatgcaaaatattagttaaaggggtctaaaataaatatttggtaactagagggactaaatcgaaattcactcgaaaaataaacccctccctctcccctagaggtggccaaatgggccgggccaaacgggcggcccggggcacggccgaacctgtagcaggcacggcccggcacggcctgctacagtaacgggccgtgccggcacggcacgagtagccgtgccgtgcttgggccgctggccgagcccgcgggccggcacggcacggcacggctactgtagcgggccggcacggcacggcccgcggcacggcacggcacggcacgccggcggcccgtcaggcgcggacaaggcgggcggcggtcgaatgggaaggcgccacgtggcactaacggctatttgaccgttcaaatttgaaaataaccgttgggaggctaaaaaattcataaaaatttcgaaaaaattccaaaaaatctcaaatttcgccctataaatagggcatgaaccctagccatttctcctcatcccacactcctcatcttgtgctctcaagtgttttaagtgctctctttgttctcaagtgtgcattttttttgattttgacaaaatttgctcaaattttgtcaaaaatcaaaattagtttcgtagttcaacagtttgatcgcagaggtttgaagagctcgcggttggaaagatgtaagtaatattcaaatttgtgtattatttgtattgtgtttgtgaattcaataaatattcgaaaatttgtttatgtcggtttaaattttcagaa

SEQ ID NO: 3296 - DNA, 1501 bp, Oryza sativa
cctgtaatacttgaagttgacaaaatgcgattcttcagacgatataataacaagaacatttctgaatcttcctttaaaaaatgttgaatgcataaaagaatcttagctgtgatggcaacaacacgactttctgatagtgacattggatcttagttgaatctggcatcttgcgtatgcgaccttgcttggatctgtcggatactcccaacccagcataaattactgatgtctgaaactttctgagcaaagcgggaactcaggctagttgagtcgctcatcatcaaaagtcaagacaatacttaagtaaaaacaaaacaaatatcactgtcgcaaaaccagtgtaaacctattgggataattttaacagtcttacaacaccagcgccgagacgtctaggtaacaaattaaatcatcactgacaatttttgaagataagtgaatcacatgtctttctcaatgaacttaaatttatgaatgaaccaacctatacatgaaactaaatatgatatcaagatcagttaaaaatcttgttttgtgaaatttcaaaacaaaaaaataaaattgcagcgtacctttatttcaagagaaatttaattcactaaaaaaaagtaattgtatgtgccaaattttacattaaaaaatggtatctgcaatgtattcttaaggatgataaaattatctcagtaatattcaatcattcattaatagaggtgaactgctcgttcttttactcatcacacctgttggatgaaaagattggttgctgccactaaaaaaattaatcaactcattgcagttggcaaaaaagaaaaaaaaaggttttcaggcactagtatatgtgatgttagaagggaaactattctaatccctcgaggggatgttccctcgtttactcaaaaaccatctaaacggttatgaaaaattctgaaaaaaattgacaacattcatacaacacatatatacaacttcacaaaatcttaagtccaaaatcaactcacacttcgagatataaaaaagacaaattcagcgtatgaatagtagcgtactgtttatatctaaatttgtcttttttgtttctcgatgtgtagatcgaatttgaatatgaattttggtggactagtaggtatcattatactctacattgttaatttttttcagattttttccatagctatttacatcgaatttggaagaaaaaggtatacgaggggatatccccttgaggtattagaatccactcccatgttagaaggaatccaaaacagtatacatgcatccacgcgcacctcggttttgcatttcccgctgtctgtgatcacgaatcatccaattaaaaacaaccatcaaccatggattccaatgtgttctgcccctataaatagtccagcatctcattctctcgtctacttcaaagaatcacacaccaaaacctccattagttcctaaaccctagcaagaagcagcacaaaaccttgccacacttggctagtgagacacacca

SEQ ID NO: 3297 - DNA, 1501 bp, Oryza sativa
aaatactactatgtccaaaaaaaaaagacaaaccccagctattaacctgggcacgtatatgtccaggttcgtaaataagattgggttttttatgggacggagtgtgtatgttttacagacggatgtcactgcttatcagtatcaatatcaatcacacggtcgggtgcgcgtagcagggagccgggaagcagagaggagttttacgcagcaaatataaatgcagcgtggttagcatccacggtgaaggaccgatggcacgatctcgcggacggctccaccaccgcgacagcgcacgcacgcacgccccctcacatgccgcctcctgcgctccccccgcctctgccgcgatccagatcccaattcatcgtagtcgtaggccccacctccctgcggggcgggacaacctgcagatacccccatcgccgtgcttcaattgcgatggccgatggacctcccgcgtggccgccttgtgtttttccattgtttttttttgctcccggttttgtcacttgtgagagccggtcgctcgaatgccgattggtcgtcactcttcaagtcgtgttcggggtatactccgtatgaattaacagtagttgctttattagttgctggtgctttgtgttcgtctctgcatcttgctgtctcgtgcgtccttttttttttcttttgtcattcatcttcttcgctgtactggagggttttttttcccgtatttgctaacgtggtgtttgttcctccgtgctaacgactgattccttggactggagtgttattatgtgtttctatgctttagtgtgttttcagagttttagttagcggtggttagtgatgtgataaggtgaaaagtgatggtgtgtgctgacgggcatcttcgcatccacctcctcaacgtcatcttgcactttaccagaggggaactgcaaatcagcaatatgcgacagtattcgggtccatcaaacaaatgggacgggccgagccgtgactgtctccgacaaggccgcctatccagcccacagtaactccggcccaaaaggaggtctcatggcagcccacagtaactccagcccaaaaaggagatcgcatgacagcccacacccgtgtgtgtccactgaaaagtctgaaaccgacacagtacccacacgtgggaccccaaccctggaccggaaatggaccagccgccgccatatgccgacctgcacacggcctggtcaaatccactagcgctcgaggcggctactactactccaccatagcagggcccacccatcagtggcccattctcctcgagcctcgagctcggccactacgcactcagaattccttttttttttctaacgcaacagcagccggtacacgtacgagatacgatacggataccgatggtatgtattcagcaccgtacatcgcatcctacggcggagagacggcgacgagcaaaaccctctttaaatcccgccccttgacctcgccctcggaggggaaacccatccattccccccca

SEQ ID NO: 3298 - DNA, 1501 bp, Oryza sativa
ttacatgtaaaccacgagagactcaaaagtggttagagttcccagcgaatatgtcgttttacacggcactaggtagatcgctgaagccagtgattccggcaaggcggcgcgggtccaccagggacacgtcgcacggcacccggagcgccgcggcgtcgccgaccctgtcccagcacgacgccaccttccgctgcccgtagtacggcatcgcgagcgtcacctcgaacagcgcctcgccgcgccgcatgtcctccgcgagggcgtccagctgtgtccccggcacgcgcgccccgctcccccgcgcgacgacggagccgtcctccgccgcgcccatcggccccgcgcagagctccgggtccgccggcgcgcgcccgccggccagcgggacgccgcggtaggacaccagcaccgacgtgccggccctgacgcacgccccgcgggtggagctccgcgaggcgacgcggacggtcaggctgaacaccgggtcgagcgccggccggccgaggtccgtggacgggtcgacgcccgagacggcgttgatcgcgacgaagtagtcgggcgggctcgccgccatcccgtccgtgtcgggccggcggatgcagaggacgaccagcatgatcgcgaagatggccagaaacaggccgaagcatacaccgaaggcatccgtgtactcatcgtcttcttcttcttcctccggtcgaaaggagctgcgtcgaccaaggagaggtggctgttcttgctccgggaacgcacccatggcctcctctccagatttgggcttctacgcttgacgtgacgtcgtgtcaattgttaccagcacgtactcgtggacatccatggagtttgcaattgtaatcggccgcggcaaacgcagaattctacaacgcatcaacgcgaaacattcgaatagaaatcaaattatctcccgtatcattgccgaactcatctgtaaatcaaactcccaatctgattactccttggattaatcttccaactgcgacctgtatataactgacgccttgatacggcggacgctaagtcataacgcctttcttcgggactgtctaggcatctgtcgtgtgatttttgagaaaaaatcactcaaatttttcctcccctcaaatctgcatctaacggtaaaaaaaaattaacagtacagagaaaccgtccatgtagcctgtgattgtgctcgttagtagagtagttgcatttataactaaaattacggtgttttataactaaaattacatttgtaaaaacagtagatatggcatgtaagtgcactataattttagtacaagtgcactgtaaattttggtaactagaatatttgtcgttttagtataaatacattgcttgagaaaccatgcagatatctgaagtgttaaatgttgcatttataactaaaattacatttgtaaaaacaatagatatggcatgtaagtgcattgttttagtacaagtgcactgtaaattttggtaactagaatatttgtcgttt

SEQ ID NO: 3299 - DNA, 1501 bp, Oryza sativa
gcggcgaagccgccgaggagaccgttgcagacgtcggtcacgttccagtgccccgtcagccatctcttgccgtagagcgtcgtcagcgcggcgacgctccccgccagcgacgtcgtcacggcggtgcggcccaccgccgaccactgcccgtcgatcgtgcccgactcgccgtagatcttggagatggtggtgaaggaccccgggttgaagccgaaccacccgaaccacagcaggaaggtgccgagcacgaccagtgaggcgctgtgccctttcatcgccaccgtgcggccggcggcgtcgaaccgcccgatgcgagggccctcgatgaaggcaccccacaggccagcaatgccaccgaccagatggacgacgccggagccggcgaagtcgatgacgcccgacttgaacagcaacggacccgtcaaccggccggccgaagcccacccgtcggtggaccagaaccagtgcgacaccaccgggtacacgaacccggtgaggaaggcggagtagatgagatacgcgctgaagcgcgtccgctcggcgatggaaccggacgtgatgccggcggcggcgatggcgaaggcccactggaagaggaagaagtcgtagtcgtaccctgtctgcggcatgtgcttcagcccgaagaactgcttcccgatgaagcccttggacggcgtcccgaacgcgaaggcgaagccgaagaggtagtagaagagcgcgccggcggcggcgtcgagcacgttggtgagcatgatgttcatggagttcttggcgcggacggagcccgcgcagagcatggcgaacccgagctgcatggcgaacacgaggtaggccgagaagagcaggtacgtcgcgtccaccgcggaggaggtgtccgtgaacctgttgcagatgtagttggccgcgtcggtggagttcgccgcgccgccgagcagcggcccgaggctgtccaagcacgtcgccatggtgtgtctcactagccaagtgtggcaaggttttgtgctgcttcttgctagggtttaggaactaatggaggttttggtgtgtgattctttgaagtagacgagagaatgagatgctggactatttataggggcagaacacattggaatccatggttgatggttgtttttaattggatgattcgtgatcacagacagcgggaaatgcaaaaccgaggtgcgcgtggatgcatgtatactgttttggattccttctaacatgggagtggattctaatacctcaaggggatatcccctcgtatacctttttcttccaaattcgatgtaaatagctatggaaaaaatctgaaaaaaattaacaatgtagagtataatgatacctactagtccaccaaaattcatattcaaattcgatctacacatcgagaaacaaaaaagacaaatttagatataaacagtacgctactattcatacgctgaatttgtcttttttatatctcgaagtgtgagttgattttggacttaagattttgtgaagt

SEQ ID NO: 3300 - DNA, 1501 bp, Oryza sativa
gtaaagcattttgctagacatgagtgcattattatttaaagagaattttttactactactttcacaataagaatcatgatcctcaaacttggatttgaaaaagacccgttatttaagtaatatttctgtgggattttgtggtcactccttttgaactagggttgtcaatatatccaaaagtaaaactaatattgatattcagatggcctccttcggccttcccggcgaaaaaaactaatattgatataatgttgttgccaatatattgcgatcagagaagttgtgaaaatcttgcattgtgactattaacttaaagaccatttatatttggccagagattatttcgaattgtgttgtcaattttggtcaaagagtggacgtatacctctataatggtatatatatagagagagagtaagttcacatagttatctgaaattgttgcttagaagtgtgatttttatagttttgtgaaaggtagtgttgtttttgtggaatttattcacatatcgtatacactttttgcaaaaagaaaaaaaaacatgtggctgttttttggatatatagaattttatgtgtggatgtctgagggattatgatcttatgtctgttattttgggggatggggcagggaggtctagagctctggatgttgatatctcctggcaaagaattggtctagaatttgatctctaataactgtacaaatgtcagtcctttaaatccctgttctactctgttgcgagcatgcttgtctagtgatactgaacaatattggagtattctagagatgtcctttgcttcctgcagaaagtgtcattgttgttgctgtcatgtttatattctttttttggcttgttgctagctctttacttcatttctaatcaagtcttttggattttctatttttcacgttatgaagatgcacgtaggacttctggtgctcgccatgatcagaagcatgaaggtgtatctggtgcgcatgaaaggaacagggctgttgcgtgtagcaaccaggaaattgtaagcagcaaggattctccatccaacattgaggtagttttgtcaaattatggagctgggaaactatcattcacatacaactcttccctggcaaaccgttctgattttcatctgcctgacattaaattaatttgcaagaaaatggaggctagatgccttaggaaatacaagagcctagaacccaatttctcttttaagaatcttattaaagatacttgccagtgtattgttgaatctagtggacctagacatgaaggcatcatacaaactgttcctgccctggacattctgtccaaaccttcagtgccgcaaatattgcagtcaaatcaagctaattccgcttttatgccacctaataatgtcatgagccttggtggtacttcttcctcttgcactgttgctggagttagccagaattctagtaatatgccggttgttccgcatcaactacatattggtgccaacagaccacctcatg

SEQ ID NO: 3301 - DNA, 1501 bp, Oryza sativa
agatcaaactgaactgatgcagcattaagtatgaagagaagaataatatctagacaatcaagccgctggatgtttcatagagtggtagatatatcacataatccaagttaacattgttatctaacctaatcggctgccttctattgacaggtgctagtcggttataggttagatgacgatattatcaaagattatgtgagatatatgataactcgacgaattatataaacaagattagagtatcataaagatggaagcactaatctcgagaacacaagtcgtcataacaagttttacctcttattgaagatcgaaaccgatgcagctcaacccgaaagcaagaactcgtcgaaataaaactaaatcaaaagggtggcgatgcgccgagattgtattgaacgtgtgttaataattacatagggttcggggtctatttatacccgagaattacaagatatgtccataccggacacgactattatctctaacaaactctaagataccgtaagtctttgcagcagacttttgtccacatttatctctaaggaatttacataaaatatcctaattaatagatacaattgcctttctcaggactctatccatgtacggcaatcatcttgaagcacatcaactcaatcccgattgtcggatacgagccatattgtcagaattggctgtatcacttaacccagtctgactcagacttagccgtagccgatccggactccagccgattcttactctgcctccgcgataacatcgtcgtactagattgtgtcacatccctctaaaatcccttatattatgggacggagggagtgcgatttttttttttgaaaatcttttcttcattagtaatctatataaagttttcaaaatcaacttaccaacttttgtcataatcaatttgtgttctagaataataatcagtttcagtttcatccgtcatccatcctaacaaagaattcatctaggagtacgacggagagagagtaggagttagcgtaagatatatctaggagtattttttatttcgaatatagaataacgatatacggtactataacagattagtatttgtttgatacgtaatgtagcatagttggcccgtaaaccaggactcggatctctttccgggcacccgaagaactccacgtccgatcaacttacgacgtgtttcgatccacggacatatagaccagccttccggccgctccgtccgttccccctcctctctctccgcccccacccccaaaaaaaaaaaaatccatctagtctctcaatctcgatcaccaaccatgggcgcgctcgtcgaggaagaacagccctttttgcccctcagccgcggcggcggcggcgcctctggtccgagagcagcaagggagcgcggacgctcacagacgagcgacccgtgcctggaatgctgcggcatgatcgtcgggattgccttatttggggtcctcttcggtgccttgggctggttggccatcaatcatca

SEQ ID NO: 3302 - DNA, 1501 bp, Oryza sativa
gttcaacctcaccctccgcgtcgcctcgcggagcctcctgagccgcgcgtgcgtcggggtgagcagcacggccgtggccgtgtcgtaccacggcgtccggctcgccagcgcgcccgttgcgccgcgcgtctgcgcggcgcggaggaagtcggcggacgcggggccgttcgtggcgtggggctcctcggtgcgcctgccggggttcgcgcgggacagcctcgccgcggacatgaggaacggcgcggcggcgttcgacgtcgcgctcatggacgggcacctggtggtgtgcaggggcaggcgggtcggggacgcggacgccttgcaggctccgtgcgtcttgacccacgtggaaacgggtgcggcggtgccgcacacgggaacgtaaagaggctcgccgtaagagtatatctttgctcggccggccgtgatcatcttggcacagttttttcttagcccagatcttagcgcaattgtcttagtatttcgaactgatgcgatttttgggttacttttgtatttcctgcaagattattagtccaaattcaggttattttcttattctttaataatgtaaaatcctaaaccaaaatttctatacacacatcctttacttgtaagaaactcaaatggttatgaacaaattatacattttgactaacctagcctatgatgatttaagtcaatatataaatgtgtggtttcttcatctatatataccgttaaatttaaattttgacgtacatgcttatgaaagaatccttatattatcataatctaccgtagcaacttctattaaatgttcccctcaaaaatatttctattaaatttatctataacacgagcacgtacgtatgtgtgcaacatactctctccatctaacaaaactagcctagtattaggatgggacacatcctagctagtaaatctggacttatattttatattagtgaggttgtctttagttccacgcctaaattggaagtttaattaaaattggaagtttgaagaaaaaagttagaagtttatgtgtgtaggaaaattttgatgtgatgaaaaaattggaagtttgaagaaaaagttgggaactaaactcagcctgatacttactcctcctgtcaaaaaaaataacctagtacattttctattgtaaatttgatacctcttaatacttagatattatatagtattaaattttacattaaattaaatttaatacctcattatacctcaataataacagtaaaattgctcattatataaacaacagtttcttaaccactccctccatccggtcttaggaaacgtaacgtcggtgcgacaccagttactataccttcgttgaaaccaaacgctatattaggtaaaaaagaatacattaacatatataatttccgggatatggaaggctcaaactacgggaactatccgtgtgtattcgatttcagactgcaacatataccatttttaaggcttcagaagctaccaatatgtcagatcaacg

SEQ ID NO: 3303 - DNA, 1501 bp, Oryza sativa
tcaacgtacaacaatgctgcgcgcggcgccgatccaagtgcagccggcagagccagggccacctcctcgtcgctgcagcgcctgcgtggctgtctttatcacattcgtcatattgtccgggttgttgttcgtgttagtgctctcagccgctctatttggtgagcagaagtactacgtcgccatagacaccgcctccggcctcgacccggcgacggatcttccctggccagtgctgacccctgagttcaacctcaccctccgcgtcacgtcgtggagcgtcgttggagccgcgtgcctggatcccgccatggacgtggcggtggcctaccggggcctcgccctcgcgcgcgcgtcgccgccgccgcgtgtctgcgcgcgggggtggggccggacggagcaggtgccggtcgtcgcctcgtcggggaacggagtgcgcctgcccggtttcgcgctgcacggcctcgaggcggacgcgtggggcggggctgtggcgttcgacgtcgcgctgactatgccgccgaagggcagagacaaccggcatcagctgtggtgcagagctgtgccggtcggcgatgacggcggcttggggatcccgtgcaatgcaaattcggagtactaaaggtattagcggtgcgaattaacttgtgtcaacagtgatgtgcgtgcatgcacgcgtgtgtctgtgcgaacataatactatgtgtctttgtgtttttctcccgtgatatagacttgattatcttggatggtgaaatactgtaacgttactacagggtataactatttatagatacatgtgccataatttaaaatagggtctaaacctcggacttgctggtgatccgggtctagcaaaacaacggcgtttgtctactatatcggcacacagatgaaacctctcgttgcttgttcatagactgcagatacacaaggaaaagctaagacaccattgccaactagatagcctataaccccatcaaaccaacaaactgggtgcatgtgacccagtctatgattggtgggagtcacttgcaacacgtcagagcgcacccaagcgtagtacttgatccataattctcctagtctcatgggaaatatgaaaggaacggaatcactgaattttccgaaataaggagttatccacggcggccctcattgtgaacataaaggaagagtcaaaatctcgggctttggcgggagccaaacacctaacggagatgttgccatagttccccaatcttttttttttgtaaatattaccttactccttacttaaatattacttccttctacataatgagtgagacatggggaaaaggctagcttctcctctctttctcaatcggttttgtgattaaaagtaattaataattaaaaatagttttattactctgattggtattcgggctaaaattctagaaccaaatctggctcgggtaaggtaacaggcttagtcgaaattaatactacaatattgtgatgtccgattgacgaatttgtt

SEQ ID NO: 3304 - DNA, 1501 bp, Oryza sativa
tttcttgtcttttgtttcttggtgattgcaagatcaaattgactagcacgcttacgaacctaaaagcaagattttggacctgcacaggagttaagcagatcttccaggccagtgtgtgtttttcgcatcaaaacattcataaaaaaattattgtgaacattggtagtcctatctttgtatgaatgcttctcattttttatgactttcttttaaaaaataaatacatatttttttatttatttatctaaaaataaattttgtgataaataatgcatcacacaacaaactcataactctagtagtcttatgcgacaaaattctactgcatttttaacaatgtaattcatgaatttctatgttcatccaaaaggtaaaatagtcatttttattaaaattagacagtcaactaacggttaactgacgggagaagtatggaagggatcaaaatcaaattttggagatatataaagaaataagcaaaattcaagagtatagaaagctaaattttaaaaggtatatatagaaaggattttctcaacaatatagatacagaggcgaagccacgtgggccttccctatgtacaggacacagggtgttaagcttgctcatcacgcaaattttctccgcacaacaattagtgccacttcccttcgtcccttaaaaaaagaatttaatatcggatgtgattgtaacatattctagtactatgtatctgcacatatttatatttatatttgtagtaataggatgtgtcatatccagtactagattaactttttactgaacggaggaagtattatacatgccaaatatgcatataggacactccataatttttattctagattcactgctaaacaccagctaaatagatgatgcaaaacaaccagatcaaccagtgaataaggtaatcacttctttaccacacaaaactcggactacataatacaaatctacaatgaatgcacaccgtacttgagtaaattaatactgttcaacgaacaatcccaaatctctccccaaacaccaaacaagacagcagatcgaggaccgccccattatttaacagctctcatatgcatctgaattctgtaacccgctgcgggcaacggccggacgtgcaatccaccagaccaccaccgaaaccgcccctgtggtcacactcttcctgcaggcgcgcgcatgaacacgatccaaggcggcaagccggcctagctacctcccggccggggcacgtaaatgcggctccaaatcaaccaaccacctcgcatcattcaccgcatttgccagtatctcacctggcaattttttttacctttgctgcaaaacaagttgttcgtgtgtcgatcgagccagagctagccaaggcctctataaaaagagggatcgatctacccagctactactcgagccactggcactagtggactagtagagcgtgcatcttgatcacagtaaggacaggtagagagtcagcagtgcttctcacgtccgcgagcg

SEQ ID NO: 3305 - DNA, 1501 bp, Oryza sativa
acagcgaagagaaccagacctccatgagggtgacaagcagctgcctggcggcgtctcggacgggctgcttgccgtcgcccagccgctcgacggcggcgggcacgagggcgttgaggtggatcttgaagtggtcgccggcgagcaccgcggcggcggagagcgcctgcaggccgccctgggcgacgcggaagttgccgtccttggtcagatccatgcaggcgtcgaccagcgacgtcacctcggcgacgtcagccctcgcctcgccgcggcctccagcgcctcgtggagccgctccaccccggccagccgctgcttcgtgtccttggcgcgcgccgcctccagcgccgcctccatctccgccccacccccacccgacaaccaaccgaccgaagcttcctcctcctcctactcctcaccggcggcggcggcggcggcgaccagtaggcggtggttgggtcgcgcgctcgcgatgatttttgggggaaatgggagtggtcgcggatctgagagagacgaaaagggaggggagagagagagtgtgagacagcagcgagcagagtagtttcagagaattttgtgcacgttggtccctgtcatttcgtaatgtcgcatgtagcacccccggagaagtccaccgtactaccgccgtatatttgactaccgtttgactcgtatgtactactgcagcttaatttagattttgaaacttaagtttagagttaattttgggttgtttttcgttttcttcttttttcgacctaggctttttaatctgctaataataagtatacaagttttagtttatttttcaactttagtgtagtttgtcgtgcaattggtgaattagcaaatttatgagtttgtgacttacagcaattattgtttgtaccactagaactccattcttcatgaaaaggatggaacgagcgtagcataatgagatagtagtagggtggaaagtccaaccaaaaagtcatcacgtgaaagaaagggttaacaagcgtatgtgaggccctgttctttttcatggaatggaatgatggacaaatacacatgttttccgagcttctagacattcagttattaaaaacattcaatatataaaattcttataaatttgtttgaatccatttttcaactttatagcatttaattcatccgcttgtaacctcaaataatatcacaaatcattcaaatgtgaaatcttggtaattaaaagtttgaatcgtatgtgccgatttgtttcaataccatccatcagtcccatgccgttagcaaccgaaatttcgatccctaatctttgctggatttgaactcgcatcttagtttgttgagctttctaagttaagcagtcaagctttcaatctatcatgcatgaagtcacctaaccaagctgggatggcactgtcatctaacaacatatcccttcagtaagtgaaatctaacaaatttggtctctacattgccacaatcttttcaagttagttggatatctattgga

SEQ ID NO: 3306 - DNA, 1501 bp, Oryza sativa
atttagaatggtcaaggcaacctacgatcctagctagtgcgtcatccaaaactacggaaatttgttcaagagaatcgttgatctctaccagtaatattttactatagtagtatcaatgatagaaatgatctcaatgttgatttataagttttatgttgatataaaaaggtattttactacctgatagtatgaatagatacaatccattggattaaatatatgaatccattagattaaacatatgaatggtctggaccattgtaaaactcaccgtaaaaatgatcactgaaaaatatttctttcaataacagttgtcgagatcgatcttaacagtacaccatttcacaaactaacaagccatatatttttctcttaaactgcaagctaaaatctctcatcacgttacataaggcctgctgcatgcgtaaggtagactccagtagaagaacatcccctcaatacatccgtgcatagggcttcaggcgtgtatttttgccgcttccattttaatttgctggaggccggaacattttctgtggaagctttgcctccaaagagtgttcgaactactgccagaaagaagggtgtcaccctataccaaacatgtggaggcaaactgcattttgaggcaagcgccgttgttctaggggcttgggggccatgtgctgctgtgggatcgacaaggctctcccgatgcctaccatacccaatgagagttcgatgtagcacagtgtaatgcatacaaagtatggctcaactgtagaagcagctaggggcagagacaagggtggggcaattagggcttaggccctaggcttaggaccaaatttccattaaaatgttatgcaaaatactataaaaagctgaagatataaagagttttactaagaacacatcaacttagccctaatcggccctagcgtgatcaattctcggctccgccactggaagcagcaggaggtgatgtgtgtgtatagcaatgaaggtacagctgggtcataagagaaagtaattgtaggtacctttgcttcagaaattttggtacgtcaagacatctagtatatatatatatataaggtatcaagttttataatagaaaatgtaatacctcctgatacctttttaaggataataaaattgtccatataaataagatgaaagggagaattgatcgtaagtctagcaatgttttctacatgatgtagcaatgttttctacatgatgaaatgagagcagcccatagaattaacaagatagattatttttgtttctttaaaaaaaagatagattatttctggtataattatagaagttaaatttgaatttatatgtttgtaaagtgatataccttatattaatctatcttgttaaaaactttcatgattatttaggtgtggcatgcatatatgtaagaaatgggtatgccccttgagagatgaaagtccatctccatgttagtttataataccgaatgataaaaatgaaataatagtgatatgca

SEQ ID NO: 3307 - DNA, 1501 bp, Oryza sativa
aatcataagatgcacttgcaccaactatgatgacattacgcttcaactaatcctagctttatcaccccggctctcctctgttttcccccaaaaatagccctatgcttttgcaaaattacaagcataattggggtgttcatctcactatctcaggtatatatctactcccataattctgaaggccgcctaatttcagcatctgcttggtaggttgatttagcttataaacattgagcagacaaatttaagaaagggctttctttattagactgaaacatttctaaaattgaagtgaacaatcacgtgcggtggcttgtaagccggagctcaacgaatcaggtttacatgctacatccaatagatatccaactaacttgaaaagattgtggcaatgtagagaccaaatttgttagatttcacttactgaagggatatgttgttagatgacagtgccatcccagcttggttaggtgacttcatgcatgatagattgaaagcttgactgcttaacttagaaagctcaacaaactaagatgcgagttcaaatccagcaaagattagggatcgaaatttcggttgctaacggcatgggactgatggatggtattgaaacaaatcggcacatacgattcaaacttttaattaccaagatttcacatttgaatgatttgtgatattatttgaggttacaagcggatgaattaaatgctataaagttgaaaaatggattcaaacaaatttataagaattttatatattgaatgtttttaataactgaatgtctagaagctcggaaaacatgtgtatttgtccatcattccattccatgaaaaagaacagggcctcacatacgcttgttaaccctttctttcacgtgatgactttttggttggactttccaccctactactatctcattatgctacgctcgttccatccttttcatgaagaatggagttctagtggtacaaacaataattgctgtaagtcacaaactcataaatttgctaattcaccaattgcacgacaaactacactaaagttgaaaaataaactaaaacttgtatacttattattagcagattaaaaagcctaggtcgaaaaaagaagaaaacgaaaaacaacccaaaattaactctaaacttaagtttcaaaatctaaattaagctgcagtagtacatacgagtcaaacggtagtcaaatatacggcggtagtacggtggacttctccgggggtgctacatgcgacattacgaaatgacagggaccaacgtgcacaaaattctctgaaactactctgctcgctgctgtctcacactctctctctcccctcccttttcgtctctctcagatccgcgaccactcccatttcccccaaaaatcatcgcgagcgcgcgacccaaccaccgcctactggtcgccgccgccgccgccgccggtgaggagtaggaggaggaggaagcttcggtcggttggttgtcgggtgggggtggggcggaga

SEQ ID NO: 3308 - DNA, 1501 bp, Oryza sativa
gaagcatgatgttttagtactactttacctccttttcaggccatcgtttctgaaggttatagttcatccataggtcaaggctggacaggatttaatttttttcatagcaacatgttttggtttgtacaaacaaaaaatcattcagtacacacggacacacagctagaggtggagactatcagtccaaagactagtgatgcgtgcacatattgatgctttctctgttggtcatggtctcatggatgacgcgtaaggtcgaaaggaccctgtaagacgttagtgcttctcatcagggagtgagggtagtgtgcatgatggcaatgattgggtgcactcgcaagaggaattttcacttcccctcttgctcacccacctgtacaaaaaaagagaggaaaagggagattgtttgggagggtctaggccgtgattagtttcaaagtttttcttcaaactttcaacttttctattacatcaaaactttcctatacacaaactttcaacttttccgtcacatcattccaatttcaaacaaactttcaattttgacgtgaactaaacacagctctaatgtagctggagtgctggacctggtgcccacaattggtggtgctgatttcctctcttttgtggtgggagcagtaacgcatgctgcatagatagtatattcccctgcccttaagcttagtttgtttgtaccaaatctggattactaagtcaatttacaaccttgttgccctcatagaattacatcgtcatgagtcagatgaagtgctgcaaaactttgtcagcatgagttagtggctgaacaggcaggctgcattgctccaaactccatatattatgaaaaatgcgcatctcgaaaaggaagattgcttctttagctttatataaaggatgccctcttctctttttatcgcggatctgtggatttggttgctcagtgaaagctgattagactctgtttgttggtaaacatctggttgggtttattgtcccaggttagtcgtgagatgcttaacttctaagtaattggttagctacatgcctacatgaatgtttgcttctgaacttttgccggcaagcatgactgttggtcagcagctgctaccaaaatggtaaaaattgacagatcaattgaggtatagaggttgtctaaacttttactaacatcgatgcctttggtactctaattggaggacagaaggtgttcgaatgtcccacttaaataggtaggagtgacagctctacaattatacctacatttagtaagtttgtttgggagccccagaagtaggataggaacgaagaatcgtcaacagatgaagtgtagtagaattgtcaacagatttaagtttagtagattgatgtttgaggcatgttcagtaaaataaacgtactgaacacagtaaactttgttttctacctttcattgtcattctttcccataaagcgcaccacactagcctctttaaaatgccaccgtgcaagttcttggctctct

SEQ ID NO: 3309 - DNA, 219 bp, Oryza sativa
tacataaacatagaagcattatttatagtgataacactataccctagttttgtaattgggtgaagtgtttaatcgatatttcccaaaacagggcaacttttcctcaattattcgcaaaatttgtgtggcatggttcaattgtcccattattgggttcaaacatctagactcatttagctaagaaatactacaccattagtttagacatacttggtacat

SEQ ID NO: 3310 - DNA, 448 bp, Oryza sativa
ccgcgcacactatccccgttgggaacctctagtagcgaacagatagcatggagtttattatctcacccctccatgcatgcactcctctacgccatgaccagtgtgtgtttattctgaatattttttttctacctttttcaccactgcccaatgcccacttcgtttaccttatgctactgttttacttaaaatgcaatttacttcttcacccgctactactttaaccctctatatatcctgagtagagcctcgctacggtgctctccactaatagtagaaaacagtttgaaccgttgatcttatttgagctaaagattcaaaactatttatactaccacccaattagcgatagtagaaacataaaggggtattattgtctaaaagaaataagtgtgaaaagatataatcgttattagcagtgactaaacttttttccctcttttttagc

SEQ ID NO: 3311 - DNA, 1501 bp, Oryza sativa
atttcatcaatcttgaaaagccaaaacatccatttcctagcctcttctccatcaatacagagagaaatattagtccaattcatatggtggaattccaaacgttgcagcccgaatccaacgccagcacctgtagctttgacaaatgcttctttaagacaccaatacctacagaaacagacaattgttaactccacaaattttggcttgtaaacatgatcagcaccctgcacttgttctgaaaagaaaaaaatgaacaagaacaaatgcatacctgtagaactcagttagcataccatcatgactgtctgcagtaacaatgcagttccactcatgatctgtgagataggaagtgaaattgttgatgaactccagggcagtttctcgttggggcttggagatgcacacaatgtccaggccaacgaggcagagaggctcagatgctatgccaacgtactccccctgatgcgacgtgttgaagttgaagccaggaaggttgacatttttattctgctgcaacaacaagacgtgatcgattccaatttgggcttcagaaactgacagaatgtaaacgtgaaactgaagatatggatttgggatgaattaattgatgagaatatctactagactactactactaccagatagggcttcccttcaagcgtgcggttgatgcgaatttggtggaatggcattccaagggcatggtgcacgagcgagtacttgagcaggcggctgacgagcgctcgtttcctgtcttcttctctgacgaacctgcaccggtgaggtcgtgaggacgaggagaaaaatctagaggctgaattcaattgcagtagtgagtgggtggaatcaatggggagaaagaggagttggttggaaaaacctgtggatggcggggcggtcgtgcggcgggaggacggcggcggcggcttggaactcggcgggggaggggcgccaccggccgacgtcgacgagccacctacaccgccaccgccccccgctgctctgcttctctccttcctccatcatcaacaactcgatcaacggacaacggtcaactcaagagttaaggcagagaaagccgtagaccatggcctggccggccggcaaggaaaggaaaggaaaggaagagggacgacgacaacagagaggggaggttaggatgggcctttctcacgaggcctgtaaacttttgaagctaaactaggcccaaattgcatatgtgcatcttgccatggtgccatggcagagacatcagcaaattaaacagcaacagagacataaccatagccatcagtccatcaccatctgccaatctctcacattcaataacagtcgccattgatacgctgagtgttgtgcactacattgattttttcgtcagactcggaggagatggagattaattgagctcgagtgtgagactaacagcaatgctacgcaggctaaagatcgcaatagtaattaatggcgaatcgagccaacgtcagttcgctatcgaccg

SEQ ID NO: 3312 - DNA, 1501 bp, Oryza sativa
atcgatcgacaaattggaagccaacccgatcaaatcgcacccaggattgagtgagtgatatagggcaccgaactcaacaagccttacttgaatccgacgcaaaggaggagagagcaccggagtccgaaaatggaggtcgcggctgcgcctccgcgtctccgccaagggaaaggaacgggtcggcgaggcagcgcgtggaccaggtctcccgtggaacgtctccgtggggcccaccgtgtcagtggctgttggtccacaagacccggtgtagggagaagtgcatgccggtttggcgggctgtgtggaagccgtggtgtttggttggttggtactccttttcaggtctggtgagcgaccacccaaccccgcgagttcttatcggattcgggctgtgaaacgttgttgtgttcacccgttaataacagtgcctgataaatatattacttccggtgattatgcgaatgccctgcttataatctgctcaatgtagattaatgtggaaatggatcttctggattttagtgatggtgattatgaatatattcattaccacctctttaaatatgagatcatgaatcaactgataatatacggattgatgatcttttgtgtcttgacagtaaggatacccgatccgcataatttgtatttaatgatctttgaaagtgtaaacgtggtcagcttaactccagagaaaagaataaatcagatccggagttgtggtggtgcccaaaattctattgatgtatacatgccgtcctcgtgttttattaggtggctaggaaccatcttatttaatttagagaaaattgcaaaaaccaccccaaatgtcactctgagtttgagatgtctccccataagaagatttgttgcaaatccccacatcctaattcatcttgctttgatttaggcaccttctcttcacacgtgcgtgattcttgaagaatctcgtggcgaaatcaaccgagtcccactcggcgagagcaagagattacgttgtttgttctgtataaggcggtcattttgttgcgttatcatggtcatttcactgtgtttttcatggtatactagctatatattctaaactgatatcatgtgtattgaacaacatatccttttttttcatggacataatgagcatatagaaacatttgaacatgaagcaataatcatatagccagattaaacctgcatgacttcatctattgcaattggtcagatgacccaaaatagcatgtgttagtataggttaatcagaaattaaggccacacaatctaatgcaaaacggacatgttgacaaatcatcacgatgggcaggacttggctaatttcgccatgagatgctccaggaatcacgcatgtgtagagagaaggtgcctaaatcaaaccaaggtaaattaggaggtgaggatttgcaacaaatcttcttatagagttatagggggcatctcaaacttagagtgatgtttaggatggtttttcatttttccctttaattta

SEQ ID NO: 3313 - DNA, 1501 bp, Oryza sativa
ggtgtgggcagtgagaaatcacatgttagtgggtttttcttaaagagatagtgcttatacacacatgtaaggacgtacgaaaagagtgcaaacgaaccggttcgctttttaagtagtagagatatcatcttacgtagacttcacttaaaacttgatggtctacttaaaaattttaactccactggatatgcttttgttctcaattcgatcatgagccggttatataaactagtatacaattcccttaatatagcaagtttattaaacaactcattttattgttgcacacatgcagccaacggcggaggcacttcccgaacgggttgggcggccgcgtgaactccaccgctactgtctctattaccgttagctacttatacgagtataatacaaattgaaatatcgtatgagccgctatcttgtttttctttcaaaatatgggagacattatgaaaaaccatacggccaggttaataaagtaaaaaacaaatttacagaaggtaacgtggatgaagtgaagtctgagtaagcgctaatcatgcatggagcaatggttggcttgtgctaatcaagaaacgagaatataggtagtacaaaagcaatgaatgaaccattaagctcacgaatttaatctcagcaggtcaggtcatgtgcgagtgtgcgaccgtctgctacacatgcacacgcaccctgccattggcggtttcaagtttcaacctctagaaatctaatctatggactgtaaaaaaaaaagcttaaaattgtatccctccgtcccaaaatataagcatttttagctataaatctagacaacaaaaagttgttatattatgggacggagtagtaataatcagctaatttgggctgcgtttagttccccgtccaaaatttttttaagtatacactaataacaaaacaaattacagattccgcctataaactgcgagacaaatctattaagcctaattaatatattattagcaaatgtttactatagcatcaaattgttaaatcatggcgtaattaggctcaaaatattcgtctcacaatttacatgcaaactgtacaattggtttttttcttccatatttaatgctccatgcatgtgttcaaatatttgatttgatagaaaagttaaaagtatgaaggtaactaaacacacagccttggtagttatttcttagagctaaaaaattggttttctagctttctacttctattttattttgttaattcaacaactataacttattagagtacgaacgaaaagttaaatcgcttgaagagcttctgattatcataagaagctacagctattcagaaacccctcgaataagccattgctaaaattgaacggttgtatgaggtgcacaaatcttaaaacaaatcataaaattagtaattattaatttgatgattttgattaattgaagggactgtatgtatatatatagctctccaatgtggctgcatgatcaatggagaatatatatatatatat

SEQ ID NO: 3314 - DNA, 1304 bp, Oryza sativa
attcctgcagcccctgtttgttagttagaccctgtttagttcccatgcaaaaacttttcaccctgccatatcgaatattgggacatatacatgaagtattaaatatagacaaaaaaaactaattacacaaatgcgtgtaaattgcgagacgaatcttttaagcctaattgctccatgatttgacaatgtggtgctacagtaaacatttgataataatggattaattaagcttaataaatttgtctcgcagtttacaagcggaatctataatttgttttgttattagactacgtttaatacttcaaatgtgtgttcgtatatccgatgttacacggcaaaaattttcacccctagatctaaacacagccttagttagattagatttcctcattaataatagtaagctactagtatagtaactagtatagtgttttactgtttgatgatcacttatttctagcagtagtgggctgagactaggggtgaaaacggtaacggtaattcctggccgaccgacattcgtttccgactttctagtggctgagccatatggaaatggcaatcgactggaaaaaaaatgaaaatggtaaaaaaatatggaaatggaaatggttttgctgttataccgattgtttccgtatttaccatattcctgtggcaattaccatttcctataatatggtgattactgtatttctaaatatatcgatatttatagggtatgtctgtacttgacccacagtttagagattgactgactcttcaatcaaattcctaacctcaatatacttatgtaaagttaaatatatgtattctatagtttaatgtttccgtatttgttatcagtttccaatatgtactgacatgtttccgtccgtattattttgtttctggctttccaatatttccgatattattttcgtttccgactttaccatttttgatttcgtttctgagaaaaatatgattatggaaatggttgaggctgtttttcgatcgtttccgatcgttttcatccctagctgagacgtactctaaacacacacagtttcggttgaaatttatggaactgctgggtttaggctgcagctggttgactttagttaacagcacacaatttgcctaaaatttaaggaattactgggttctggcagattaattagttctcttacaattgcagcagcaatggtgcctccattaagtttttttttaatttgtatgtacgtaatctgtcaatgggatgtacgatagatgaataatcttgaactacttctactttttttaaaaataaacttcaactaaat

SEQ ID NO: 3315 - DNA, 1501 bp, Oryza sativa
cacacaatttgcctaaaatttaaggaattactgggttctggcagattaattagttctcttacaattgcagcagcaatggtgcctccattaagtttttttttaatttgtatgtacgtaatctgtcaatgggatgtacgatagatgaataatcttgaactacttctactttttttaaaaataaacttcaactaaatatttttaattattattattattattattattattattattattattattattattattattattattattattattactactactactactactactaccatatatatactccagtttggagtagtacatagagtaccgttgaagaagattggcaacaacggcaggtgacaattccgacttggaatggtgcagatatatacatgatgtatacatgatgaagaaatcaagtcagtgaaacctgcatgtcataatcttgagtcaatagttatgcacctgttcactaactttggatggagattcacaaatagaattcaataatttttatgatctttttatgctgtgagttcttattagttcgtgtatgcttttgtttattctagtgtgagtttttgttgaattggtgtaataattggttgtagctctttgagcaaagcccgggattatattccattatctaaaaaaaaggtggaaaagtctattcgtctcgagggaacaccctttatttttatatatcgtttacaaatcataaaaaaaataacaagatgtagatcaatatacaatatattaataaataaaatacaagctcaaatttaactagaaatagaaataataaattgattccgaataaaacatgtcattcatattgaaatttattttttaactatatatatctaattgaatttacatatttgttgagtgacatatcacatatttaataaatcttattatatttttattaaatttattaatgatattttaagatgacatacaccgacatgcacaagtaaagaaacatagcaccgatatatatatagggtttagggttagagttagaatccccttatctctaagaaggaaggcaacactatgatatgccttggtaaggaactaggcataactttgagtgatcaaagagaatcattcgaggagctaagctatgtttacattttcaaaatcaaatggaaaaacccaagtttctgaactgattgatgcaaaagggaatttgaatccatgcttttccattattcaatcacccaagataatgttcacaggttcatgtgaagcctggaataacttgtatgcatgtttcatatcaaggagatgacccatcttggtctttaaagcttttctcgaggacgagtaaaggactaaagtgtgggggagcttgttggcggtccttaactcatatttccaactgccaactctcacataaaatctgcataaacaaacaccaaactttgcaagacttacacataaataactaatgaattccacgagttttggtgattcaccattgtttgcaaga

SEQ ID NO: 3316 - DNA, 1501 bp, Oryza sativa
tctctgcatattattcagtaataggatcctgaccccagctcctaatctaaactctgtatttttcactgtttgcctgactagtgaattggagagctgtggactgtggttgggatggtagagtgtctgatctttttctgtcattaatggacctctggtttcttttcataatgagatagaagtgtttgtttgtgcccttaaatgttaggagaaacatatcgtgctttcatcatctaaaacctcacttgctgctacttgaacattttaagagttgaagtgggaacttaggttggtacatgcagatgtgtttgtgagcactcattgatatattggtggtatatatatgtgcatcctgaatatccttttcacccacattgctcattcaattgcccctctgcatatatatacacactttaaattggaattcacttcttcacccactactactcccctaagccaatgaattcgttcccatttctctggcctttattcgcctttataaacacctgccctcttgcttcccttctatccggataaaaatccttactcctgatgccaatgagaggttgtgtgtcctatcgactccaattgagcaagaaagacggagatcgagtagagctagtgactgagcatgagaggcgttgggagagcaagcactataaggtcaatactctgaagctatcgtgagcaataatgatgtgtttgcgtgcgctttgctaaattaaagctgtgggcaagaacttcttgaacgagaggtagctacagcgtgtggttgatcaagttactctagagagacggcatggctgccgcccgtatagttggcttggtgtacctacgcccatacaccggcagtgttttcttgctcatgggcagcttcagtgctgtttcttctacctagagtactcttaggagccaaaactttaattagacaagttaggccattttgactttatgtagtcaaattaatctctctaagtttaacatgtttacataaaacatcacagcattttcaataccaaataaacatactatatatcaaaatatattcaatatttggttttaatttggtgttataagagttgttacgtttctccgtaaaatcgatcaaatttatagaagtttaatttataataaaaaatcaaagtgttttgtaatatgaaacagacggagtactagaattttcatgcgtagtttgacctttttcacgatatgtttgccatcttatattgtggtgatactgtatcttgactttttcttgagcttggtatactgtcccctttgtcaattgttaatcgatataattaaaaatcatatgcatgcatacaccatatcaatagatcgtcgtacaaataactgaaggtcaagggtctgatcgaatcagtttagagttctatattgatttgcaaaatctcacttggacacacgttgtgttcatgagtgctagctaatgttttttcctccattttttttttccggagaactccattttcttccccttactttg

SEQ ID NO: 3317 - DNA, 1501 bp, Oryza sativa
gatttggggatttgagcctttgcacaggcactttgcgaacgaaacacgagttgggttttgctgagttttggggattagggttttcaagagtgtttgattgcggctgtttctggtttttttttcactactacagtacttttgtggttatggcttgtctattactctattgtactgtacaagcagggtttaccttaccagctgaccgctagaattcgggcacctttgaatcgcaggattgagaaaacagaggaataggaaaaacgtaggaattaaatgccacacttattggattcctatgggattttgaaacacagaaaagtcttcaaactatcgtttgattagcatacaggaaaaatacaggaaccttagacacataaagagaaaaacatgaggtgagacctcatcacctcatgcttattttcctccaaaattgctctagtaaagttcattccataggaatttcaaaggaattgatagaaaacaatcctttgtttcaaatgactctataggattatttcccataggataaaatcctctagaattcctatggtttttcatttgattcaaagggggccttcaagctctatccgtatcatgattttcgaccgcttttcgataaattccgctgaattttgatcaattttaatgtttgacattttgatttatcggaaagcattagaaattccaataaaaatagcgccacgtcagaacgtaaaaaaaaaacacgaaaaccgatggctcctcccaatcctagaattttatgaacctcggttacaataccgtgcccaacagcacctcccaatcctagattttggatttcttttagttttaaaataaactccaacaagttctccataaagatactcaaaaattgaaaacccatcttcactgatctcgttctccacaactcagagcatgcccagtataaatacaaaaattgtttcaaaatttatgtttttgaaattcctaactcaattttaaggtgtacactactagaaaaacacctttcccaagcggcccaaacatatattcgtgcactctgtgcaagtatcgacggtcgccttcaaacttaaaatctgagaaacaacttgggtaaaactggagttttacaaaagacttggaaaacccgacacctgggtcggtgcttgcgaactaaatgaatttccaaaaccgcggaccggggaacgtaccgggtgtacggtttcccgctctcgcacttaaggaccgattcccttggaatttcatccaaacataagacaagtacgaccacatgggtggaatgggacacccctggctgagtaactagcttatcaggggagtcttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgaca

SEQ ID NO: 3318 - DNA, 884 bp, Oryza sativa
agctattttcgcaagtggacctgttgtatgcctgcgaaaatggttgatttttgcaggcgttgatgtcacgccccgaactagtcccgaccggaactagcccgtgacgctccaaattaacctgttaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaagcggaagccaggacttagaccaatcatcacaggcgcgacttgggaactaggccgaaaccctaaaactcatcgtagccgacttgctcctggaagaactcctcgtcagcaggatccacttcatcttcttcagcaactgggggggggttatttatatagagcaagggtgagtacgggagtactcagcaagccaggggaaataagtgtttaatgcaggcttcaaggaaaggctgttgttttagtaattgattttgtttgaactcttttctaaaaggtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacatttcaaacggccacccgggcctagctgatcccgtcagctgctgatttttcaaacatcgaacccagtttcacaacagcaatttcacaagcagtagtcagacaaaactacgctaggaatcacctcacatccgcccatgaccgtgggcacggctgttcgagcagtttgttaacctctgcagagggggtacactttacccaca

SEQ ID NO: 3319 - DNA, 1501 bp, Oryza sativa
ttataaaaatatatagaaatattgtaagaaaacaaatatatttttaaaatatatttaatgtcataaactaatttagcattatagatgttgctaagtttttatataaatttagtttgaaaaaaagttaaaaagatctataacatgaaatggagttagtggaactgttgtgttacttaccttagggtgaaaacaaaccacaaggggtgttttgcaaaaactaggggaaaatgcttgcagtcaaacgtctgacgcaccaaacaaaattggacgtgatctgctcacgacctacatactatatgtctgctctcttatcttttctcttagcctagtttatggttgcacatttctctctctttctcttacttttctccttagtacttcactcttcactctaacatataagtgtgcatgtatgtaaaaaaaagggctatgcatgcattactgcattagtaacttcaaactatttttctcctaaaatatttattaaatctacaatctgattacactattatatccgttgcaattaaatctttacaataagatcttagttgattacattttgataaaaaataaataagaagaacaaaacactgttaaatcctaattgaaacatttttattctatatatgaaacatcgagttataagtgttgcaacaccgtaactatttattgagacactaaaaaaacgccggtgcaacatttacgttaaattagtgaaacattagaaaatacttattgaaacatctaaataatatcacgtgcaatatttataaagatctactgcaacataaaacttaaaatgtgcaacatagttaaattccaattgaaacatttatttctcacacgtgaaagatccaagtccaaacggttgaaacatttattttttttcttagaatataatgatgtgatatcttgttatatagatttaattacaacgaatacaacagagcaatcggattgtaaattggataaatagtttttgagaaaaaagtttgaagcatgtcactatccatgtacctctctcatttggtactgagcatgcacagttaaacttttcttgttgctgctcttctctgcatgcgcatgtaatagttcttttaatcggatggacatgaagggatggacgtggattcaatagtagaacaggcgtccgacgaaaacaatagcatcggacgtccgatccgtagtcgtctccaaaattaggataacctttgtgaaaaaaatagcccgaaacaggggtttttctgtaaacattattgccgcccgtcagtgcgcggaacacagcgatttctgccgttggatcgatcatcaacggcccatcgagcacctccggccgagccccgcctccccgtcaacaaatccggccgcctccgcccttcccgacgtttccagtttcccttccttccttcctccgcgtcgcttcccttcctttcgcgcggcgctgctccggtagggttttagccggcgatctctcccctctcgcgcgctcggcgactgagaa

SEQ ID NO: 3320 - DNA, 604 bp, Oryza sativa
ccccttagactcgggtagtagcacgagtagcctccctgtagctagccggcgccgccccgaccgttgccgccgctcgccgtgtgctcgccgccgtcgccgcccgagctcggaagcgccgctcgtcgccggcctcgctcggcgcagctccgcccaatccaacgctagcatcggattcccgtagccgcgtagatgctctcgccgccgggaatcggcccctcgtgacctcatcgccgtttcccccttctcccgccgccggttgccgccgccgcaattcgccgccgtcgggcatcctccggcgaatccgagccgttggctcgtctcccctcgtcctgtgcaaccacccggtgtgctcgcttttgcctgtatcgccgtggttcactccaccgctcgccgctgtagtccgccgtccgttccggccggcgtcctcgtctacctcccgccggcccgcgtggcagccacgtaggcgccacgtcggcgccagctcggccaaaaccgggtcgagtcgaccccggttagccgctccctccccgtgcgcgcggtccaccgcgagccgtgaggctgcgcgtgggcccgccgcatccgcgtcctccgcgaaccgcgcgcg

SEQ ID NO: 3321 - DNA, 1501 bp, Oryza sativa
cctccacttcacttgtcaatagttcattttattctctttttgcttgtaaaaattgtggatgcaacagcaagccggatcctttaaacttgatctctgtaatctcatcaatcctccgcgccatttccggtgtcaggtgattcctccaatcaccaaccacgccacgccggaagaatatgttgttcgcataggttttatcgaccatgtcagttgtccccgactggttcacttccaacctcgacaagctctccatggcgcaggcctccacgatctttctgtccacttcgatctcctgctccttcaccatgaacgggcgtccgacgaactcggctaggcgtctcagttggccgagtgtatcggtagtgagctcctcataggtcaagaagagtacctggcttggtctcttgacgtgccacctccaatagccgaggacatgctcccagtacgggccaaacagtgagacaccatcgcagaagtttcggtgtgcctcgttgatgtcccacggcctgaacctgttcaagaaatgccagagcgagatgaagcagtccttgggatcccggcatagatacaccaccttgcagctggagtcagcaacagagtccggcaacgactgggacgggatgtgcgtcatcaacagccgcggcgccgggagggagctcaggtcagggatccgatctttgatgaacacctgggtctcaaggaaaggaacgagctggtgggggctgtgtgccgcgagatcgtcggccctgcggtggagagccgagtgcaagagcgccttaagccaggtggtgccggacttagggaaggtgaccataaagatgtcggtggtgcgcgccgtaaggtgactcttgatgaccatggcactcacaaccccctccgggaacgtgtaccatccgtcggggtggcgactgtacgtgaagctggtgctgctgttgggcgccgtcgggaaggtctccacggcttgccggagttggtcatagatttccttgtgtgcggttgcttcatcggctgattggggtgcaaaggagagcgggaaggagggcgccatgaaaagtgaatgcagaacaccaaggactaatggttgttagctggtgttgtgatgctgtgattctgtgaatatgtgggagcgtaaagtgcaaatatataggcgaggagagacagattcggaagtcaagaggacatgagtagtgttcaaactggaagtgacattttgacattaactaccttgttagcatctctaaagtgttttcatatgaatctcccttttcttttgtcaatgcacgtgatgatcaacttgagcttacaagaatttattaattcttctgaagatcaaattgtatcatgtcgtcaatcagtgagtttagctcttaatagggggtattaccgccccttttcttagcgaggatgacacatgtgagaacgtactatactgattagaagatacctttagaatcttgtcctaagaaatatggatcaaaaatgataaagacagcctgttatatat

SEQ ID NO: 3322 - DNA, 1241 bp, Oryza sativa
ggttggaaaaccaggactataggtgggttcccacccgggagtaaaactcgtttatccaccagtgagtggaagcctctgatatatatacttgcattgcatatagtagcggattctcactttctcagttgatcttcattcggtgcacgctgacagaatattttacatgcacgtacacggctgtcttaattagcacactactacagaacatcatgtcgccactatagtgtcgccagtataggttccggtaatgctaaaacctgtatttatagacctttttccatcttcgtgggttgaaatcgtaaaaaactgacactttaagtaattataggtgacacaaaatataatagacgtcggtttttatttagaacagacacctttaatatattataggtgccggttaattaaaaccgacatctataatatattataggtgcactacaagaaaatgctttgtagagacatttttctagtactatagagacacttttcaaatgcttttacaatactatagaggcgttttaaaaaatgtctaataaatgtcttatggtgaattgtctctacaaatgaagaggtattttataaaatgtctataaagtggtagaggcattttctagagacattaaattataccacaaccatatgaaaccaatgtaaaaatgagaataaaatattttcccttgtttttgccaatccttgaactcatgatctcttgaacaaatcattcttatcttcaagacactaaccaactcaacccatgtcattcattgtatatgtttatgccttaagttacttatatttagccatttagtatacttttattgtaagaagtgtctctacagagtttaaagtgtctcaagcaaatgtctttacatgttagacacattttaaagtgctgaaagaatgcctctacaagataaaatctaataaaatgtgctgaaaatatttctaaagtgtctctagagtaaaattttctagacaattttgaaagtgcctctataaagtgtctctacgctataaaactcctgatcttagaggcaacttgcaaaatgcctctacaaaagtgtctttatataatgtttttgttgtagtggtgcccgtatcttttaaaaaaaccgacgcctattgaaatcgagtcgagccggcatcggatgagccgaccggcgggccccaccaagacgaggcgaggaggagataaggttcgatcgtcgtctcactctcttctctctctccctcccttctct

SEQ ID NO: 3323 - DNA, 1501 bp, Oryza sativa
ttatatgtcgttagccgcttttgtatgtattaataatccttgttaattactagttgttagtgtaactatagctgccatgaattactggatagtgaaagtaacatctcatttagctgaacgcacaaagttagctagtgaaagtactacttcaattcagtactgctgttgttcatcagaataatgctattgctagctagctcggtccattgttcatgcatattatttgcaacaacctacctatcaaatcggccaatatgaaacagtagagatctctgtagtaatgtatcggagagcagacaaaaattaagcatgttttgaagtgccgaggcctaatgaagcaatgatcagtcaccagtaatgcatctgcagaaagatatacaatcataatatcatgcatgctagggtagatgctgcagagcagacaaggttgtattcgtgatgggccggaacacaaagaattcttgggccaggccgaccgtccgtttgggtttgggttaggttgtctcaggctctcagccagtaccagcagcgttcagtattggactatgtcttaaatatatagttacatttttttagataatgacatactagtatatagttagataaatcttcaaaacatatcattcgatccttagtccaaggagattggccacaaagtaatctgttctgtttcttcctagtagatgagctagacatgtaccaagaagacagagatacccaagtccattggaaacagagtaacaaacaagtatattccaacaagaaatgcttcagtgcaaacaaatgatgaacttacaaggctacaacttggctaatgtacatccaaaatcctgaaacccaggtcataatttataagcaacaaactaatacctttttcttgttctcttcgaatcatccaatgacaagaaatgaggcaagcatacacgcacgcatttttttttctcctataaattcaacagctgccacaacattgaaaccctgctcctactgagaccacctgatccaactatactagctgctggtaagtggtaagtgatctctcattaattacttggcatttttatcagaggaattagttagcgttttttagcaatgttttctggtacggacgcatcgtcgccggagctgtcgctctgctcgccatatgggccgtggacgcaaggccgtagcccaaccgaggagctgggcctagctctgttggagtgtgcggcccacgtagagactgggcccatggagaaggccacgcgttgcctcgcgcgcgccacgggcctcgccgccgccgccgccgccggcgacgggccgcggaagcgcctcgccgtggcaatggtggactgcctcgcgcggcgcctcctccgccccgtccaggccatcaccgacgcgctcatcgacccctccgtctacctcgaccggcgttccgtcagggcggcgcgccgcgggttctttgaactcagtcccttccccaaggtggcgttcgtcgtcggcaaccgcgccatcgtcgagg

SEQ ID NO: 3324 - DNA, 1501 bp, Oryza sativa
tacagccctggctggaagactccatctccacatcgcaagccaaaagtcgcatactggcatcgcaaataccgtgggaagcttgataatcccgcggagagccacgtgccaatcgcgtgccactcgtttgactacacatcgcccgaagcacaaccaccattacgtatgccgctgaccagaacaacgcgcacgatagcaaccatggcgcgatcagactaacgcacaccatccccaaggccagaactactcaattcgcgggtgagagtgagacgatgaaacgatgaacttaccaatcttgcggacgttggtgttggtgaagaggtacatgaggaggtggacggtgcggaggctgaagctctggctgtacccggacagcgcggactgcagctccttgtcgtcgatcatcccgctgccgtcgcggtccgccgcctggaagcacgccaccacgttgggatccgtcccgggcgggaacgccgatggcaccagcgacgcgaacgggctgccgtacccgccgggcgccccgtacggcgccgacgagggcggcggggccccgtatggcgcgccgtacggctggctggagggcggagccccgtagccgccgccgtaggactggggccgctgggtggagggtggggcgccgtagccgcctccgctgccgtagggctgggtggagggcggggcgccgtagccgcctccgccgccgtagtaaggggcggaagaggaggaggtcttaccttccttgggaggcttctcgccgtagggcggggcggagggggcgggggaggagccgtagggcggtggcggggcaccgtagccgccggcgccgccgtaggggtagccggagccggggtttggcgggtagccggccatgggagagagagggattgcgaatttggggaacgagggttatcaagtctgtctgcgtcctctgatattttgtgtgtttcgaaattcaaaatggaagaaagctgtggagggtagtacgggttatattaatgatgaagatgatgacgtgggaagtagatgcggttgttgcaggcttgaagatggtgaggacacacggtgtacgcgtgagttgtgaaacgacgacaccgtgtactccgtcgtatttgtgagaacaccggaacatgtgtcacgtatagttgggtcgaaggtagtagaagaaagggcgtgatgcgcgtgggcagcgacggcacggccgcgcggccgccgccgaattgagtgtgcggcttaccttggcgctgcatgtttcgttattcgttcttgaaccaaaggttgagcagtgagcacggcacgaagcatcggggacgcgtttggtcgactggcacacgggaatacggggatgatccaatgaacgcatgcttcctgcttggaagtggtccattcctcagttaaggccattaagccaaagaaatttgagcacatgtcacttgattcgtctgcctctaaattttcatcacccaatccacatgctttttgagatgtgagtataactttctccgtt

SEQ ID NO: 3325 - DNA, 1501 bp, Oryza sativa
caagactcagacccagttgagttttgcctgtggagtggagctgaagccccactaggattgcctttttccgctgctgttgctttcgtttcggtgtgaggactaagtgcctcttctgtaagtatttacgcttttatttacgtttggaactgtatattacttgtcgttttgtgtaccctggctagtcctggacagggatttaatacacaaaatagtctggaaatttgggctaaatttctgggcgtgacagctaccgagtgaagcggaggcgcaacagctcaatatgtgaagcttggtgaagtggaggaagacgaggtggaggacccctaggcggcggctgtggaatctggtgacgggggagaagccgatggaggactggagagcaatgatgatagcaatggtcctaggtccgtgcgtgggtgctggagacccacgcgaagctaggggcaagggcaagctcggctcccaggctcacctccccccccaccgcagggcggtcctgactttttatggccccggtgcgaaactaaatttagaggcccttatcatactatataataacaatcaatagatacatatactaaattaatgttgtaaacatttaaattgcattcagaaataatatttaaatataaaacattgtacatgttacctcaaaagtttcttatgggattctatctaatcatctacccttttcttttttttcttttcttgctactcgatgcatactttctcgacaacatggcctggtaattgaaaaaaaacattattatagtagtttaactcataaattacaatacaaaattacaaatcaaaatttaaaatcgtaccaattagtttatcacaagcgtctagatgcacacggcaagtgagtcggaaatacacactagtgccttcgtcggttcgtccacctatcggaacaactgaataaacctaacatacgactatacattaatacacgggtacatggctatttacatattaacagataaaaatcacaatggtacgaaatttcaatttttcatatgacgattggttaacggccaaagcttgttatagcaaactctctaatctgatgactatacataactgaagcgggcgaagctaatccagctgctaccatgtaaatgcacaaacacataggatcctagctaatagtaatacctgaatcaagattcaagaggtggcaggcggcagtggctgcgtccaccgggcggtcacggagtcacagctgcattgcgcctcgtgccttactgccgtcgactgtcgtgcggagcagcagaaggaaaacgagaagccggcggccggcgtgcttatgcgtcatgcgtggccttgcgctgttgcgccgcgcgatttcggtgccgtgaggaggagaagattagaagacatgggcggcatcacaggatcgcgttctgttcgcctttcgcttccggcttccgtgcacggcgtgtctgttcaccttcttgttgggcctgggttggggggggggggtttcaagcggttg

SEQ ID NO: 3326 - DNA, 1501 bp, Oryza sativa
  unsure (1)..(1501): unsure at all n locations
aaggttgttgccagtcctaatgaaaaagcaactgaatttccaacaacctaatatatagaatggaaacatatcaatttacatcaagaataacatggatgaagtttgttttttctacatggtgaatggatgttatgacatactatgaggttttgggtatacatgttctatttaatttctataagttattttataaataacagaatatacctcagatcgatctttgcccgagccaaaagccacctgaaagattttaaagaatgtgtcatcagatcagtgccatcaattataactgatcccgggcaacaaaaaaacagcatctcaaaaggtagtcgctatacttacctatatatcctagagtcaatggcagaacactgagtgtacaaggagacaaactagttacaagtccagcaccgaaaattacagccaagctaatagagaaacatgtcagaaaagagatggacagaaacataaaatataatgaaagaaagtaagtaaacagattctgtctataggcaattgactgcaggggccgaaaagctaacctagtgaaactaagagcagacagctgatcctgaacagcttcgttggcttgctgacccgctgaatatagcaaatttccaaaccaatctccaacgctaaggtcagccaaagcaagtccagatgaccctagctgatcacaataaaattttatgcatgtattagctatatgccctcacaatgtaataaaaaggaatatacgatattgctctttcctatgacagataactacactgctgactacaattcacaattgtttctacgcagtagtacaatttgacatgttaaaatcacaacttgacacaggcatcacgaaatcttttgtgatcagcaagaaggggacagaaaattcgaaggcacatagtgctccctcaccagagaatccccaatttctgtnnnnnnnnnnnnnnnnnnnnnnnnnnnnnnnnnnnctgagaccaagaaacaccactcactaacgtcagagacatttcatcaaacagattgccagcgatagaacacatgaagggagcagtcaacagctaacactctacccgccacggtcgccagcagcatggggcgctggcggacgagagagcacctcgccgcggcctccaatctcgctccacgaatcgctgccttggaaaccgagctcccgcgctcgcggggacacccacgagcacacccgtaccaggggacgaggaggtggagggcttggaagcagaaacctgcgccgggagcatgggcggcaggtggaggtggtgctactgacggggcgcgcggccatggcgacgcagagcatggaggagtggagggagaagagggagaagagacgctgctgcttgggtcaaagggagaagaagccacacgcccgcgaggagacgtatagccttcgatgggccgggggcccacgagtcagtgcgacgcaagcagcttcatcttttggcttcatttaaagctatagctttctccggcaagccgtcgc

SEQ ID NO: 3327 - DNA, 1501 bp, Oryza sativa
ttatttaatgatttttaattccgatcaaaaatcggggcgttacagtagctgactgtcgtattatcgttgccgtcgcggcatcaccgccaagagacaccgcccgcgcactgcctcctacccttcttcggcaaaagtaggggtgaaaacggtaacggtaattaccggccgaccggcgttcgttttcgactttctaccggccgagccatatggaaatggtaatcgaccgaaacaaaaatggaaatggtaaaaaatatggaaatgaaaacggaaatggttttgctgttataccgatcgtttccgtatttactgtattctcgcggaaattaccgtttcttataatatggtaattaccgtattctaaatatgtcgatattataggacatgtctatacttgacccacagcttatagattgaatgactcttcaataaaatctctaacttttgtacatggctaaaatgaagttaatttataatttatatagtataagcttgaatttatgtatatatatataacatacttatgtaaagttaaatatatgtttttatagtttaatgtttccgtatttgttaccggtttccgatctgtaccgacatgtttccgttcgtattgttccgtttccggttttccgatatttccgatatcgttttcgtttccgactttaccgtttccgatttcgtttccgagaaaaatatggttacggaaatggttgaggctgttttccgatcgtttccgaccgttttcatccctaggcaaaagtggcacgaaaccaaaagtttcgcacctccagtgacacttttgcaaagacacacagattgggtggcaagaattcaaaggcacacaaatcagatggcatatcctcaaatttcttaggccacggtcccgaaacacatatggccttggtaggtcttgcaatacggcaatacctaaatacttgacctttactttatttcctatccttaatccaaagattgtagccagactgcgtactcagtttgtgatttcccatcttttcaaaataaaataaaagatgcttatttgtgagattattggtagtttacctcgagaggatttagcaataaggactagtttcaaactaccactgattattaaaagttaccgggcttaccgcgggggcacggtaatataaataccgcggtaacctccttaaattcaaataaattttaaaaatagtttgaatttttaataaattttgcgcggttttatacggtttttcacggttaccgccggggcgcggtaaccccgacctcggcggtttgggaaaccctggtgccatctcaccttcccatagttcatactgaggcccaagatagagctaattcagcccatcgtaagcgatatgaagggagggaggaaacagcggttagatggatggataatccgataggcgaccgaaccaacggcccaccggcttccacgtacccaaccaaacaagcacctccttgccttgcgccatccctgacagcacagagcactgacacc

SEQ ID NO: 3328 - DNA, 1501 bp, Oryza sativa
  unsure (1)..(1501): unsure at all n locations
cttggtagttgaacaaaactagaactttctgacatttaagcaccacattttgaaataccaagacaaattagacaaacaataagactattggtaaagaaatttgccatagcaactctggttctaagcagacagtccactatctacgacggttgtgcattcttaggatgggtagaatgatattcatgtcgattcctagaattccaatccacagaaaaagattagccgacattaccagacctactgacctagatatctagatttaaaaatttctaaccctattatcgcctaacaaatcaccacctgaacttaatcgaatcatacaaaaacgcaatccaatccatagaaacaaagggaacagaacaagcaaatcagtcatccataccgagatcaggaggaggggaaggcggtcgtggagcgcggtcgtggcgggtcctcctgtaccatggccgccgatggtgattccaattccccatcgccgggaggaagaggaggaacaccagactcaaaatgattcgccgatgctctctctcgctcttgacggcaatctcctccggcaaaccggaatgctatctcgccatggaactaggcgccgcccctgcaccgcgagattgggcgccgccgccgcaatttccaaacagtgagatgagctgaggcgacggcttgccggagaaagctatagctttaaatgaagccaaaagatgaagctgcttgcgtcgcactgactcgtgggcccccggcccatcgaaggctatacgtctcctcgcgggcgtgtggcttcttctccctttgacccaagcagcagcgtctcttctccctcttctccctccactcctccatgctctgcgtcgccatggccgcgcgccccgtcagtagcaccacctccacctgccgcccatgctcccggcgcaggtttctgcttccaagccctccacctcctcgtcccctggtacgggtgtgctcgtgggtgtccccgcgagcgcgggagctcggtttccaaggcagcgattcgtggagcgagattggaggccgcggcgaggtgctctctcgtccgccagcgccccatgctgctggcgaccgtggcgggtagagtgttagctgttgactgctcccttcatgtgttctatcgctggcaatctgtttgatgaaatgtctctgacgttagtgagtggtgtttcttggtctcagnnnnnnnnnnnnnnnnnnnnnnnnnnnnnnnnnnnacagaaattggggattctctggtgagggagcactatgtgccttcgaattttctgtccccttcttgctgatcacaaaagatttcgtgatgcctgtgtcaagttgtgattttaacatgtcaaattgtactactgcgtagaaacaattgtgaattgtagtcagcagtgtagttatctgtcataggaaagagcaatatcgtatattcctttttattacattgtgagggcatatagctaatacatgcataaaattttattgtgatcagctagggtcatctggactt

SEQ ID NO: 3329 - DNA, 1501 bp, Oryza sativa
tcgagttccttagccatggtttgtatctcatgagcctgttcgactacagaacggttgtcagccattttatagtcatgaaactgctccatgatatacagatcattgctagcatcagtagcaccgaatttagtattcagtgcatcccacaactccttagcgtcggtcatatgcatatacacctcgaccagacgatcgccaagaacgctaagaatgcatcccacaaagagagtagtggcttcctcgaattgcttctgctgttcagcagtaagaacttcttcaggtttgccagtactcacccagaagcatttcatagctgtcagccacagagtgaccctgatctgccatctcttaaaatgcacaccggtgaatttatccggcctcagtgcatcggcaaaaccagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcacgcgaagcgcttcccaaaaaccttacatttgcagccttctcccggtgcagaacgtcgaaggcagaggttccggagacctgctctcccgatcgccggtgcacgccggcgagcgggatggagtagtctacgagcgacggcgcagtatagagtaggaagcaaaccctagattgatttttttgtatgttgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgcaaaaagaagctgcatctgcgcaagggtgaggagccaatttttcggaccattcgacgcgtacgtcgtgcacgcgcgcccccggcccggcccggcgagcgagcgcgcgcgtgtgtttcccctcttctctccaccacacatgcttcaagcgactaggagggcatcctccattttaaggaggtccccctctcctagaataagcaaggtggtactaaactccacatgcatgccatctcatgaggtgggcttttgtgatttttcaaagaattaatcttcgagtgggctaaggcccattcattaattccaacatccccttgacctaatgtataagagcaagtttaatagtacagtccactactagctcaaattcatttatagccaatttaatagtcaattcatacaatagttgctta

SEQ ID NO: 3330 - DNA, 1501 bp, Oryza sativa
gcatagtttcttcttgcaatagttagttatattttgaatttcagatattttaaatagttttgtttttttttacttttggactctaaacgatactaatgcattgtgaccagagtctgtttttacacttgtatagttgtatttccatttccacaataagtttgtttctgattgatgtttgacactttgacagtttccatgaatccgtgtccgattgctttactatttcttttcatattttcatccgattaacatatccttctccgcttgccttttttatttttcttattttcttcgattaacgtggtaatttctataccttgagagcgaacgttttcttattttcttcgattaacgtggtaatttttagatcttgagagcgaacatgatagctcctttttctattactttattaagttaatagatgtataaagacgatatcctagctcctgctaattcattgtgtcattattaatattatttcttgattaattaaacctttagagtagtcctcaaaaaagaaaatttgacgaccgtggcctcatatatatactcctatatatccatgtagggaccggtcactgattagtgcatgggcccattgtttgatgagactctagggttagctaaatgtataccttcatatactagtatccaaaatatatatattattaataataaaattagtaccattttaattaattttctataattaggcgtggcaaggatattatttgcattactagttttatttatttctctctttacagatcatccgtagtaaaccaaaaatgtaccgatacattcattacatttgtatatatgcatgtggtggtatacatttcagatggcttttcccatctgaagaaatgaatataaaaaaaaggtacattaagtgaactaattctattagggaactcactctatttatacgacccaagttagccaccaattattaaaggaatatattaattttgaacttagcatgtttttataattcagtttacagcacggcacatattttctcaaaccgaattaggttcctactgttgattcataaagcgtgcatttttttatttaactttagtaattaagtacgacatatatatcctcaaaaaataatttgtgcaacacattgggagtacattgtataatcatattttctcttataattaaggatgcacattccaaaaggtgaaaattgaggcgtaagaaggaaatttggcctatctatccacaagcgaatataaatagccaaaggttataaaaatacttatattttaggtctcataattgagaaacaagaaaataaaacaaaaatactagaagactaagcttcagttttcttctccctaacaagcctgccacaccaaaaaccacactgagtcgatcttatgtgcagtctgaactcttacacccttatttgttttacatccacctttgaccagctcctttgcaccatatccctatcactggatggatccaatcgatccaaatttagcga

SEQ ID NO: 3331 - DNA, 1501 bp, Oryza sativa
ttgtggatttctatttttagccttaacttttggaccctaaaagtcttaccttaaaattaatttcagccatatgtaatatatcagcttgaaggtcttgtttgattcaactactggctactagattatcacggacacatctctcataccgctaaacggtgtactttttttaaaaaaatactggtatctatataaaagtttctttaaaaatcaaataaatccatttctaacttttaatattaaagttatcataaaattagaataatctacaatataacaactaacctcacaatcaaatacggtctatacgcaactctaaaaatagcgctttctaaacaggtcggcaatatggtgaattggtgcgaggtcaatacccaataatttatgtgaagagcgacagaaaatcagttaattgagatgtattttgcgcttcatgaattgactgaagtcgaactaaaccctgctggcataatcaactagccatcgggaaaaaggctaatatccacacgcaaatacagtggctcgggatgaaacactgtgtgacatgcgtgcatatctgccacacatacacacatacatatgcatacattagctgggatgtcaccgaatttaaatattttttttaaaaaaatactccattcatttttttaatatatgaccttgcgtttgatcatttgtattatttataagttgcacttatcgtttattttcttataatttattttatcattgaagtactttaaacatgttttatatttttcatatttacgtaattattaaatgagataaatcatcaaatgtattgtttaaatcagtatataatatagtatcatataggagtattaacaaataaagggagtataaataagtaggtcggaatcatttaacgtctgaatctctacgaacctaaaaactaaccaatcacaagctctgcccattcacttcctcgcttttttaccacataaaaaatctaatgttcatgaaagttgcgcacagtatatacaaagtgcaaaccagttactagtgcctatagtgtcattggcagatggggtctaccaagagcagtgccctttctgtcagtgacgatcaaaacgcacagtgagctgcaacaatgcatcgatcatccatggaccattgatactgtagccagaacagtatggccatcagctgtatgcgtccccacccacaagcttgccacaaaagagacgacgggtacggtaccattgctcactgtagctgtagcacaaaggggattgatagcatccgcatgctcccctctcctccatttctctcctcacacacacctctccttcaccctaaccttttctttttcctcttgcaacagttgcttctaccttgtgttgctccctccctttcccctccacctctcttgcttggtttgcttcctcaaaatctctatccaaatccctcctcctcaccttcctgcgcctgaaaagttggggccaatccggcgcttttatctggtggtgataagctgcacatg

SEQ ID NO: 3332 - DNA, 1501 bp, Oryza sativa
ttaatcttacagcaatgcgagtttagcagcttttcagtagcccggccatcaacgcatgcgttttctcgtcagtcaagagtgaacgaagagtgggtttccatgcgacaccctaccctagcgctggatcctaaaacaatactttatccctttaattgacctatataaacactggagtgctactgtttaattactgcttgagttgagtacttggggattttcttttcatgtgaaatggcaaaattagagcatgtacaatagcagactattagtcagctacaaatatattttaataagataaaaaatgagagagaaaaatagcgggctacagatatgtagccagctgtagcacggacttaagacacaatgtgtgtatgacaggtgagaccgtatattaatagtatagtaagcaactattgtatgaattgactattaaattggctataaatgaatttgagctagtagtggactgtactattaaacttgctcttatacattaggtcaaggggatgttggaattaatgaatgggccttagcccactcgaagattaattctttgaaaaatcacaaaagcccacctcatgagatggcatgcatgtggagtttagtaccaccttgcttattctaggagagggggacctccttaaaatggaggatgccctcctagtcgcttgaagcatgtgtggtggagagaagaggggaaacacacgcgcgcgctcgctcgccgggccgggccgggggcgcgcgtgcacgacgtacgcgtcgaatggtccgaaaaattggctcctcacccttgcgcagatgcagcttctttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacatacaaaaaaatcaatctagggtttgcttcctactctatactgcgccgtcgctcgtagactactccatcccgctcgccggcgtgcaccggcgatcgggagagcaggtctccggaacctctgccttcgacgttctgcaccgggagaaggctgcaaatgtaaggtttttgggaagcgcttcgcgtgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttacta

SEQ ID NO: 3333 - DNA, 1501 bp, Oryza sativa
gtgttaaaataaaaattataaatgcaaccatgaaaataaatttatgcataaatttaatttatgtagggaccacactcctacactttgaatgtcatccaaattgtcatacaaaattgtaaaataatttaacaacatatattgcatgatcatacattactttgcaagcatggatagaaaaattagatatataatatgtaagtgaaaagaacaaatttaactatgaataacataacaattataaaaaaaagattttacctttagttggatgcaacaatagctaattaattatgtcttttgaaatatgctcaactgacgagataaattaaataggttgatttgtacataagcgttctaaaatatagtatacattatcatttaatggacttagaggtaaaagaaacaaatgaatattactatgacttccatatcttgtagatacaaagataaatttgtctattttatatgcgtagaccattaaaaatgtgaatactcctgtatatgaatattaataggctacgagcatgttcattgttcgtacgcatgcataactaactttaaaatccatttatatttctcttatgcaagctcccctcctcctgtatagaaaatatattttgtgataatataaatcatatagctaatattttacgtacatcattagattatttactacaaaatttataattcaagacccaaaccattggatctatctcaaaggaaacaaaactcctcccctcctcatgctgtacgtacatgtgcatgtctcccggaagaaaaatcaggatttatctactctatctttattgatccatatgtaaaaatatataacaaattaattacgttaatatgaaccaattaaaaggagggctagcttgatggtacattattaacaataatattttttgagatttattaaaaaaatccccaaaacattcaattaaaaagaaaaaaaaacacattacttttaatttgaacttaatttgttacacatgatttctaaacgaaccaagtctacctccattttaaatggtgaaaaagaaaataataattacggatgcattaaatatttcatagtataaacatatttctgaagtttggcaagtatggttaatattcatccctggtaagtttctcaaatatagcctatggtatacatgcccgcgcggatacgcgggctaccatcctagttaggcttaaaagatttgtctcacaaattagtcgcaatctatgcaattagttatttttttagcctatatttaatccttcatgcaagtgttcaaatgttcgatatgacagggtgtaaaatttttgtgtgagaactaaacaaggcttaccataccactacatcaaatggcgtggtcaaaaagtttatttacataatagcctagatggtttattttttaagtagtttttagatcgataaaagttcaaacaataaataattcatgaaatttctgcttttcagagggattggtatcccatctatcgtatctgatcatgg

SEQ ID NO: 3334 - DNA, 1501 bp, Oryza sativa
tatctgaaattcaaaatataactaactattgcaagaagaaactatgcataaatacaatttagactaatctgaaattacatttttttagaaaatctaatattgagaccatagttgtatagaatttacttaaaaaagagtcaatataaaaatataatttaaaaatatctaaaatccctaattaaaaaaagaaatattcgaagagaagactagactccatacatgtatgcaatgtagaactaattaaaatttggaactaaagttagagtccataaagaaataaaatttaaaaataactaatattcgaaattaaaaaatattgaaaaaatagtttagagtcattatagaaatacaatttacaaacaacagaaattcagaactaataaaaatatatattggaagaggagtctagagatcaaataggaataaaatttaaaaataattgaaattcagaattaaaaataagaaatacttattgaaagaaaggtttagagcccatatggaaataaaatttataaataacagaacattgaattagaaaagaaataaatattagaagatgagtctagagtccatatagaaatccaatttagaaatatcaaaaatttaaaatttaaaaatagttaataactatcacgtatatacaatacaatatgaatattacatattggttggtgcggttaagttagtacaaaatttaaaactatgttgctattttaatatattttaattatattatgtgaaaatatatatgctactatgtgaaaaaaaaaatataacgttactagccacgtatgtaatttgcgcgagccaccatactagttttaataaaaatgaaaaacacacacatatatacacatgctttgactaacagagtctgtcgatcatatagatatgcaaaagttcatggtgttctaacaggaggtttgtaatttgtcgcctcatgttagacaaaaatcacgtactgccggtactaattgtacaagatcagtacaggatcgagagcatgcatgccatcaaaaagccattcttaaagagacacagagaaaaacgaccttaccagtagatattacttcatccatgcaaaaggatcgatctgggccgtccaatcctccaggatatatactgtggcgaatttttatatatatatatatatatatcccagagaaaatgtcgtcacacaggagaaatgcatgtgcaaacccagtgtcattcaattgcttgcacacttagattcgccttgtcgaacgccactcgatccccattccttcacatgatcttgcaccccgctttcctatcgtccaaagcctactacagttatcaaaagctgcactgcataaagacattgtaaaaacaccaacagctaaaatcctcttcttcaggccatcaacactagtagctgcagctggatcgagcatgctcatctcctggtggatcgatcacattggagactacagctccaatattacaagatgaacattgcttgatggtttgaaactttttg

SEQ ID NO: 3335 - DNA, 1501 bp, Oryza sativa
  unsure (1)..(1501): unsure at all n locations
ctaactaccatcatgtactcttaatcaatacccagtgttagcagcagatcccaagatcgaattgcaagcacatggaagaggaatttcaaattatttgcagctgcaggatgcatgacgcgtatatactacgtcgtgttcctgaattttccgcgcagtacctgaaccagcagggcgagctgctcgacgccgaaggagcgcgcagcggcgagcgtgtcgagggcgaggtcgacggcggcgccgcaccgcgtgtgccagcaaccccgggcgccgcaccccgggagcggcccgctcttgggcgccgccaccgacgcctgcccgctgtacaggaactgcagcacgagcacgagcacctcgtaccggatcgagctgacggggatgacaagctccagcgtggcatgcgctcctccaccaccaccggggccgncacgcccttcaccaccagagccgccgccgcctcccccggccatcggccagtttaacggcggcggtggcggcggcggctggtgattcggatcgagcccgcagaacaacttcctgaagaacaagctccgcgccgccagcacgcagcggtgggcgtgcacgaggcggccctcgacgctgaaggcgacgtcgctgaaggcctggccattgatgagcaggctgaggtagtcaagcgacaaggatttgagcgagtcctcggagctcatgatctcatgtgcagcttatcaccaccagataaaagcgccggattggccccaacttttcaggcgcaggaaggtgaggaggagggatttggatagagattttgaggaagcaaaccaagcaagagaggtggaggggaaagggagggagcaacacaaggtagaagcaactgttgcaagaggaaaaagaaaaggttagggtgaaggagaggtgtgtgtgaggagagaaatggaggagaggggagcatgcggatgctatcaatcccctttgtgctacagctacagtgagcaatggtaccgtacccgtcgtctcttttgtggcaagcttgtgggtggggacgcatacagctgatggccatactgttctggctacagtatcaatggtccatggatgatcgatgcattgttgcagctcactgtgcgttttgatcgtcactgacagaaagggcactgctcttggtagaccccatctgccaatgacactataggcactagtaactggtttgcactttgtatatactgtgcgcaactttcatgaacattagattttttatgtggtaaaaaagcgaggaagtgaatgggcagagcttgtgattggttagtttttaggttcgtagagattcagacgttaaatgattccgacctacttatttatactccctttatttgttaatactcctatatgatactatattatatactgatttaaacaatacatttgatgatttatctcatttaataattacgtaaatatgaaaaatataaaacatgtttaaagtacttcaatgataaaataaattataagaaaataaacgataagt

SEQ ID NO: 3336 - DNA, 1501 bp, Oryza sativa
gtactccccctgatgcgacgtgttgaagttgaagccaggaaagttggcatttttattctgctgcaacagcagacgtgatcagttgcaatttgggcttcagaaactgacagactgtaaacgtgaaactgaaagagatggatttgggatgcagagcagacatgaactaattgatgggaatatctactactactaccaggtagggcttcccttcaagcgtgcggttgatgcgaatttggtggaatgggattccaagagcatggtgcacgagcgagtattggagaaggcgactgacgagcgcccgtttcctgtcatcttctctgacgaacctgcagcggtgaggtcgtgactcgtgaggaggaggagaaaaatctagaggctgaattgaatttcagtagtgagtgggtggaatcaatgtgggggaagaggaattggttggaaaaacctgtggatggcggggcggtcgtgcggcgggaggagggcggcggcggcttggaactcagcgggggaggggcgccaccggccgacgtcgacgagccacctacaccgccacctccccacgctgctctgcttctcttcttcctccaccatcaacaactcgagttacggcagagaaagccataggccatggccggccgccaaggaaaggaaaggaaaggaaaggaagacgatgacaacagagaggggatgttaggatgggcctttctcacgaggcctgtaaacttttgaagctaaactaggcccaaattgcatatgtgcatcttgccatggtgccatggcagagacatcagcaaattaaacagcaacagagacataaccatagccatcagtccatcaccatctgctaatctctcacattcaaaaacagtcgccattgatacgctgtgtgctgtgcactacatttatttttcgtcggactcgcggtggagatggagattaattgagctcgagtgtgagactaacagcaatgccacgcaggctcaagatcgcaatagtaattaatggcgaatcgagccaacgtcagttcgctatcgaccgacataataaatcagtttggttgtgaaccaagacatctcatcatcccaccctggagtcaggagctcaggaacagcaagcaagaggagaggaagaagctgagatggctgcaggcgacgctgcgacgccattgctggtgctggagacggcgtaccaataccatgagggctgccccgcctgcgccgtggagcgcaacaaggcggtcaacccgggcatcccctacatgcgcttcttccacatctggatcatcatcctcgtctcatgtacgtacgcgcctcctatcgatcactgcttcatttatactcctacgtgttcatgcatgcttcgcttcctgcttgactgcctctccaatctccttattattcatgttatattcgaaaaagctaatggacgagcgctcgcgttcacccacccccacgcgatcagtttactctgaccaatcccatgccacgcgaagtataggtggcca

SEQ ID NO: 3337 - DNA, 1501 bp, Oryza sativa
cttttatgttttgcccccatataattttgattgcgtgtcaacacaatgttgatcgtggttgtgcatatactatcagttattcaacttcacatctagcacctgcctagttgtctttggaccctatgtatatatactgtggccttgtttagttggggaaaatttttgagtttggttgatgatgagagccttgacgacgatgacattgaatgcttcgatgcagaggacataatttgagaggagaacccggacgatgaaatcatgtcccacttgttaacctagctagtaccaatatagccacgtacatcccatgtgcagctcctgcaaaaagagacaaaaatagtgatgttatatctccaatcaagtagtttacaggcatacccagttagtgaaattctttttcaaaaaagaaaaggaacccagttagtaaattatcacgaagaaattagatgatagactatatataggtgcttctcatcgtctgagaaagctagaatatttgatgacagtagttttatgtgtggtttggtggcacccgagttctcagtagagaacgattgatcaagcacctttcttagaaattatctggatgccttccactcctagtaggagggcaatgcaattctcaaacatttctcacccagctacactcaagcacatcacagcttgttgttctatcagtgtacaacacgacagcgtcttcttctctcacttctcagttatcaggcattagacaaggtatttgatgaatcagattcagaggataaggtgagaagcagccatgaatgaggccatgtatatatagagaagatggctggcctgttggctgcatgttagttgtcattagttgtcagagatcgaagaagagtttaagcagagttggtataggatcgaattgatgaaaaaagtttcagaaaagagctagcattgttgaaattacagtaaccgttgctccttttattttgtgctcgttttccttttgggcatggctaattgggcattttcatgctattttaatttctcaaacacccgaatagctgcatatgaatactctgccaaaagaactgcaaatattttctttttctaagaactgtacatccttctcttcgtatttgagacgaactctagtactaaaaacattcgttaatgctagctttatctgtgcaatcaaccacaaatgtttactcatctcgctacaagtttttgcaacgacgagatcatcctgctcaaccgtagtttcttccaataatcccaaaatggccgagtctaatccagcaaatccccaatcctgatcaactcgtctagttatgaaaaaacaagctaaaacgtctgttccagagtctagcttggattcaagaactgaacctgatcggtagtatggactgtatcatgcgattgactcccagcatcaatcaagctataatgctatatcctcctgctagggccacaaggcattttgtacctcagatagacgtttggttccgcgttcctgcatagcatgacc

SEQ ID NO: 3338 - DNA, 1501 bp, Oryza sativa
gtgcgcctcgagcgcccgcgcgccctcgccggacaccgcgacgcccccggcgacgtagaacacgcctcccgcgctcgcgccggcgcacccgtacctccgccgcggcgcctcgccgaccacgcgccacgcgtcagcctccgggtcgtactcctcgaccaccgcggtgcgcgcggacccgccggcgacgtagatccggtcgcccacggcggcagcggcgaacttcttccgcgggaagagcgtgggcgcgcacgcgcgggccgcgccggtgagcgcgtcgacgcgcagcgtcgccccgcggccgatgaggaagacatcccgacccagcacgaccgcgcgggcgtgcgcgaacacggagccgccgcaatgcagcagggtcgggggcaacggcagcgcggcgacctcgagcacgggcacggaggattcaaaccggagcagcgcctgcgcgatgcagccgttgtcggagacggagaggccgaggagggaggggcggaggtgggcgtgggcgcggcggaggtggaggaaggcgtcggaggcgaggagcgtggcgaagcggcgggagacggcggggagcggagggatggaggcgcgggggacgcgggcgaggcactcgaggaggaggtcgtcggggagggcggagattgggggtgccggcggcgacgagggaggcggcggttgcggggtggggcaaagaacggggacagcgatgtggcgggcggggtcggcggggatgcaggacttgacgagccacgagaggctgcgggagtggcagctctcggcggcgggcatggcggattgccggattgggagctcagctgctgctcggggagcgaggtgggttgtgattggacgtggggaatcgtgggaggtggagtggagtggaggggaagtcgttgggcggctgggctcgtgcccccaccttgtgcggggcgcagcaacggcgacggtggtggagccgttgcttttctttgaaattcgaaggtttgggtttaaaatttgagcgttttgaattggttaggtcagctttggcctgtaggaataacagtgtacttcactttacatcatctgatctattatatactaaaagtctattaaactttctacaaacgtcctcaaacggccacgtggactcctacaaacattcctagaccaccacgtggcactttctaataatttatagaaaaacaaagcatctcaccattaattttcatttaaattggtggatccattagtatacaccattagattagatctattggataaaattaatcccttccaccaaatctcgcgtgtatacaaacaaaatacgtaactatttcactgggaaattttaactacgtatttacgtacgataaaaaataattaaagctggcgaactgttcaccagccaaaaaacccaagaaaccatacgtagtacgtacgagtagaaaaagttaaagcccaaataaaacatgtatacgtgcgttagtgccatcgggaaaaaaggacggtctatataattttc

SEQ ID NO: 3339 - DNA, 1501 bp, Oryza sativa
ccataaactccactgatccaacagcaaacaagcattcccagtacacacgaacaccgtcatggcggctagttgctagtgcgcaccatcctctgccacgacccacgccgagtgagcatacaggatgcgccccttccacccctgcagcaaccaccctgcatcctcctcgatcacgaattcctcgtgatgccgcctcctcaccctgcgcctcaccgcctccaccacgtcggcctccaccgccacctgtctcagccccgcgcgccgattcctcgcctgccaccgcctgtacgtctccggccgctccacccgctccgccccttccccggcgatcacccccaccgccgcccgcctcagcacgtccctctccagcaccgcccgcaggtggctcccctcctccggcgtcgtcgcgtccagcatgtcgaacagcgccgagaagaagaagagcgcctcccggaacctcgtcgggaagaagggcgcgccgtgggcgccgttcaccacggcctggacgaacaccgccgggcgcatgtcgcggatgctgccgaggaccgtgtcccgagggctcgggtcgtcgaacacgccgctctcgtccatcagggtgcccaggctgagcacgtcgttcacgacgaccgccgcctcgtcgtggtcgacgccgacgacgtcctcggcggtgaccgtctcccacctcgccgccgccacggcgcggaacttgaatgggagcccgaacgcgcgcgcgcagttgctgagccggcgccccgtcctctcgagccgtcgggctggccggaaacctggctgcgggtggccgacgagcgtcatcctcacctccggtggcccgccttccctctccgccagccgctgcagcaaggatggccactggaggccgtggtactgaccgccgtagtccacgatgtgcaccttgctcctcccttccgccgcgcggaggatggccatgttggcgaacgtgaacgccacccacttgaagcagcacgccgccatgaacacctggtacgcttccagcaactccatggccgacgcgcgctcctccgcggacgcgagcagccggtgctccaggctcgccgcgccggccagccgcgcctccaggccgtcggcgaagtaatgcgccagccgctcggtggcgtcccctgtcggcgacgagtgccgcttgatctgctccaggagttcgccggcgctccggcggttgcccgatgccaccgcctgcgcgcacgacatgagcagctcgcgcaggtccaccacctcccccttgccctgcctcctcttccgccgcgccgccttcccgccgtttttctccgcggggacgcgtggcgcgttcatctcctcgtccccgttgagcatcatcttctccaacatctcgccgacgccatcgtcgtcgtcgtcctcctcctccggcgtggccatcagtttgctcgccctgcccacctcggcctccagctcgtccccgccatgcttactacccttccgtcccctaccattgccgctcccctgcatc

SEQ ID NO: 3340 - DNA, 1501 bp, Oryza sativa
cgctcgcaacccggctccagcccaccgactcggtttcctcctcggtggttctcctctccgctcctctataaatgcagcccgatcctcgctgctttttcttcgttgaggatggtcccatggcttccttcctcttctcgcgcggtcattcttccccttttcccctccgccgcgggtgggctggtaagtcggtaggtaagggatcaatcggtttcgatctcacctcgttcgctgccgtttgttgattgatgatcaggcgcaccaactagccggatagattgcccgcttgctcgtccttttctggtgcttgatccgttcggtttggggggggtctagtttcggcgatttgcttctgctgttgtgttagttttctgaacacagtatctctttcgattggtttatggctaattgtggtttgctgtgttgggtacaatatgcgcgatcggttggtttgtgtcaattcatgtttggtgcgatggatttgtcatggatattttgggcttgatcaaaggctagatgaactgaagttttcgctctgaattggtcatggttaggattgctcactggcctcagattattgttcggttcctttcaagttcgtgatgcttggttttgtttgagaccgttcgtctgcttgcagctatgcagtttttccttcggatctagtaatttttatgataaggtcaagtcatatcagaaaatttaaggtctgttcagagctttcaaatcaccggctttaacttgttcaatttcggcaagacatactcttcagattatcttgaatatggttgtgtgtcatcttaaccggaccatgtattgctttttggctttgataaaaatcgtcactatgtgctagggcgttggaatgattcttctgtgtcagttcttagttaaagtttaacatcaggatttctcgcgaggatttaaggagctctttttgaccgccttccctgtggattaatttatcctagtacaggaactacagattacttgctgcttgacctgctcagtttgaggtacagatctcgtgatttccctgtttactggtgttagttttaggaaccttgatgctttggtttagggctatggttaattgcaatttattgaaatttcaatatgtcaatattgtgcagttggtttgcttccattacaagcaactgtccaagaacattttatttgtaatacgaacatttataaaccagagaaattgaagcttgttgtatgggattggtcattgttaggaatagtctttggtgtataagatgttttctccattccattcaagactgctgctacgcttttgggtcaaaataacaagtgagattgatattatttggaggccatttgtctgcttggaaaactctggttatttaagtccatcctgctgcgcttttatggttgtcttgtcagaacatagacatggccatagttctccgagaatttgacgttaacttgtttacttccggaaaagctatatcagtcagttattaacttgctgtgaggg

SEQ ID NO: 3341 - DNA, 1501 bp, Oryza sativa
ttccacacatgcaggtatataaaaaaaatgaaatggaagttccacacgtgcaggtatataaaaaaaggaagaagggattctacacaaaacaagaaaatgaaatggaagttccacacatgcaggtatatataaaaaaaaaaggaagaagggattctacacaaaacaaggtcccagttgagctaagtttatcttcacaacgtataataaaattgataactatataaagcattacactggacaaaaatactaataagcatgcacatttaagtgaattaatacatgcaaaaggatgctatatattagttgttctgttagtatggcactacctcacaaggcaaaaaattctcattggcaagcaacaatgtgctcttgtttaaggtcctttcttggcaaatcttaattggggatactatgttgaatgagatataataattataaagaaagaaatataccagacaaactgtaagaagaaacaagttagtgataatgtgttgttgtgattagcaactaagttcaagggattcacctcaattcaaaagccctggacataagatatataatttaggacaattcctatcaagcataatatttaaaaaacatccacatttccatcttttatgagcctaagcaaaaattgcctcgacactgtaaacttcagttatctaccaagttagtatagaagatgaataactttcaaaactgtggaagctgcaagacgatccaaaatattcctggaaatatcctagttcctgaatgaagtgctacaatgctacattcaacactcacaaaatgaaagcaagagagaacaatgccacaagagccatagagtttcattctatacagactaaatcagtatatggacaaaattaccatgttacaactcaggattatcaaaacaaattaccatgttacaactattatacagactaaatcagtatatggacgtctatatcatttgataattacaatttccaacatcagagggaagcttaatgaacacacaaattacaagatgacaccaaaccaacatacaagagggccaatcatatgttgaaatgaacccatatcctagctagttatggaacagtacaagcccatatgtaaaggatactactggagatgcaagctggaccaagtagaaatcaaatactgctactgagaactcctccatggttcataaagcaattgtttctactcagaagaaacttcaaacagatggctttataatgttgaggtccataaatgttcttgaaataaatcttcaaattaatttcacccaaagtagtcaaaagatttcagaatcaccttcacaaccttgtaatattgttcgaaagaactgccaaatgaatcgtctaccacagaaactttaggatgtgtcttcttagttactacataaccaccctcacagcaagttaataactgactgatatagcttttccggaagtaaacaagttaacgtcaaattctcggagaactatggccatgtctatgttctgacaag

SEQ ID NO: 3342 - DNA, 426 bp, Oryza sativa
tgagaaaaatgcaaaaaaaaaaaatctagccattgattttcattaaatttgatgaacccattaaaaaacttttatctcttgaaacccgatcttacctgggccacgtacgtatgtatgttaccttttttcttttacgaaaatgcaatacgaaaatgcaagtacgggaaacgcgccccccctccacccccacccccccagccgccgccgccgccatcttccctcaatctctttcgcctcttttccacctattcattttcctattttcatgctttgttagttagaaaagaaaaatgcgttaaacaatttaagcaactataatgtctaaatcatacaactaacctttatccgctaattttcactatattttaactttgaaaagaaatttcatttggattatattttctaacttttgtatgccattcaagc

SEQ ID NO: 3343 - DNA, 275 bp, Oryza sativa
aatgcaagtacgggaaacgcgccctccctccacccccacccccccagccggcggcgccgccatcttccctcaatctctttcgcctcttttccacctattcattttcctattttcatgctttgttagttagaaaagaaaaatgcgttaaacaatttaagcaactataatgtctaaatcatacaactaacctttatccgctaattttcactatattttaactttgaaaagaaatttcatttggattatattttctaacttttgtatgccattcaagc

SEQ ID NO: 3344 - DNA, 1501 bp, Oryza sativa
ttttctctgtggttttattccagttggtataaaatatactcatacgtcccataatatatatatatatatatatatatatatatatatatatatatatatatatatatatatattgacggagcgttggggctcctcaccgggagaccgcgcgggcccccctttgccggttcggccgagggcgctaggtgaggttttaagccctcgatctgtggaatgtttcgcgagagagcaaatgcgcaagacacgggcgatgtagacaggttcgggccgctgagaagcgtaataccctactcctgtgttctggtggatctatgtacgaaggagttacaaggagctggagatcaaaagagttcaaactctagagaccctctcactctttctctctacgagctctgctctcctctttcttctttttcagctccctacagtccgttagtccgtcagtcccctctcttggtaggcatggaccttcttttatatctcaaggggataccacatataccatttctacctacccttcttttgggtggggactcatcctactttaaccaaaacttggctcgtaccttcgcatgccaccgggttaaccctgtccttccctcattaatgggcggagatttgcaatggctgctctccgaatgaccctccgatgggatgggtcataccaacctccactccgccggaagcaggtgcaacgtgggagcacggttgtttgctaatgacgtgaccggcgtcagactagtcacaaaccggtcattcttgtctaccacgcgtcagtttagcatgccacccatcagcccttcttcgtaaaatgacttccttgtaatggttgcgatgaagcctggtatgaatctagccgggactgacgtgctaactctaggagttcccacgccggctccggctagggacgagtgcctaggggctctcatcattccgacgggacggggcgaggcgtgcgaaaggccgcctgttgccacctaacccgcgatctgaccggtctgtaaccggtcacacactgtgacctgtcacggaccgaacgagtgtgctgcgctgcattaaatgcggtgtgggacgctcgtccaacccgcgataaacgcggttaggtgagcgccgctgtgctcacctaacccacacacgtggcgccaaacccacagggggtcggggcgccccagccctcggggtcgaaacgggagcggcccgacccctcggggagacagagggaggggcggccacatcaccctcgggcccgacccccccgagggggtcaggccacgtgggtgaccgcggctgccccaaacctctagtcaagataaccccggtcccatgtcaccgacagtagcccccggcgttatgccagggcgatcgccctccacgaggaaaacgctcgggcgtgacgccactccttaggcccggtgacaggtggggccggtctctacaggcgagcaggaatccagtggtcgcaaatcgcgcgcatcggcaagggaaaaccgaccgacaataa

SEQ ID NO: 3345 - DNA, 981 bp, Oryza sativa
agaggccgagagagatcgatcggccgaaaatgtctaagtgttggtgaagaagacgagggcgcaccgggaatatatatacccccggatctttactccaggttgttctcaacaaccgggagtaaatatcttttcccgctatttcaaaattctttttaaacccggttagggttaagaaccgggactaaagattatagcactgcatatgattttcgcttacatatgtgtttataaaatagaagttaatgcattaacattatttaaagtacaaagattaatgacaattacttcgaaaaattatttttgtctgtaataaattaagtggataaatcgtaataagcaaatataattaataaaaattccaataatcatatatacttagcatatatatgaatgatattattatattggtaaaaactctaattaagatatgtatgtacatactgcatgatttaaaattaataaaaattgtaatcatcatatgtacttagcgtaggaattatattaaattaaatgctaaaaactctaattaacatatgtaaatgccacatgcatgatttaaaccttttaaaaattcgaatagtcatatataagtagcatataaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatatgaaattgccacttgcgtgatttaaaacttttaaaaatcctctagtcaattataattagcatatgaatgctagtaaattaaatgttaaaaactctaattaacatacatatgaaattgccacctgtgtgatttaaaacttttaaaaattgtaagtatcacatataactaccatatacatgatttaaacttgttgaaacctctaataatcgtgcgtaattaacatatgccata

SEQ ID NO: 3346 - DNA, 1501 bp, Oryza sativa
cctcgagtatgaactcgtcgagatgagagatgccgctagatccctcttgtcggcccccgtgggcactgatggggtttgccaaggctaatctgatctctaatgttgatatctggtgacgtgtgttggcttgtgtgtatgttgtgttggtcttgtggcttccgtgtatgttggctgtgccccctctcctcctagggggcttgtatttatacccatggataacccattgtccaagtaaaactagggagaccaatatggatacaatctgggtagtctttgtcatttccatatagaactctatttgtccttccttatccggatttccttctatatacgaagtttgattccgtataagacatggtatatggtgggccccgccgagctgaatcgattactattgggtatgtggtatccataaccctgacagggcctatgtggccccacattttatcctcattactcccgtcttgtatctatcttctctatcctcttctctctatcatctatagagtcccactctgaagcggcggcaagcctcaggcggagcggagcaaagggatgaagtggggtgggcggagcggcagggcgagcgaagcacggtagctggatcaggccgatggaatggagcggaccgtcgtcatcaactgctatagcacctgccatagttgccgcgctcgccgacgactgctcgagctcctcctccggccatctccaccgttgttgcccccttcaccgcccgtggcctgccttcgccgctgctccgtccacggtctaccgccgccaccgctccgctggcatgcaccggtcaccgcgttgcacccgtcccactccgctagcatgctccaaccgctgccgctccgtagtgagactctacagaaggatagaaagaagaggagagaggatagagaggagagggggtagtgaggatggcacatagggtcacatgggccctacccttttttatcgttttatgtgtgatacttacatgtgggtcccacgggttttattatttttctagatcgattgccacatatttgtcacgtcaatgccatgcagaacaaagatctaatcacaagagccacgtaggcatcacattagccaaaaccagggacaatattgacaagggacctcgtttacacggttttttaagttggggatgcgttgtagccggttttatcatccagggatgaatttcgaactttgtgacaaattgagggacctaacgtgaacttattccgctttggaactaagggtgttgggccagctgaggttctggcccaaaaggagttagactttttgaaattaggcttttaattagttttattaattgtaagtcctagatttattgcttgttatttactggaaaggtcacatattaatattccccataatatatgtgggttccatctgtagtagttttatagaattaagtgataattgacattcttttttaaaaaaaattacatagtataacgcagacactcacaacgcacgcacactcacc

SEQ ID NO: 3347 - DNA, 1501 bp, Oryza sativa
caccactgctccaggctctttcccttactgctgcagttcggtgatgagcgtattggggcagcgccgcccctctgctgctccgctggccccttggagctcgagtccgcacggatcccttcgtctctccgcccccctcgcgcggatccgccgtcggcgcctggattccaccgtctctccacccttctctcgcgcagatccgccgtcggcggcaataggaggggctgatccggcgacctcttcccctctcgcacggatcccgtcgcgccggcgacgacgggaggggtggatccggtagcctcccctacggtgacgacgacgatgggtggacgctacctccatcgctccatctgccagcgacggacatccttgattcgccgtcaaccccagccactgccgcccaggtattctttttttttaagacaacatctgagaattccctctagtcacaacctgaaagtactctcttgtcaaaagtaagtgatttgtttaatcctttagttggtcagtcggctgaagagctggtctgtagcattttttggtccgttgatgctaatcgaatcatacaaatagcacttactcctggtagcgaggaactcaggatgttgtagcatggcaacatactaaatctggtatgctcactgttcgatcggtttatcatgcacaatgcaatcataagttctgcaatcaggataggcaatctgagaaggtagagcaaacatgatttagataaggtttattttgttatgcggcttacaaaaacatatttaattttgaattgattcttttattggtacatgcagtgataatatgaacttattccttttgatgatagtacctgttcatctaattaattttataccacacagtatcctgagggaaggcttcatatttgctaagtgagttgcgtttttttatgtgtgctattgaattgaagtgagcaaatattgctgtcgcacatacaggtctgttgttcttccatccttcttagtgatttttacctccagatgtttatatatagatagaatagacaattctaaggtacctctttagagataacattctcttttgccttattttactatcgtttgtgtctgccttcaaaataaatgttctgaatattcagatagtttaaatggggtatctaaatgatttatatgacttaggaaattagagctgttacaaacaaatttcttgattttttttcccatcaccatagtgcattaattgtctagttttttggccttctcagatgaaattgatcttgcattcttacattggtaaagaaatattttctttgttggtttaaactcggcttgcttttgcatgagcgaatgtactattttggtagatacatcacatgcataattaaagacagtataacgtaccatgaacagtgagtgcatcagcaagttattatgagccaatgcatgttatgacttagtgataacattaaaaaagtaggcaagcatgcatggagtagaattttttgagttatataaat

SEQ ID NO: 3348 - DNA, 1501 bp, Oryza sativa
cagctggacgccctcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtctcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctttgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaattttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggatatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatataatatatatatatatacatatatatatgtatgcatatatatgtattgaaacatatatatgcatggtttatatatatatatatataaaccatgcagcaacagggccatgcaaaaaaaaaaggtcagctcgatctttagtcccggttggtaacaccaaccgg

SEQ ID NO: 3349 - DNA, 1501 bp, Oryza sativa
ttgtatggtcacgaaaaccatggagagatcttgttcaaggtatattttcaaccaataattttgtgtcctctaattattttcctcttgttgattcttggtcttctatgctgattcttctcgagtcgagaaaattataactcaatctatgactaaaaataaggaaatttgtcgtagatggttcatatccttttttttaatccaaatttattgtcaatatttgttcagaatcttggtacttgtcgaaattgcaaattttcttcctccaatcatacgtatccgagtagtgaaattatctgtcatgccttgagggaattttatatgtctctaacccgtatttttgtatcgtttgatttcttcagatattttctcctggtctgatatacccatttatatatttaggataaatgagtataataagttccttcagtactaccatcttgaataattattggttcatatccatctttccagatcagggtcttgaatagaatacctcttttattcaggccttcatagtcggtcgtcctaggtcttctttgtgtccactttatcatgtaatcttcaaattatgaatagtcatgcttatgtgtcgtaattactatggcacataagttactatcctattttcttgtataaacctttattccattttctctacacaatgtcgttatgttgcttagatttatctgttcagactccctttgtaggtcttgcttttttttatccagtcatagttttagcttggcagaaagagctatcttcattaatgtaagtacttgtatacttggaaaaaatatcttcattcagcgcggcaacaaatattccatgaatattttgttccttctgaagcttcatttattcttcttgattggttgtgccacttaaccaataggagctcttgtcttcatgaaattgttactccatgcattgctccataatagtatgatgtctataggtataaccgctctcattatatacatataacctcatattagtgtattctttgataattcgctctacctatgatttatgataacataggggtttttttgtatatatggatggaagagatgattcccttctaaattacatcaatagtcttcagaacaaatgttttcttggttggttaactttcttcagaccgcgtccattaatttgcatgtttattgtcatcaccagtctgttgatcttctactccctgaaattgaagctcttggaatctttcaaattattctgagtcttgtatatttggaagttcttcaactagatttctataatctcgggaatccttcattctgagtcacttatttgtttggaaatatctggatgcttctcaagtacttgaactgtcacttggcttcatattgtatgtcttcttgattgtatatatgtcaatgatagatcttgatagatatcaacggatcaagactatcctttcttcgcataaaatcaaaacatataatatgacatccccttttcatcttgcacatatttccctagt

SEQ ID NO: 3350 - DNA, 1501 bp, Oryza sativa
aatataagaaattcaaataatattttgaagcaataaatgatttcaaatggaaaagttgtgaataacaaagttgtataacttatcaagatctataatttttgttttggtcatttttctatatgactttgtttgaatagtttgaatttgaatttcaaattataacaacttcaaatagcattttcaaatactaattgatttcaactgaaaaagtcatcaataacaaagttgtataaatcatcaagatctataacttttattttgatcattttttcatccgacaaagtgatttataagattattcataaaatgtacatatctcttatattgtttataaaactataagagacatgtacattttgtaaacaatcttacaaatatttttgtcggatgaataaatgaccaaaatagaatttatatatcttgatgagttatacaactttgttgttgatgactttttcagctgaaatcaattaccgcttcaaaatattatttgaaattttgaaattcaaaattttaattgataaaataaagtcacaagaaaaaaaggccaaaataatagcagtaagaacacaataacatgatagagcatgattttagaaacatttagaaaaaagaatcatttaatttagaatttatatgagtgagatacactagtttcaaatttttcaaattttatttttacatacgcctccttaagtggcatacgggcgcttaattgagccgcaagcaaaaatgagctcatttttgcatgcggctgtcttaagaggtccgtatgggaaaatcgatttttccatacggcccacttaagggggccgcatgcaaaaatgaccctcaatttttgcagacgccactagttatggtccgtttgcaaaaataagggtcctcgtacaaaaaaattacttttgtagtagtgttactatatattttatatatatatatatatatatacatatatatatatatatatatacatatatatatatatatacatatatatatatatatatacatatatatatatatatatattcattaacattcatatgaatgtggaaaatattagaatgacttacacagtaaaacggaggaaataaaacagaaaattgagggtccgggggtatcttgactagaggtttggggcagccgcggtcacccacgtggcctgaccccctcgggggggtcgggcccgagggtgatgtggccgcccctccctctgtctccccgaggtgtcgggccgctcccgtttcgaccccgagggctggggcgtcccgaccccctgtgggtttggcgccacgtgtgtgggttaggtgagcacagcggcgctcacctaaccgcgtttattgcgggttggacgagcgcgccacaccgcatttaatgcggcgcggcgcacgcttatccggtccgtgaccggtcacggtgtgtgaccggtcacagaccggtcagatcgcgggttaggtggcaacaggcggcctgtcacacgcctcgccccgtcccgtcggaa

SEQ ID NO: 3351 - DNA, 1401 bp, Oryza sativa
ggagggcgggggagtcgccggcgacgacggagggaggtagagtcggcagatccacgcaggcggccgctcccgccccctgccgccgcgtgccgccctcggccgctgccgccgtgtgccagtgcgtgccgccctcggccgccgcccctgcgtacctcctcggtgtcgccgacgcccgccgcgaccttgctgtgtgtgagggggagagagagatagagggagttgaggagaaataatggtggagagaagataaggttggagataaggttgctggaattctgaagcggtggagagggagaggagacaaattagacttctagataaaaatgaacattaaatctaattttgtggtattaaatgaactcatgtgaaaaagttgtcaaaaacaaagttgtagagatcattgagatctaccaattttcttttggtcatttctccatccaagtttgattgagatatataaaatttgaattttaaaatataagaaattcaaataatattttgaagcaataaatgatttcaaatggaaaagttgtgaataacaaagttgtataacttatcaagatctataatttttgttttggtcatttttctatatgactttgtttgaatagtttgaatttgaatttcaaattataacaacttcaaatagcattttcaaatactaattgatttcaactgaaaaagtcatcaataacaaagttgtataaatcatcaagatctataacttttattttgatcattttttcatccgacaaagtgatttataagattattcataaaatgtacatatctcttatattgtttataaaactataagagacatgtacattttgtaaacaatcttacaaatatttttgtcggatgaataaatgaccaaaatagaatttatatatcttgatgagttatacaactttgttgttgatgactttttcagctgaaatcaattaccgcttcaaaatattatttgaaattttgaaattcaaaattttaattgataaaataaagtcacaagaaaaaaaggccaaaataatagcagtaagaacacaataacatgatagagcatgattttagaaacatttagaaaaaagaatcatttaatttagaatttatatgagtgagatacactagtttcaaatttttcaaattttatttttacatacgcctccttaagtggcatacgggcgcttaattgagccgcaagcaaaaatgagctcatttttgcatgcggctgtcttaagaggtccgtatgggaaaatcgatttttccatacggcccacttaagggggccgcatgcaaaaatgaccctcaatttttgcagacgccactagttatggtccgtttgcaaaaataagggtcctcgtacaaaaaaattacttttgtagtagtgttactatatatttt

SEQ ID NO: 3352 - DNA, 652 bp, Oryza sativa
tttagttgaaattggaacgatgagccgaaaaagttatgtgtaggaagtttcgatgtgatgtaaaagttagaagtttgaaaaaaaactttgaatctaaacacggcataactcaacacgtgagcttgttgaacagtattatcaattggaattcggagagttgttgatctctctctctgttcctcgtagctatattcttgctatccacgatggctgattggaattggtttttgatgttaactggacctccgcaaaccctttgtagtactagtttgtaattttctttagtctcaggttgtaaattgggactataaatacatgactgaagatttttatccttagtctcggttaaaatacccagaactaaagatttttttttattttgcttgtgctgcttactacctgattatacgtttaaatatgttatatatatatatatattgaaaatccgctctaaatttaagattgaaaatttaaattttagctgctaaatataagcatgagagaaagatgaggccgtctcggtcgttatctcgtgcaggacacgtgtctcagtcataatctcaatggctctcaaagcatcccctcaaaatcgtattaattagtaatgtcattagcaacaaaagtgactttgacgtggacttgttcttccagc

SEQ ID NO: 3353 - DNA, 1501 bp, Oryza sativa
ttttctctgtggttttattccagttggtataaaatatactcatacgtcccataatatatatatatatatatatatatatatatatatatatatatatatatatatatatatattgacggagcgttggggctcctcaccgggagaccgcgcgggcccccctttgccggttcggccgagggcgctaggtgaggttttaagccctcgatctgtggaatgtttcgcgagagagcaaatgcgcaagacacgggcgatgtagacaggttcgggccgctgagaagcgtaataccctactcctgtgttctggtggatctatgtacgaaggagttacaaggagctggagatcaaaagagttcaaactctagagaccctctcactctttctctctacgagctctgctctcctctttcttctttttcagctccctccagtctgttagtccgtcagtcccctctcttggtaggcatggtcctccttttatatctcaaggggataccacatataccatttctacctacccttcttttgggtggggacccatcctactttgaccaaaacttggctcgtaccttcgcctgacaccgggataaccctgtccttccttcattaatgggcggagatttgcaatggctgctctccgaatgaccctccgatgggatgggtcataccaacctccactccgccggaagcaggtgcaacgtgggagcacggttgtttgctgatgacgtgaccggcgtcagaccagtcacaaaccggtcattcttgtctaccacgcgtcagtttagcatgccacccgtcagcccttcttcgtaaaatgacttccttgtaatggttgcgatgaagcctggtatgaatctagccgggactgacgtgctaactccaggagttcccacgccggctctggctagggacgagtgtctaggggctctcatcattccgacgggacggggcgaggcgtgcgaaaggccgcctgttgccacctaacccgcgatctgaccggtctgtaaccggtcacacactgtgacctgtcacggaccgaacgagtgtgctgcgctgcattaaatgcggtgtgggacgctcgtccaacccgcgataaacgcggttaggtgagcgccgctgtgctcacctaacccacacacgtggcgccaaacccacagggggtcggggcgccccagccctcggggtcgaaacgggagcggcccgacccctcggggagacagagggaggggcggccacatcaccctcgggcccgacccccccgagggggtcaggccacgtgggtgaccgcggctgccccaaacctctagtcaagataaccccggtcccatgtcaccgacagtagcccccggcgttatgccagggcgatcgccctccacgaggaaaacgctcgggcgtgacgccactccttaggcccggtgacaggtggggccggtctctacaggcgagcaggaatccagtggtcgcaaatcgcgcgcatcggcaagggaaaaccgaccgacaataa

SEQ ID NO: 3354 - DNA, 1501 bp, Oryza sativa
ggaaacgcgccggggaaagcgagagagagagagagagggagcgcccgggagagagggggccggggaagagatgggccgagcggaattcggcccatcgaacccgggggaggcaaactagacttttgcggagggattcgatttggaaggaattggattcggaattgaactcgacgatagatcggggattgagatcttgagatggcacggacactagacaacaagcaaagaaacaaatttcgcaattagggtttttaagagataattttcccgctaggcgccacgacggaacgggtgctacagggatttagttggtcctgcataaaagaaaaatgatgtaattacatcttcaatcaagcagttcatacgcaaaaaacttcggtaaaatcatcagacatgaacataaaataaactttttttttgaatggaaacataagataaactagaatcttggtgcttaggtcgctccagttttttttttgacgatttacttactattacgcactcatggaaaataagattcttttttcttttcgcttgctttcaatgtgattgaaaattacgaatgcccttgaagacgatggtgtacaccaatacaccatacaaaaaccaaattactttctccccaaaaggtgccaacttgaagtctctgttataaaaccggcccccaaatcacatcggaaaccaaacgcggaagaaacgccatagaagatccaaatacgatgacgacactgaggcacgatatttgataacgaagttctgccgaggcctacatctctgggtcactgattgcgggcgttcctccccgatctagcatattacagcgtatcagagttacaacgactcacggctggtcactgccggcagccgctccctctcgctgtgctaagtcgccatgcggttacaagaggcacgcccctctatttatgagagatcctaggatatagtccgactcatactctattcctatacctagtacaactctaagtcctaaactgtaaccgattttgtacacatgttcgacacaaactctaacactaatgctagtttcagcctctatatatacggagtagtacattctttctgctcaattgctgcatccttgccccttcatttgcacacactcacactaacatagaaaatgaagctgcatgaatagaacaatatagcgaaggaaatgatagagagctttgtgttaatttttgggactggaaggcatcaggagcattcctatgagaaatgtacgtgataattactctaaaaaactgctatcgcatcgactctttcacgagtgcgcatggtacatatataccatgtgggaagaatgtacctctattaaaatcagtggcggaggatggaaaaaaatctagatatggcggtgtgacccatggactagcgcgaagccccagatcagacataatggctgtgtttagttggatccaaagtttgaattttggttgaaattggagatcatgtgactgaaaagttgtgtgtgtatgacagg

SEQ ID NO: 3355 - DNA, 1501 bp, Oryza sativa
cggcgccactcgaggtcgtcgtcgccgcggcagtgaggaggggatggcggtggcgtcgctgcccgaggtcgtcgtcgccgcgggggtgggcgccgccgttggagggcgggggagtcgccggcgacgacggagggaggtagagtcggcagatccacgcaggcggccgctcccgccccctgccgccgcgtgccgccctcggccgctgccgccgtgtgccagtgcgtgccgccctcggccgccgcccctgcgtacctcctcggtgtcgccgacgcccgccgcgaccttgctgtgtgtgagggggagagagagatagagggagttgaggagaaataatggtggagagaagataaggttggagataaggttgctggaattctgaagcggtggagagggagaggagacaaattagacttctagataaaaatgaacattaaatctaattttgtggtattaaatgaactcatgtgaaaaagttgtcaaaaacaaagttgtagagatcattgagatctaccaattttcttttggtcatttctccatccaagtttgattgagatatataaaatttgaattttaaaatataagaaattcaaataatattttgaagcaataaatgatttcaaatggaaaagttgtgaataacaaagttgtataacttatcaagatctataatttttgttttggtcatttttctatatgactttgtttgaatagtttgaatttgaatttcaaattataacaacttcaaatagcattttcaaatactaattgatttcaactgaaaaagtcatcaataacaaagttgtataaatcatcaagatctataacttttattttgatcattttttcatccgacaaagtgatttataagattattcataaaatgtacatatctcttatattgtttataaaactataagagacatgtacattttgtaaacaatcttacaaatatttttgtcggatgaataaatgaccaaaatagaatttatatatcttgatgagttatacaactttgttgttgatgactttttcagctgaaatcaattaccgcttcaaaatattatttgaaattttgaaattcaaaattttaattgataaaataaagtcacaagaaaaaaaggccaaaataatagcagtaagaacacaataacatgatagagcatgattttagaaacatttagaaaaaagaatcatttaatttagaatttatatgagtgagatacactagtttcaaatttttcaaattttatttttacatacgcctccttaagtggcatacgggcgcttaattgagccgcaagcaaaaatgagctcatttttgcatgcggctgtcttaagaggtccgtatgggaaaatcgatttttccatacggcccacttaagggggccgcatgcaaaaatgaccctcaatttttgcagacgccactagttatggtccgtttgcaaaaataagggtcctcgtacaaaaaaattacttttgtagtagtgttactatatatttt

SEQ ID NO: 3356 - DNA, 350 bp, Oryza sativa
cttaatcagtgtaaccgtagttaaattcgtgtttccaacttaatgagctatatatatatgaaacaatactatcgttcgtgtatcaatcagcatgacaagaatttttgttggaaagaaagggagggtcagtatttctaatgtgtgacacacagaaaatgcaggaatttgataacttaactttgtatactggtttagctagcatcgtttactttgtaagttctgtcaaaagagccaacacttgattatgtggaaacaaatgactacctagcagtgcatgttgccaaagccggccacctgtagatggaattatattttcatgcaaattattagtttttggttccctgaatagt

SEQ ID NO: 3357 - DNA, 1501 bp, Oryza sativa
gtacagtcatgttgggctgcggactgatcccgagctcacaactgcattacaaaaggaaagcggaagccaggacttggaccaatcatcacaggcgcgacttgggaactaggccgaaaccctaaaactcatcgtagccgacttgctcctggaagaactcctcgtcagcaggatccgcttcatcttcttcagcaactgggggggggatatttatatagaacaagggtgagtacgggagtactcagcaagccaggggaaggctgttgtttttgcaatttggttttatttgaactctttttctaaaacgactaggtgagtgcttctcaaacgacacggatgggacagtgcgtctcgtccggtcggagtatgtgcaatgtatcagtctttagatcttgaaacagggttggcattcggccaacagcttttcaaacggcctcccgggccaacaacttttcaaacggccacccgggccaacaacttttcaaacggccacccgggcctagctgatcccatcagctacagatttttcaaacatcgaaccccttttcacaacagcaatttcacaagcagtagtcaaacaaaactacgctaggaatcacctcacatccgcccttgaccgtgggcacggctgttcgaacagttcaatgacctctgcagagggggtacactttacccacacgacattactaacccgggtcacccagcccgtggggatcagccacgtcgggagacttccaactttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatgaaattccaaggaatcggtccttaagtgcgagagcgggaaaccgtacacccggtacgttccccggtccgcggttttggaaattcatttagttcgcaagcaccgacccgggtgtcgggttttccaagtcttttgtaaaactccagttttacccaagttgttactcagattttaagttcgaaggcgaccgtcgatactcgcacagagtgcatgaatatcgaggtgcaactggagttttacaaacggccaacagctggcatccggccaacagcttttcaaacggcctcccgggccaacaacttttcaaacggccacccgggccaacaacttttcaaacggccacccgggcctagctgatcccatcagctacagatttttcaaacatcgaaccccttttcacaacagcaatttcacaagcagtagtcaaacaaaactacgctaggaatcacctcacatccgcgcttgaccgtgggcacggctgttcgaacagttcaatgacctctgcagagggggtacactttacccaca

SEQ ID NO: 3358 - DNA, 1501 bp, Oryza sativa
caccaccaatccgcacaagaaggatcgtcgtcggtcaacaacattgtcccttcagcgattcggccaaggccaccgcccataattgttcccaccgtcgacggcgcgtccgcacctggactcctccttccccgccgccatagagagtgtcaaaatagttgctatatggaagatcaaatgccatagagagtgtcaaaatagttgctgctgaagaaaatgctataaaacattgaacttatttttactcattattgcaattgaattttttatactagcggtattaactaaaatttgtgctctagctgcggctatggtgctgatcattttcaagctgacgccaaacctttagatatacaagagttgaatcttttattggcacatttatatctgatcaaaacctaaattcaactaaaatacctttaaaaatattttagttttgaatggccaaattatttagtgagccgattgctcccttgaaaacgatataacataaccacattcaggaaagtaccattcgtgtgatggtagagtctttgattggcacatgacttaactcaccaagtataaattctgatgctcataaatagagctatatatatgtattgtgaaaataatcaaatgggttatgcaggagtatattacagtcctacggtctgtataggctccgatgagtacagtgcagatggaacaaacacatgaaaaaactacatattggtcctgtcttttcaagggccgtagtgcaagaacatccacagtacactatagacaattagaacatatggttcatgatgccccgtttcatattcatctgctaataatcaagggcttctcgaagaattatgcgtgctttctgattattggtcgcttgctctactgtcaacgatgacaatgcagctgcctgctatactccataatgtttttttatctggcaacaatagcgactcaccacattagtgtgcaatattaattacaatgtcgtcacttaagaggtttctttttttctccggttacacacttttctggttcttaattactaactcgatgttttgcagattaaaacaaataagtcaattacagtactgactgtccttaaccttgtaaattaataatcgcttctgtcattacaaaaaaagaagtcgttagtcgtccattacatacgaattccctcccctaactcaaaggacaaaattgaatgaaaaaaattcagccttatttaatatatctgaaagtgccttaaactacatctcaaaataacaaaaggtatcttaaccaaaaaattcagaccaaaaacacatcgaattccacaataatttgtttttaggagtgtctatacacttcaggcgactgaatttttcaaaaatttccatcactttttctaccacttggatgatgaaaatccaatggttatcattactcaccaactacttattacttatcactctcaatgattgaacaataaaccgttctaacatacaaaaatttacaaaactacatgaaaaacatt

SEQ ID NO: 3359 - DNA, 1501 bp, Oryza sativa
aagtatccaagttttggcataggaaatgggggcgtcaggaaaaacaccttcgacagtgtaggccgctagtacagctcgccagcgttgtcatggctcatgcatagatatttgcctctttgggcaacagtagtaaggctcaacggaccatctccatagttatctagcttctccgattctcatcaaaatgtctgcttgcacttgcagcggctttcaactactgaagccgtatggtagcaatcgcggccgatcaaggccaatgcgtacttctagcgtgctatgcacttgggaattacatccctgggtttagcaattaccacccgttgcgaattgcgatcaaccctcggaggttaatttagggctcctatgaaacgcgtcaatgaaaatcgtagaaataagaaaaaaaatacataaatcaaatgtacgccatataaaatcttataggaatttatcaaatttgtggtcttgattgtcggggcctctgatctcaagcgtggggaggaaacccccctctgatgatgatgtgcttttgaattttgtcaaccaccatctcataacctcatttacattgcccatgtgtacgcatgccagcatatatatccgcgtactcacttccctggcctggagtccattcacactactcttcggacattgtcaaaaaaaaaaagggggggtacaatctggtgacaaggttgatatggctttggtttctcactcccctccctcttgaaaaatagttttggacttagaaatgggagacgtcaggaaaacacgttcgacaatgttagacaattctcctacagctaccaagaataggcttgatagtcatgggccttgagtgggtcaaagtgcagtggctcagttcgatcggccatgaggataggtgtcccctcctcctttttgaccttaattaggctatgtgtttaaatcatcactgatctgtgtgcttatgcttagattgtttataaatatcagattaatccatttctcaaatttataataattaaaacttaattaattacacagtactacaaccttatttttatgaaacacttaatctttatattcatctttatctttagaagattcaaataccataatagtatttaccctacttggcatcgcgaattaacgagggtttggtttgtctcgtcggcggcacgtgttggtgggccatggattggtgtgaatccggcccaggtcccctctcgggctaaagaatctcaccactcttctttcccggataggtgcagaagcacacacatggggagtggattcaattagtattgtgctcgcaaaaggaataggaataagcggccataagaccctctgcgaggtatttttccttacgtaatactctaattgcttgccttattttcaacgtgatttcatagctttttcggtgggaatttccctattaaatactaaaggagcgagctctaattagatacttatttcttttttttcccgagcattgaaataacaaattaaaatcaaaataata

SEQ ID NO: 3360 - DNA, 1501 bp, Oryza sativa
cagctggcggggtaggcgggtgcgcggccacgctgggaggcaggcagcagctagccggccagggccaggcagcggcgcggcggcgtgggcgtgctgcggtgcggccgcgggaggcaggcggccagcgcagcagggcagccggcaacaagcagtgagccacagagccagtgaggcaggcagaggagagaccgagagaggatacatattcttcaaaagttcaaatggatagaaagagaaaaggaaaagcattgtcttcacaaagaggtacatattcttcaaatgctgacaattttagaacatttttgcatttgtttcatttgttttgcatatttgaagagttattggacctggggctcttgtagtgcatgcccaagtactcatggaagccaaaatgttgcagtagagatggaggaggaggaggggcagatggaggagcatgttgtccaagagcttggggaagaacgtgttgaagagaattttgaaggtataactaagttcaacccagattacattggctgtgtttagatccaaagtttggatccaaacttcagtccttttccattacatcaacctgtcatacacacacaacttttcagtcacatgatctccaatttcaaccaaaattcaaactttggatccaactaaacacagccattatgtctgatctggggcttcgcgctagtccatgggtcacaccgccatatctagatttttttccatcctccgccactgattttaatagaggtacattcttcccacatggtatatatgtaccatgcgcactcgtgaaagagtcgatgcgatagcagttttttagagtaattatcacgtacatttctcataggaatgctcctgatgccttccagtcccaaaaattaacacaaagctctctatcatttccttcgctatattgttctattcatgcagcttcattttctatgttagtgtgagtgtgtgcaaatgaaggggcaaggatgcagcaattgagcagaaagaatgtactactccgtatatatagaggctgaaactagcattagtgttagagtttgtgtcgaacatgtgtacaaaatcggttacagtttaggacttagagttgtactaggtataggaatagagtatgagtcggactatatcctaggatctctcataaatagaggggcgtgcctcttgtaaccgcatggcgacttagcacagcgagagggagcggctgccggcagtgaccagccgtgagtcgttgtaactctgatacgctgtaatatgctagatcggggaggaacgcccgcaatcagtgacccagagatgtaggcctcggcagaacttcgttatcaaatatcgtgcctcagtgtcgtcatcgtatttggatcttctatggcgtttcttccgcgtttggtttccgatgtgatttgggggccggttttataacagagacttcaagttggcaccttttggggagaaagtaatttggtttttgtatggtgtattggtgtacaccatcgtcttc

SEQ ID NO: 3361 - DNA, 1501 bp, Oryza sativa
aggccatttcattagtgcatttttattgcgaggttatccttttaagcccttcaaccttacccaacatgtccgactctacagccatgtgaatcaaatagctcaactaattgacaactaaaggtgtgccaaagttttctcgcagcatgagagaatgtggcccatttacctggtgatctttcgcacacagttcaatcatatgctactagatgctaccacaccgtcgagaattagagaatttaccatcaaattcgtgtgccttaatttttttacctcttaactcgcataccctctataatatattattaggattctttcttggtattattagtttgaggcacacggatttgatgataaattatctaaattctcccacaccgtcacttcttgatgcgtcctctctgaggaaatcacgcttataacccacctggtgaaatcaccaagctggaggagtattagtctcatacgaactggggctagacgtgagtataccttaacgacaaccacggcaaatcgacaaaaacattttccttggtgtcactcaatcccaaaactatatgcattctctcgttgtagatggatatggcacgattaattgtcgtcctaatggtagcaatttgatgttttggggcgagaagagagcatgggctctcagcatatattgtgatgcaaagtaggacggacagaagcaatggattttgagaggcgcatgcagtgaaggccatgcatgcactgctgcctagtatttgcttctacaaactaatgaaagcaatatcaatgtgtattgcttcttaaacttaggccatccccaacccaaaaactatctagtagtttctatactagctatgtcatatagacactatgtatagaaaatatatatccaatggatggtgtcttcaaattaaattatcatccaatcacctttcttctctctccttttatccacctatccccttgttttcattcttgattcttgtagagatagtttctttatctttttatctctctcctcattaactttcttgccacatcagatttttacttatgtggcaatatattaaatgctatgaaactagatgacatggagggttaggatggccttagagcaagtttaatagtatagcccactgctaactccaatttatctatagccaatctaataatcaattcatacaatagatatttactgtactattaatatatggtcccacctgtcatacacacactgtgtcttggagtccgtgctgcagctggctacagatctgtagcccattgctcttctttctcatcttttatctcattaaaatatgtttatagctagctaatagcctgctattgtacctgctcttatgcaaggtggagaattcaaagagcatcactcttaggatgcgttctgagatgctaaaggccaggtttctaataaatggtgtgttttttcaaatactttatatacaaaagtttcttaaaaaattaaataaatttggttgatgcacggcctgccaaa

SEQ ID NO: 3362 - DNA, 1501 bp, Oryza sativa
acgcctagccgcctccgcccccggcagtggaagccatttcccctctctctgcaagggtagcgccatccgccgccaccacggaagaggaaagaaaagagctacaaggaagagagagggaggaggaagaagggttggagagtgaaaggatgataggtgggctccacaatatctttttttatttgaatgacaagtgggtccctcatatattttttaattttaatgccacataggcactacatgggatgaagatcaggtcagcaccaccacatcagcaccacatcagcaaaaccacccttcaaaaccattaagggagttaaattgcactagtttcaatagttggggagttgtcttatctggtttttcaattgagggtacgaattagatacggcctatttttaaggaagttaaagtggactttttccttctaatgaaccggtgattaggccggccgtcttggctgaatcagctggcatccgtccatggcccatctgcaaatggcccaatacaagctaaaatagaggggcccgcctacaaatttaacatatgccctctaaaaaaacaatttaacatgcgtaatttctgcatctcaatagacaattgaacatttgggatttcatttctgtttcattagtctttccctgaccattccgtgtaagctgcagtgtctgaactctgaaacacttccataatcttcccatcccaggcttgcacagaagatttcaaccggaaaacacactgaacttgcagtgctgatcattctccgaaaacgcagcggttcagttcagatgttacaaaaaaacccacttgtttccagtaggcttagccaaatcatcatgccgaggcaatcgaacagcactaatctactagagacgagacgaaacaaaaaataaagcaccagaatattttatctcaaaagagcattcaacttgccatattgcatattcgggttgctgtctgaaccatccctgtcatcgtctgccgcccagcccgccccgttacatacgttgtagaaaaacgaaggaaaaattctggtaaaatcgacggaaaactaacggaaacatcaccacactgcatgaccaagaggcttcgtttgtttgaaacaaaatcatcaatttaaatcagcctttcacacagcaagtgcatggctgatcgcattctttaaccccttttccctgcttcatcctcaccttggttatcttgagaggcacgaaagcatcgaaaatacgcaaatattgtgtacgtacgtctcgatcaaccaggatgaagcttccaagtaatacctggctaaccagcgcataaatatgccgatctcgcgaggccgctgcatgcaaacctgcaacacacaagaacaggactgagttgctgatcatgcgcttctcccgtctcgttttttttttattgtttggtgagacgagggattagcgacggtttcgatcgttttgttttgttttgttttgttctacagtgagccaagtacaggtcgatccgttggtgttgggtt

SEQ ID NO: 3363 - DNA, 1501 bp, Oryza sativa
cccgggtggccgtttgaaaagttgttggcccgggtggccgtttgaaaagttgttggcccgggaggccgtttgaaaagctgttggccgaatgccaaccctgtttcaagatctaaagactgatacattgcacatactccgaccggacgagacgcactgtcccatccgtgtcgtttgagaagcactcacctagtcgttttagaaaaagagttcaaataaaaccaaattgcaaaaacaacagccttcccctggcttgctgagtactcccgtactcacccttgttctatataaatatcccccccccagttgctgaagaagatgaagcggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatcagtccgcagcccaacatgactgtacttctactctataataaagagacctctgttgctgtgatactctgtctccctgtgataccagcattgtttcctgggactggtatcgattaacaggttaatttggagcgtcacgggctagttccggtcgggactagttcggggcgtgacaatcccttacacaagggtaggatggttgatggagtttaggaatttggttaccgacagttcatgtcagtactaggtgttttcagtttcctaggtcatgttatgcaggaccgcggcaccagtcgtctctctagatgaggtacaaaatgcttaatttgtggcactaaccagacaccagcgcgatatagattgatgctggactagtcgatggcatgatacagtccacactgacgatcagactcagttcttgaatccaagctagactctggaacaaacgttttagattctaagttttttcataactagacgagttgatcaggattggggatttgctggattagactcggccattttggcattattggaagaaactacggttgagcaggatgatctcgtcgttgcaaaacttgtagccagatgagtaaacatttgtggttgattgcatagataaagctagcattaacgaatgcttttaggagtagagttcgtctcaaatacgaagagaaggatgtacaattcctggaaaaagaaaagatttgcagttattttggcagcgtattcatatgcagctattcaagtatttgagaaattaaatagcataaaaatgaccaattagccaggcccaaaattggccatgtatattcatcttataatgcaaaggccggacgctgcccattatatatataaaaaaaagccaggcccaaaaagaaaacgagcacaacataaaaggaacaaaggttgctgtaatttcaacaatgctagctcttttctgaaactttttccatcaattcgatcctaccaactctgcttaaactcttcttggatctctgacaactaacgtgcagccaacaggccagccatct

SEQ ID NO: 3364 - DNA, 1501 bp, Oryza sativa
cagtttgaggaacctgtgactggggctaaggatctggactgtctgaacataaattttgttgagaacctgaacatgttatccagcacaaggtttctaatgatcaacagtcatgttacatacctaagcctgcgaaggcctatgcatatgcgtcttcttacagtttgagctgtaaactggtatctgtgcttaaagttttgtcactttcactgcaggaactttgattactctgaagagtcgatgaaccaacatgtactccctccgtcctaaaaaaacaaactctggtttccgtgtctaacgtttgaccgtccgtcttatttgaaaaaattatgaaaaaaattaaaaagacaagtgacgcataaaatattaatcatgttttatcatctaacaacaatgaaaatacaaattataaaaaaatttcatataagacggacaatcaaaattgaacacggaaactcagagttttttttttttgggacgaagggagtatattatagtttatttttttatacaaaatgctgaatcacaatgtatagttgacgccagcccgagtaaacagtcgtggttcaatcctttgcagttcatgggggatcaaaggcgattcatgggggagtcgatcatccgctactctacaaattcgtgaaccccgttaaaatggccaaaatcattcagaaattcagccttgtctttctcgttgaacccatcgcagtacggacccaaaattagttgctctgcttccgaagtaatctcactgttgagactataaatatactctgcattgttcttgaacatctcgaaccagcgagtcatctcagcatggtcacgctctttctcgtaagcctcgcaccagcgctcgtacaaggcccatatggcttcgtccgactctaagtcttttcccgagatatccttacctggctcaggatcatctatatcacaaaatacaacaacattgatacagtcaaacaacagcgaaattggaggcttgtaagttgcaatttggttggttgcgagcacaaagaaacgaaaaattcagatctactgtttagccttcggcttataaacacaattggacacgtgaattttgaagtttttcttcttaatttacttttcgtaatacacatataaaagttttacctacaaattatttttaatcactattgaaccaagattcaagacttcaagtactccttgcgaattgcaaactctccagaagggtatgggcagcagtgcaacattgggatagcatagaccttggatgctacacacgccgcgtaaccccataagatctctaaaatccctaataatcctaatagcctgagaactttggtgtgagagaaatgctaggatttttcgccgtatcgccgccactccagccaccatcgtcgcaaaaatcaagaaagagaccatgacctaggccaaggcgggagcctcaaagtttgctgagttaactcttttggaagagtccccgtaatttctttgttcgggctcccgtttctattgacat

SEQ ID NO: 3365 - DNA, 1501 bp, Oryza sativa
cgaccacatgggtggaatgggacacccctggcggagtaactagcttaccaggggagccttgatgccgagagacatgtggattcgccgggctggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggctaggtgatccgggttagtaatgtcgtgtgggtaaagtgtaccccctctgcagaggttaacaaactgttcgaacagccatgcccacggtcatgggcggatgtgaggtgattcctagtgtagttttctttgactaccgcttgtgaaattgctgttgtggaaaggggttcgatgtttgaaagattctgcagctgatgggatcagctaggcccgggtggccgtttgaaagttgttggcccgggtggccggttgaaaagctgttggccaggtgccaatcttgtgtcatttctaaagattgatacattgcacatactccgaccggacgagacgcactgtctcatccgtgtcgtttgagaagcactcacctagttgttttcagaaaggagttcaaataaaatcaattgcaaaaacaacagcccttcccttaaagcctgcattaaacacttatttcccatggcttgctgagtactcccgtactcacccttgctctatataaataatctcccccagttgctgaagaagatgaagcgaatcctgctgatgaggagttcttccaggagcaagccggctacgatgagttttagggtttcggcctagttcccaagtcacgcctgtattgtttgatccaagtcctggcttccattccccttttgtaatgcagttgtgagctcgggatctgtccgcagcccaacatgactgtacctctactctataataaagagacctctgttgctgtgataatctgtcttcctgtgataccagcactgtttcctgggactggtatcgattaacaggttaatttggagcgtcacgggctagttccagtcggtactagttcggggcgtgacaggacagtctggagtggagttatggtgctgtctaaatctagctccacaactctagttcattttgtgagagagcttcatccagctccactcccagttttggtggagctgaaactgtttggctgagctccagctccaggaggggtggagctggagctggagctgtaccaaacaggccctaagttaggtctggagtggagttgtggagctgcctaaacccagctccacaactctagttcattttgtgagagagctccacccagctccactcccagttttggtggagctgaaactgtttggctgagctccagctccaggaggggtggagctggagctggagttgtgccaaacaggcccaactcctagagctaaatttaggagttggagttgtatcaaacaggtc

SEQ ID NO: 3366 - DNA, 1501 bp, Oryza sativa
gtcgctcgccgtgtgctcgtcgtcgtcgccgctcgagctccgtagcacccgctcgtcgccagcctcgctcggcgtagctccgcccaatccgacgctagcatcggattcccgtagccgcgtagatgctctcgccgccgggaatcggcccctcgtgacctcgtcgccgttttcctcttccctccccgccggttgccgccgccgcgattcgccgccgtcaagcttcctccggcgaatccgagccgttggctcgtctccccttatctcgtgcaaccacccggtgtgctcgctttcgccggtatcgccgtggttcgctccgccgctcgccgctgttgtccgccgtccgttccggccggcgtcgtcgtctacctcccgccggcccgcgtggcagccacgtaggcgccacgtcggcgccagctcagccgaggtcaggacgggccgaccccggtcagcccctcccgagcgcgcgttccaccgcaagccgtgaggctgcgcgtgggcccgctgcatccgttcctccgcagaccgcgcgtgtgcaccgcgtccctcccccgcccgcgcgcgtgcgccgcgtgctccctccgcacggtgagccgagccgctgacaagcgggtcccactcgggaccgcgcacggtgagcctggtctaccggccctctctctcctcccctcccgcgcgcgcgcacttgggccgccttgggccggccggcccatttagctcgtccggtccgctccttttcccttgggccgcgccctagccgcccgaggaaaagtctataatccctccctattttcttttcttttctttttcttttccaaaaaggatttaattaaatccttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatttaattatgttgcttgaaaaatattatgcactgataggatcgcacttaatctgttgtcccgtctgcaaggcagattggcggacttacataatttgctgcatttgatcctccctttgttaattgttatatcatgtccccttgtaaccatctagttgcgtctcgatatccgtgcatcctgcgcgagtatcgacggacgccttcaaacttaaaatctgaaaaacttcttgggtaaaacttgggtttacaaaagacttggaaaacccgacacctgggtcggtgcttgcgaactaaatgaatttccaaaaccgcggaccggggaacgtaccgggtgtacggtttcccgctctcgcacttaaggaccatttccttggaatttcatcca

SEQ ID NO: 3367 - DNA, 1501 bp, Oryza sativa
actgcatgcatgtgccaagttacctgtgaggataaaaatctctccctagtttcaaatggaagtgacacacttggtaaatctatttgaacttgcaaaggcagaggataggccgtaaagttccaggtcatgtgtttttctgttcctgtttccaacctgaagctgaaagatggagcattgtgcctacctgatgagaaagctacatgtgcaggctggaaatttttcatccaaattgttagttgttggtttccatttccccatgagtagttggagtcttggagcactagatgttattaggagagaaaaaccagcacaagatattagatcgatggaccgatggtgtttcgtctcactatttgctttggtagtttgcttggctaatacggccgtcattagtttgtaatatcaatttgatttgactggctaatttcgtactccctccggcttagtaaaacttattattttaaacaacgacacgcggttaaaaaacgatttcaacaactattttttattacaatatatataacaacatcaataaatatataatttattgaagtacttttaggactaatctaacattctgagatgttattttagtcaaagttgtaaaagtttaacaatatttttgttcaaaataataagtattactaaacccaaattgtaattagtggtttgcatgtgttcagattaaaaaaaaatagctaacatcacctcgccatccccgttgccgtgccgctcagctatctcaacgtggatgcctcacttgatttgggaggagagaccgagaacaggagcatgggaggagagtgaggatgatatgtgaggcccggtttgtttttgccatgtaagcgcgtagtcagcacaagtggatcggatcaacttgccacgtcagtagaaaacaaccatctatgctgcgggagggcctaatctatcccagttttgcaagtttgggggtcaaaatttctggtatcgtggtccaaggatacgatttcaaactcgatgtcaagaggagggacctaaagtaaacttattcctattccaaaacaccggttcactcactcttgggccggcgaagtgaaccatgtgagaagtgaaagcccatacttggtttggtcggtgaggcctcgagccctcgactcccggacgcctcgcctgcgtcgatctccatccatcgccgccggcgtccgcggcgtctctctcgctggttggctggtgagtctcatgatcatccatcccttctttctcatctctctctacttattacgttcctttctcgaatttgcgttagccctagcttctcttctagatcttggaagcttttctctttgcctgccgctgtgatcacaaactgtgtgtcgcttgccataactgacatgctctttgatttgtgctagaatcgtgtgcctggctagcttgtttcagatctgtgctgaaataaagaacaatattagtatatgttaaatcgagggatggataagtttgttttctgatgaaatttgcgtgc

SEQ ID NO: 3368 - DNA, 1501 bp, Oryza sativa
aaccggacgtctatactgcctagggacttttttttggacggttttacataattgaggggtacacatttctggtttcgtggttaagggacctcaaaaaatctcgctgttaagtcgagggacctcgggtgaacttattccttaattttgcgctagttgggccaacgtataatagtccaattttcagcccatgtccgcattgcgacctccctctcgtagttcagcccaagtaaaattttgggctcattacggtcgtttttaaagtttttaaatttggagctcactagaggacactgataaaagtatgttaaaatcagcatcaaatttaagttgaaaattcaattttggttttagctttggttttgacttattagagtataatcaatgagggtcggaatagattctgcttaatctagacgagactatcatcatgcaagtctagctaggtacgacctacgcgttggccgtgaccgcgaccttgaccttcatgcccgcggtgcagtggtcccggatgctgcagatgaagaaggcctcgccgccggcgagcttgatccggtcgtcgccggagttgtacaccttggacggcccggtcaccgtgcacccgccgtacccggcccggtccacctccaccacgttgtgaatcttcgcgtcatacttgaacactgcgtatccacatccatatgtatttatatatcaaactcatgatcaaattggattaagtcgtttttgttttttaagacaaatttaggtttgtccaactacaacgctaaattagttttattaaatatatcttgataatatttaaaaaatattatatttctataaacttaatcaaacttaaaaatgttcgacttctcttaaaagtgaaagcaaacttgtaatacaaaatacaaaagggagaaagtataaattatgttgctcgatcgagcatcgatctcaccaagctcgtcgccgggctggattcgcttgccgttctcccagccggcgacgccgaaggaccatcccttgttgtcgccgacggcccaatcctcgccgtggacgacggcgatggcggcagccgcgcagcaaagcgccagcagcagccccggcgcggcggcgcttccccgtgccattgatgctactgccggtgccgcagtttcttacgaattaattaacgttgtcacccgagctcacaagaacgatcaggtgatgtgatgatcgacttggctgctttccttttctaatttctagtatcgttttgtgtctataggggaaggctctgtttttatagctagcctgtatatttatttattagaccttactactagtgacgttggagagatatcagatatgcacattgaaatgatgggatatgcagcattaatagatccgtgtatatccacttgttaatatagagaccgacagtagtctcatctattgtcttaaaaatttgaaatggaggaaggatgcacatttattggaatagatatatccaactatttctaagagcaagtatcattgatac

SEQ ID NO: 3369 - DNA, 1501 bp, Oryza sativa
tgaattattttagtctaaattaatactacctctgcttttttaatagatgacgtcgttaattttctgtcacacgtttgaccatccgtcttattcaaaaatacgtaattataatttattttgttgtgagttattttatccctcaaaatactttaaacatgatttatatcttatacttctgcataatctattatattattaaaacagccttaaatgaaggcaccactttgccgccgtgggggctagaaattcccacattaatcggagaaaaagaaaaggagagtccaaatagaaatacaatttaaaaatagctgaattcggaattaaaaataagtaatattgaaagaaaactccatataggaacccaatatgagattaatcgaaattcagaataaaaataaaataaaatctgaaaatagaaaaaaattaagagtctaagtaggaatacaatttaaaaataactgaaattcgaaatttaaaataaggaatattgagagaagagtccatataaaaacccaaagcgagattaattaatattcagaataaaaataaaaataaaatccaaaattagcaaaacgaaaagaagagttcaagtaggaatacaatttgaaaataactgaaattcataattaaaaataagcaatattgaaagaagaattcatataagaacctaatacgagattaattaaaattcaaaataaaaataaaataatatcaaaaattagaaaaattaaaagagagttaaagtaggaatacaattttgaaacaactaaaattcaaaaataaaaaataaaaatattaaaagaacactatacagtattaattaaaatttgaaaaaaaaataaattctgaaattagaaaaagaaaaaatattttagttaggaatacaatttataaataactaaaattggtgagaaaaaataaagactattgaaagagaagaccatctaaaataaatgatgaggtaaattaagtaacaagcctataaaggagtagagtggtgacggttgatacgacgtataaaaactgttaataaaacaccaaatagaatcctaatgacgattaaaaggagggacgacaggcaggccatgaagcaaacaggcaagacggttgccgggacttctagaaagtaaaaaaaaacccgttgataatcatattcggtttttaaaatctcaatgacagtaaaaaggagaagcagcgggcggggtgtataagagtatagttgcagagctgttaactgttggcgggacttcttaaaaataaaaaataaattccaacgatagttatgttcgatttttagaatcccaatgaaaacaaagagtaggcggcggatgggtcgtaggggagtatagtggtatcgtttgacgggacttctaaaaattataaaaaataaaacccaacaagaaaataaactctaaaaactacaaagtccaatttctaaaggttcggaacttcttaaaaggtaaaaaaacaatgataattatgttcgattttaatatctcaa

SEQ ID NO: 3370 - DNA, 1501 bp, Oryza sativa
tcaggtaattaaccctagctagctagctactccttctctctttccgttttaaaatataataaacataggatcaaattagatatcatctagtacattaattattacgaatctagatatagcgttactgaaattcataatattattagatggtgtctaatctaattctgccttactgtattctgagacacggggagcaaataactgagatgttggtttggcagttgatggatccttccaacacatgtagcgtcaagtcgtcacgccgatcgagggctccacaccccccgcctgccccgccgacgtcggtcgtatcgtacacccaccacatggccgcgcgcgcacaatgcatggcactgcagctacctacctgcatgctacgccgtgcgtacgccggctggaggctggccggccgggccggcgaccgcgcgtacgtcgtcgttcatcccgaaataccaacagcagcagcaccagcatctactccagcatactccctccatcaaaaaaaaaaagacaaatcctagtttccccgtccaacgtttgaccgtccgtcttatttgaaaaaattataaaaaaattaaaaagacaagtcacgcataaaatattaattatgttttatcatctaacaacaatgaaaatacgaattataaaaaaattttatataagacaaacagtcaaagttagacacgtaaacccagggtttatctttttttaagaacggagggagtactatctatcacaaaacacgaggaatttgctagcttagctgcactgcacgcctctctctctctccctctccctcctctctgtgcatgcaggcgtggtacgatcgatccagcacagcgcgcgcgccaagctttttctttctttttttttctttttgcgattttattttttctttttcgattttctcctatttctagcgttttcttttcgcgttttttctgactattttttaaatcttcaaagcatgtgttttcaattttttgagttcaaagtttttaaattttaatttgaaaacttttaaataaagatttgaaaattcaaatcttgacttgaaagtttttcaatccgaatcgaaagttttcaaacttgggttgaaagtttcaaatttcgagttgaaatttttcaaaatttgacttcacgtatagatttcgtatcaatctattagtaaaaaaaccttccaaaaaaaggaaaatattgctaattaccataattagcactaactatcatcattaccgctaattacggtgctaacagcgcaaggtgttgaggggggcgtggcagcgcgctacttccgtagccagcgcgcgcgaaataggaatcccccacaacaaggagcatcgatcgagtagtaaaaagagaactcaatttagaagtagatgtgatccttggtaatacaatgaatctccattcttaggttgagttactttttttttggacggaggaagtatatatatgtgcgtatgaatgcaatccgttctaaaatatactccctctgtcc

SEQ ID NO: 3371 - DNA, 1501 bp, Oryza sativa
caaaccagccgaacataacaattctggtcaggtctgtcacgtaaatttctgaatccatccacctgtcaaggttcaaattaatcaaatatttgtgtgttctcattggactagaggactacttaatttcattgcctgaattgcaaaattctgaatccaggttctgaccagaaactctgcaggtcttgtgtagaatctcagaatggttctaatgtagcctatcatttttccagaccattgctacggaaaaatcagaagaaggaactatgccatttctttgttataaaaaaaagttcatttttcttcccaacaatttatcagagcacttacccgtcgttttacaccccgaactcggttcaccttactccctaagatatttctctcttttttatgtatcagtcgtattttggactgaagtttgatagaatcaatagctgtatcataacataccttgatatttttaaaatgtttatcactgtttatataaattaaaatcactaagactgatttaaaaaatcaaggttttaaatttaaataaatagttacgaaaataatttggaactttcatagtgatgtcatccatggctttaacaattttcaacttaaaatacgatttatataaagagaaacaaaatattattaagtattaaagtgaacgtctttaatattattttggaaaggtaaaatgaccatcatctcctatttaattggtggtttattgtcggatcgactcaattaaaggtatgtagtatgtacaaaaataaaatctaatatgggctctatgtattaatacatgtcactatactattatatcctattatatcctataatagtagaaattatatcctataatagtactataatagtagaaataacgggatcttttaattattagtgctctatttttttctattatcattctttcgttttctccactatcgtgcaacaaaaaattccgttaataagtgataagaatcgactataagccattgccatacgcaacaacaatgttaatttctgttttatttcctttctctcgtcaccaaatttacttgatgaaaactcgttattgaacaccattttgctcaattgtcatctgcatactatttttgaaactgaccaatcaggcaatatctttgtgattgagatgaagggatatgctaagatgtccaggggaattgtccaaatgctaagattgaggcaaaaggttacatttgggatgtctttatctcatccaattaatccacggataccatgaaattaaatgcttggaattaacgccttctatatatttcagtgaacaaatcttcagatatagaactcccattttgccgaacattaattaccaaggtacaaaaccgaatcgcccctataaattaagagggatcagtcgcacctcgccgagccaacattcagatcatcaaccacaagttcagaaaataaatcagtcagtagctcatccggttgccattgccaatatagttcttgcgagtaatcagttcag

SEQ ID NO: 3372 - DNA, 1501 bp, Oryza sativa
tgggtaaggcttagtttgtggctcagtctagttataaacaaaagtacacggatggaggtggatgaagtcgggggtcgatggacattctccagggcaaatgacggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtttagttctagaatcgtgtttacaaaatagccctgagcaactaaatatctttaaatgctgtttactgcaaccctaacccctttatggtataactcctttgtactcccttgcatttattctgcatttgtgggtgtgtcttgttgagtacggtggttgtactcagtcttgctcaatttttcccaaccccagaagaggaattccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctaattacgcttccgcttgttaaactctgaattgtatcaacttttggtgtaccttgcctcctgggacaaggattaatgcacgcacgtaaggaatgcccgttgggttatttccggtcgtgacaagggtggattaatcataccgatcatatcaattccccaacctctaaaaggccacggtttaataataggattcatagccgatgctggcgccctttggatcgctccaaacttctgacaatcttgacaacctttataatatctgaaacaatcctccagcattgtcggccaaaaatatccagcacgtcggagcaaccacctcattttatgagccgactgatgtgtaccacatatcccttcataaacttcgccgattgcaacttttgcctgatcggcactcaaacatttaagcaacactccatcaatcgtccgataatagaagtcatcatccaataaagtatatttcaaagctttataacgcaatttccgcgaagccgattgagatggattctgtaaatactgaaacacatcatatctccaatcatcggctgtaattgtagcaatctctatttcgatatcttttatc

SEQ ID NO: 3373 - DNA, 1501 bp, Oryza sativa
  unsure (1)..(1501): unsure at all n locations
ggatgctattgctcctgtcctaaggaccagttcggataaatggatgtcggatatatattatctaattttgtgataatactcgagagttaacaataaattaattattgtaaattggaaaaagtacaaattaccccctgaactatcgcggtcgatcgaattacccccctgaatctgaaaccagacattgttcaccctgaacttttaatatcggacgaattatccccccttagacccaatccagagcgattttttcctacatagcgtacgcgtgtcaatccagtcaacattttcttttaaaaaattggtgggacccacctgtcatttctccccttcacctctctctgcgcagaggggcgggcggcggacgacggcaacgtaagacgaggagggccatggatgaggatggacgccgccaccatcgccagaccacgttgttgcatgttgctgccgcgcttcttgacgccgctgccatggatgaggttgccgcggcggtgcatggggcggtgctcaagtgggcgcaggtgcagcaggagcgacggtggcgcgaggatccgccgcccctgatcctcgggagcgacgtcggcgcgtggatctagaggccttcatcatctggagcgcctgggggagcgggaggcgtctttctcctccgccaccgtcaagtccatcatcgactagtcgctctccaccccctcgttgtccccctccaccatcgccgccgcggcttccaccccgacagcacgcacagcgcggcgtgggaatggaaggtggncggtggcgcgcggggtcgaaaggacggagggcgccggtgggtaacaagccgacgncggcttggttgcgcgcgggcgggcgtcggcacganccggctagcgccatcactcgcccgagagcgtcgtcgtcttcgagcttctgccacgtggcgctgttgtcgtgtggtctaagcctccaagggcctcgtgccaccgcgtgtagaggccatcacctcctcctcctcctcctcctcgagccaccatgttgccgtgtgacattcccttgttgtgctcagcccctgtgtcgccgcgggccgccaccgccaccgccaccgccaccgcgggcccctcctccttctcgtcgccactgcaatcggcactgcctccacctgtctgcccccgcccgtcccctcacgccgccggccacctcccgtccctgcgccgccatgcctattttgtgcccgagagagagaggaaatggggtatgacatgtgggtcccactatttttaaaaaagaaaatcctgactacattgccacgggtatgccacataggacaaaaccgctctggattggatcgagggggtaatatgtccggcattaaaagttcagagtgagcaatgtctggttttctagtttaggggggtaattcggtcgactgcgatagttcgagggtaattcgtactttttccttgtaaatttaaaatttattgcggaaaatgcttagaaacttataggacatttaaaaaattcacac

SEQ ID NO: 3374 - DNA, 1501 bp, Oryza sativa
tcctaagggttacaatgttttacctccattaggattgagtcgactagacgttagacataacaagcaatcatgaggcaagaaagttgtagcccactagtctagctcgcgagccttagccacttcacatcaatctagggccactcacagcgcgccaccaagttttatcgttcttcacatgccacgtagatcaagaacagtataagctgcatgctccacagtgcaagttacatatagcgggttaggtctatatccagctttagctaatatattgacgtgtaatcattttaggtgttaaaaaaaatagttatccatctttagggttgagtgacgcaagaatttggccagagaatcaattgtctccctcctagacaagtccaatggcgactctgttcatcatttggccagaggtgtcgtaatcaacatgcccgtacctaacggcatcatgtcggagtactaaagagcccagctacgattcatctacggacgtcgtccttactaatcccgaactcgatcaatcaaaacgtaacctttcaggtattgaaaacttaccactactccagtaaatcacagcgtgtaatccgctgtcacaaaacacaaactcccaacagacacatcaagggcgcaattacactctcaccagcagcaacagtcgtcctcgagaccgatttgtgaccgcaattaaatcactcgctcatcgtacagtacgtacgaacgatgtgcatcgaccgtcgatgccctggatggaatggccgggccacttccttcgcccatggggcaaaccaggcgaaccttccccgaatcgcaggccttcgcgcacatggcggcaatgccgtcgtgttggctcgtccgtccggatcacgatctgctgcttccgcgcgaaccgaactgcactgcaggccatgaactgtaaagccgaggctggccgcggccccgtgtgacgtacgatccgcgagcaaagccgagcaaaagcgccacaaaagctgcacactttaccacgtactcgcatccatccgtccatcggcaggcatcacctgcccggtttacgggttaccgctttcgcggatgccgccgcggggatgggtgtggtgtggtcaagtaaagtcccccgcgtctctggcccccacaccccggcgtaggcacgcggcggctggatccagcgtgcgtccagccatgcatcgcccccgccccaaatctatccggcgctctgcagcgacgcgctccgtgccgcatttacttctttaaccgtgtacgcgacgcgccaccccagccggcatttgcccgtcggataccacctgtctgcccgcagctctgctattgctagctgccccggccacgcccaagtataaataccggctcataggcaagtgcttcgccatcccattccagtgaccaatccacactgatcccagtagctctcattgtcctcacgcttcgactcgcttgctagatctttgggttcttgtgtgttgtgatcgcgcgatgaggacggtggcgcttggca

SEQ ID NO: 3375 - DNA, 1501 bp, Oryza sativa
tacttagatcatgatgctgtttcctaagggttacaatgttttacctccattaggattgagtcgactagacgttagacataacaagcaatcatgaggcaagaaagttgtagcccactagtctagctcgcgagccttagccacttcacatcaatctagggccactcacagcgcgccaccaagttttatcgttcttcacatgccacgtagatcaagaacagtataagctgcatgctccacagtgcaagttacatatagcgggttaggtctatatccagctttagctaatatattgacgtgtaatcattttaggtgttaaaaaaaatagttatccatctttagggttgagtgacgcaagaatttggccagagaatcaattgtctccctcctagacaagtccaatggcgactctgttcatcatttggccagaggtgtcgtaatcaacatgcccgtacctaacggcatcatgtcggagtactaaagagcccagctacgattcatctacggacgtcgtccttactaatcccgaactcgatcaatcaaaacgtaacctttcaggtattgaaaacttaccactactccagtaaatcacagcgtgtaatccgctgtcacaaaacacaaactcccaacagacacatcaagggcgcaattacactctcaccagcagcaacagtcgtcctcgagaccgatttgtgaccgcaattaaatcactcgctcatcgtacagtacgtacgaacgatgtgcatcgaccgtcgatgccctggatggaatggccgggccacttccttcgcccatggggcaaaccaggcgaaccttccccgaatcgcaggccttcgcgcacatggcggcaatgccgtcgtgttggctcgtccgtccggatcacgatctgctgcttccgcgcgaaccgaactgcactgcaggccatgaactgtaaagccgaggctggccgcggccccgtgtgacgtacgatccgcgagcaaagccgagcaaaagcgccacaaaagctgcacactttaccacgtactcgcatccatccgtccatcggcaggcatcacctgcccggtttacgggttaccgctttcgcggatgccgccgcggggatgggtgtggtgtggtcaagtaaagtcccccgcgtctctggcccccacaccccggcgtaggcacgcggcggctggatccagcgtgcgtccagccatgcatcgcccccgccccaaatctatccggcgctctgcagcgacgcgctccgtgccgcatttacttctttaaccgtgtacgcgacgcgccaccccagccggcatttgcccgtcggataccacctgtctgcccgcagctctgctattgctagctgccccggccacgcccaagtataaataccggctcataggcaagtgcttcgccatcccattccagtgaccaatccacactgatcccagtagctctcattgtcctcacgcttcgactcgcttgctagatctttgggttcttgtgtgttgtgatcgcgcga

SEQ ID NO: 3376 - DNA, 1501 bp, Oryza sativa
tggactaatttgcgagacgaatctattgagcctaattaatccatgattagcctatgtaatgctacagtaaatattctctaattatagattaattaggcttaaaaaatttgtctcgcgaattagcttccatttatataattagttttataattagtctatatttaatactctaaattagtgtctaaatatagagactaaagttaagtccatggatccaaacaacacctgaattcatgaacgcaaaagaaatgaaacgaatggtgtgagtggtcagaggtagtaccagcacaagtttgacatgttctcaggacaccactaatgtatatagtaaaagttaaataaactttaactatagcacttctcacaaatgtatatggatacaatatgacattaagagaagagagagaaatagagatagataatattatttatatcatatgggtagttcatatgcatatggatacattttgctattttctttatatgaactagttgcacaatgttaataggtggctgaatggaatagtttatattgtggatgccctcatagcaatgcaacttcttttcttaaaaaaatctgtggaaataaattccatcaaaatgacgagttaggcaaatcactaacctgtcatttgagatgcaaactctattaaatcttcaagccattaatttgcaagaaattaagaatccaaagccaggctgatattagcaatgcattttcctgcattgtcatcgtttcgcacatgactgatacgcttattgcgaaaaaataattaataaatatctttttaaaatgtgcatttaacgacttaaaaactaatgctaaaaagtaaacaacgattaaatagttatttttaaaatttaaattttggttggaactaatagtccaccaaatttatgtacagttaaacctggtgcattggggtcctattcagattcgtagtttctagaaaatatcacgtacctttaaaatttcttatattatactactccgtaggacggagtaccaaagaaccacaagaaaatttatacggccatctgaattctgaggagaacacaaccaaagatggcaaatccagcgatgagcaaacgagccgttgcgtccagaattcgctgaacgtctcggtcgattttaatatctgtactatactactacgtgaccctctatggcgtcgtcgagccgaaccgagccgagccccctctgctgctcgctacagaggccgctgtctctcgcccctctggtgccaactcacacccattacacggctggcaatggcacggcatggcatggcagagaaaagatcactcacttcgcggcaccatccatccaaccatcttccaaaacccctatataaaccccagcttcgccccctgaatctcccacacacactgatcaccgacacaaacccaaagctaagcttcgagctcccccattgatcagtgagctagctagtagctggttggttaaaaggcctttttgttttgtttgagttggagcaga

SEQ ID NO: 3377 - DNA, 1501 bp, Oryza sativa
tacatttacatctccgtggcaacaaaacacattcattattcgccatctgacgtgctcttctcatcatttttttcatcgatgacggatcatgcatgcgtagcgtacgttatgatcatcttctcgtgtcgatctcaacggagcttgcactcggcgggggtgccctgggggaaccgcttggcgtcagtgcagtagttgtagatcatgaacttcctctgcacccacctcatgcggcggtagctcatgtcgctgagctcctggttccaccacccgccggcgccgcccctcctgccgccggccggcgctgcgacggtctccattgtgccgacggggcagcgctgcgcgccgttcgaccagacgcaggcgtcggcgttgaagtcgcggaaggaggcgacgaagggggccttgctccagtccgccttgacgcggccgccctgcgtcgcccagtcgtccgcgttccacaggctcgcgtacacccgcatcggctggctcttggggaacgccacgccacgggcctcgtggttcttgaagtccctgatcggtgtcccgtccaccgcgaatctgcacgcaccaccaacacgttgttttagccaaaacccatcgagtatcaaccatgcgtctctgtctcgcgtaacaacaagaggggttcacgtgccaatgtggaagtaaagtaggggactcacatgacgtgctgtgggttccagatgatggagtaggtgtggaaggactgggtggggtcgaaccagaggcggaactgctgctcgcgctgcccctgcccctgcgtgaacacgttggtgtgcagcgtgtacggctcgccggtcacgttccccaggaactcgaagtcgatctcatcgtgggtcgaaccctgcgacgacaactgcagccacaagcacagaagatcacacaaaccatcagcttcattactccactttagttccgtttttttgccgaatttggtagatgaataaatgatgaagtgatgagaccgtttggggaggaagataagcttacgtagaaggtggtgacggtgccggcggagttgccggggacgagcttgatctgcatgtcgatcttgccgaagaggtactcgctcttggactggaacccagagccggagctcctgtcaagcgtgaggtcgagcccacggccaccatcgacgatcttgccgcggccctgcccccacgacacctccgcgtcctggaagaagttgcctccatgcgcaatggccaccaggcaggccatcgccacaatgccaagcgccaccgtcctcatcgcgcgatcacaacacacaagaacccaaagatctagcaagcgagtcgaagcgtgaggacaatgagagctactgggatcagtgtggattggtcactggaatgggatggcgaagcacttgcctatgagccggtatttatacttgggcgtggccggggcagctagcaatagcagagctgcgggcagacaggtggtatccgacgggcaaatgccggctggggtggcgcgtcgcgta

SEQ ID NO: 3378 - DNA, 1501 bp, Oryza sativa
ggcggaggcactgcgtacaggcacggccgcacgggacttcgtatagaggttgaagacgatgtgctatagcggaggcgcagcgcacgggcacggccgcgccggtgaagcccttccccatccgccgtcgttccccatccgccgccgtgctctcctcctccggcgccggtttgtccgtcgagacgaagacgaagacgacaagaagataacacggagacggctgaatgtgacgaagaggacggaaattgtgatggagtggcatggttctaattttagaaaattagagtggcatctacccgatttcatgaataataatgtcatttttctgatttaccatatttatagtggcatggatccaattaactaaaaagaaaatggtgtgataacctgtgtttgaaagaattcgagctcagaccaatgcatagctctggcagatcccagctagtcaagcactcgagctagcagccgttctcaacggaaccacagattagcaatttagcattgccaggctgccagcgacaccacttggctgtgttcagatatgggaagttgggaactaaactctccgtacggaaaacggagcggtccattagcgcgtgattaattaaatttttgctattttttttaaaaaataaatcgatataatttttttaaacaactttcgtatagaaactttttactaaaaacgcaccatttattagtttgaaaaacgtgcacgcgaaaaacgagggagaagggttgagaacatgggattgcaaacaaaactgttcgcttcacatttctactagttttctaactacactgctaactgcttcactgtacccattttgccattgagtcagagtactcgcctgtactgtacgatgtagttacataccaatacggagtactgcgattttcagaccaaccgtgcatgggatactcttgcgttttcggcttcacatcagttacagtacacgcgacggtcgggccctacgttgtaaagccacctgatcaatgccaattgaaacgttttaacgctccccaagcacgggagttcggtgactatttaaggttttgttagcttgtcgaattgaatgcatggatgcgtacatacatttacatacccacttgtttcactttcacctttcctccgcacgagcgacctaacaattttaactgatttataccagcacaagctaaggtagcgggagactagtgcaaccacgctacagacctactccctccgtctaaccaaaaaaaaaaaaagacaatccctgggtttccacgtccaacgtttgactgtccgtcttatatgattttttttataattagtatttttattattgttagatgataaaacatgatcaatactttatgcgtgacttatctttttaattatttttataatttttttaaataagacggacggtcaaacgttggacacggaaacctagggtttgtcttttttttttttggatggagagagtatagtacaggtcaaggaaacgatgcacttttaact

SEQ ID NO: 3379 - DNA, 1501 bp, Oryza sativa
acaccccctagtatactctagctccgcccctatatatatatatatatatatatatatatatatatatatatatatatatatatatatatatatatatatatatatatatatatatatatgaaggctagcatctggtgggtagagacaatggctgtgggctagcggcatcgatcaaaattaagatagtcgagcgcgtcatcacagccagtgccggcgcgacgcgacgcgaccgatcgacacgcctcatacgtcatcatcgccgtccgtcctcgatcgatgtcacccaggccacatcgtacgacggccactatacggtggcgggggccggcgaacacgacggagatgctttccatgcagtacggcttcgacgacccgctggagcggtttgatgatcgacctctctccttcacgtccgcgcgcgctgcttcaactcccgctgtcccgcaggccgcatatactccctctgttttaaaatatttgacaccattaaatttttaagtatgtgtttagctattcgtcttattcaaaaaatttaagaaattatttattcttttcatatcatttgattctcatgtacatatatagttttacatatttcataatttttttaataagacgaacggtcaaacatgtgctagaaagtcaacggtgtcaaacattttaaaacggagggagtaggatatatctacgtccgcgcgcttgtttcctgctcaacttccgcatgttatgttaggaccaggcctcgatcgccaagctccggctgcaggtccagcatggggccgcgtgcgttagtgtacaaccatatatcaattgtatttatcgacctttaccaaccatatatcaatttttattgggtgtagctatatttatggtgctatattttttataaaaaaatagtcggcatgtatttacattgtaagtccctaaattacatatgtaattttagtgtatttacaatgtaagtcttaaaattacatatgtaatgtaaatttgaaaattacatactaattacatatataagtgaggtgtaaatgaggtgtaactactgcgtaagtggctgaaaaaaagtcgactgtagcatatggcgccatatttctagcaactccgtataatatatagctcatgcatggaacccaatatatcttactactcatctgtgttgacagtacgtatttgccaaagtatcttttgtcggtcctgttttatcatgtgtttactagctgtttaattctttgacgggcacaaaactttaaaaacggaccatttaatatgcacaattaaaattgttttcacccgttgcaacgcacgagcatttatgctagtaatatataaaaatttaattcttccttataaactaaacgtcgggattttattttattatctaacaaactgatcgatccattcatcaagttttatctgtatttcatataagaagcaatccataattatcatattagattcccttctatcaactcagcatattgaagatctaatgtgacca

SEQ ID NO: 3380 - DNA, 1501 bp, Oryza sativa
aacgatctccgtatctagtgagatttgatagcttgtggttaattctattatgtgaactgcgaagacttctcaacatatttttttcatttattttcagtcataagaaacttgtctctttaaccaagaaagctagccctgatttatctaccttcttcaatagttgttacttgcaagtaatgacactactacaacctgttttaactagagggaaacttatctactatatggctcgacgcagacggttctaatttcatgatgtcatcgtttcaaaagaaaaaaaaactctaaatatgttcacttatttaatcactcaaacgaccgcttagatctatattgttatgcaacggttttgtcctacgtacattcaatattggcggaaaaagcaactttgcacgcacctaccgtacccctacagttttccgttaactactctatttgtatgcgctgatacgtcaagtaaccagccagccaatccaaaacccgttctcgtcaccagatataatttatatcacccgatcatccataccaacacaaacaccatctcacctaagacaccaaacatagattcaagatattaaaaaaaaaacatgtataagctactagcaacaaacctatgcatggatggataatcatggaggatatatcatgccaagggcgaaaaggtaatttcaccaccccaacctcaaggtccccaagtaaccctgctgcttcctagcagcttccaagaccccacgtcacgtcgtcgtcgtctttctcgtcgccgtcgcggaatttcctccgccatcgcgcgccctcggtataaatcgccgggagaaatttctccgagctctctcccacccaccaaccccccatcgaggagacgacgacgaggaggagatgcttccgggggtggagctggcgaggcggcggcgggtgcactaccacggcgacggggcggcggcgggggcagggtttggggagcaccaccacgggcactacaactacttccaccagcagcaccaccgtcaggcggtggcgagcgcggaggcgggggcgggcgcagggggcgaggtgagccccgcggtggcggcgcgcatccggctcgaggagaagctgcggggcgccgcggccgcgccctcgtcgtctctctcgaggtgaatgaatccccctcatccgtgccctcttttccctgttcatttctgttccccttttctttgtgttgagatccagccatggactcgtggaaaaaaagatcgcgttctacatggctaatatattttacttctgctcgaattgggggagaggatcggtcggttcttgaattcgatggcaagaagggagccaagatctgattgtttcatcaaccagtttcttggattcaactagaagctatatattatcacataggagtaattccatatgaacagtgtatcaggctttgcttaatttcagcattcagctattccacaatacttcagacatagaatacttttaattccatgtgtactagcaaaattcagac

SEQ ID NO: 3381 - DNA, 1501 bp, Oryza sativa
  unsure (1)..(1501): unsure at all n locations
cagggaggccgtcgtcatcctcgtggttggagacggcgattggtgcgcacaggcgcatggtgtaattgggcaccccagcgaggtgcacggtgtctcgcgtgctgagcgcctcgatatccgtgcacgacaccacctctgggcacatcttctatagctccgtcttgatcccattgatgatgtcgtagcccttcaccgatatgttcggctaggcctcctgcttcgcactctaaatcgacgggcgccgtcctccaacaatccgttgagattggagagagagagagagagatgaagagccacggacatgtggagcctacgctgactcagtgttgttgacttgggtcaaattaccacgtagaataaaacctcttgccatactatcttgggacttatattgtaccggttttaacatatgagagacccgttgattcaagttttgtggtcaaagaccacctgnnnnttcgttggtaaagttaagggatttgaaataaccttattccggttgccaaacccgttggttggtgcgtcttctttctttgtaggtccagcgaaactagcccatatgcacgattttctgatggcccactatgacattcctcctaccatgcattctctttcagctttgttccggcgagttgttttcgttactccccttcttctcgggaggtttgtgcgcactgtgcaggcgttcatggtagttggtggacatcgcacacaactcaacatgcccacacaggagtacaagacggaccaagttgacgtgaaaaatctcagccttcactcacaacaacaaactactcaaactgtggtagctgtcgtggcgagcctgagggccgtggtgtttcggctaaccgcgagatagtgcaacaaattgtttacgtgcgtcaggccgccgctgtgatgacaggctgaagggggagagcaaaccaagccttctgacgaaagctagatgggagtctggctatcagccaaccacaaacacaatgtatgtatgtatgccttggtacatatgatatcacacattaggccattaactcagattcagaactaaacgaagccacaggcctgcagcggtgcagttgagccattcgatatccacaacaacatagctaccaacccatgaaacacatcgcaatagtagcagcgcgcctgccagtgaggatcttctcgagtacgtttagtttgtactttgtacgtagggcctcttcaagaatacgactgaataattccgccccaacaaaaacgaaaagaaaacgaaacgagttgataaagcaagagcagccgaacgagttaatttccaatatagtttggcacgcgaatacgcgattgctccgcgcgcttacctaacacaagtcctcccgtacgtggccgtggatatacaaacaccggacaccatgatcgatcggcctttgctattgtagtagctagctaccagtccaaccaacaccaacaactgcgcgagtgagcgcgcggctattgcgtgccacggcgtgccgttgagcga

SEQ ID NO: 3382 - DNA, 196 bp, Oryza sativa
tttacaaataagccgtttcgcttataccgccaataagagaaacaatggcttcgtatgtctctatatacatatataatatatatagcggcagctatagccggaaatttaaaacggcgaggaatctaatctaacggcactttcaagaataacgccatactatacatacctgagtcatctctatcttgcttgaaataga

SEQ ID NO: 3383 - DNA, 1501 bp, Oryza sativa
actctagctagtttattttgcacttctgttgaggctgtgtttagttccacgctaaaattggaagttttactaaaattgaaagtttgaagaaaaaagttagaagtttatgtgtgtaggaaaattttgatgtgatgaaaaagttgaaagtttgaaaaaaaagttgggaactaaactgagccgtaccgatttgtgagctagaggaggctaacgagggtatttataaggcgagctagaggaccagagctaatatgttggcttgttaaatattctgagggatgggtgcgtagctgaagcatatcccttcgtcgtaaaataaactaactcataataaatgtaacattatatatactagacaccgatccacgtgacatagctattactttattaattataaatattagaactttgatcatatatgaaatatgatgggtattttctgaattatgtatgatgctttagtaagaagtccgcctcacttgcagttgctagctacaactttatactattaactctgatttttaaaattgtcaaattttataaactaaaattaaaagagtcaatgttacttctagccaagttctattttacatgtgctcccaatatcatctcggtttcaatgattttaacccatggctagatatattaattagttaagtgaaacctcttaaagtatcataatattattagtaattgatatagaggtagacagaaggacggcactaaaaaaagatgcgcgcacacggcaagtgatcatagaaaaggggatcgctgataaggataaaatatatagaggatatcaagaattaagtttttataaagaataaaatatattaattagtggtaatatatcttgtgagatgcatacaaattgataacttatcttatataaatggttttgatagttcacacaacttgattggagtatgatcaagctcaatttaccgcatggccttctaattataccgataaaatcacatcactatcccaagactgatatggatgaaatatacgatcatgccatataatatactgttgtgctgagttcaatagaacttcgcatcatcttgtgtgagtcgttaaaaaataatatgttgttgtgctgagtttgaatggataagatatgagttgtgcaagattgtacaggaagctgaaaaattatatgaaaggaagggcattgtctagtgtttgatttatatctgatcgtccgaaatgggtttatagtgatcgcttgcgtttgtagccgtcttacctttttggtctgaagtctaaaccgcagagcaccggctccaacgaggcgcgcacataaggaaaggaaaacctgcaacaactccatggtctcctcccgtttcgatcaaacaaaagaccagaaaataaaagagaaaaaggtaatagtaagcctccgttcccaaactcccccaaaggcctccaagctcgagctcgaccccgaaccggaaacattcctcgtcggcgaggagcggcgagatcccccgggccccggcca

SEQ ID NO: 3384 - DNA, 1501 bp, Oryza sativa
gcgtcccaaactgatggaaatagcttgatattatccagggagttgtttcaacgaatttgagaggcatttgatgtgggatttgaattcaaattttatatttgaactcaaagaagtatagggagtcaacgaagggaaccgaataaggaattcggtattatggacatggaggagtatttgtgagggatttaagggggaggggatgaaaaagttggaattcaaggagggagtttgactggattttgcatcctggagttgggaggaatattttgagaaaggattcaaagggagataggtagatagatggaaatagagataaagatagatatagagatagatagagagagagagagaggatgaaacaatcgagaattgatttcaaggactaagggaaaagtttaggatatggaggtgaatcattggacttagtttttatttgagcattagatgaaatttgcggattcaattcgaatataaggattcaaatttcaaagctattttcgaaacgaagacttgagaagttaggttagggattcgaatttgccaaacttgagatttgcaatcatgagcccttcgcaaggagtaaccggagatgatttgagtgtggactcaaatcttcggagaggaactgaactggaattattcgaaggggaaatttctcgatagaggtttagaaaggagatttgaatacgaaggttcgaaatgtgagattattctcggacagagattttgggcagacgattttgacattagggaattgagactaaggagggatttaaagaacgaaatttttcgcatataggatttttattaaattagttttttaacgccacgtgaaaatcggggcgttacaacgcgtgcgcaccttaccgctataagcacctccaaaaagcttggattggcatattttaggattaatgaagtcgccatgggcatatcaatatcgatatatacactgcttactactaaaataataattacctacaaatgtgagcatccatgtcaagtctaagacttaaactcgagtagcttggttctaccacaagtaataaactaactagttgaactaagctcacctcgtgacattaataccaattcgataggcgaggctcactaacttaggaacatatcatatgcacataagtttttcgtacacaccaacaaacaaatgtcacagaaaattctagaaaaaattagacacgtgctcctaatagtattacacatatatgcgaagtttcatattcaaatgcattatattttagctgtaacaaaaaaaagtgaaaatctgaccggttttaagagtaaaatctagataattttatctttttgttaccgctaaaatataatgaatttaaagataggattttacacataggtgtaatactaaaatataataaataaaaaatatgtgtttaatttgtttaaaacatttctataacattgttagttggtgtgcataggaaacttggaaacttgtgtatatagattcgttccccactaaagt

SEQ ID NO: 3385 - DNA, 1501 bp, Oryza sativa
gaagaaaaaagttagaagtttatgtgtgtaggaaaattttgatgtgatgaaaaagttgaaagtttgaaaaaaaagttgggaactaaactgagccgtaccgatttgtgagctagaggaggctaacgagggtatttataaggcgagctagaggaccagagctaatatgttggcttgttaaatattctgagggatggtgcgtagctgaagcataatcccttcgtcgtaaaataaactaactcatgataaaatgtaacattatatatactagacaccgatccacgtgacatagctattactttcttaattataaatattagaactttgatcatatatgaaatatgatgggtattttctgaattatgtatgatgctttagtaagaaagtccgcctcactttcaagttgctagctacaactttatactattaactctgatttttaaaattgtcaaattttataaaactaaaattaaaagagtcaatgttacttctagttcaagttctattttacatgtgctcccaatatcatctcggtttcaatgattctaacccatggctagatatattaattaagttaagtgaaacctcttaaagtatcataatattattagtaattgatatagaggtagacagaaggacggcactaaaaaaagatgcgcgcaacacggcaagtgattatagaaaaggggatcgctgatcaaggataaaatagatagaggatatcaagaattaagtttttagaaagaataaaatatatagaaaaggggatcgctgataaggataaaatatatagaggatatcaagaattaagtttttataaagaataaaatatattaattagtggtaatatatcttgtgagatgcatacaaattgataacttatcttatataaatggttttgatagttcacacaacttgattggagtatgatcaagctcaatttaccgcatggccttctaattataccgataaaatcacatcactatcccaagactgatatggatgaaatatacgatcatgccatataatatactgttgtgctgagttcaatagaacttcgcatcatcttgtgtgagtcgttaaaaaataatatgttgttgtgctgagtttgaatggataagatatgagttgtgcaagattgtacaggaagctgaaaaattatatgaaaggaagggcattgtctagtgtttgatttatatctgatcgtccgaaatgggtttatagtgatcgcttgcgtttgtagccgtcttacctttttggtctgaagtctaaaccgcagagcaccggctccaacgaggcgcgcacataaggaaaggaaaacctgcaacaactccatggtctcctcccgtttcgatcaaacaaaagaccagaaaataaaagagaaaaaggtaatagtaagcctccgttcccaaactcccccaaaggcctccaagctcgagctcgaccccgaaccggaaacattcctcgtcggcgaggagcggcgagatcccccgggccccggcca

SEQ ID NO: 3386 - DNA, 1501 bp, Oryza sativa
gaagaagatggaaatcggaaaattcaactgaatattgaatgtagccttcctgttggtactacccacaactcattccattttcaggacttacttttgaagaactattgtcacagtagggggcgaggccgctccaagttcaaaaaacgccagtgaaccaacccactaatatttctcatatgctttctgctctgaaactattgattcccgtgcatagtttataaccaactggtcatcaaagtacaagtgacttggctgcttgcttccagcagaagctacctgtaaaggaaatggttcatctggttatactgccctggggcaaacggagcatttcagagatgctcaattttgtacaccataccaggaaacattttgtgtaagctgcatttttttttcttttgttgtaaatcggtgactccgtgttaatgagctcttgcttctttgtagaacagaaaattttcctgactccgtgttttatacatcatattcttttacttacctgtagctttcacatgctaggtaaaagaatgtgtaattatttcgaggaaaagtttcttttctcccttgctccccgttctctacaaagtttactgtaatcggtagaagtcaatgaccattgtattagatataaagtaaccatgtgacggtgtggatggtatcccataatgaatgcaccatgtcttttgctccgtccgtcataaaaaaaagataagtatttatgaatctggatgtctagaacttcatgtttatatattttttatattcaaggatggatgggtgtgctgtatatacttgttgtaattaagaaggggccattttgagtttacttaccgtgcaaattgaattttgttactgtttggtacttctatttcctgtccactttctttgtcttgaataaaattatttttaactataatttttttaaaaaataaatttatttttgagtaatcattggatgaaagtaaaaaagaaatgcattggaagtagataaagagagataattatattaaggtttgattaagttaaggtatttagtttttttattggtacgtgtgagatgaatgaaaaattgagtgttttaagatggacgaagtatttgtgagaagtgcacatgaactttctctgcaagcgcttctattcaatgaacataaataattgtattcatttgctcgttcttaccttcacataaccttacctgtttctttaacaaagctacagagctagtactaatgtttagtggatgtcgatgaaatttgttcagtccatacgtacttgatctgtattcagtgaagtgcctaatagtattataaacaaaataaaatgtattttattcaaaaaataaaaaagaaacaacaataagaaaaaataaagcgaggaagaccatagcatcgtcgtccgcaccaaaccaagcaaactccatctcatcgtcgctccggtccccaccctactccaccaactcccgccgccgccgccgccggcggtcgtgcgctccgggccgcagcca

SEQ ID NO: 3387 - DNA, 1501 bp, Oryza sativa
gccgcattcttttctgattgattgagatatatattttacatcgatttttgttagcatgtttttttaaatcccttactgctatatttcatacgaaaacattctatatatatatagaagtatttttaaaaatatcagatactaatgaaaacttaattaatcatataatggttttcttgtttcttatgagctgactttatttttaatcttcagtgaaacaccctcatagtggcgtcgtctgttcatttccgcctcccgactcccgagtggcaacggcggcttgaagtactgtcagtctgtgctgccacgtactcctgactcgcgcttgtacgttcgcggcggccgtgtgcgcgaccgtgcgtggcggcctacacgcaatccacggcgccctcgttttggttccgccgtccgctgacttccgaggcgatacagccatacaggctttgcattggcgcgtgatctcaacccatcgatcacgccatgagatcatgttcaccggcttgaaaacgggtacgccgtacggcgtacgcgtatgcgtacggccgagctcgattgttccataggagtagatttttgcagagtagtacaacctttggacctttaattcagtcgagatctcgagagaagaaaacgaagaatactagtagtaatatctagcgtccgcattgtacctggatttgcagttcgaatatccaagtcgagcagtatactctatactccaaaggaaaaaaaaaaggcataagacgtgcacgcgtagtagcacggctgcagcaaaagcaagcaacaaacaacggcaacacgagatcgtttctttccttcaaagtgtcttggcgcgccacacgggccaaacaccgggagcgagcaaggaaaggagggggaccccacgcatcagacagacgaggggctcgcgtgatgaagcgtccgagagaagggtcccactcccactccgacacaaggccctgtccttctgacagcgggccattgggaccctactgtcagtcgcacacggcgtacctgcgggctcgccgctcgatcgcgtgatcgtacgtggacttttaaaccgcttcgcgtgctccgggcgctccgagccacgtgcccaccggcacctcggccgcgcgggatcctctacgcccaaatccaataaaaatccacttcgctccacccagcacacgcgggctacacggttccaacgcagatatccacggatctcgtgctcccgctcggttcccttccctgtacctgtccaggcaacccgtacccccgccctgcgcccaccgacaggtggacccacgatcttccgggcccacatgtcggtgacgtacaggctactgtttcggtgacgcggacggggacggagggggtgcgttgcgcagctactagtagcggccgtgctctccaaacagcggcagtggtggcgctcgcatttttttttcagctccgcggaaggaacgaaacccaacccaagcgaggcaaaagcggcggcggcggaggaggagaggagcaa

SEQ ID NO: 3388 - DNA, 1501 bp, Oryza sativa
tgtaaaacatgcaagacctatatgccttaagaggataaactatggtctgcctcgggcccggccaagtcctgggcctcaggctcaccttaatccttacaagtcacgcattactcaaggaagaggggtgacggggcttgccaagcataaaggcgtaaaccaaggtgtgcttcgggccccgagctcaacttggaccttgtatagcttgcgttcctctgcttagagggttgtccaaaggtacaagacgcacaatcttaagatattcttccatcaacaacgccttcgagaagctcctcacggaataattaaccttctttaagtgcgacagggcgcgatctcagaaacttccaggaagttggccgtgctccacagccaactataaggtagcacgccccgccataaatgaaacaggtttatggggggattcccgaccagtctgagttgaaaggacgtagacaagacgccagagctaagtcactttggacggtggcgcctgggacacgcgtcgcacatgccccatgccacttcatttagccaaatagacagataagtactgtggccttgtttcgggcaagtcgggcctcgtcgagcccaccacgcaccacgtggtgagcacactggcgaaagctcaactatttcagacgaagcccgggagcccggggtaatatgaactgtaagacttgaacggtttcttggggctgcgttatgacaccggctggcaatgacaagacggttgatgagacaagactaagagtagatttgtaataatgtgagcccctctttggactataaaaggaaggggactagatacagatgaagggttggattcttctaggccaaatctattgctttgtagccgaagaaggcctccttcgtacttagttgatctagagaaaaagaacgaacaccaacacagaagtaaggtattacatcttcgaatggcctgaacctatataacctcctgcctcctcctcgcggggtggtcagaccccatgaatccaccgcgatcgcagataccatgaaccgtacgccgactaaccccctggccaaatcttcactcagggagagaggtctccactccccgctgtctgagggaccacaccctccgacacattcttttgaaggtgttcatgtagatatttagtgtgcgtgcgttcatatgagatgaatgcgtatgcatgttgtgggcaattattatttgtcctgtgcttaaaaaaaatcatatggcagattgtgttgctagttccgttgaaaacgagagacaaaatcatgctaccaatttgatttgtgatcttccgatctgcttcgcgaatggcaaactactagtactccacttcagtacaaccaatcgacggttcggccataaatgccactgacttcagctgtccaccatccagcctcccaaggttctggatcacatcgtgccaccgtgccggctcggctcacgcgtggatggggaagacggcgaccgaaggggacaaggaggcggggcggggcggcggcg

SEQ ID NO: 3389 - DNA, 1501 bp, Oryza sativa
acagcgcggacgcgataatttttctgctctctaggagaaggttgagggtaatgacgagccctgcacttatctttcaattattgttcttgtagtatttgtttatgatgttactgggcctgttcagcaggccggctacaacggctgcagctgcagctacacatattgagtgtggcactgttcacattagctatgggctgcggcgcagcagcagccccggctaccaaacaggcccactagtgatctttttcatgcaattatcactcttgctgttgtttcgaaaagaactatattcattcggttagggctaacgccgggggctactgtcaataatatggtccaggggtatcatgtttggagggaagaggccaccccgaaacccacatggcacttccccgagggggatcgggcccgatgtggagtgacggctgccccctcttcgcctgagggtattaaaacttgagggaggaggctgctcctagcacccacgtggcactcccccgaagagggtcgggcccggggtagggcggcggctgccccctccatgattgggggttggactgccccaacccccaccgcatgatgccacgtatgcggagttaggtgggcgcccccaacggccacctaaccgcatttaaagcggccagagtgcgtgctgtgcacgtgaccggttgaatgattgatggaaccggagtagtgcgcctgtgcactactcacatgtcaggcggcgtgcgatctaacctgccccgtcacatcgtgaagcctctcatcccgaccggagtcggttcatccactctagtaagcaaggctcccgttttccggtgcaaacgggaacccagaagtcttcacccattaaatgccgaatgacacgagcgtccctcgtgttaggcggttcaatttgatgggcccatgttgcgacacttgtgcgcatggcttccaagacaaggcacaacacacacatttaatgtagagaacatttttcctctttggtaggtagcactctcaacacccgtggtaaccctttgaagtataaagggaggtccatgtatagcgagggagggggatcgaaaggtgaaaaggcttagccctagcttgtataccagagattcagagactttgtaagctcagaaaaatcatcatacacatgagtagagtattatactccttagcgacccgaacctggataactccctagcgtctcatcttcaccgagggcccgaccctctcgttttctcccaatccttccagttcctcaactttcacccgctgtccccgaccaaactaacaaaagaggggcctcacggttccctgctcgaggagttcaccctccgacacatacgtacatatatcaatatggcgtaaaattcttttattttagatagaaagtaactttatatatatatagtttatatgtgtgtataaaaaatatttgcatataaattatatatatacctatatacaattttatatatgtgtaaatttatacgcatatgcatacttttga

SEQ ID NO: 3390 - DNA, 1501 bp, Oryza sativa
cgacgaagccggcggcgatgcactgcgtgctcgacaccagcgtctgctcgtacgccagcagcgtcacggcggcgccgacgcacccgatcaggaacccgctcagattccggtccatgccggccagccgctcgcccgcctcctcgccgctcgtcgatccctgctccgccctcggctacggatgccgtgtgctgctgcgagtccacgggacagaggctgggggcggggattaaagctgcgaggtcaacggctttggtggcgatgagagggcatggaattggaagctaaagcttatggagggtttggaaggtcgccgatgtcgttttcgcggctgggaagcgtcatttgcggttgcggatggagctcacgagtttctcaatctcaacgcccgtttgtttggtgttatagtttgcgaatcagagcggaattttaatcgggaaaagtgcgttgttttttttttttgaacttaaaagtgcgttgtttaaccacgtgatgatttcgtttgatctcggtacgtaaggtcaagaatgaatgcgcctaattttatttatttttcgttgggccagaacaggattgcggctcgagtgcgggcccatataagatgggccgtgacgaaattccggccgacgcgcgaccccatacatcttggacctgaacaggatccgggcctccttgtggcccatgatgttcaggtccatatgagctgggctggagcgttttaaatcgatcgtggagacgggcactcgaagcaagtaggttaacatgagatggcaagcactgtccagactccagaaagtatgtccctgcatttgaggaaactgctgtatgccttcatcaaatacagcacatgcacatcgcatcggtgtgatctttgaactgcttcaacaataattctcatgaaaccaactcgctacgcagccttaaattaccgaagaaattaaagaattttgcatcattgtgcaggggagagccaggagccttaccaagtccagattttcagggggtgccaaaagtagacaaaagactaggagtatcgagtatcgacattacactgtgggtttggagctaaagagggcttagttcaagcagaaatatttgcgacttggtacgttgcgtcccatagcctcactcgagcaagtaagagcaggtgcagagtcaaccaatggcaaggcgtgctttagttggtgtcaacaatgaattgtcaaagccacctaaatcaacacccttgccccgtgctgcatgattgaccaaacagaccatgttggttttgttaccggaaataaatcttcttttgccaagtataagaaggtcttgccacatgcaggttctctcaagcaataagcaattaatcaggcattctcacacctctgagttgcaacgatcgcttagatttagcaaccaaaattgcagtagttaattgttgttgccacactcaagctagctaggtgtactagcagctgcttgctgttcgtggtgcgtacgtgtcatgacgaaggacggatca

SEQ ID NO: 3391 - DNA, 1501 bp, Oryza sativa
tgcgtttcttaaaaaaacatgtttattcacactcatcactacaggggactttagtgctctttttgaacataggagttccacaggatattctccatgatcaattaataaaattcccttagaaaatacggcgatttttttttctaagaagtccttaacagtttttttgggacaggaattaaaagattaatggacgtgatgttgaatcatccatatattaaattacaaaggagaactctcaactatgtgacaaatgaaaatggtgatagaaattcccaactgatcgagcactgtttttgtaagagtggatggtagggatgaaatcgttggagaattctctatattttccaattcaactattttagtaataccatcaatatgatactaataggaattagacaatttaaatttatgtctagaatcagaaacgtcacaacttctacgagaacaataatggatcggttgggaatatccatcaccgttcccatccctaactttcggtggagctcatcggagcatgtacaatggtatagattcttagatagatagtacatgggtgccgcgctgaggggtgctaatgcatgggtggtcacacgggggcaagcctgcgcggtgagttcgccccctctagtctctcatctctcctctttatatgtatatatgtatgtatatacttttatatacatacgtataaactttgtatcactttgtcttgacgcacaccgatatcaagggccccactagcgcacggggagccagccccccccccccctccgattcctcctcattgctcatggcaaccgtgcccctgaccctgttaatgaaaacaagtagtaccgttcgctccaccacgaggacctgcttgaggcttgagagaggagggaaaggaggattgtcacaaggctgtgaaacgggtggctaggaaatttaaagcaaaaccaatatttcgttatccattaggtgtgcaattggtagagcattctcgagattgtattgtatgcaagggtttttttcatgaacacgtagaaactttacacatcaatatattagaagaagtgtagtatacaactgtgacacgccgggcagtcactggaggatcagtgggagggcatatctcgttacataagaagcagtctggaccaagcaagtgttaggtggttcaggacaacacaaattaaattatacaatctacagttaggataacatgatttacttatcaataaccatgttttttttaaagttaaacgtaacataggagttctctcacagtgaccaactagctttagctactgtatctttcatagtgaccaactagctagcatagctgcgcataggtaggtataggtgatgcacccaacaacgtatgctgtatgcagcaaaagcgagacgctgaagtgcagaaatgcttccaagttccagcctgttttggggcttggctattgcctatatatactgctccaagatgaccctgcattaatccatgctgagcctcttatactaatat

SEQ ID NO: 3392 - DNA, 1501 bp, Oryza sativa
tgtcgcccatttaaacccaagctcctccccctccaatctccctcgttttcgtctctcgccgccactgtcgcccctgttcgccatcgccgttcgtcgttgcgcgtgtcggaggagccggcacgagcaaggacgtggaaggggacttcggccgcaccctcttcctcctcttcctcggcccgaggccgaaatgatcacgtttcgcgctgtcggctctcgtcactgctgtcacatcctgatttttgtttcaggatttataaattatttaataaattaataatagaatttatattaaatgttctttaatttacaagtgaagttaaatgtgggaaataaaatttcttaaatataaagcatggatggatttaatttttattaaattctccatgattaagtcaactctctgaaattttctcggatttttcagagctcaattcctaaatgatacaaagaacagttcagtaattatttgatcattaataatctaattataattgttaagagcttttcttgtttaaaaatccttaaattataaattgttgtttaattggaattattagaatttattttaaaagcctagaagagaagatctaattttaattaataaatctcaatataaaatggggccagataaaatttcattaaatactttgcttaattctataattcctagatttttctgggatttatttgagctaaggaagtatttttaataaatagaattgcatttcatgaataatttaaattgaaaaaggtttttaaaagtctctttttggctttgggccgaaagccggcccaaaacctctctctctccccggcccaagtcggcccagtccgcagccgccgcgcgcgcgcgtttggtcgctgacaggcgggacccacctgtcagtcttcgtctacctctggccgccgccgcccgaaacactagcgccgccgccgctttccaattcggtcgctcctttccttttccggccgaatcgattgaggggaaacgatcttcgcgatctcctcttccttttctcttttggaagcgtcgtctaaatcgctttggaagttcgtggattcgaggtcgaatcggatcggtctctttcctccgaacccgaggtttccttcgcgtcgccggtcgccgtgggccttcgccgccgcctccttgcccctataaaaggacccccggtgtctcctctacccgccgccaccctcgccttcgcctctcgtcgccggtagagccctagcgccgagccgcctcacgccgccgttgtcgccgccgctccagccgtgcgccgccgtcgctccagtcgtcgccgtcgcttggggaggtcaccgtcgtggtcgccgtcgcgtcgccgtcctcgtccgccccttcgccgtcgttgaagaccgccggagcaccgtcgccgctgtcgacccgatcttctccgccgcttcgacctcgtcgccgacgtcgtccgttgctcctccgccgttgctttggtcaccggtgagttcgccgcgatgcccgcaccgt

SEQ ID NO: 3393 - DNA, 1501 bp, Oryza sativa
agataaatatattaagagcggataaagtaaaaataattataaagatcaccaccaccattagatctatgcgggaatgacgtttggctagatcggagctcctaaaacatataagcgagacaaacgcactactaaaaaccattttcacagacaccatatttatttctgcaggcaggctaaaacgttcccaattatgatcgttcgtacaaatatataaagttgtacctgatcaaaacctgcctgcgaaaattgatttccgtataaagtagttttatactggttacctggaaaaataaaaacatttttgcaagcgaacctcttaaaaggactgtctacaacaattgaaatttttgcagacggcatattaggagcaccgctaccaaagataaaaaaatcagccaactatattctttttcccaaaattatcctctcactctcgtaccactcctttcttatcctctcctctctctccctcttcatcttccacacttatcctctcctctccctctccttctccggttctccctctcctatctctctctcaccggtcggcatggagcagcggtaactccacgaaaaggcccggcggcggtgactgcaaagcgagcatggctcgcggcaactcaacaaagcggcccaccagcgacggctgcaaagcgggaaggaggggcgtagcggcggctcagtgaaggggtttggcgcatctcctcctctgctcccgcccgcctctaccaactaagcccatagtcgacgagcctcgagaggccgcatcagaagccaacagccttgggtggtgacgacgacctcgatgatgtgacgatttctaggaacaagctcgggggaggtggatccatcgccggtgagcttgggggaggccgacgatccgttgccaacaagctcaggggaggtggatcatcgtctgcgggctcaggggaggccgattattcatcagcttgtttgtaacctattgtttgttctagtggatctaattatagctgtgttcgatgttgttcttgtttatacttgtcttttcttgtttgtctatggatctgattctaatttgaatatgatgcttgcatgcaatgaaaattgaacatttccccctttttttttttgccccaaaataccttttacacgcggggtgatattagagcgccacctgtgaaaagtggattttcccaggtggggctcttaggatgcctatttgagaaaatcgatttttgtaattggttggaggctccgcctgcaaaaatcaatgattttagcaagccttagcatacaggcggagcgttagccgcctacgaaaacttgttttagtcacatgtaaatggttttctagtactgacgtagaactaagttcagggcaaggcaagattgccccgcctctaatgctgctttcatcttcgctccacgtcttgctcgtgtctattttttttatcacttagtgtttgattcaactctaccttctctagacaacgatttgagatttagagccctgtcaaac

SEQ ID NO: 3394 - DNA, 1501 bp, Oryza sativa
caataccacataaagaaccaaatgatgcattcatctttctctcctcatcccctctcatctgatctttggagtggattcatcctcttccggagcttgagatagatgccattgtcgtgtctgccattgccaaggacgaggtggtcacaccgaggcttcggctggagctcgatctagatggcgtcatcgctgctattgtcgtagtcttgatgattaatcaattcaatcttggctgtcatgagaggagaggttagatttcgtggtatagatggaaaatttggttattagatttcgtggtatagatggaaaatttggttatctttgtggtattatttggcattcaaaaaattttgtggtattctttgattggagaaaatgtttgttatgggcggattttcttaaggaaaaagtacaccaaaggtccctcaacttgtcatcgagttacaaaatcgtcccccaaccacaaaaccagatatgaaacatccctcatcttgaggaataagaagcaacccataacaaacatttgctccgagaggagagaagtgagagagggagatagaggaggaagggagaggatgggatgacgtggcatcctaacatgtggggcccatgtgggtcacatgctgactcggccactacgtgggataaaatcgggctcaagaccactgagggacctaaagtaaacggttttgtaagttgagatggatgtttcatatctggttttgtggttgggggatgattttgtaactcgatgacaagttgagggaccttcggtgtactttttccttttctcaaaggttagctatcaaccccgccgactccgctggaggcccaactcggcccacggccaattactgggccgccgcctgtcgcgcgacgcctctcccttcttccccttgccccatgtcgccggccgcctcctaacccgacctactaccctccatggccgccgccgccgccatcgccgccgcactcctccgccgctccacatcctctcaacaccaccggcgcatcctcctcctcccactcctctcccacctccagcgggccgcgccccgatccccttccccctgggacccaccgccccaccaccgcttcttcttctcctccgacgtgaccgccgagggggacagtaagccgcggccgcctcttgacgggaagcagctatggcgcgaggtgtcgacctcggagcccgccaccggcgcgtcgcgcctcccgaaggccacgtgggacgccgtggtggcgctcctccgccgcttcggcaaggacccggctatgtccgaccaagccctcgcgctctacatccccgcctcggcgttccccacctacgcccgccgcttccgccacttcctccccgcgcgcctctccctggagtccgccgagcacctcctctccctcccggccgacgacgcgcacgccctcctcctcccggccttcgctgagttctgcgtgacccacctcgcggacgagctgaggaagcacgagtctgtcatggccgcggcgg

SEQ ID NO: 3395 - DNA, 1501 bp, Oryza sativa
gaagtttggaattgatcttatcctcaaaatgacactgaagccatccagaggtgtaagctagtatgctttagtggcgccacgggatactttaacttcagttttgtagattatttgcacgagaaggatatatcgacatgaattcatcagaattaagttattagtgttttcctgatatgaacaagggagtaagggactgtggtaataagttagctgggggatatacggtttttttattgggtattcacttagccttggatgtaagggactagaaagtaaacttgttttgtttcagttctgtttgaatcaatggcagcggtataaccttctgcaacgttctcacctgagttttccagtgctcataaaaaaattcttgtgctcagtcagcacacaggtgtaactactgtttctaatcagggatgaacgcgtccatgagcactcatcggcacagtgtaacacgagactagaaaataatatcgcactttgcccgttccataaaaaaacgaacttaatttttcatttggtgcaataaaagggcatctgtttcatgtgttttcaattcctataagattaaagatacatgctactctctcggtccctaaatatttgatgctgttgtcttttttaaacatgtttgaccgttcgtcttattaaaaaaaatttaagatttttttcctatcatttgattcattgttaaatatactactaccactactactcaagtagcttaggataggttagctgttggtgtggtgttgtagttatggttttcgctcagtttcctaattaaccgtgcgctgtaaggtttgatcctgttttctccttaaaatggaatatcttcttcttaatataaaaagtcagcaatggcctgatcgtttgaaaaaaaaagatagaaggtgttgagaggattaaattttaatatatatattttttcatcgatttttgtatatatttacatgcctttgaaatatatttacataaatatacactctccgcgggatagaaacgagccaccgcaccgtcgacgtcacgcggcacaaaaggcgcaggatcgatgggaggggcggtggtgcggcacccacacgcgtgaccgcatgtgtgtaacatggatggattaggtattaataatacaatatatttacaacaaactattatataaatagattattagattgattatcgatgatattttaattaaacttcctcttcagagaaagaaactactatttgtttcaaagggacctagcccataagaaaatgaggcccaacccaacccaactcaaaccggcgaatctctgcgcgcggcccgatataaaagggctcgcaacatacagcacccaccatcccctaacccctgaccacccccccgcctccgcacccgcctccggttgcctcctcccctctcggcgggcggcggcagcagcggcggcagagtcagcagacctcgccgggaagctaaagccctaaagctcgcggaagggtttatcgcaacgggcgatggcgg

SEQ ID NO: 3396 - DNA, 1501 bp, Oryza sativa
tggtggtggtgggttggtgcagggcggcgcaccggggaggaggaggccggggcgccggtggaaggaggctggggccgggcggcgtggcgcgcggcgggtcgatggctgagtgcggcggcgcagctaggcatggcgcgcggtggtggggcggtggtctggcgtgatggcggcggggcggtggccttggggcgacggcggcggggagctgcggttgggcagcgtgcggtggaggcggcgtagagggcggcgtcagcacaaccgtgcccagccgggcgccggccggcgcggccgcggccgcggcctgaagacggctcgtcggcgtcggggatgggagcagaggtaggagggtgtggcgccggctgtcgcggcgagcggaggacggcggctggccggcggtcgcggcgagcggaggccggcggcgaggagctgcgcggtggggcggcgcgcggcggaggcggcgcagagggcggcgtcggcgcggcagcagcctgaaggcggctcgtcgggcattgggatgggggcggaggtaggagggagtggcgccggctgtcgctgcgagcggagtaggcggggcgcggcgagcggaggtcggcggctgcaacgccgcctcgcataggagaggatgcgcgcatggatggcagccgcgtcgttgtcgtcgccgttgtccaccatcgctgatacagatagagagaacgtgggtcctacaatcccaccgttggagagcctgttttggctggccagggaggttatttggccagccatatagcttggaaagtgggatagtgggatagctagtctgttggagctcgtttttttttcaaaattatcaaattttagtttaaagagtgagatagctataccgttagagatgctctaatcgcggggctttggctagaggctgacaggccatgtgtcaagagtggggtcacatattcacatacgctccggtcttgatggcgcgaccagattcctgcggcttgacgcctatggcttcagtactctacggtgcaccattttacgttttcttgtacgtatggtctatcatgtttgttttatccatttggaactaatggcactattatttttgtttgcttttttacttgatctcaggtccttattgcttagtgactggccttgtctttgtacggatcatgaaacatatgcatccttagatagttttggctatgatcaagattcaggatcactggtggagaaaccatctttactcccggttgggaaccccctttaatctcggttttccaaccgaaagtaaggatccgggactaaagatggacatctttaatcccggttgaaataactaggactaaagatatatctttattcccggttggtaccaccaaccggaactaaagagagtggatctttagtctcggttgatgttaccaaccgggactaaagagacaatagcgtcagtacagatggtccctttttctttttcttttttcctttttattttctcccgaatcaagtaggcaaatcc

SEQ ID NO: 3397 - DNA, 1501 bp, Oryza sativa
ttcaattattaactattcaaactgcacatttgctattcatctatgcactaaaatttccccaaatttcagacaatcgttgattttttgtggattaagatgcaatggcatgcctatcgtcttccaccttttagaccgggggaggtgggagaagaggaatgggaggtaaaagatggatttaccagcaacagtgatggcgagcctcgatggtggtgacctttgaactccagcagagaaccgacgtactaggttttcaaagttcgaggcaatgcgggggtgggggtgggggggggtaagggcggttttagagggatggccggggtggaggggaacctgattgtggacggaacacaaaggcgggcgacgaggtgtcaccaaaactgcatggacagtatgttgacgggcgttagatctattgaggcgagcgttgaaagcccatagatgtcacttggcgggagtggtcgaataggtgtttcttaaaattctccgatcgcaacggttaaatttaatagggcgaaacttcctagcagctttctcaaccaagccaagacagccactcggaacttccaggtcgttgtgagtcgctctcacaagcacctcatagcaggaaaaaatgaaaataacatgaagcctaacacaacgatcaacacaacatgtgtacaaagtggaaacatatcacaaaaacataaggtaaatcaatacacatgtggacatgccatagggaacaagagaatgagagacaatgagaaaggggaagaggaatgtggtggcggcggcacgagaaagaagagagaaaggtagatttggagagatttggcacgaatcttaaagccatcctatccgtccaaaaatcaattgacattttccaaaatttcagctgcttgtagcaagtccttcaaaccgtttattaagaacacgtccaaaggatggttctgagttctgacttgtgggagatagttttgcatgatgcggcggcggcaggcatcctacggcgcacgtgggtgacaactgacaagttcaaaatcttatcattggcccgtttcagtttctttttttcctttctttttgaagagctgtgcacagtttcaagagtggccacgcacgtactagcacacttgccaacttccccaatgacaaattgtcatcccactcgctcgcgggcggaccaccggattccggccgatcgagcatgcacaacctgcgaccaatgcaagcggaccgtgtacctggctccgtttcgctgcgacttgaggacacaaacggatgaaaggatcagatcaatcaaaaagatcacacgctagcacgcgcgcagcgcaggtgtctgtccgtaaccaggctggtccggtcccgcctcgaacaaactcgtccgagatcgcggccggtatccgcctatatctacatctatatcaggagaccatcgagaatgagttgcatgcatccctctcctctcgtcctgtgagttgcccaagacgaatcgctttgctcacaatggctggagctcggt

SEQ ID NO: 3398 - DNA, 1501 bp, Oryza sativa
tgtttattcattatattaatatatgataaattggtaaatcaattcaaagatgcaaatgtgatattaatgagagaactcgttaacgagtcaagttgtgagtcgagccaagctgagttatgcttttagatcgttaaggttaccaaaccgagttaagataacaaacccaaacgcactaagctagctcaatatcctcccttcccacgactccaccatcgcatactgctccaccattctcttccggacgacttcaatgttcacgacttaaccatcacacgccctgctactgtcattctcttccggacagtttttaatcttcaattctataaaaatagtgaaataggacctacttggtaaaatttctatcttataaactgaactttaaaaacagatcgatatagtttgcgtctaaattgttcactttatgttttaattagcacaaaattgcaacggtttttattcattgtggcaattcacacgctgagtggtatagtgaagttaaaattttaactgtcattcacagttaaaatttaagttttaaaacttaattttagttccaggttgatttggggtttcttattcatagtctatctttcaaccttaacttttaaatcacaaactttgctggtttcttcatttatatttttttatagcctgtcactcgtggctgaaccaatcagagctatgattgtattaggtaccacggcaatacttgtgacaattgtatgttttcttggcaccttcctcacaacaatgatacaagaggaaatgtgacggttttgtcccttacttattgctagctaaagtttggctctgattttcctagccaaaccttatactaggacttcatgttagcttaaagagattattgtgggctcctccatctaaacgggctcttatctccttcctagcaatacaaagcccatctagatgacccacacaatccaaactgagacgagccggacataggtttgtccagggaaataagttcacttaggctcccttaactagtggtcgaatctaattcatatccctgaaccacgataccggatatctcgacccccaactattaaaaccagtgcaatttgactccctcagcggttttgaagggcagtttcgttgacgtggcgcctacgtggcggcattgaacagcggcgggtcgctgctgaccaaagaggggatcatcgacaccgccatggtcaccctcttcgccggccacgacacctcctccatctccggaggggtgagggccggagagatggtgtcgccgctccggctctcgcccgctcgctgccgaaggggagaggaagagaaacagagagggagggagaaggaaggatgagagaggggggatgacatgtcggccccacatgtcagtgagcctaaattttttgttgtgtgaatgacgaacgagtccacatatatgtttttcactagttaagcggctgaatctaattcgtatatctaaccacaataccagatttctcaaccatccaactattaa

SEQ ID NO: 3399 - DNA, 1501 bp, Oryza sativa
aatgccataaaaaatcgtttttctagtagggtattcctcatagaggagccttcgcttctctcgtatatagcccattctatccattgtatcatataggatacaaatccctataaaacactatatgttcctgttgtccaaaggaggattaacgcgagttcgagcactacaatgctatattttcctgttgtccaaaggaggattaatgtaagttcgagcactacaatatggaggcttaacgcaagttcgagcactacaaagataattttctcatgccataagaggagttttagtcttcgaatactccttgtattcctggagagaggagccttcgcttctctcgtatatatcccattttatccattgtatcatataggatacaaatccctacaaaacactatatattcttgttgtccaaaggaggattaacgcaagttcgagcactacaatgctatatgttcctgttgtccaaaggaggcctaacgcaagttcgagcactacaatatgacatgtgtttagaccatattgatgtaacatgaataagttaagctatggatattctaataactacaaattatttttaaaaaaaacacatggggatgtctctaatttattgtgttattgcacacctgacactgttagtggatccatccactggtggagaaaccatctttggtcagtctggcaaaatccacaatagtcccagatgcaaaaaaaaaaacggaactaaagattgtttttagtcccggttataaaaattttgatctttagtgatctttagtcccggttcatcccttgttagatgtatgtcagggggccgaggatctttagtcccggttgttagtaccacccgggactaaaattaaacacatagtatataatccctaacacttatcctctcctccacagttacaacttagacatatcgaatctcaccccctcttcttagatctatcctctctaactctcttctccaactcttccccttcctcctctcctcccccttctctccccttcctcctccccttcctggccagcctccccttcctatccggcgggccggccggcggtggggccacgcgcggcggcagccagcggcgggcggcggggcggcgcccggcggggtcgcgcgtggcagagggcggcggggcgacggccggcgaggccgcgcccggcggcgggcggcggcagtcggcggggccgcgccggcagccggcggccggcggggccgtgcccgtcgttcgtggcgaccggcagcgatagcgcattctttttttttaatttgtgatgattcaaattcactgagatgtatttgattgagatgttacaaatttgtgattcattgtttagatctgtgatgtatttgagtaatttcttaggatattgtgatgtatctgatttgtgtgtataagtaactttatttgtgatgtggattcagtgatgtgaatttgggatgttagttagatttggggattaattttgggatttgcctacttgattcggg

SEQ ID NO: 3400 - DNA, 1501 bp, Oryza sativa; identical to SEQ ID NO: 3388

SEQ ID NO: 3401 - DNA, 1501 bp, Oryza sativa
ttagttatgtttttttattggcaatgtagatattgtccaagaaattaatggtcatagtcaaacagtctcatagtcatcgatagagtgtcagacaatgtgtacggagtctatattattagtgagccgggctaagagtcaaccctttcccttgatccaaaacattgggcgtgagtgatcttgtctcacgacgtcatcgatcgctgcaaattttgagttcgtatacaaagacttggcgtgcgcgatccggtcatttctcgaatcactagcttctctaggactaacctagtgtgtcggtgtaacaaaatagggggtgtgtttagttcacatcaaaattgaaagtttggttaaaattagaatgatgtgatagaaaagttgaaagttaatgtgtgtaggaaagttttaatgtgatggaaaagttagaaaattaaagaaaaagttgcctaagtaattttatcatctttaagaaaataccgaaagatatcatattttctaacataaaaacttggtacttcagagtatctcaagatatcaatttttttatgtagaatttaggtatttaggttgtgtttagtttcttggccaaatatttttttaagtatacggacacacatttaaagtattaaacgtagtctaataacaaaacaaattacagattccgcatataaaatacgagacaaatttattaagcctaattaatctgttattagcaaatgtttactgtagcatcacattgtcaaatcatggcgtaattaggttcaaaatattcgtctcgtaatttatatgcaaactgtgcaattgatttattttcatccacatttaatactacatgtgtgtgtcaaaacattcgatgtgatgtttttggtaaaaaagattgaatataaacacggccttgaggattgtaaaatttccctgataaaatacccataatatttgcattagtttgcgtgcttttgagtttacttcggcatacaaaatattcaaaacaatttggcaaaacggaatggttaaatccacatgtgttacactgacaaatttacttaaagtcaaagtaaatttcagaatagtaaattcggaggagtacacttgattacaagtacattaactaaattgttttattccttgacctgacatgactcatgcacgctagtactcctcccgagttggatcgtaattaaccacgcaactaaattaaccgaagtcgtaattaatgcatgcgattatcgttgatgatcgagattaattagcctaacccctgattaattaaggggttaattaattagctttgcgggtctcgagtccgaatccgaatgggaagagcgggtcgtagtgctcgtcgccgacgttcatcggcagctgctccaccgaccggaaccacgtcctcgccagcttcccggtgaactcgtagtcgccgaacagcacgtcgctgacgccctgcccctccgtccccggcagccacgccgccaccagcgcgtcgatggcgtccatgtacggctcgatcacc

SEQ ID NO: 3402 - DNA, 1501 bp, Oryza sativa
tagataaaaggagatgagatgttactgcaatcatcataatgtggatcaaaactaaccgcagtctacatattagtgtcataggactcgagttctaaattccagtagtgacagtgaaagcagcagaatttcaatttcctgccgcacagacggtggctgcaacgcaggatccgatcgatgctagaaatcaccaaagctgaagcggcgagagtgcgaggccacccgccggcaaggatggcggtgacttgactcactcaccggagcggaggatggtgtcgaggacgcgcatggcctgctcctccccgagcgggcgcgtctgctcgggccccgtgcacacccgcgcctgcgcctccagcaccgtcgcgttcggccgcggcatccccggcggccggtacgagtccgacaccgccgggttccgcctcaccccctcctccagcaccgccacccccgcctcctccatccacgacgcctccgcccccgcccccgccgccaccaccgccaccccgcgccgccatctcccgcgcccgccgaaactcaccgccgagccaaccacccgccccctccccggcgagccccgaccaccgctcgcccccgcgctcgggagcggcctgagcagcatcgagttcatggcggagcccaaggtcaatgcagccgccgagccggaggaacacgacgactatattttttttacattttagtcctttccgaaaaacttatttataaataagggctctatggcttattcggtatgattgcaaataaaataatttataaataatatatatatatatatatatagtaaatttgttttgtgctccatggtgtccgggcaccattgttgaaattgagtatatacccaatttaaatgagtatgaatctttttcagttacttaggtattaacattaaccactttactaactagttcaaagcaagtttgaactgaatttgaacttgtttttgttagattttgattctaggtatatagcatctatacatataattagttaggtatgtaatcatggattgtgaaataaagttaaatttgagttgttttgttgataggtataggtatgaatcgaattattataactagatatatactcacaatttgaaaattttgagtgattttgtgcattagataccatggtgcccgggcaccatggtgccccatatgagtgtcatatatatatatatatatatatatatatatatatatataaacaaaggttgaaaaataaacctcgaaaaaaaacactctaaatttaatattaaaataaaaattttggtcagtaaatataagcataaatgaaaatgcgagagaataagttttaaaaagaacaaaaaagtaaaaaaaatacaagatcgaaccggatgggcccattggtcaggattgcttggagattcgtgcggggacgcgcggggtgatcgggggatcggacggcggggagagggggaggagccctcacaaagcgcggcgccgcctccatttcttcgtctcctctc

SEQ ID NO: 3403 - DNA, 1501 bp, Oryza sativa
ccccttctaatctgaaggatatcgcatcatcccattcgctccaatcaacagtaacacgaaatgcaccggactcacttgcgcactaaaaaaacgccacccacccccagccaccgcatccaacccccaccattgcaaatttgcaatcgatcccaacaaaaaaaacccctcaacgcaaccaaccacagatcccacgcaaaaccgaaccaatcgtcggcgccgccgccggatcagatctacctcaaaactagggtttccgcggcggggcgcgcgtgcgcgcgcggggggacggggacggggacggggaagggagatgcgaacctgccgggagcgggagacgaggcgagcggccaacgccatggctgcggctgcctccgcttcgctgctccgatctcacccaaacctccaagctccgcggcgagagcgagagcgagagagagagagagatggggatgggtggagaggagacgaagaaatggaggcggcgccgcgctttgtgagggctcctccccctctccccgccgtccgatcccccgatcaccccgcgcgtccccgcacgaatctccaagcaatcctgaccaatgggcccatccggttcgatcttgtattttttttacttttttgttctttttaaaacttattctctcgcattttcatttatgcttatatttactgaccaaaatttttattttaatattaaatttagagtgttttttttcgaggtttatttttcaacctttgtttatatatatatatatatatatatatatatatatatatatgacactcatatggggcaccatggtgcccgggcaccatggtatctaatgcacaaaatcactcaaaattttcaaattgtgagtatatatctagttataataattcgattcatacctatacctatcaacaaaacaactcaaatttaactttatttcacaatccatgattacatacctaactaattatatgtatagatgctatatacctagaatcaaaatctaacaaaaacaagttcaaattcagttcaaacttgctttgaactagttagtaaagtggttaatgttaatacctaagtaactgaaaaagattcatactcatttaaattgggtatatactcaatttcaacaatggtgcccggacaccatggagcacaaaacaaatttactatatatatatatatatatattatttataaattattttatttgcaatcataccgaataagccatagagcccttatttataaataagtttttcggaaaggactaaaatgtaaaaaaaatatagtcgtcgtgttcctccggctcggcggctgcattgaccttgggctccgccatgaactcgatgctgctcaggccgctcccgagcgcgggggcgagcggtggtcggggctcgccggggagggggcgggtggttggctcggcggtgagtttcggcgggcgcgggagatggcggcgcggggtggcggtggtggcggcgggggcgggggcggaggcgtcgtgga

SEQ ID NO: 3404 - DNA, 1501 bp, Oryza sativa
ggcaaccgcaagaggatctcagccaccacgtcgtcgttcatcgcggccgcgcctaattgggttgcggtcggggtcgcaatgtgctgcacctgcacacatatgtgtagtactccacgagtccgcgtacgtaaccaacacgtctgacgcttgttaaacaattattattattagtgggctaggcttcttttattttattggctgggctcgcttcattatgtagagtgggctgggcttcttttattttattggctgggctcgtttcattatgtagtgggctgagcttcttttattttattggctgggctcgtttcattaggtagtgggctgggcttcttttattatgtagagtgggctgggcttctcttattaaagctcggcctgacttcaaactcctccgcctggaccttcgcgaccgaaatggccgccgttgccggcgacgacgcctctacctcttccgcccagagctctccgccgccgacctccgcctcgacgactcgctcctcctcctctccttctcgctcgccggggaacccgtcccccacagggtccccgtcccgagggtgctcgtcgaccccgcggcccctcccgagcgccgcgccgcgggggaccatgtcgaggtccgcctcgcgctcgtcgtccccgtcgtcgccgcagccccccggcgaggagccgcccgcgcctctctccctcggcgatggtgagctactcgtgtgttttactgtcctgtgaaattattaggtagtaggggtttatgagctttctggttgattcgtggccaataatttgatcactgctagtcactccaaatcgtcctgtgcctctgggattttagtactactgaaaacctaagtcgatttgcaatttaaattttaaaatgcaattcccaattttaatttaaaattttaatagcattttaaattccccgttcccaagtctagttcccacttcccgtcattgttcttctgtccactgccataaatccacagttcttgacttccacattcgaccaaatgaagccatggccgacaatataaattttcgcacgcctgcgtatcaactcgttagcaagctaaccattcggtgcatggaggggcacctcatcctccatgaggtggtggtcacatcacactcttctctgctagttccaatttggtgagtagaatatggattccaatggagagtaggtttgaggttttttaagtacaatctgactgtacgcttattgtcctttcatctgttgcttattttttaagtcttatcatctgaatagctacaatagaatacagagatgtggactgcaccaggtctgagctgcttaaggttgccttcaccgaaaaatggctgcccgaaaggctccaaaataatcggaaagcaacagccaagcaaaggtacatcggcggcattaatgttcttaacaatttatcaaatgtattttattgtatcttaggtagagacgttggtgtttcctaagcctaggtgtttagctgtaaaggaacatatc

SEQ ID NO: 3405 - DNA, 1501 bp, Oryza sativa
caccgacccaatcaagccagcaaggggaccgaggcagggagaatcgagcgaaactagctggtttgctgtcaccactaaatgcaagaaggcatttgcctcccatctcagtgtacgctgatgatgccgttctgttcttcaagccaacggctgctgaagcaagcgcgatcaagggactgttgacgttgttcggcgaggcaacaggcctcaaaacaaatttctgcaagagtgcgatcaccccgattcagtgcagtgatcaacaacgggcaatggttgagtccattctctcctgcagagtagaagatttccccatcacctacttgggcctcccgctaggaacaagacagccaacaaaagccgaagttcagccgatccttgacaaattagctaagaaagttgccgactggaaacctaagatgctctcgatcgatggcaggctatgcttgatcaagtcagtgctcatggctcttcccgtccacttcatgtcggtgctgcaattgccgagatgggcagtcaaggacatagagcgcaaatgacgcggtttcctttggaaggggcaagaggaggtgagcggcgggcattgtctagtctcatggcggaaggtgtgctctccagtggcgaaaggcggtctcggagtgaaggacctgaacttctttggtcaggctttaagattaaaatggctggcgaaatcgctggagcaaagggagagaccctggacgatggcatctttcaggcctggttgtgatgtggaggccatatttcgctcggtgacagagtacatcataggcaatggtgaagacaccgatttctggacagcaaactggactgggaagggatgctttgcatggcggtggccgatcctgcactcttatgcaggccgtgtcaggctttcggttgccaaagctctcaccaacaatcgctgggtccgcacactgcagggggcgctgtccaacgaggcgatgggcgagttcttccagctttgggacgaaattcatgatgtgttgttgctcccctcgacggatgaaatcaggtggaaactggcgaacgatgggcaattttctgtggcgtcggcctacgacatgttcttcatggctacggaaaattgtgcattcggcgagctgctgtggcactccagagctccctcgcgagtccgcttcttcatgtggcttgcgctaaaggaccgttgcctgcggacaacctcgccaagcgaaactggccacatgatgatctgtgctcactttgtcagcgagatgatgagaactgccaccacctgttcgttgcgtgtgattacacggcggcggtgtggcgttctatcaagcgatggtgcaatgcaagctttccaataccggcagatggggacgctgccctcgctgattggtggctggcaactagatgccgttttcagaagagctacagagcagattttgactgtgctttcatgctaatatgttggctgatttggaaggagcgtaatgcacgtatatttcagcacgtgtccaagcta

SEQ ID NO: 3406 - DNA, 1501 bp, Oryza sativa
atcggccggcgggctctgccaccaaggatccaatgggacgccgcctctagaggcggacaacgatgcgccctacccgcgcgcctcaactcctgtccctagtgttgtcgctgcctgaggttaggacaagatgacaagagcatgggaagggggcggcggtgacgggtccaagatatgcgcgaggttgggacgggacactgcagcgtcgtcatcatcctcctcctcaactccggatgtgccgcagatcgagatggtctgacggcgttgtgcggctgcagcgacgagaggaagaggaaggggccaccgtgagcctctaccttccaaccaccgtgagcctctctcaccggccgtcacccttgccggtaaccacccttctcccttctctctgttgtccgtcacccgctacgcacctctccctctgcccgtcgccgtcgagcccccacccacgacccccggcctttgctggcctccatgcctcctccctcccctcacgcctcgccgcgcaccgctcctctcccgtctcctatagggcgccgcgcgccgctgcctccccatggcacgtggagagaggagaggggagaaatgaggaagaagaggagggtgagccaccatttttaattatttttttgtgtaattgacatgtggagtcataatttttattattttccaaatcaaattgccatgtcaataccatgtcagattaagaccgagtcaaattagctacgtaagtgccacgtcagctaaaaccgtcgtacaaactgccataggacctatgttgcaccagttttaatagttgagagacccgttatatctggtttccgattgaaggacgaaaatcatattcgttgacaattaaagagacctcagatgaacttattccaaactactagtttatacggttcgcgtgaccatatagatggccaaacagcccggggcatggcccgggccatgccacgggtttttggcccggtccagacacagcacggcccgaatggtgtcgggttcatggccgacctttgggtcatgcctaggcctctgcctcggcatgatgggccagcccggcatggcacgaaccaaagagataagggacacaaaatagacttatttcaaggagtagcacggtgggatttcgtgacttattccaaggaggagcatggtagaatatacttgtcatggatgagttgtaggtttagcaatagcattaacaaatttatcttgattcgtagttaacaatagtacgaccacatttaataatttaccatgttttcacgcccatcacctccatcattgttaatttttaaatgttccatttattaatatgaaataagcaatttttttgacctggtgaaataagcaatattattataataacaataattagtcatgattatgtcaaacttgtaaaatgtatcacaaagattatattcttatgtcaaagcaaatttattttaaaaaaaagatactatgtgcatgtcattatatcgagtttactgtctatatattc

SEQ ID NO: 3407 - DNA, 1501 bp, Oryza sativa
gttggaaggtagaggctcacggtggccccttcctcttcctctcgtcgctgcagccgcacaacgccgtcagaccatctcgatctgcggcacatccggagttgaggaggaggatgatgacgacgctgcagtgtcccgtcccaacctcgcgcatatcttggacccgtcaccgccgcccccttcccatgctcttgtcatcttgtcctaacctcaggcagcgacaacactagggacaggagttgaggcgcgcgggtagggcgcatcgttgtccgcctctagaggcggcgtcccattggatccttggtggcagagcccgccggccgatcgtccttctcaccgctctcccccttttctacaagacgccaaggtggccgaccagcgtagcaccgtccctcatgacggccatggtcatctccatctttcacgcccgtctttgccttcctggtcggccgccacccttctccccctctgtgtgcgcttgcctgccggcgaggccgcgagggagctcgaggagaaaggatggccgggagggagagaggagaaggaagcgctgtcgtgccgtcgttcgtggatagagaggaggatgggacccactgacatgtgggtcccactatttttttcttttgtctaactaacatgtgggcctcatatttttgttttagttttaaatttttatattttgctttcagtgccacatcaccgccatgtaggacgaggaccaagtcaaaccagaaacccagatgccacgtcagctaaaaccaccatctaaaccgctgaaagatctcgtttgtaccggttttaatagttgagtgatccgctgtacgtggttttctggttgaaggatgaaaatcagattcgttgacaagttaagggacctcaagtgaacttattccaactagtttctcgtgaaatttctctgccacgtcccgcacgagcaacggccaccccatcgaggtcagcttccgcgccgcccgcccgccggccctctccgacttcgccgtccactgccccgccctgcggctgcaagagccagccgactacccctccatggtgcccaaggccatcgccgtcgacggcgacctcttcctcttccgcatcccgatcgaccgcgtcggcaccatgtccctcactcacaacgactacttcgtctacgcggcgcggcctccccctcgccgcccgaccctagatctcctccccaacccgtcccacgacaccctgggagacagggagatcgccctactcagctgcagcggcggcgatggcggcggcgacggcgagccgtgttacgtggtggctgcgctcaggaccatccccggcagcacaaccatccacaggctgcatctctaccgctccaggccgggcggcgagcaagggagatggacctcgcggatggtgtccgtggacgaaccgccgccattgatgagggacgtggtgttccccatcccggagacgtcgcaccggcaagtgcaccacgtgacgagcaaggcgatcaggctgggatcgg

SEQ ID NO: 3408 - DNA, 1501 bp, Oryza sativa
accggcccgaccggcgagcctggcgcaggcgtcagcgtgatctttgtccgcccggagagcggccacttgtcgccgtagagcatcgacccggccgtcgacacgttcaggccggcgaagaacgtctcgccgttgacggcgacgtcgaacactctccagctgagcgggcccggcgcgcggttgtcctggaagtagagcgccaggtagtagctcgcggcggggagcggcgccggcggccactggagctccaggctctcgccgcggccgccggccgtcgtgacgcctcggcggaacacgtcctccggtggcttgttccagaacgccgcctgcgacacgctcgcctggctctccaccaccggcatcccgtcgctgtgcgcctcccagaaccggttgaaacgatcgcctggatagctagaaaaaaaaaatcacagattcgacgagcatcaagcggcaagcacgccatgaattcgtagcaaggaaatgggcggtggtgcgtgattgttcttacctgacggccgctgagccgtcgtggccgaagctgtggcgcgcaatggtgctgagagcgtaggactcgaagtcggtggagttgtacaccgagtcctccaatggcgacacctcaagcgcggagatgaaggggctggacttggtggcggcgttcctggcgaggcacacgctgacctccttctcggtggcgagcacgacggcctcatagtacgtggcgaggcccctggcgtagtcccccgccgtgtccacctcgctccaccgcgtgccctcgatgatctggtcgaacaccggcggcgcgctgccgccgtcgaacccgccgtagaagtacgtcgtacggacgaggtacttcctcttcctctccgcgggcaccacgtagcagtacttcctcgccgacgtgtcggggaagtaccggagcgaggagagcaccggcagcacccccggcgaccgcacgtcggagacgttgccgacgctgacgaaccggccgtcgggaacccatgtcacgtcgccgaccaccttctccgacgtcgcaccgcaacttatctggtaccctgtgtacaaacgcggacaatgttcatcaactgcccaagcacattgcacgttgtgaactcaccgagggcaaaagcgttcatcacctgaaaggccatcggcggcgccggcgatgccgaagacgaggacgacggcgaggagggagagggggatcattggaggaggaggaaggtgcaaccgcaatgagatggtcgttggctcgttgccggcttgagagttgagacttctgctttgttttgtttgggtggcagtttcttcagaagttcattatttttctctatgaattttctactactcatcagctcttggtggcacacatgtatagattacatatgcatgacctcttctaagacaagggagctgcattgcaaatttggaggcttgcagtacatgacacaatgattaacctatgatttgagatgaaacaagcatcttttataatagagcatttttc

SEQ ID NO: 3409 - DNA, 1501 bp, Oryza sativa
atacaatttagaagtaactgaaattcgaaattaaaaattaaaaaatattgaaagatgagtttagagttcacatagaaatacaattagaaataataaaaaattcagaaataaaaataaataatattggaagaagagcatagagtctatatagaaatacaatttacagaaaattcagaattaaaaaaaataaatattaaaatacgagtctagagtacatatagtaatatatataattacaaataactaaaatttggtattaaaaataattaataactaacacgtatataaaatataatatgaatattacatattagtagttttgtaaagttattgcaaaatttaaaattatgttgccattttaatatttttgaataatataatgagaaaacatatatgctattatatgagagaaaatataataatgctagccgcgcaatatgcgcggggcaccatgctagttttagtaaatacataagaaatcctgtcaaaattttggcaatattgtcatcttgccatattgccaaaatttaataaggtttattttggctacaatctgaacaagcccttaattttcagtgttagtaattttcattaactaattctagcgaggactcttgttttaatcagaattgccatccttgatttatttacttttttatttaattaacatggaatgtacgagccccatcaactggccaagagctgatttgatgccaaaacatggctcattagcgataaaaaataatttataaatgaaaattttatatatgtgtttttaattagtaacttaaaagctaatgctacaaaagaaatacattaaaaatattctaaaatcaactacagaattatgttttgaatcagattttagcagcggttgattttatataggacaaacaatgaggctctaattccaatcagtaaagctagccgaatggcattcccttgaaaaagaaaacaatgaggctctaattctaggaagtgtccggcaaaagtacgtgtacaacaaggataattaaattcatgatggatggatgaattgtataatgtaatttggataccaaagaagaaaactagcaaacataggaaataaagaaaaaacattaattgcgaaacaaaattcgaattggttttagctagctgcccttaggtggatgtgcgccaacagagacgatcgcatgaaggaaggctgcagcctggaacagcctcgcctcctccagggaacgggaacgggaagaacaaaaggaagctttacctggagcccacaacgctatccaaggctttatctaacttcctattggcctcctttttatcctcttttaaatgagcgcaactcgtcgccgccgtgccgttgcgtttctcgttaggagcaactgaacttatccaacgaattgaacaatcaattcacccggagaggtacgtctgcatgccgggctgcacctataaattcccatgcaccagcattccccatccacacaactcagcttgtatctgagacacgcaa

SEQ ID NO: 3410 - DNA, 1501 bp, Oryza sativa
tccatctataaatccaatacgagattaattaaaatttgaaataaaaagaaaaatatattctcatagtggatctatattataacggttaagattgattgtataggtatataaataaagaaaaaaaatactacgcagtatacatgtccttctcatagtcatgtttgcagtcggactcccaaccgagcaaagccacacaacaacatgacacgttttttttggaatcatagctatgaaggtctagcaacaggacaggaaaaacaggacaggacaagtcctccatcggattcaaatgaaaagctaaaacttttagcagtaatcctattctctaatataattacaataagtttttattgactaccacatgctaattttcaaatacacatatatagatgggttctctttcctctcaagtttctaatcataaatgctagaaagcctatatatgtcaatatttttataaaaaaatactcctatatttttttatatgatattggttagttaaaaaaaactgagagtactaagaaataccatgtcctaaccaaatcaacaatccatccatgaaccatactttgaaaacatgcagttcagaactctataagcctagaattatcaatttggaataataagttaggatattgaaagaataggccattcaaaacacaacacaagattaattaaatgttggaatgaaaaataaaataaaataaattctgaaattacaaaaaaagatattataagtaggattacaatttagaaataactcaaattcgaaattaacaaaaaggaatattgaaagagcaacccatcaccaaactaaattctaaagttagaaaataaaaataagagttcatatgggcatacaatttaaaataactaaaattcggaataaaaaataagcaatactgaaagaagagatcatctagagcacgagtttaattaaattttggaataaaaaataaattaaattctaaaaatttaaaaacaattaaaggcgttcaagtaggaataaaatttataaacaacataatatctgaataaaaaatatggaaataaaacacaatccatctaaaaacacaacgatggcaaatgaaaataaagagcggagaagcaacgagactgtaaaggagtagggtggcagtggttgatgggacatctaaaaactataaacaaaacctaaaatagaatccaatgacaattaagacgagggacaatggacaggccattgtaatagcatgatcacgggggttggtgggacttctagaaagtaaaaaataaactccaatgaaaatcatatttgatttgtaaaatctcaataataaaaaagagggaaggcaatgggcgtaaaaagtataaacaaaaccccaaataaaattccaatggcgattaagaggagagatggcgggcaacccgttaagaagcacaatcagagtgatcggcgggacttctagaaagtaaaaaaataaaccacaatgataatcacgttcaatttttaaaatctcaa

SEQ ID NO: 3411 - DNA, 1501 bp, Oryza sativa
ccatctctcacgcatgtacactctacgcgattaaacaccagattctattgctttatccttaatcacctttttagtccatgtttaattatataggcttggtccgttataacgtacgagcatgttattagtatgcaacaaatgcggaagtgctaatgggcgatcgatcgcccggcgacaagggtagcgatcgatcccccttccccctccctccctccacctggtttctttttttggcaccgcattactttcctattttagtaaatttatacacctaaagtttatacaccttaagtttacacatctaaagtttatacacctcaaatttacacatctaaagtttagagactaaaagtttataagtcaaaagtttatatatccgattcaaatttgaatttgaattcaaatattttatatatatatagtatttctataaatctaaagttcataaacctgaagtttatagacccaaagtttataagtcaaaagtttacatacccgattcaaatttgaatttgaattcaaatattttcaatatatagtatttttatgcatctaaagtctatacacctaaagtttatagacccaaagtttataagtcagaagtttacatatccgattcaaatttgaatttgaattatatccgttcaaatttgaatttgaattcaaatattttctatatatagtatttctatacatctaaagtgtttatacacctaaagtttatagacacaaagtttataagtcaaaagtttatatactcgattcaaatttgaatttaaattcaaatttgtatggtgtagtagtaagagaagaaggggaggtaaggtagtaaggggaggggcgggcgatcgaccgcccgttaggagtatcccaacaaatgcaccaacaaagaaaaaaccgtgtccttgccagtcgcatcttacccggcatcagagccttaaaggccagctaattctcaatgggccatgcacccatgccacgcaggcccgtcgatggctatgtgccaagtaggcgaccgcacagggcctctgtttttttggcccccatataaacaatgaaggttcacttccaattgcccagctatagcatgcaacaaccaaatagactaataggcaaatcaatcaataagaccaagccaggatggggcgctgcaagtctgcaaggctctgctattacctaccttttgcatggctgtcgtgcgatcctaattctgtgctgcgccaactgccgggatgtcgtaacgtgatctcaattccacgcgcaacgactaacgaggcggcgacacaacttgatgctttcaacttcgaggctccaagcagcatcgacgatcgcgacgaccttgcagctctgccttcggctgggctcctgggtccagccttcttcctccttgtttgctcgtcgtcctcgactcaaccctcgatggttcgactcggactggtaaggttagcctggatgatagatcgtaaatatgtaatatgcatcaaattgtcgtgagttcatg

SEQ ID NO: 3412 - DNA, 1501 bp, Oryza sativa
cgtatcaagctaaaatcgattcaaagtagagtaaaatatgtgagtggaacccctctattttgttttagctttgtcaccgttttcagtgtacgtaggtaaccaccgtatctaatgctttgtcccataatcacatttatgtagcacatccctacttatataggtccgacacgttacaaataaggctccgttattggtactttgaaaggggagtcttccgtccaccccctcccagtccttcacatcatgcacagtgtgcaaccatcacactcgcaagaaaacaaaccaataatgttcctaacccgttcccaatcacacctcatttccaattacatggtccaaaaaaaattaatctccattgaaagagacaagtatattattatccattgcaacacacagacgtgttactactattaaaacaaataaattggtagtaaagatatgcacacgtgtgtatcccaccaagtaaaatagaattgtccatcgaatgtagataaaaggatgcacacactctttcttatgcataatttgttaactcactacaagaaaacagaatgtccttggcggccatataatttctttagcggtatttacttagcgatcggccgatggaataattaagaccgccaagtacattccgttttcttgtagtgacttgggaataatgtttacaatatacccaagtgtcatgccccgaactagtcccgaccgagactagcccgtgacgctccaatttaacctgttaatcgataccagtcccaggaaacagtgctggtatcacagggagacagaatatcacagcaacagaggtctctttattatagagtaggagtacagtcatgttgagctgcggacagatcccgagctcacaactgcattacaaaaggaaaacggaagccaggacttggaccattcatcacaggcgcgacttgggaactaggccgaaaccctaaaactcatcgtagccggcttgctcctggaagaactcctcatcagcaggatccgcttcatcttcttcagcaactggggggggatatttatatagagcaagggtgagtacgggagtactcagcaagccaggggaaataagtgtttaatgcaggcttcaagggaaggctgttgtttttgcaattggttttatttgaactatttttctaaaacaactaggtgagtgcttctcaaacgacacggatgggacagtgcgtctcgtccggtcggagtatgtgcaatgtatcagtctttgggattgcaacaaggttggcacccggccaacagcttttcaaacggccacccgggccaacaacttttcaaacggccacccgggcctagctgatcccatcagctacagatttttcaaacatcgaaccccttttcacaacagcaatttcacaagcagtagtcaaacaaaactacgctaggaatcacctcacatccgcccttgaccgtgggcacggctgttcgaacagttcaatgacctctgcagagggggtacactttacccaca

SEQ ID NO: 3413 - DNA, 1501 bp, Oryza sativa
cggccacagacaagtcggactctcctcgccgtcacagcagcgacacgtcctcctgttctcctgagccgactcggcttgccatagccccgagccaacctatcagatcaacacaaatgcatgcagccacatgcacgtgtacatgcatccacatacacgcatacacgccactgtgtacacatatatgcacaatacagtaacaccgctacagtacctcgagtactgtagcaaccatataatactccacaattttcctccgcgaacaccgacgcttgcacgcacacctcgtgaagcccgctgcgaagatctcttccacacgatgtccatccatcatgtaccatctcatatccaacttcgtcacccggtatccttaaccgtctggaccttaactcctccctgagtctagtcccgatccccaccgttgaccgaagttgaccttcaagaatcctgactttagtcaccttctcacatggtatcccgaccacactagacatctgttcctccctgaacatagtctcggtcctcaccattaaccaaggctgacctcaagtcacctgcacacaatcagacaaaacaaccgtttctgagcacaaatatcacaacctgacccacattagtcacacgcacacacaccaacatccacacatcttttcaaaccaattcatcgaataaatcatttgtaaagccaattgttcatcacaaatattaatcatgacaatgatttcacaattggtatcagagccaggctaggttaacatctctggcccgatggacatgtgtgaaggcctgatgaaccgtgggtgcctgcggggcccgtatacctgatggaccgtgggccggtgggggcccggatacagtgaaagggcggtgaagggctgagggacactaatgtgtgaaggaggagattgttgaatagtcccacattggttgtagaagggcaaatgacctaagatataagtggggagcccctcatctcaatggctagtttctgaggtgggaaaggccctttacgacttctgtataaccgtgaaagaaaatctcaggattttaagaattctgttccgaaattctgagtcgttggtctccatctgtgtttgagtggatatgtgaatgaggtttgcatacatcctgtgttagcttctgtataaccgtgaaagaaaatctcaggattttaagaattatgttccgaaattctgaaccatgcatgctgacaggtttggcatgcccctatggcggcgaaattaagacagtgttgcgcgcccttatccgtttgattcgagccaatccagaaaaccaggagcatcccggccgtctatccccgcactactataaatacttgcccggagacgatttcttctccacgcagcaagagccgatcgatcattgtccaagtctccaagcgatcagctagctgacttgacgacgctgcgagcagcggcagcaagagagcagcagcacaaagggttcccctttcacaagtgtccggccggctgcacgtaggcca

SEQ ID NO: 3414 - DNA, 1501 bp, Oryza sativa
aagttgtaccacttagaattatgctctcaatttattatgaaattaaaattaataattatcatattataaatgacatggactcccttttaaatctaagcaatactatcaccgtcccataataattgtatctgtacgtttcaaatttgtgccaaaatagttgttataatagagtactaattttccctttaatcacttctgatttaaaattttccatattctacccccaaccaccaccccactcttacctatacaccatttaatgagggacaccttagtctttcttctcaaatcttaatatatgctaaataatacgaaaataggacaaaggtagtagtagtaatttggagaaaaagtaatctatgtattgaacatatgattcgaattctaagatttaccttatgaataattgtagccatgcaacgcacgagttgatgactattatttacaaaattcattgagatcatattgagagctaatttttaagataattatgaatatatgagttttatacaatcaatctaaaaagatgttgccattcaaagaattaaaggtttgtttgggacgttttaatgtttttacgactgctggagtatccataccgtgcatgtactccaatatatgacttttgacaaagagattaatattattcagctccaagaaatatacgataacacgttttagctatgttcgttgacaaatcattgtgatttatttttaataagattatatatctaaaaacagatgacgcgccatgcatataaattaatatagcatgttctttcatggtagatggaactaataatgaatatcataatgaacatctgtttctagatgaactaataactacacataaggaactgaataatgcaaataaattgaggatcatttctcattaaagacatgacactaaatgaatatatttgcatcactgcataaaaatagccctctctaaatgaaccattactacaatttacaggtgggcagatcaggttttcttcatctttttctgaatgccaaatgtggcaccacaccacaggtatatggaatgcagaataaatgcaaactttaaaccaaaacaaatccaaaaaatcaaaatgcatttaaaactcgactagatcaaaccacagagagaggccttctttctttctcctcctcctcctcctccttccccctagaaatcggaattaattggcatgaataattcccccaaccatttcccaacaacaccaataaattagtggccgcccattcgccgcgtgggtcccacctgtcggccacggcggcgcgcgccctctatatatatataggcgagccgcgcccaccaccaccagcgccaccgcttcttcttctttcgattcttcttcttcttgcggcgacgcggagaagcagaggaaagccgccacgggggagaggggaatggcggcggacgtgagctctgtggcgaggctgctgcgaggggaggccgggaggaggggcggggcggcgggggaggtcgtgacga

SEQ ID NO: 3415 - DNA, 1501 bp, Oryza sativa
agctatttttttcgtcggaatatatccatgtgtggtcttgtttttaagatttaattgcaacgaatttaatggtgcaatcggatcatgatttggataagtaatttaagagaaaaataagtttaaagtagttttgcacgtaaatcggtgctgacgtcagcgcccgattttactccaaatcgctcgggcgcccgagccgtaggcaacccaaaattatttgcgccacgcgcgtacgtgtacaatggtgtggtactatgacagttgatgttttttcaaaaatttatatcccaataggttctatgaatatcatactatttataagattttatttgatttttttcttttttatcaattcagatttgaatttggatgaaactcatcgaaatctcatacagcttactactttcgagcctcatcgaaatctcgaaatttcactgtatttgaccggtctttattggaattatgaaccctggtgctgtgctgtgtcgtctgagaagctgtttttacagcattgtttggtgtaaattgatatccccttcgtgactctgtctggatatgttgcctatatctttaaggctgagttcgtttgttgcagtcagaaagtactcattagcatataattaattaagtattagctttttttaaaaaaatgtattaatatggttttctaaagaaattttcgtatagaaatttttttaaaaaatacactgtttaatagtttaaaaagcgtgcatgtgaaaattgggggatgtgagctgaaaaaggtaacaaacgaacaaagtcgatgaatctgtccacgtcccgtattaagtttgtttattttaggtaaggatgtaaatgttttgttcaagcaatgggcatttgatcggaagaaatgtcttcacagatttgttcagccaataaaaaaatattattaaactctccttactgtgtatgcttgctgaaatctctcgttgaagattccacgtgagtatactcaaagctgaaagggacccaatcacaaactcacaatgcatgaagtaccacatgtaaataaaaattagcatggccaattgccattatttttgtgttcaaatgttcaaagcctgagcttccccgtcatgttagaagtcaggcttctttggaaatgggggatgaatatgtgcatgtgcagccgtttaggatggacctatggactggtgaagtacactgaactcattaccatattgcaaatcttattttactgtccagatttacggatcctgacaaggacacgtcatgccacagtgccacttgtgcaacaggttggaaatgtatacacgaatcatttgccaacatggtacttgcattgcatagtttggtccaaggaaactgcccattgacgcaaaataactggcagactgaatttagtcttatcaccttcgtagtagtatatagaatgttagaatctcacttttttctgcaagtttgggcagctagttccgataacagcttgcattgcttgtcatttgaaagatcagcttga

SEQ ID NO: 3416 - DNA, 1501 bp, Oryza sativa
tcatcatctgacgaatcaccttcctctacacgctcgttgtcagaatcctccctcttcatttcatccacaatggcaccgacagtctccccctcgtcgaccactccacttggttgaatgcccactggaggtactacgcccccgtcctctcatgcgttgacctcttccacaaaagtctcatttacttcagcacttggtccctcgccatcattcatgttcatctgcacacctggatccttcgggtgaacaaacggaaccatagctagagaccacccacgttgcaatgcattttccacataccatctccacactcgagagttttgaactggcattagttcccaataaaaaccctcagttgcccgacttactataacattgattgttatgtcacttgtctgtggatcaactctcaagcccctcattaaccatccttttatagaaggtacactcctctcagccggtctatcaattcccctttctgatacaataaattctgacagatctaccccagttggcccgtaacggacgtttcatgggccatggtaaacttggaatatttgtttgttcgacatatctgtcaacgaaataactagatcatattattctttcatgcaataaacacctacaacgtaatatctccttgtgtatgacaatgcaacggtaaagtactgattccaaactagcagatctacgtagttaccgatatctacaatacgcacttctagattagtacaactaaaaccctaaaaatataatgcatttattcaaacaaagttttaaaaaatacacaatatttaactcaatagtcacatataggatcaatgaatattacctgaaattggcgtgtgaatccggcagggcttcgccccttcttctcttctcctcccctttcttcttttttttactagatttgtggggggaggaatgagggctaggggctgggcggcatgccttttataggcagcgaggcctgccgcccgaccagagagcggcaaggggccgcctggaaaatggccggtcccggctggcttttttgcattgggaccccttgccgccccaacagagggcggcaagggttttcctgcaaaaaaccctccctccgtcaccgcctgtccctcccccgtttgccacgtcagcttgccgcccaagtggtggacagcaggatctatttttataatttttttgaccgatagattatttctgtaaatattaaaaaaaatctaaaaataaaaaaaattccgcttcttcctaggtcggatgggccttctgcccattgccaccacctggatgtctcctaaggtaattccttggaaaaagtacacctaaggtcctcaacttgtcatcaagttataaaatcatcctccaaccataaaatcagatactggataccggtcgtctctcaactaagaaaaccgtttgcttgaggtccttcagtggttttgaccccggttttatccgacatgacggctgagtcagcgtgtggaccccacatgtaagatgccat

SEQ ID NO: 3417 - DNA, 1501 bp, Oryza sativa
ttcctaagaagttttttctaatgtaaagaatgtcttactatccccttcacagcacttcctatttttcttaaaggcgggcctggcagaaaagaaaaatacgacctctacgaaactctcatattgacgggcctagcagaaagaaaaatacaaggcaactatgatcagatgtcggatcataattaaaaccccgaatggtgttttaccatatgtacaaaaatatttaagatgttttatcacccaataaaaattattttagcaaaaaaaatgatttaagatgtctcatactcagtaaaaaaatattttagaaaaatgatttaaaatgtttcactgctcaataaaaaatgtttaatcacttggtgaacagtgaaaacctgattgcaacatcaggaacctaatacgtgcaatatccaaggaaacgttaaagtgcaacagagtgaaaaaaaaagagaacaaagagtaaaacatcttttttttttaaaaaaatattaccatatgatattttgttataaagatttaagaaataaccacctcaattgtcactcttgttttcaaacccccaaaggttaatttgttgtaaatgactgctcactcaaacttgtccacgtatgtgaatagccgaatcagtccatctctgtcaatgtgtacaagcagcatggggaacatagctcaattgtagtcaattgtcgtttttgatcgctgccatccctacaccctcatgctgttcgtgatcatcttcccgcttcgagctacgccgagaatctaactagagtaactagagtaggatgcatcgaaaatcaagtgtgaccttttgacatgccttatgaaagttctttttgaatgtgaaaatttcaccaggttttcatacataaactatttcaattctcatgaaatttataaaaaaaatcttcattctaaaggccttactagcctcttcctaatactatcatttttatttctttactactttaaacacacagagtcgttcttctcccatctcctcctatctgtttatatcagcctagccagaaaaatctggcgggcctgatggataataaaagcatcatatatccacacgtggttaaacattccagttccagtgagcagcgagccagcgacttcgccgccacagtcaaacaacaacaagagtgtgggtcccacacgtgtgggcccacccccacacagccgttgagccgcccccgcctcgcgcgcgaaaaaaaaaaaaaagagcgttagtttatcactcgactcgtcctcgtcccacccgaagaaactgcgcgaagccgttgcctcgcttgcttcccttcccccgcggtttatttatttcgtcgcggttgactcgctccccttccccccctcccccctcgccacccacctccgcctccgccgccgtcgagtggttggcgccgccgacgaagagcatatggcctcgtcttcctcctcctcctcgtcgtcgctcgcctcctcctcgggtggaggcgacgctgcttctgcttctgcttct

SEQ ID NO: 3418 - DNA, 1501 bp, Oryza sativa
ctcatttgtccaattgtgcattgttcaccaggaatgattgtaggaaaatagtttgtggctttgaatatattgcctgatcattaggatatatttaatagcatacttgcattaagaactagattgaggcacatcaatttatcattttggttcaatgcattcaataaatcatcaagataaataaaatatcacaacattttctcatcatcatatagaaagtgccgtgatattagctagtagcagtgtgacaccgaattaccaaattagcaaaagtgttcgagccaatctgcttcttccttataataatagagtgcggccaaaagaactatatattttcttccattgctatagtccgtcttgtctctttcttcgaccagccgctaacattgagaagggtgtcaaagtcatatacaatgaatcagcaatcaatacttacaacagcattgacagtggttgaaataatctttctttatgggagctcaaacacatgtttaggtgtgatgccttttctcagattttggattattgccataattattgcgcaactaatcaattttactacaaagtacaaatagttgttgtttattggtggagtcaacatgtaaacaaggaaattgcggtatcaaataggcatttctagttttatcatgtacaacaacatgagcttcatcctcaacatagtcactatgtgaaaataaggcctgatataaaactgtcgttggggagggtttggggatccccgtgcttactgttgatgaaaaatccgcgcttggctgatggtgctagaactgtattggcgcgaactaagtcgacgaacacaacggcctgagagatctgcttagctccagtgcaagtccaaaggttcatgagatacgagcgtgctagccagtttgatcctgcaactgacaagatatacaaatagcagatcaatgagccgatcggctgataagccgatggagtaattccagccgatgccgataccagccgatagcaataggattttgagctatcggctatatgtttaatgtagaatatgacacttgatgtaaataatgatataaagacaatcggttgatgatgatgtaataaaataataatataacagtattccctctattacagattataaggcattttgtcccatcatgattttttttcctttgtcctattctgattaaatcacgtccgatatctttattccaaaactaccgtcctgattaagataggagccaaaacatctcttgcctaccgcaagacctatcttgcatcttcccaactcgtgtttgtgtatccaagactcccatcctagctccaatgtcttccaatcttctcccaaatcacaataccgactagggcacgaccgatttgcctcctctgctagggactctttgtcacactcaaggagtcccgacgtcaaggtcgtgtcttttctccatgaccgcatgaccggacaactccatcgcttcgccaaggaggcacaagcgttcttggcagtgtagatcca

SEQ ID NO: 3419 - DNA, 1501 bp, Oryza sativa
atgaattatgttcaaaatggtacctagcatttaggtgaacaaactgaagccaatgctcgatcttccacttcccgaaatggcagaattgttccgttaattgtttgttcgcctcaatgtcaaaatgaatcctgctgctttgaatttatcctcagctaaactgatacaacatttgcaacattggcagagctaaatggcatccctccagaagccatcgaacgtctggttcccgagcatgcgagaaggcagagtttgttcatggcgctgcgcacctagttctctagctcttcttttttcgcagtttttcttcctgagggaagctctgtaaaggtgtagtggcttctatgtgcccatctcagtgtggataaggtctttggctagagttgttgttgttgttgttcatggcaggatgtgatgtgagtgaggttggagaagaagaggcttgtgctttggtgtgcttgtgcagttggtttgaggttggaatctatgcttcagggttccaggctgtgtaactcctccagttctctttggactttggtttgaagattgtgtgcagtaacagtgcttggttcaacttcagttcagagtggtctggtgatgataaagaaaatcattcagaaagttttgtttatgttcagtgcttcaccattcaatactgtcgatgcaggtgcagatatgttcaacttcagagttttgtttatgttacatgcttcaccattcagaaagtgtgcacaaaggatctcagttttcttataaatcttcagaagattctcaatagaatgatctctcaataaagtgtgccccgttcttttctcataaagataatgattttacctcagtttccgttagcacgcttttcaaactataaattgacatgttttttgcgaaaaaattttatatgaaagttgttttaaaatattaaatatatctatttttcaagtttatagtaattaaaactcaattaatcacatattaatggttttcttgttttgcatgtccacttttaatcttatcttcagaagattgaagggagcttttaatccgcttttaaactggctgtgactacatgaaatcatatgaaatcagagtctttccatctccctgaagaaaaaagaaggaaagaaattgaaaaataaaattcaaaatctccagcggaaataaccaccaacttcgtacatacgcaagaaaagacgatcacgaccgtccgatttcgggagtgcgcctcatcttgcagaggaagtaaagcacaccgtctcctttcttgcagtggaggaaagaaacccaaccccgtcgccccctcctcgccgtcggatcaagatccaacggctgtgattcctcctgttcgtcctctttaacacccccaccccttctcctttctcatttcctctcctccgccacctcttctcctcgccgccgccgccgccgcctcctcgccggatcacgcaaaaccctagctaaaaccctacgcttccgccgccgcgagcgcgtcccccctccggcgaga

SEQ ID NO: 3420 - DNA, 1501 bp, Oryza sativa
gcgctctcctcgatgaagcgcctttggcatgttcttcaaggatgagtacctcggccttaggcttagttcggcaggatgggtttcccaacccatctcacttgtgttccacgtacacgcttttcaaactattaaacgatgcgttttttttaaaaaaatctatacgaaagttgttaaaaatcatattgatctatttttgaaaaaaaaggaaatacttaattaatcatacgttaatggaccgctccgttttctgtgtgctggagatatgttcctaggagtagcgaacacagcctaagggcctgtttggaggagtttctagccgctgcaacttctcacagtatcagaagctcccctaaacagtccagcttttggtccagattctgagaaactgtacttgtagaatccagaaaataagcaagccagaagctgggaaacccaacttttctagggcctgttcactttgatgctattttcaaccttaccaaattttggtaaagttgttaaaaaagtggctacatttagtttgctgccaaattttgctaactatataagaaatcatgccaaaattttggcaagttgccaaacttttagtaactatgccaaaattttggcaatgccaaaatttagtaaggtttttttttgcaacaaagtgaacaggcccctagattatcagaagatggttaccaaccagctgcttctcagaatcttaagttctccaaacaggccctaagcctcgccaagagcgccatcacgatatcccccattgtcccatcttctccaccgcgccacaaagctccgccccctacagtgtcatccccaagcagaggccgttgtggagaggagagagaaggaagagcagaaagcggagaggggaaggtggcagaggagaagtaggttcccatattaatgggcctgttttgttggtgaaatgaaaattttttggtgtcacatcggacgtttgaccggatgtcggaagaggtttttggacacgaatgaaaaaactaatttcataactcgcctggaaaccgcgagacgaatcttttgagcctaattaagccatcattagcacatgtgagttactgtagcacttatggctaatcatagactaattaggctcaaaagattcgtctcgggactaatcatagactaattactgtgcaattagtttttttatctatatttagtgcttcatacatgtgtccaaagatttgatgtgatgtttttacggaaagtttttgggcatcacgtcagtcaaaaaaaaaaaacaaaccattctcgaaaacaaccgagcgagatggttttggttttgtggtaaaagatgagattcagccaatattccgagggagtcatagtggacttgtatttctttcccgggttgctgattccgccaacattttggtctttactgggcccacgagctgctgctcctcttttcttttagtactccataggaacctcctctctcatctgagatgagataatccctttcctctcctctccgtgg

SEQ ID NO: 3421 - DNA, 1501 bp, Oryza sativa
aatatagtagagggtgtagttttcaaacaaattcagctccattttagttttgcagactgcagtgctcatatagcaactttttgatggacagaacatatcctgctaaaatagattatatgtctcgtctaattaaaagttgttatattttaggacggtaatgcctatctgtaatgcacgtgctctgtgtatgtcgacgtcttggttaccggccgatatgttcatgcgtgcgtatgtgcttctcctgtctctccctccctgaattcatcatcggctgcgtacgtgcgtgcgaaccatgcgtatctgttgcactcgtcgttacaggtctacatcactatatccaccctccgtgcttgcgtacgtacgtttaggcctcctttaatttgcaccctaggaaaaatagaggattgtaattctatacataccattggcatttggaacatcaaatcctatggactggtggattgagttcctatatacaccaatttcgtatcagactaaagccatgtttagttcccacataaaaattttacaccatgtcacatcgaacgtttgaatatctgcataaaatattaaatactcctttgcgagacgaatcttttaagcctaattgctccatgatttgataatgtggtgctacagaaaatatttgctaatgatggattaattaggcttaattaataaattcgtctcgttgtctactgtcggattatgcaattagttttattacttcccgaatatcctatataatagccgatgtgacacacgccaaaactttacaccccttgatctaaacatcccctaaacacttagctcacgcctctttcttttttttcccatgtagaagccgagtgagcccttattctacatgcagctagctagaccctgtacgacaactcgacgaatgaaacacacggaatgtcggaatcaatgacggacgactgatcgacaccatagtcttttctcctcattgtaatctctactttctccgtctcattttaagtgcagccatgatttttcgtgcttaattttgattgtccgtcttatttaaattttttgaaaaaaatttgaaaacataagtcacgcgtaaagtacgttttatgtttcatcatcctataacattaaaaatactaattatttaaagttggacatagaatctcatggttgcacttaaaataggacgaatggagtactaagcaacctggaaatactccctttatttttttaaaaaatacaatgtaccacgtctagcatttgaaatttatatcaaaatataagcagtttttcacgtctagcattgttcagaataccactttttccactaatcagtttccatttaaatttcgtaaatcaatcacctttttgtcttaaccatcctcgtttaatgggatgggtcgtcaaagtcttttttttattttcaactttaatatttatactaaataatttaattaaaaaggtttatgttttagcaaagatggcacttatatttgggaagggaggggaa

SEQ ID NO: 3422 - DNA, 1501 bp, Oryza sativa
tggaaaacaatattgcgtgaaagtacatccaaatatgaacccataataattggaccaattgctggtaaaaatctatggccttcaacttttttcaagataatacatgctctatattatgagggagatttgacacaaatgtgaggtaaaagaaaaccgaattttcaactacatggtctaagggtctcatcggttaccaaagacttattataagccacaacggcttttattagtgataaaaaagtaattttttgtctaaaacatttacaatgtgttcttagcaacttaaaagccaatgctgaaaaagaaactatgttgaaaatatcttaaaatcaacttcaaattgagtttgaaaaattaaaaaaaaaagactttggttgaattctttttaggcctaccaatgggctaaaattgtcgataaagcataacaggttatggtcttgtggttacattgaattattggactggtcttgcccaacggactgtggagacctgtctaagagggacatcaatctattggagcaattttggttgtgtaactattgtagaagtgcctttgtaggctttactgaagccatgcagaaaacaaaatggaaaaatttacattgccgctacactaaatttacatacataaaaaaaaaaaagtggagcctacaggaaaaggggttaacttatagacattagccgaataaagatgcaaagaaaagttttgatacaaaaataattacatcggtgcatttaattaaggaaacctgagtatctcactataaaaaacaatataataaaagaaatgaatttaagtacatgtgctatgcattggaaaactgtaattaattaaagagaggttgatgctttactccagaaatcgatttattattgttggcaaggggtggttgaggagtagcggaggaactgaagtggcgggtatatgagatgtgaggcatctcgccacggataagcatgggcaacagcctccgctccgcctccaaagccggcgatgtgaccgccggatatacaacccgcggtcgctgtagtgcgcgaccgcagatcttccgcgccgcatagcgaagcgcagccatcgacaactacttcgctgacagtatatcggatcggagcggagcgtattttctcctcagaccagacctaatctctcgggaaggggctcccttctcgtcaaaatcgactcaacatatatagtatatacgagtacctaacaatcgaagatcggtattggaaataatcggaaacgggatcggtaggaagaatcggaaacggtttagggcacagttttaccttttctttatatacgaatccaatcgctctacaggcacctccccacctccgccttggcctttgtgtgttcccagcggaggcccttttatttatttagttttttttagtggctaacaccattcctgtccatggcggcggccgaaggtggacacagcacccccacggagaggagaggaaagggattatctcatctcagatgagagaggaggtt

SEQ ID NO: 3423 - DNA, 1501 bp, Oryza sativa
tctcctcgtcgtgtgtatgcatgacaccatcctgcattcaacctgaattatttctcacaatatcatttccgaattcttgtgagtttgacgatatcaattcatcagagagtacaactgaagaagaagaagaagaaaggatataaaaaagatgatagatagatatactaccgtttgagaaggaacttgtcatgcgacgtcttgtcgtcccagagcaagatgacgatgcggacgccctcgcgagcccttttcttgagaagctcgccgagcgtcgatggcgtctcgccggggagcgcccgggtgggctccctgacgagcttgacggggtggtagatggaccatccgaccatgtacacgaggtggtgcgcctccacgatggagtggcagatgtcctcccagcatcggccgtgctcgtacgcccttccgccggcgatctggatggccgggaggccgccgtcggcgacgtgggcgtcctggtagagggtgacgccgccacctcggcggagagggaagtaggcgttggggacggcgccggcgccgcccctgtagagggggttgtcgtcgatgggcctgtactggacggagaggcggagctccggcggcggccgcatggggttgctgctgcagtggccgtcgatggggaaccagccctcggcgggggcgccggagaggatcctgtcgacggggagggaggcgacgccgatgagctgcgcgccgaagacgtcgttgtccttgacgtggaactcgagcctggagacggcgtgggcgacctcgacgcggaagcgctcctcccacctggggttctcggagttggggatgacccgcgtctgcgcgacggtggcgccggcgaggcagacggagacgtaggggtcgctggtgatgatcttcttgggcctgacgccgccgccggcccggcgcgcgttgtcgccggtgccgccgcacgaggagccgcaggcgccgtagccggtgaagaagcggcgcatccgctccgacatgatgtccatgttggggaggcacttggcctcggttatccaaatgtcgaggtcgccgtgcaggagcacggccgactccgaggaggcggacaagtcggcggagcttttccccatgccgcgcaggggggcatgctcttcctcttcctcttcctcttcctcttctcctgcttggctcggatggcttgcgtaacaatacaggaggaaggagagagatggcggcgcgggcgggggcacgcgcgcgcgggacggaggcggaagccgaaacaagaagaagaataaacggacgaggtggggttggcgacggttaatccatttttggatttgccatggccgaacaacggtcaggtgtttcgcgttgccatggacgcgtcggttcgcagagacagttgcttcactgtcagcatcccgttttgggcgtctttaaatttggttgtgtttagttcagcgcaaagtttaaatttttattgaaattggagataatatgactgaaaagttgtgtgtgtatgatagat

SEQ ID NO: 3424 - DNA, 1501 bp, Oryza sativa
ggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccagggaggaaggttatagttaacaagcagaactggccatgtactgtgacgactgctcaaatcaccaaaaggattaatgccgtccgtacacattgcgaaacgcatgtttcttgggtcatctgagaattcctggtaaatcctatcgattgtcctccactgtactgaatctgctgggtgcctcagcatagtatcgactttccgttcttcggcatgccagcgcacaagcttagcttgttccttgttcgcaaacattctcttcatgcgctccgcaattgggagataccacaccacctttactgggcctcccctctttgacttacttccttcaccttcactctttgctcgtttgtatcttgatgtcccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatgagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctctacatcctgatccaacacttcttcagctgcgacatcaggcacctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatattgagaatgaatggagaataatgtgttttttaccttgaattttagcaaaaaatcgccccccttgccctcccaaccgatttgtgaacagtacaatggtcgggatggaaagcagttggcagtttgggggtatttatagacccaacacacctcaa

SEQ ID NO: 3425 - DNA, 1501 bp, Oryza sativa
aacagtgcgagacgagacgatcgcttggcgtccgcgggcgagtgggcgaccggtgcggcgcgcgcgggggagcgcgcgcgcatgcgtttgtgtggtggtggggtttggttctgattccgcgacgcgtgcgaccgataacccccgcgcttataaaaaggtcgagagaaaagccagagaccggtgctcctgtgaaaaaagagagggcggaaacaaacggttctgcgcgccaggaaaaagatcccggtcggtggtctggccccaccgcccattgaccccgacgaggggccctccgatgccgacacgtcacgggagcacgaatctcaaggacgatgtcaggatcgcgacatggcgtctttctgttgctgtcacggctgcgtggacggtactgatctggaaagaaatacttgtcaatgtgggctttgctagattgacccctcccattgctttccttgtactccaatctctcgagaggactagcttagtggctcgtttttatactcgagtttatgagttttccgccaatccgatcacgctgccaataattgctttgttagtttcatgtttaagaaaaaagagaggaaaattctgatgttcctgaatcctgttggaccgtgttaataacatattcagtaggtgacgaagggcctagggagattagttttcttaatgacatatgacaacccggcttgtagggcttcgcgattggcatgttctagcggcatgccagaaggggaatggattaattaaatcatatcgaactgttagaactgtataatatcttatctccccgaattagttaagggaagtgataagctttgtcgcataaattattaacaggctaacataatcagagcttcttttgtcgtactgttagctgcttaattaggcacctcaccacgtgatttgtctggacgatccatcggcgtgaatttctcgatcagggctagcgatatatctctctccttttctctcagaggctaattaagcacgcctgttggcttcctctcctgatcaccttgcggtcacttgctacatgcactgcatcatcacggtgaggttagcttgctattttacgagctgtatatctactgatgtaaactctgctgttttctttggaacaatcgcggttatgaaaggctacgttaccccgatacgctgatacgaatacgcgacacggcgataccgggatacaccatcttcctaaaaatatggatacggggatacgcgaatatatatatatatatatataaaaaattgagtgtggaatatagactgaaaaaataggaagcaaacagcatcaaaccaccaatgcaccaatcatcatatatatgatatctcagtacgacagattcacaggctcacagcatctcaccaagtcaccatttattgaagaggcatgcataaataagtgcaagactatacagtagatgaaatcatgaaaataacatagttcttcaaatagatggtagacattaggcaacattgttcacatagtagatga

SEQ ID NO: 3426 - DNA, 1501 bp, Oryza sativa
acgcggaaacagatggataaactgggcgatgggtccaaccccccctactacacgatcaccacgagcgaagaagtacgtacgtacgcggccgcgcgaccatggaagacgccgtcacacgttcggtcaccaaggccccccccttttttttttctcgcgcactttcgcggtttcccctgctttttccccttcacgcccacgttgcactgagtcagcgtcgcgtcctaccgggcaccgagtcggatcacccaaccgtccccggttggcagccgcgcgcgccaccgatcgtggcctcgtgggttgggttgggttggtgccgacgtaccgatatatcgattgatcgatccagccagcctgcaggcaggcaggcagatcgatcgagctgatgggctctcgcgtcggtcgttagctcggtcgtcattttctatggcgggatcagcggcgggcgccctcgatcgagagttgacagttcgccggccggcagcagcatgcatgtgctgtgatcactgatcaggacatgcgcatgtgtgtgcgttatggcttccctgtcagtgatgatgcgatctggcaatgtgtacatgtctcgtttggatttttttttatgtgttgcttttgtgaccatgctctgtgttgttgcgtgggatatggtcatatggagatagacatcggagttaaaaggttgttgggggagctggcgttttgatttcagaggtcaaagtggataactttagtttggccttccattgactatagctaaagcactcttgctgtgacaaaaaaaaaaaaaaggaaggaagaaaaacatgagaaaaggtggagaaactgcgggatatgcgctgggttttgcgtggaaaatattccctatgcacagctagaatagataaggactggaatatacaaataaagaggacatgtgtgtgttatctcatattgatagattattagtgtctgaaaggtgaaagtagcatgtatctggtgcgaaattggtctattcaaaatctaaatcggtatgtcgtcaaattagatatacttggagctcaatggaaaggagaagctagcttcattgttatccaatggcaaatgtatatggatgcagacaccgcatgcatattcagttactgtagtcgtaagtgctttgtagtatatttaactatgtatatgacccccctagtagctcatcccactatgcgtttaaggcactatatcatattcttataccagctggatatgtttacaccatgagaacaaggatatgcgtgtgaaaagtgatgacccaccaaacattgatgagctagctcttttactgtttttttttccttagtcggggaggtgcaagttaggttgtgaagaatgacacaggtcaggccctgcctgcttactttcagtgtttgcaatttgcaaagtcccgttctattggttccacccggacgcatggcaaaagaaaagaatgggggtatcaacgtgtcgtggcattgataagccattcacattagtgtaagtaacc

SEQ ID NO: 3427 - DNA, 1501 bp, Oryza sativa
tgccctcgcccccgcgcgcgcgtcagctgctgcctgtctgcgcgactggtggttggtgctggtgccgtcgtcgttgttattgcggtgatgccaacgcctcccctcccctcccccctctctgcccgcctcgcgtcgtcgtcatcgtcggttttgttaccaccgggggttactgtttactgtcgggttggtgacctggtggtacgctcgtccttggcctttcgggggcgcggcctctccttctcctctcctctcttgtccttggggatggagggggtagagggagttaaaattccgcgaccgcgggggcccaggcttcagcgggttgtgcccggccgcggcgcgaggcagtgttaaccgctcgtgccgtttcggggaagtggactaggcaggcaatgcgattttggaaacggagaggaggtggcgcgccgtcgtttggttttacttttcggtttcccgtcaccagcagccgacgacgcgtcctttggagtatgcacataccattgacttgttggcactgtttgatggtgccatttgtcctctcttcgtttcagcgtactaccctagaatagtactcctacccctgagtatgccaacgaaatctccactcagcatctgttaagccttttttttttccaatagacgacctgcagcggtgtgcacgatttgaagtttcgttgcgcagatgcatttgataaaccgaaagaaagaaaggtggaaagaaaagaggagatgctaaacccaagcacgtaaaaagaacggatacacctcccaggctataccagggtagcaccacatgcacagggccaggaccatcacgcgcccggcacactggcgcagtactccatcaaagctctccccctctataccgacaacggcatccgatgcccaagccggcatcaccacggccgagagctctcagtggtgcccgcgttgcgcttgcgcccccgtatacgtgaaggcctcagagaaaagcagaggaaaaccccctcggcccgatcgagcgacgcagagcgcgcggtccccgtggcgtgcagaggagcacggcacggcggcacgcacgcatctgatgtcgctctgcctcctttggcccctgcgcgcgcgagcggtgcataagccgtcggcccgctcgggcgggcgcggcatgattaagcaaagcacaaagcgcaagcacaaaccacccggtcgagtagctgtggtgtctcgtgcgctaatcaagccggctttcatcgagacgcaggccgcggaccacccatggtccggccgggccccgtccatttttctgcccctgtcagccagaggtagtagtagctcctatagtttgcagctggattgttactgctcctatgagattctccttgctagtacgtgccactagctgattaataagggattaagttgtccgtttaatcgggacggatcactccaagtatatgcggtacagccgtgtagtagtagtatatccgtttacttattcgacgtctgtgttactgtgcgatcgatc

SEQ ID NO: 3428 - DNA, 1501 bp, Oryza sativa
cttaggagctcaagccaagtcctgataattaatctatctattatattattaaaaaagctttgaaaggaggcaccacgttcgctgtgagggctagaaattctcacattaatcggagaaaaagaaaaaaaaaagaaaaggagagtccaagtagaaatacaatctaaaaatagctgaaattcggaattaaaaataagcaatattgaaagaagttttcatataagaacccaatacgagatttatcaaaattcaaaataaaaataaaatcaaatccaaaattagaaaaaggaaagaagagtccaagtagaaatacaatttaaaaatagctgaaattcggaattaaaaattagcaatattgaaagaagtttccatataagaacccaatacgagattaatcaaaattcgaaataaaaataaattaaaagccaaaattagaaaaggaaacatgagtccaagtaggaatacaatttaaaaatagctgaaattcggaattaaaaataaggaatattaaaaaaacagtccatataagaacccaatatgagattaattaaaattcagaataaaaagaaaaataaatccgaaattaaggaaaaagaaaataaagaagagttcaagtaggaatacaatttaaaattagctgaaattcggaattaaaaataagcaatattgaaagaagaatccatataaggacccaatacgagattaattaaaatttcgaataaaaatataataatatccaaaattagaaaaattaaaagagagttcaattagaaatacaattttgaaacaactaaagttgaaaataagaaataaaaacattaaaagaacacaatatggtattaactaatttttttagaaaaaataaattctgaaattagaaaaaaaagatttcaattaggaataaaatttataaataactaaaatttgtgataaaaataaagactattgaaagaaaagaccatctaaaacacacaacgagataaattaagtaacaggcctataaataagtagagttggtggtggttgatatggtatataaaaattgttaatgaaacaccaaatagaatcctaatgacgattaaaaggagggatgtcaggtaggatgtgaagcaaacaagtaaagcggttgcctagacttctagaaagtaaaaagaaaaaaaaaccacattgataattattttcgatttttaaaatcttaatgacaataaaaaggagaagcagtgggcggggtgtataagagtatagttgcagagcctccgacggttgacggaacttctagaaaataaaaaataaattgcaataatagttatgttcgatttttagaatcacaatgaaaataaagagtaggcggcggacgagagctgcagaggggcatagtggcatcgtttgatgggacttctaaaaattataaaaaataaaactacaagtccaatttttaaaggttcggaacttctaaaaagtaaaaaaaaaacaatgataatcatgttcgattttaaaatcttaa

SEQ ID NO: 3429 - DNA, 1501 bp, Oryza sativa
ccgggcgcgtgatggtcctggccctgtgcatgtggtgctaccctggtatagcctgggaggtgtatccgttctttttacgtgcttgggtttagcatctcctcttttctttccacctttctttctttcggtttatcaaatgcatctgcgcaacgaaacttcaaatcgtgcacaccgctgcaggtcgtctattggaaaaaaaaaaggcttaacagatgctgagtggagatttcgttggcatactcaggggtaggagtactattctagggtagtacgctgaaacgaagagaggacaaatggcaccatcaaacagtgccaacaagtcaatggtatgtgcatactccaaaggacgcgtcgtcggctgctggtgacgggaaaccgaaaagtaaaaccaaacgacggcgcgccacctcctctccgtttccaaaatcgcattgcctgcctagtccacttccccgaaacggcacgagcggttaacactgcctcgcgccgcggccgggcacaacccgctgaagcctgggcccccgcggtcgcggaattttaactccctctaccccctccatccccaaggacaagagaggagaggagaaggagaggccgcgcccccgaaaggccaaggacgagcgtaccaccaggtcaccaacccgacagtaaacagtaacccccggtggtaacaaaaccgacgatgacgacgacgcgaggcgggcagagaggggggaggggaggggaggcgttggcatcaccgcaataacaacgacgacggcaccagcaccaaccaccagtcgcgcagacaggcagcagctgacgcgcgcgcgggggcgagggcaggaacccgtcgcgattgggcggacgacgaaccggtcgcgcgcgggcgcgttcgggaatcgtggtggatctgacgccaccaccgccgccgccgccgccgctcggttgctcctctcctcgccgcgccgtcgcgtgcgtcgccgtcgcctccttgcccctagcgggcggccgggcaattccccgcgcgcctgctcgatctgcctcggtggtcaatgcgggcgaggagatgagcggcgccgaggaggaggaggaggaggaggaggtgttctatgaggcgcgggaccgcgtgctatcctcatcatcatgctcctccacctcggcctcggacgacgacgaccacccgcggcgaggtcgggatgcggcggctgctgctgctgcggcggcggcggcggcgctcgacgtgtggacgtcggagccagcgcccgtgcaggaacgacgccggaggcttctccagatgatggggctctccggtgacccctctctggcgcgcctcgagatgggtcgatcggcctcctacgacgggcccatccggccggagacggtgtcgcccatctcccgatccagatcggatggcagcgtgccggcctccgccaccaagcccccgctcgcggcccggtcgcgccaaacatcgtccgactcctccgaggccacgccagggggagatgacgcggaccccagg

SEQ ID NO: 3430 - DNA, 1501 bp, Oryza sativa
tagattttgaagggatgtgatgcatcctagtactaagaatctagacatgagcctgcccagattcgtagtactaggatgcactatctgtctagattcgtagtactagatgcgctacatccctcctaaatctcttatattatgggacggagggagtagtgtataggtaacgaattgtggatagcgagtgcaattacagatgctaagttataaaaaaaataaatataggttatttatcaatagtaacatcaagtttcacataaagtttagatacatttcatagcataagaattataaaataacatcaataagatataaggggtaagtcctacatgccccttcaagtgtcgcaaaagtttgatttacaccctcaacaccaataccagacattttacacccttcaacttatcaaaactggacaaagttccccttagcccaatctaaagtggttttaatcctacatatggcgatagttttgctatgcggctgtccaaccaatgaaaaggccatcgatatattttaaaaagtatataagaccccacatgtcagtcttatcactatcttcttcttcctcccccctccctctaaccaaatcttgatccaagcaagaggacacgaccactacctcaacaccaacaaggagaaccgttgttgccccagttctcttgaccgcgcatcgaggaaccatcgccaccatcgttaggaatgagggaagcagggcccagggcccacaagaccgagcaaggaggggagtgggttttggtggcaacaaggagggtgggagagcagagggagataggaggtgaggcaagacaatgttcgagctcatcattgtcctcgaggggaatgtggtgcttggctcagtgacgatggagggaggttagctgcacacccaatgaggaccgtcatcggtcagatctagaaggagaccacgtacttcaatgtcccctcttagcgtcgactatgttgccgcctgcactcctctccgttggcaccatggagaagatgtagggacctccttcgctcttcttgacagctaccatgtcatgccgttgtcacaaagtgtgctccgaggcagacaatgtatatgccacatagaactaaaaccactttggattgggttattggggtgacttgtttggtttgaaaagttgaagagtcatgaacttccggtatttaagtatctagagggaggtaaatcgagcttttgcgatagttcagactcaacacgaccttagttttgtgaaaccatgtgtggttatagttcttttgtgatgggaaattgacaagtaccggaagtgcaagaagtgtgtgcgtggactaacattggtcagattgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacataaggttgcacacggtggacg

SEQ ID NO: 3431 - DNA, 1501 bp, Oryza sativa
gaggcggtcatcatcgtcatcatggcgctgccggtgcagctggagttgaggtagtcgaggagcgtcgagtcggagtagtactcggccggaccaaggtccagcccgtcgaggctgaggcttcccagcgccgacgccgagtcgacgaacacgccggcggcgccgtcgtcgagctcgccggaggactgcatctgctggtcccatctcagctcggagaagcagggcagcggctggaacgccgccgcggccgccgtcgagccggccgacgtcgacgtgctcgggctcgggtcgatgtggtggtggtacacgttgttcgggacgacgcacgccgttgctgcttctgcttgctgcaggtgggtgtcgaagtcgaacggcgaggaggaggcggtggccatggcggcgtggtggtggagtggcggtggcggcggcggagtggggtcggtggctgctccggccatcttctcgaggaggcgaggcatccaatagcagcggacggcgtcgcggaagacggtgctgttggcgtcgaccttgagctgcctggcctgcttctgcaccctcgtcctccagtagttcttgatctcgttgtccgtcctccccggcagatgctgcgctatcctcgaccacctgatcaatcaaattaaccaatcgatcttgatcagagataattgattttgattgatatatatgtgcagattgatcaaatcaatatgtatacctacctgtttccccacctggaatggagctcaagaatgagcagctgctcctccggcgtcagattcccgcgctttatgtcaggcttgaggtagttgagccatcttagcctgcagctcttgcccgtcctcttcaaccctaatcgattaattaacccaaatttgttcaagattgattgtacttgacctagatgccatggttagatcgatgatgattgcagagtgacggaggactcaccggagcagcgggcgaggagattccagcggccttcgccatggcaggcaatgtagttcatgaggaggttgtcttcctcgagggtccatggtcctcgcctcagctccatcatctcctctgccatggcctcctgctgctgcttgctcatcactcccatgggccctgcaactctcctctgcgacattgctgtctactacctttgcagcagctgggatatatagctatctagagcttcttcttctactactagtagtataaatgttgttggtcagttggtggattggatgatgaggtcgatgtatgatccccttggagggtgcaactcatacaaccatatatatagccatgtacctccactagctctcactagcttaattagcttgccccttaactactctctcaactctcaactctctaggagatcaattagggaagaaaagaatggaagagagcaagcacaagtaagtacaagagaagagggaggagagatgcatatggcctagctgcagagagagagagagagctaaattaagttattattggtggctgcttgagatca

SEQ ID NO: 3432 - DNA, 1501 bp, Oryza sativa
  unsure (1)..(1501): unsure at all n locations
ggtcctacgaatattttatatgattatcctaggaacttatacaggcattcctacctaatctttgcttacttaccagggtgctgtctccaaagtttagtgtttcattggcttttcgggagaaagaactacaaagctatttgctttgcaagcacaagtctcgctgattgattggcttaattntccttnttttggncnttntttggggaaaaaagggtttaagggnnaaaacccccccgggggtttttaaacccccttttattggaaataattctagttcaaactggtagtaaataattaattatgaaacagataattattctgattgaacgcatggttaagtgccataggcccataggcaggtagttgcatgcgtggagacacatttgcatttcactataccataaagtgtggtagctttcgaaaacataccaatgatttggtgtaatatcaataaataaaaacccatgcatgcatatgtatatgtacatgtctctatttgggatttgagcttatcacaaaaggataatatatattccaaaagaaacaaaaagaataacgttttgcattactgttttttttttgcagtgcaaaaggagatcgtggagaggtgtgtggttcaccaatgtgtgcatccaacaatttggtcatctctccatcccactctccctctctcgtctaatcctaacacagtgctgcaagagggatgacaaattgttcagtcaaacacgcttcatgtaggagagaatctaaagatcagtactgggcactatttcttctctcactctctctctctctctctcattccatagaaaaagatggaagctttgacagattgccctgaccttttggtgtgtaacaacgcacttggctttctcctctcctcttccttctcttctcccccaagaagctaattaacccaccaaattaaaatgtacccctcttcttcctacaagtagtagtacttttcagtcttgattaggggcagttgcatgcatgccccctcaaaaattcccttcatatgattgccacaagtcattataaaagggatatatatatatatatatatatatatatatatatatatatatatatatatattgatctcaagcagccaccaataataacttaatttagctctctctctctctctgcagctaggccatatgcatctctcctccctcttctcttgtacttacttgtgcttgctctcttccattcttttcttccctaattgatctcctagagagttgagagttgagagagtagttaaggggcaagctaattaagctagtgagagctagtggaggtacatggctatatatatggttgtatgagttgcaccctccaaggggatcatacatcgacctcatcatccaatccaccaactgaccaacaacatttatactactagtagtagaagaagaagctctagatagctatatatcccagctgctgcaaaggtagtagacagcaatgtcgcagaggagagttgcagggccca

SEQ ID NO: 3433 - DNA, 1501 bp, Oryza sativa
agctacctctaattgcaatattgtttttagataagattgttgaaacatataaattgtaacatatgccactgctactcttatcaacttagtaattctatgtttctaaccatgtgcagtcctaattgaaccaaaattgtctttatcctatcctatcctagctcaactcacagaacaagcaagcacattgaaggtgaacaacaactatggttaagacatcgatccacaaatcataactatatgcaaagcaattcaaaatgcacaagaaaggtctacctgctggacgacggtccacttggtatgcgcagccgcaaacgactgctgctgcacataggaatgcaccaccttcgcatcctcctccacgatgatctccatcaccggattagcccaataacacccaccgtcctcctgaccaaagtgctcctcaatgatggccacctccgcccccttctccgccacaacgagaaccctcgggttcgacatcatcatactaccatcgccgcagccactgtaactgaacatgatgtgcaccgggtcgtcggccatacttaccccctccggcacgtgcacgaccacgacatccttcgcgccaacggcgttgaagtcgaagaagaggtccttgtcggcgaatcccgcggaggcggcgagagcggcggccgcacggtcccggacgtggccaggcgggaggtccgcgagggcggagacgtgggcgcccgaggaggaggtgaggacgccatcggagaagtggacgtgggaggcgtagggggaggcgggcggcgcgacggcgggggcgtcccgggaggggagggagatggggagggagcggaggtaggagatgtcggtgaagcggtaggcctcgttggagcggcgggttggccagcgcgtggagaggagggagagcgcggaggcggagcggagcgggtcgaggagcggcgaggaggccgcgaccgagtcctccagctgctccgcgatgcggaggacgaggtcgtcggagacggccgggaccgccgccgacgacgcgcgcgccgcggatacgacgggcgcgggcgcgccggggcggcggaaccgaacgacaggcgacgcaacgcgaagcggggtggagcaggaggcggcggcgcacaacgccggcgacggcgacgacatggcgagcggccgcgcgaatcttctccaccggtggctgcggagagatgggggaagaagaagggtttggtggtttctacgtgagaatgacaggtgggcccccttgattcagtgcataattgggccgagtggtgggcccaatttggcggcccagtgagtcacagccttatccgttcgcgtccccgccctcgcttcgccgcggcaatggcgctccacctcacccgtcccttcctccggccgtcgccgccgccgccgcggccgactcgtcggagctcccgggctcattgcctcgccccttctgccagcgcgcggggcccgagcttcaggaggccctacacgtccgtcctggtggtccccaccggag

SEQ ID NO: 3434 - DNA, 1501 bp, Oryza sativa
agcgggtccacgtacttgggtaggtccgccgtgctcctcaacggcctcgccgccgtcggcgacggatctgccgccggcgtgtagtcgtcggggtcatctgacgcccaaccccagcgacttttgctgatcacgctgcagatgtagctagggatcaacgaatcactcttacagttaagtattgacatcactgtatcccactgagtttggtagttttttgctgctgcaggttcatccctggcggctgcgacgacgacgacagccgccagcaacatagcggccagctgctgaatcctcggacccatctgcacacgtacgcaataatcaacaatacaaacatcagttcattcatttacaatagtttgattgtgttctaagttaatctctaaccatatcatgcagcaatgtcgtaattaatgtctcagtttctcaccttagctagcagcgtccgagcttggagaggggcatgcaaaggataattaaccgaggagaaagaaagattagctagctaagacaatgacgatcgatgtgtgagcgtgtggctaacacacacgagccacacgactgatgctcttggcaatctgagagggttgctatttataggattattattactgtagtttgaacaggtaaacggtcaattaatcgtgcaggtcagtgacatgcatgcatcgacgctaattggccgaataatttgttggatttggccaacacatcaacctaaactaagtagagaaattggatgcgagtttctacacacaacattttaaatccagagagcttcctctgcatgacccaactagctagctagttaattaattaagctctgcgagattatatatagtcaacacttgaacatagatattcagcagctgctagctggtccttttgaacagtttcttaatcaatcactgtttacttatatatagtttgtcctaatcttggctgtttcctcgtacggcaggaaataatactacataattacagtcacacacacatccatcgtactccgcccatgtgacatacatttacttcttccttcatgttaaaaaaaagtttttccggattttaagttttattcgcatatataagtattttttaatatggatttcaatgcatggaaatccatatattttcagccaaacaattgaaatttaaaatttgatatctgagatactaaaaggaaacctttgctataattaaatcaacatcctggtatctaacgttgatatcatccaacagtcctttgaaaggcctgcttctctctatatctgagttaacaaaaccgatcttttttttttcttttaagaaattaaccgctcaattttttgaaactgtcggtgaccggtttgtaaaagtcaattattggttttagcctttttactaagctggccgagagttgttggtaacgcggtgaggagtggttttaaattgcaaagcgaaaaaggtaaaccctgctctctactctcagccagtcttcaccgtcttcctcaaacccctgctc

SEQ ID NO: 3435 - DNA, 1501 bp, Oryza sativa
ccatgcacgtgatttctcgatcgggatacaagattattcagagcacggtgtcaggggcactctcacttcatatataattatctaagggtgtgtttagttcacactaaaattggaagtttggttaaaattgaaatgatgagacggaaaagttagaagtttatgtgtgtaggaaagtttggatgtgatggaaaagttgaaagtttgaaaaaaaatttggaactaaacacggtgtaacactaattttctttttgttgttcggtagtgtaaaggaggagcggcggataccacgatgttgctctaaaataccatatcaatctattttttaaatttataataattaaaactcaattaatcatacgttaataccatcttattttacgtaaaacacttaacattcatatttatctcatatttataggagaagagaacaccaccttacttctagtaaatcgtaggatttgcatcgattcatcggccgtgtgcttcctcataaacatttgtaaattgtttagtaaaaattagagttaataaaaaaattatctttcaatcgtattaatggtcaaatatataagattccctcttaaaaacacctgactaaaaacaatgtagcatgatttttgtgcattataatcaatattttagaaacgtttatgttgtgatacaaattttaatcctagaaaagcttatatttgaaggagaagttgattatttttaatcacggagggagtaagtatacgatcaatgtgatttgtcaagtgtacacagtacgatcgatgagtgaccgtaaatatataatgcttgccgtacgaggaaacgacagccaatattaggacaaattataagtaaacaatgattaattatgttgttaattataagaaactgttcaaaaggaccagctagcagctgaatatctctgttcaagtgttgactagctacatatataatcttgcagaacttaattaactagttggtcgtgcagagaggtagctctagatttaaaatggactgtgtgtagaagcttgcaagcaactagctaaaatcacatcagcaactaatttctactagtttaattaggttgatgtgttgcccaaaatcaaaaaattattcagccaattaacgtcgtcgatccatgtcactgacctgcacgtttaattatagccatttacttgttcaaactagtaaaattaatcctataaatagcagccctcccagagattgccaagagcatcgatcagtcgatcagctaatctctttctcctttaattcattatcctttgcatgcccctctccagctagctaaggtgacaaaaactgacatcactgcttgattagctacttaattacttatttcgtcttaaaatatagttatgtttattttcaattagctacgaatctaaatagtactgacattgctgcacgatatggccagaaacttagaatgcaatcaactattgtaaaatgtatactgatttttgtcttgttgattgcgtgcagatgagtc

SEQ ID NO: 3436 - DNA, 1501 bp, Oryza sativa
aaataggtggccccctaaaagatgtggtagatccacagatagcaaaggctaatcttaccaaaaaaaaaacaatacaaaaaaaacaaaaggaaaaggatgagctataattatgaggcactaggaatttaatatgtagaggcaggagtgtacgcagttttattttatcataaaaaaattatttcgcaatcgatccactatatccttgtttatttgtataaagcatgtgttctcatgaggcagttatattctcatcatctggtgctgattcctgagcaatgcacgtgatttctcgatcggggatacttagattactgcgcattaccaggggcgcatggtttcaactttcaacctagctcatcgcttaaagaaagtgacacgctcactttcttcataattaattatctgacactaattgtcttggttgccttagggttctttcattatttgtagattcatgtgtatcacaagcatccggactattatcttcctcctgagcattgggccttggctgttcctaggaaagcaagccggagggagagatattgttcgttgagaaagaggatgaaaagaggacaaaatctttacctcgtttttattgatagagcaggggtttgaggaagacggtgaagactggctgagagtagagagcagggtttacctttttcgctttgcaatttaaaaccactcctcaccgcgttaccaacaactctcggccagcttagtaaaaaggctaaaaccaataattgacttttacaaaccggtcaccgacagtttcaaaaaattgagcggttaatttcttaaaagaaaaaaaaaagatcggttttgttaactcagatatagagagaagcaggcctttcaaaggactgttggatgatatcaacgttagataccaggatgttgatttaattatagcaaaggtttccttttagtatctcagatatcaaattttaaatttcaattgtttggctgaaaatatatggatttccatgcattgaaatccatattaaaaaatacttatatatgcgaataaaacttaaaatccggaaaaacttttttttaacatgaaggaagaagtaaatgtatgtcacatgggcggagtacgatggatgtgtgtgtgactgtaattatgtagtattatttcctgccgtacgaggaaacagccaagattaggacaaactatatataagtaaacagtgattgattaagaaactgttcaaaaggaccagctagcagctgctgaatatctatgttcaagtgttgactatatataatctcgcagagcttaattaattaactagctagctagttgggtcatgcagaggaagctctctggatttaaaatgttgtgtgtagaaactcgcatccaatttctctacttagtttaggttgatgtgttggccaaatccaacaaattattcggccaattagcgtcgatgcatgcatgtcactgacctgcacgattaattgaccgtttacctgttcaaactacagtaataataat

SEQ ID NO: 3437 - DNA, 1501 bp, Oryza sativa
gttgagggcacagcccggtaaggtcaaacaaaacccaatgagtaatggtgggccggcccattcagattaaggcctatgtgccggccatataaatccggcccgtttgtcaaaattgctgcagatcagcatctgcgtggtcgtctcgtcccaaaccagacacggcccagtcagatactagtattgcctgccaggctgctaactactcctaggtggctccataagtgagatttgagacttgtgagggtactttgagatactcgtacgtacgtacagtatcaaatagtactgtactatacactactagtactccagtattagcccgagtactagtatcttgttccatcacgttgtggagtaggactgtaggagtatatcccgtcacgtcagacggccaaacgtgggcggtgagacgagcgaacacgggcaggtgcagacgtgcagcgcctcctcctctcggcgcaggacccggccgaccacgaggcaaggcacgagcctcctctcgtcaaatctggttgttctggcagagtggcgtgccgtcccgtccgtgcaacgcattgtaggagtattatgcatgttcctgcataaaaatactcgtattattacgactcgagcggcgtcaagttggcaaggtgttgggtcccgtggatctgcgagccattactcacgcctctttgccgacatatggccacgcccctgtcggcccttaaatgacccttaatccatcgctttctcgactgagatacggctaacacacactttctcctcccgtcccttgtgccacgatacaaatatacaatgccgctatcaccactagtatacacgtaaaatatctgtcaaccacacgatcgatgcacgtcaagtatacgcatactccgtctgtagtagtagtaaaaaaacacgagactaaaaaacactagtaataccatgaaaagtagagattggagagctttggaagctaatagttgtacaaaggagtggttcacgatgtcggcatgcgattttgcgtacgcagacagacaggcgcacgccctcgtcgacgcccaacctccccaagtttccgggggtttccacgtgagccgtccctccatcactggccgttgctacgcgcacatatcgtggaaaaaaaaaactgccaaagccacacaccctggcccggtacgctgcacagcacgactgcacccaacaaaatatcaggaggattactactgctgctcgtttccctgtctacagtacaacctcgtgcgcttcatcaattaattaactcgttaattttcactatctgaagggaaaaaaaaagcggttacctacaacgttgtgtgattggtgcgtttaccggttgcaagttgcctcgccgcacgggctcccgtcacgactcggacctggcccgatacaccgcacgccaggacagaggaggcgacgcgacctggtccgcacataccggctgcgcgcgcgcgcggcgacggcggcgcgccaaaccagccgagccactcgatgctggagt

SEQ ID NO: 3438 - DNA, 1270 bp, Oryza sativa
acaagtcgaatgttttcgggcaccaaatcacatgaagcgaaagggacgcaagacgccggccggtcgaaacgtgcagcccgtggtggccatcccccagcatgcagtagcagtgctgatccgaacttccttttttcccttttgcgtttctgtgtgttttacatgaatcatgtagcatgcatttttactatactatctgctacagtgtgtgaatcgatttgaccgtgttagcttttggcgacaggaagaaaagctaagcgtgaccactaacatatactccctatatactcgtaaaggaaatcatttaggacaatgcttaagtcaaacatggggaatataaatcatgaataactctcaagttgttaagtttgaaaatgtaaaaattatatgaatagatttgtcttaaaaaatattttcataaaagtatacatacatcacttttcaataaatatttttataaaaacaagaagtcaaagttgtgttttggagaccgtgtcgctgtccaaaacgacttcctttataggtacggagggagtatactactactcccaccttccaaaaatccaagacctatttctttctgcatcaataccaagaagtaattaactcactcaccatgtggcaaaaccaatgaacatacaaccaataagcactagagtggcttcttggttttcgatcaacatttaatttagcacatagtgactataaataggacttagatttttggagaaaccaaagaatgaaatagttcttaggtttttggaaggagggagtatatcttaagatccaccggagtgctgtagctgggatgctgtcacagtagtgtcattggcatctccttttttaacggtcataatcaaacatagcgatgattcattaaatagagtagaaaaaattataaaactattgtcatgtaagacaatagctagaaaagaagattaacactatgcaccgataacgcctacgtataatcaaggagaagattaacaccgaatcgatctctactgagcgtgaccggttgccgctagactaataagaaagttatagccgagactgtccaaacctaaactcttcggccaccaactcaaatctatccaagattttgagatctcgttgttcagcaatttgcatgtttatgattctaaacttatagcaaccagtaccacgaaggttacactcgctgtgagacttaacgtcttactgcacgagctgaccatagacatgcgtcacttgtatcggcgttcttttttttttcttttttttttttggaagc

SEQ ID NO: 3439 - DNA, 242 bp, Oryza sativa
tatacgtgtggctggtagctgggcacatcggggctgttaacagcggccgggtcaacaacgacggggcggggcgggggcggccgccggggaggacgaggcgcttggacagcttgaggtcgtcctccaccgcccttgcgaagtcctcatccatcgccgccgccatccttcgtctggctggaggaggagaggagttggaggaggggaggacgaggtgtctccgtcaagcctcctcctcctcaaga

SEQ ID NO: 3440 - DNA, 1501 bp, Oryza sativa
cctaggtaaattacattagttaagagcatatgggtgcagatgtgatattaattaagttactgtgttactcctagctactcctccgtcccataatataaaaagttttacagtttgacatggttattaaaaaagtatgtaggagtaaatggtggaggattgtgattggttggaaaaagaatgttggtgaagaagttgttatgttttaggataaatcttgagagctaaaagttattatattttgggacggaaagagtaattacatctagagactgaatgcctcattgcctggtaaaaaaaatactaatacaagtaagtacagtagtcctactcctgagcagtatagaagaacagtagtagcagtcctgaaactgagaatcacgggcaagtagggaacttgtttaatctctggcagtacgacgtaggaccttcatcagagtagaataatagtaattataataatgagttactgatcgagaggaggagaggtagtactactagtgtagtacaacagcaagtgcaagagatgctgcagggtgacgacgactgtgccgcggcgcgttacaccgtgccgcgattggggctgacgctggtgtacggctccccgcctcgcccggggtccatttgcccggacccagcgacgacgacgacgacgacgacgacggatagctcacatgcgccacggccggcctccatctcaatccatccatcgtataggttgccttgttgctacctttctcctttgcacgtgatgaacttgcctggacgaacaccaattgctgtactttcttctcaaaaatggagctagcttttttttcattgccttttactgttccacttcatccgtttcacaatgtaaattattctaacatttctcatattcatagtgatgttaatgaatttagatagatatatatgtctaaattcattaacattagtatgaatatagaaaatgctagaatgacttacattgcgaaactgaggaagtacaaaacaaggcaggggtatgcagtttggatctaatgttcggtgttcagttctctttggttgttcagcattttgttttccaaaccggtgttaattgtaaaatgtcatgaacaatgtttggcatttgttctagcatttaggtgagtcgtttatagccgtattattcgctcaaacgtcccctgttttgctgctgctgctgctgctgctatttttctgcactagaaattagaaaacgtccaaaaggatatcaaacaaaacaaccgccaaacattaggcgtggactgtctagtatagccgtaaagagaacaaattaatagcatatggcaattcaatcatggggtgccattgttaccaataatgctgtcagatgaatgcttcccaccacaagtccatgctactgctgatgcacaagggtgtgcatccatctcacccagcaatttaattttattttgttacaattaccggattctttcgggctggccgtcctcgttcctcctcatggctgctcgctttctac

SEQ ID NO: 3441 - DNA, 1501 bp, Oryza sativa
atatggcaagatgtagaaaaaaggtaggacgaaagaatgacatattagtgtacaaccattatgtggtatagtgatatatataaataaactccatgaatatgatatgaaaatatgtttacaaccacctcaaaacaatatattccgtcatcatattgtatagttcatgtaaaaagctggaagatcctcgctaaagattgtatttataaaagttagatccatagtgaaaatcaaccaatcaatattttattgtgttgtgattcgaagaaattatacatgtcacaaagatcaacaaatcaaccaaaattaccaaaaaaaattacatgccatatctcttaatatcatgtagaatgtttttggtttacaattagttaatcgttcataaataggaaaagttagggcccatttggtagggctccaatttctaaatttaactccagcatttaggtatggagtggagttgtaaagttgtttaagcccagcttctttcagttcattttgtgggagcacttcaactagctctacttttttttaggtggagatgaaaccgtttggttagatttcagttttaggagagatggagctgaactgaagcggtgtcaaacgcacttaattagatcatataataacagctggtgcaggcccatcaaacacgtcactgtgctatatagaaagtttattgaaccattcccctgcataaaataagcaattggcgcgtggtgaccacggtgtgggaatcgtttggtccatgtggtcagagaggactctgcattgcttgcataacaaagaaagcaaatattaaaagtatagatctaattggaggcagttttggctttcttgggtgtgggaaggtttgccttcatcctcctctcctcgagacctcccaacacacactggatagatacgccaaagccagcctcctctttggccgatgcagctgtagttagtaataattaaagaactaatatatgtttaaacaaatctctggacctaattggtgcggtgatcagctggtcgcttgttccttcatttagtcatgcttgaatttgttttctcggatggcatggcatatgttttgactttatatgtcaatggtttaatggctcacggtttctgtggcatgcatgtcacaaaactttggctgaactttgactcagctgaaacgatgaccaattaatttgagaacctgaaaagatatatatatatatatatatatatgggcaattgcttatttgaccccgttttaaaccctaactaccaatttgaccctactttttgaagtttgcttgtttgaccctccttttctaaaacgaagctcccgtctaaccctgtttccactagtccgttaagttttgatttaaaataaaaaagaaatgcaactaatattcataatatccagaatacccttaggaaaccctatccatccacccaaccttatccacatttctctctctttctccttcctccttcctgctcgctcgacttgtggcggcggtgctagggg

SEQ ID NO: 3442 - DNA, 1501 bp, Oryza sativa
taattacatatataagcaatataaggtaagctcttgaaatctattttctcatttaaatagccctcaaatattcagagtatttatgcatatgtttttttcattttcatttccattttattttagctctttactctggttgagtttccgatcaaatgtctcttaatttgcttatatgtagttaacaattgtgtgtttgtaagttgataattttgagctatatatatatatatattgattgattgacaagttacttcagctaaagcttttttttaaaccaaaaccattgtgggtacagctaaatattttatgtccacttttgatatgatatattgttttactaaatgattaaaatattggatgtgtttgtacatacatatagtaccccctaaattattgtttgcgcagttttggtgtaggattgaactctattacggtaattaaattgcaaccacgcaaaaatacataataatagctaatttcctgaattttactatccggttatcgtattgtagcttgaataaatgacactacccatggatttaactaattggacatggtttaagatttaggcggtttttagtccaagatcgtcttaaccaggaaaactcctaaaatgaagggtctcaaacgtaacgaaaccttatgaaagctctcatgagataaagctagtgaatagttcagtgtctactaccttcgtctcaaagatagtaatctagtacccaatgagacacatcatagtattacgaatacatatatacctcattggggcttaggatgagttttatgtttttcagggcacgcaaaactagaaagctcataaccacatcattaatttagtattaataattataaacttgaaaaataaatttatttgaatttttcaaacaacttctatatagactttttttgaaaaaaaaacacatcatttaatagttcgaaaagcgtgctagctgaaaacgataaagaagccttagttaggaaaacccataaaatgaagaggctcgaatgtaacaaaaccataaacctctcatcagataaagctaataaatagttcaaagttactacccctgtctgtaaagatagcaatttagtactggatagacgacatatcctacattctgaatataaaaagataattcgttcatatccgtaatattagagtgtgtctcattcgatattagattgttttattaacgggatggagggacaagcagagcaaagttatgaaacggccctatacgtgtgctgcaattggacagagaacgtcggatgcgaacaaataaaatccgaataattaacaaaaagcatccatgcctgcatggtgggggatgcggagaagcaacagttccacttaatttgcaaagcctgtctgccatatatattcttcttagtctgaacccccctttggcatctcttcccattttccctaagtacgccgtacctgtctggtcataacaaaggcttatttataaatcagcaacttccttgttaattaatcttt

SEQ ID NO: 3443 - DNA, 1501 bp, Oryza sativa
tggtgctgagacgttggatcatagtgtcatcgggcttgacgttgagttcgtggttcattttaaaataagtactggcacagttcatgtttgaaatatttcttttataaggatcatattgtcaaaaacatctgcaaacttccaacttttccatcacatcaaaactttcctacacacacaaactttcaacttttccatcatatcgttctaatttcaaccaaacttccaattttggcataaactaagggggtgttgggagagaggggctaaactctcacaaaacaataagtccctaggggagggacttatgtttttgagagaggggctctcccaaacaccccctaaacacaccctgaaagagaatattttctcttatccttaatctttatagtaaataacctacaaatgtttacatttagtaacagagggagtaagagtaggtacgtgtgaatgaaagacaatattgtacattacagcaaatgatagattctactctaagctataatctcatgacaagtcgaacctagcttttctgtgtcgctatagctctccgaagctgcgctagtggccttgtcgcgcaattgataaacaacaaaactagctgagatttatttactttggtaagccagtgggaccctttggcatggcttctcttgagagagagacatgcagctagctgagagtatgtactgggtcccatcgatccccatttgattctgatgagcttctgatagatacctctgggcacatctcatgtaggatcggagtagatgaatggtccagcttgagctcggtcttgaaagaaaaatactataccatgctgcagttgctgtccatctccatgcaatgcaatgcagtacagcagcagaaaacgatcagaccgtagcacttgtggagtgctgtactgagtcaggtatagtagccgactatgcacggtgaaaacctacaactatacacacgtacgtagtatgcgtatgagtagtgtagactagtacgatcgactagtagtatacaaccaagagctagctagcgctttagccagcacagctagccagtgtcgttgttcattagtaccagtacactatcctccataatttactcgactatagcatagctagtactcctatgctacagttctcaaatatggacacttgatcgaccacggactcacggagagaatggtcatgctatggatggttggaacctaggaatttctcaggataatttcctattaggcaacgtccgttcgtttgttttcttgctggtcgatcgacttcggttttcaagtactctctccttttcctgaatacttgtcgattttaactatgcgtataggttaacttggaccattgttggagaaggttatatttttgggatcctccctccctgttagatccataaggcacaattactgatcaggacatgagttctaaactacggtagcttgccgctatgagagcctcaattattgggccaagcttcatgtcccatctatagatggcca

SEQ ID NO: 3444 - DNA, 1501 bp, Oryza sativa
tcgattggtagagatgcaatgcacctaataagcacttggattccgagtgtacagggccatcagcaactggataccaatttatttatatatggtttagctgcaaatgattctaggacacttgccataaaacactagttttattgctcaacttgtggcaaacttgtgtgctgctggggctgagtgcatatgcaagtgttcatcctagttggcatgatctcatcaagcttagctcgtggtggtgattaattatatctagtgcctaattacacttcaggctttcctagttgatcttgcaaagcagtagtatatactatatgtgggaaaattaaagttgttcccatggtttcgaccttcttttgaaccaagatagcgtgtaactttttgtttctcgttgcttgattgagaaattataatttgacgacgcatgatagagagcgtgaattacgttgtcacacggatcatcagtccactgacagcccagttaattaattacgtaccggtacggtccctgttttcaaccggccgtcgatcgctcgttcctgccctgttccaagtcaagtggccacaattgttgacgacttgagttaatttgataatgtgcattaaattatgtagatcaagtgcttaattatgcagggcttttgctcccattcttcgacagtaacaggccagttactgctggttttagagcacgtctaactctgttaattttatactgatgaaagcccaacctgcttattggttaatgattggttaatcgatatgttaattgaacgaggtaaaatgaagcactaaaaggagaagaaagacatgtttagatgtgaactaggaggaaaacagaggggaattcagaaggacaaaagaggacttgaggctcaataaagcttttcgcaagtgggctgagaatgtagggcccagtgaggcccaaatagactaattgcgcaacaatatagcccacttgaaaattagcccagatatatagcacaaaatgttgatggcccagaagtttattactctatgttgggcttattctgtaaccgggcctaataactccatattcggcctatttgactatttctctaaccgggggcccatttcgcaagcccattttctgattcatgttctgattctatgttctgattctattccgacattgttgctgcatgatagcgtgttctttgacctacttatgcaagtaaccaaaatcataatggtcagaagatgctctcgatctgctagatatgttacgtactaccactagctggatgatcatatatactgtcaaattaaagctagctatcggcggtgatgagatgatgagaaaatcgaagtaagagaattataccaaaaccccaggtgatgaaacgcatataggcttacctcgtaatgcaagtaacttgagacagggcatgcctcctttgcctcacaatcaaacaactaatttaaccactgtttaatgcttcttctgctaactctcctctcatcaacagaatcatctgac

SEQ ID NO: 3445 - DNA, 1501 bp, Oryza sativa
cctaactcctagagctaaatttaggagttgaaattgtaccaaacagaccatcagatgctctgatttcgctaatgacaggttggtagtgaggtttggcagccaggacgtatttacgtggagccagaaacatcaaaagagggtttggtttaacgctgggccagtgagagtaacgctcgatagcgacctgtgatcttatcctcgcctcttgtttggctttgagatgctagagctgatcaattgatcatgcgcatggcggattagccaaattaatctgcgtttcttatagacttgggcggaatgtcatgatatgcaagaaaggtgtcgtgttgcctaataccgattattggttttggagtctattatctcagaggatcatgtgcggtcttcagctagcattattgtttttgggttttttaagggcacagagtaccttctctcccgttgatcagagttgtgtttagtcgccgcggtagcttttcttttctatagctacagtttttttctttttcttccttcctctatcgccagtttaactgattgtaccgtgtaacaaaaactatttttctctaatatattaacgtacaatttttttacgcgtttgaaaaaaaattgcttttcgagaatgagctcgtgattaatctcccaacggacagctcagcttgctcggttatccaagtttgcacgtacaatcattttgtcatccaagtgtgatgagaagatcatgatatacctgtaataaaactgggtccatttcgatacacagtacagttagtcctgataagcaggggatgctgacacgcagggactctagtaatcagtattaccatttctagttaagccgcagcatactgcttttctatatattaccttcgttttttaatagataacgcaattgacattttatcacacgtttaatcattcatcttatttaaaaaatttacgtaattataatctattttattgtgagttgttttatcacttaaagtattttattcgtgattcaaatcttatgtatttatataaaatttttgaataagatgaatagtctgataagaagtcaatggcgttatctattaaaaaaacggagagggtacatcctagacgagtccaaggaaaaaaaataggactactagttgataaaatagtgttttgaacccccatgagttctatttatacataataatataaaacaggtaattcgtttgtgtgatgagatggggaaatcattattaattcccttaaagatttgcaaagcttaccactgtacaactgaacgatttttgttggtgctggtggtgtcaatttcgtccattttggaccgctgacgaggacgataggagcgtgagtgtgacatggaagaatacaaaatgtgttcaacgcctcacactctagcagccgcgtcagtcaaaggcacgcctaacatgcatccccaaaaaatatattcgatatcaagcatgaaagaatggcatttggcaacatgctaatatgttgttcagatctg

SEQ ID NO: 3446 - DNA, 1501 bp, Oryza sativa
ctccgactccggtggcggcgacagcgggggagggggaggggaagagcgtgggacgtggagaggagggcggctttggctttggggcttgggtggggcgatggaatggaagtgtgggggaaaggaaaaatagatggaatagttggtgttgcttgtgaataaatattgggggcgtgtgcgttgaggccaagtttttttttcttttcttttttgttgttggatgatttttttaaggagagaagtgtgttttctcttgatgttgatgggtggtaaatttggataattatggaactgcatgggggtgtggttttctattttcatgcaacaccttcctgccgtcttctaggtccattctttaacaattgactaaatttcgcggttaagcacagcacggataagcactattttaggatgatattagtaggatcgaatgatggtttttcccaacgttgtctcccgacacggcagttatagcaagattaattgaatattagtaaaaaacttgaaaaatatattaatatatttttaaaaaaagtaaattttcatatagaaaacttttttaaaaaaatataccatttaatagtgtaaaaagcgtgtgcgtaaaaatcgaggaaattgagttgggaaagaggagaaaataacatggcctttaggcagtcccaaccctctacctaggatggtgtttatggcattaattacattgctatgtagaacttttatcttatgtggcactatattaattaagagagagtgaagagaggaagaaattgggtctcatgcaagacacagctttaacacgagaacctatgcaatagacactatcaagttttgcattgggagagaataatgtcttcataatagatgaagaataaatatgattggtagagaagatagatgatgtatttattaatggcccactttatgaaaccatgggttgtgaagtgtagtttctattgtgatgtcttattggcataacatcatagacactacttatggacattatgagttgggactgcccttaacctctactcctatttatatgttctttcctcaagattcctagcctcacctctcatgttatccatacacacgctttccaaaatactagactatgcgagttttttaaaagttaatatgcaaaagttactgtaaaaaatcatattaattcatgttttcaatttttaagttaacacttcattaatcatgtgttaattcatcgtttcgttttacgtacgacgaggatgatatcctaacctcttcaaaataacaaagccttagaatttgattaaacatacctttgtatatgcttggtgtatttccatgtttgttttgtgcttcacaaaacagcgaacatattttattcacgggatataaaatatctacttgagtgtagtgatacattaatatcttaaaagaaacaaactttacaaacaacttaggacagttgtctaagcaatttaagattttttttgacaaatcctatttttagaaacataaagcaaat

SEQ ID NO: 3447 - DNA, 1501 bp, Oryza sativa
ttcataaagtgggccattaataaatacatcatctatcttctctaccaatcatatttattcttcatctattatgaagacattattctctcccaatgcaaaacttgatagtgtctattgcataggttctcgtgttaaagctgtgtcttgcatgagacccaatttcttcctctcttcactctctcttaattaatatagtgccacataagataaaagttctacatagcaatgtaattaatgccataaacaccatcctaggtagagggttgggactgcctaaaggccatgttattttctcctctttcccaactcaatttcctcgatttttacgcacacgctttttacactattaaatggtatatttttttaaaaaagttttctatatgaaaatttactttttttaaaaatatattaatatatttttcaagttttttactaatattcaattaatcttgctataactgccgtgtcgggagacaacgttgggaaaaaccatcattcgatcctactaatatcatcctaaaatagtgcttatccgtgctgtgcttaaccgcgaaatttagtcaattgttaaagaatggacctagaagacggcaggaaggtgttgcatgaaaatagaaaaccacacccccatgcagttccataattatccaaatttaccacccatcaacatcaagagaaaacacacttctctccttaaaaaaatcatccaacaacaaaaaagaaaagaaaaaaaaacttggcctcaacgcacacgcccccaatatttattcacaagcaacaccaactattccatctatttttcctttcccccacacttccattccatcgccccacccaagccccaaagccaaagccgccctcctctccacgtcccacgctcttcccctccccctcccccgctgtcgccgccaccggagtcggagtcggaggaggtctgggtgacggcggcctccacgcgcgcgttcgtcgtcgcggctttgcccgcggccgcggccatggtgatctccgccgagccgcacccgcctcctcccccggatcccgtcgcggatggcgccgcggcggtggaggcggcggcgtcgagcgctcgccaccaggccgcggtcctctcgtcgttcccgtcgctgaagacgtgggggagccaccgcgtcctgcggtgcgcccacgtcaaccgcgccggggacgccatcgcggccgccaggcgttccccggagcagctcgacggggtcaaggagcggctcctgctccacctccgcgaggtggatgggagcgacgtggtggccgacgcggaagttgcggcggcggtagccgccccggccccggcggcggctgcttcgcgcccgtggaagctgcgcagtcgacgtcgcccggcggtcgccccggcgtcgagcgcgtctccgccgccggagcggagggccgcgagggcccgcgcggaggccctcgacagggcgcggttctcggtgacgctgacgagcgaggagatcgaggaggacgtctacgctgt

SEQ ID NO: 3448 - DNA, 1501 bp, Oryza sativa
ataattcattaagggtatgtatagtgtggcttgtgtaagctcttttagtgaaagctctgctgatattatgtagtttcaatgtaacttttaaccaattggaactataattgcatacaagctagttttagaattacattgttgttgttcacctcctcggaggcttcgccttagggttttgctcttcccgcggccttctgcggttcgtaatcttttttgcctcaggctttctgtgtcttttgtgtaaggtttttgccggtttcactttagcaaaccgtgcagttgtatggtttttgggcccgttccttataaacagggtcaactctatcattctaatatattcggcaatactcttgccgcttccacttaaaaaaaagaattacattcaactcagaaatggaggtgctcatatttggactaattaatttcacattagtttgtgccttttgatctggcaaccaatatttataattagatttaagtgcgagggtaccggaggacgtaagtagggagtaccggcgtcccttagagacactgtatatctctgtgatctgtccaaactatatatacatggggcttgcaatatctttgtgcaaaaaaacaacactacctcaaaaagcaaattaacgtacccctgccaatcagtggtcctcaatcataggctagctgaacacctacttcttacacatctgatcatcttaagtgtcaagcacatacactagtactagcactgctagctttgtaagaggtgtcccttgtcctcatgcagcactagctagcaagcaaagtcattcttgctatacccaaacccaacccaagctagggatgagatgagagggcttcactgactcaagcttgtcaaaaaggacggcgttcattctcaaaatgtcaacccacaggcctctcccattcattgacatcaatcttcatacatagtactatcatagtaaaatgatgtatatgtatatatatgtgtagtttacaaacgaggtaataaatagcttttgtagcggtcattataacgatagtggatttttacactggagtatatagcaacctctattgcaaccactacaagtagcacaacaaatatagcattttagaacttaatggccgttattgctcttaacgaccattattggctttgttgggctattattacacttaaacaatgttcttcacatatggataggagaaacttgaaagacaaagaacagctatagagggggggggtgaatatagcaattcaaatcttgcccccgaaaatactcatcaagccggatttctcaaaatccttactagaaccgcggctattagagaagccggatctagaaaagaagagagcaaaagaagagagaaggaattcccgaaactagaggaggaagagaaaaggaattcccgaaactagaagagaggtgaggaagagagagcaaaactcatcatcgcaaagttcaaattgcaagcggaatttaaattgcggaatttaaatggacaaggcaaaaat

SEQ ID NO: 3449 - DNA, 1501 bp, Oryza sativa
agggcgcgggggaggggcggccggctccatggcgatgcgacggcgcgcggcgcgtggggcgcgaggcgcgaggcgtgacggcgacgggcgcgcggctcgggacggctcggggctcggcgggcggtgatggcgacgggcgacgcgacggcgacgggcgacgcgacggcgacggcggagcgtcgacgggacggcgacgctgcgatgggacggcgcggcgcggcgcggggcttggcgcgcggcgatggcggcacgacggcgacgggcgacgcgatagtgacggggcgtgacgcgcggaggggtggggctcgaggcgatgcgaccggagacggcgacggcgcgcggcacgacgagacgcgagggggcgcggcagtggcgcgcgcggcagcggcgaagtgacggcgcgcggcggctcgaggcgcgaggcgcgcgcgggaggggagatgggacgggcgcgcggcggggcaggggcgcggggcacgaggcgacgacgtgacgacgacgacgatggcgcgcggggctcaaggcggtgatggcgacggcgcggtggcgacggcgacggctcgacggcgacggcgatggcgcgcggcagcggcgcgggcgacgacgatggcgacacgagcggcatcgggcaggagaaggaggaggggtaggacggctaggaactaaatcgaacacctagggggctaatgaacagtgctagccggctatttaaccctattttagcctattcctatataaattttattctataaatcctaatttttacacaaatgaagtttactcaatatttgtgttattctaaccaatggattcaccctagattaatattacccatatttatttatttatcgcacaaatgaattctttttagattaatttgagttattggccctaaggtgaacttatatatttttgaagactttggggtactattaaatttaatataacgacttgtcatgattaatacattagcagattggtcaagtttagttgtatagcaatatattttacacggataggttcaatctatttattctataaatagtaaattgagactcggcacaatattaatctaattgtttaattaaaacctcacaaaattttataaagcttaatttaattatatgaccattatttcatgtgaattggtttacctttatatatatagaccattagagtttagtaatatcccattaattactcctagtgaaactatgttatagatagagttccattataaatggtcatcatttcatgtgtatttagacgtcatggcacgcaacacatggttcacgtatttagtatttaatccataatttaaattagtaattaaccttccgtttgtctggctttgttttcttgtgcgtaattatttgtagggttaacaatattatattctcgtaaatttatctattacttaaattttagatccttactttactttctttgtgatcatttacggtttggcaagcaatagcaatcataacaaccagcatgatgt

SEQ ID NO: 3450 - DNA, 1501 bp, Oryza sativa
atgtggacaatttaggtagatcataagtataccagtactacatatatagtataaatcaatacactatgataaggtgggataagatcaaagtgctattgatcacatggaaattttatgttgcgttgtgtatttgtgccaagattaaaaaggtaaactcgtggaacttatcaaagacgaatatgcaaaaatgtatacatctattgtgtcatttatgatttttatcgttgatatgatcattctcattatgtctatctatatcttcgaagtacaacaggattgaaatagagctactccacataacaatatcagaatttaataagaagtcagggacaactacaacattgaaaaaaggaaaaaaaaacagtggagaaccctcgttatgagataaaggtggcacaatgtgctatttataagtaaaaatgtatatcaagtacaattgtacttatatcataacattgcgtagagaactctgttagctatacatgaaggaataactcttttcaacattaccatttattaataataaataatcaacaaacacacacgacgtattgtaaaattggacaaatcaatattgctataggaaagtgaggcatgccaactactatgacacatcacagtaggtcaacatcatctctctcatctctagtagtactaatagacttccaacaacttccacctatatattaatgataggtaatttgacattcaaccatatgttcacatatcgcttcatgtatttaccactagttaaaaaaaatccatataccgtttatcgcaatattaacgtacgatattttttttttcatgccatgtaattcacgtcagaatcatacatttcacccgcccataattaaaaatgcttagtattttataaggggtaagaacgaggagaaaactagtaatgccacgcatcgtattatccaatctgagataccataacttatatccacatttatatttacgctattcgttaccaaaaaaataaaaccctagcttttttattaacatgtgagaaggtaaaccggtgaaacctaacaatatgtccgacagacaaaaatgtgctcatagtgccatatatacacaacaatattatcccatccatttacaagtatactcacatccacatcatcatggtctaacagaatccatccagaggtatctcacctgaataaaaaaggagcagcagcaaaaaaaaaaagtgagaaaaaaataatccaacaagaactcggggaagaagattacattacatcggaaaaggagaaaaaaaagagagagagaagagcccgaaacaaacgtgacaccaaagtgggtagtagacacagaggtggcgcaggcagcacacagaaaaccagcgagattttacacacgcctcgccctcgcgttcgcgtcgacgggaataaaatcccccgcgtctcctcttctcctcgcgcaactcgctcatctcatcgctctcgcctcgactcgcctccacgaagcccacctcgactcgccatggcca

SEQ ID NO: 3451 - DNA, 1501 bp, Oryza sativa
ctaacattatctttccatccaatcacaatcctccaccattcaccacaacttgcaccatttaattatatatactttcttaataattgtgtcttaactctaaaacttcttatattctgggacggaaatagtagtaggtacaaaatctgatagggtcttgtcagcaacctgtgatgtgatggagagttcttacaccctagaaatcataaaggcaaaatcttatcttgatcaatattattaagaaacttataattcttttgtatggtcaatcttatctgcctatatgcttgtacggttaattaattatatatctctgtattgtggtaattaatctgcaggaaccaccgggcttctgatctgggccgtgaccctcgccgggctcctcggcggcggcgccctcctcgtctacaacaccagcgccctcgccggctaaatttcacccaaatccagtctatgtatgtaacaccaagctgggtgtctgcatattcatctgtaatctaagatagccttcctctgaatgcgatgtgatgatgcccactgcttaatcaaactgcattgtgattaatctatgtaacactgtacttgcatgatgatgatatactacacttgatacttgaatttggagattaattgttgatactaaatacatagattacataaggttatcttgcattattgggccttctctctagtgcatatagttagctcaatgaacatgcaaattaaagtgagaagagtaaaatatccaatagctagttgactctcttacttattacggatcccaatttaaagctaaggactgaatttatttggattggtttatgtatggtccagtcaagtactcctacttcactccagatatgccaagggacaatacaggcatacagtgtgtggttcagtctatgtctagctatcttaggtgaaaacgatactactaccacatgaaattctaccagcagaggccgtagtacagagctgacgaaaatatgtggaccttcttgtcccgtgaatagttggatatttacgtggacggacaacccctgtcaaaacagttttcacaggcaaagtgagataaaagattgcctccaagtctacatgtcggtgagagatgaatatttttgagacaacatatagttgaaatcatgggctatattacataaaagttaaccatagattttcagcacaaaagataacaaccaaaagtaataattaactagttgggcctactacaacaaaaattagcaattagctacctataaaaaactacttccgatgaatctaagtgttttcatggggtcttaagatgcccgactaggtaaatattcatccccaggcgctgttcttaattgcctgcgtgtgacttgtttattgtctgctcattccactacttccactacatgtagttctatcatgatcatgcgggctcctctaaagtccaaccgctggactctagtcacgttctccattaccacgccgtgcctcatcatatctcactctccatcta

SEQ ID NO: 3452 - DNA, 1501 bp, Oryza sativa
ctcaacaggtggcacctcctcaaaggtgccggttccaaccaacacctttatggttcgaggaataaaaaaaacaggctcaatgcatcagctcgaatcaagccaatgcatcgagcagcagagaaacccaacgtccaagcctcaaattgttctcaatcagtcataaattgcttttcaacatcaaaatcactaagtgaatcacaaattttatcacaaaggatcatctactacccaagcactagatacccatttcagcataaaagggataaccaatatcgtttttacaaccaatatcaacaagtaagaaatcaacaaagaaagccataaaaatcctcttgccacgcacgggaaggagccacgacgctgctggtggtcgccttcatcatcatgacacgtggatctagtagtcggtgcctccgccatagtagggatggcaggatccaactccgagctcacggtggccaacgggccatagcaaggtgaagaccaagagggagcaacagagggtgtagatctggccatccccaaactcgtggaggcgttggatatggcaacggaaaggaggaggccgcgcaccgttggtgggaggccgggggagagggaaaggaggcgatgggcggagagaaggagagacaccattggccgccgagtgccatcgagggggacgccacctgtggagcgccactgatccctggccggccgtggcgcatgggagagggagaaaggatgatgcagggagaccgatagaggagagaagataaggggtagagaaggggtaataaaaaggggaagagagagagccagtgggtttggctcggttttttaataggtgaaaaccgtcacctataatataagtataggtattggtttttatagaaaaaccagcactaatactactggtattggttttagttagaaccggcacttatgtttcacaaatgtgtcggttcttgccttgggcacctcgcggaggtgcaccttaggcggaaaaagaactatagatgccggtcttagttgttctgatatctattttgctgttcttttttgttttgcgtgtttctgtagtgggtggcactgcaacattattaatttaacttatatatccgtaataggttgatttagtagtatcgggactaaccgaatttaaggtgtttgataacttttattgaacttcctctatgaagcaagaggacgaaagactgaaagagggaggtgattaattagtttagtttttttttatttttgttaccatttattggaattgaatatttaaacttacatgtttaatgtttgtacaatgatatatattacatattaatctatattatcaattcttttaaaaatatcataaccgtttagtcgacatgatgtaggacataaggtggactttagtccaaaaatcaaccatatacattatgagaaatatcgcaagtgacattaagcttgaggtttgggcgccatcgggaaaaaacaaaccgtttgtatttgactctcttccctcaga

SEQ ID NO: 3453 - DNA, 1501 bp, Oryza sativa
caagggtagaaaaaaatacttcacatatgctataaacagaaactgaaatacttacaacttgagaatatcacaccacatgcttaatttttttgtcagacaacactaagcgcaactattttgcgctaagcacaacactaagcacaaatcaaatacagcttagattttgcactggggcgatcgagatcagttagccacattaacagatctgactcgcagatgaatgtttccgaaaacaaattaaaaaaaattaacacaaattacaacaaatgaaaagccttgaaaaaatgaaaaaaaaggtatactcgctcaccttggtggtcgatttgccctcatggcttactacaagtttgttggtatttcttaatgtcacagataaaatctgcaagcgcacggaagataccgatgtagcactccacccagtagtattccaaggtatcgaatccacagggaacgtgtgtgctcaactcctcgtcaggttcatccaaggacacgaagctaaggataggcaaaggatagagaggatttaccgtttagaaacagtatctacggaaagcttagtttaatcttaacatgatacttcgggcactagccagcccactgctcccagatatcgctctactgcgtgcccggacatggaggacttaagtgatcttgagggctatcaccacctttacacccacctcaaacctattgtgggatacggagcaaacaccggaaatcaactacctagacaccgcgtttaagcaattaataactactatagtatttataactcactaaagcaatcactatattttactaaattatagtgaacgatgatcccgcacgctgattaggatctaaccaaaaggtaattctcaccaagcaaaactaaattacccaaaagatatttatattataatcagagtaattaacagagcagaaaaaaataagaagagtattacggacaactccggaactaatccgacttcttctactctactctatctctaatctagtacaatagagcctcttataattcagcttaagcttttatgtgtgttggaatgaaagatgagagtggtatttatagtgtgagcttgcttgggagtgtggagatgctaagaaatattctccatggaatctaaagagcatcttccttctccctttgccatgtgtcccttttgatgacagtttccatcggtattaacggccacaaccgtcataggatgagggttacaaccgccataccgaagttgggctagattaggctagctgctgattcggccgaaccctggctggcccatccagcccagccttttctctggtgttctaacatgtgagtcccactacattttctactagagattggccaaaataaatctatcttattgggtttgtgggctcaaaactccatagggttggatatggaagttatattcttcatgtacatttcatctcaacgttggtgggttgcatttacatataaatatacaccaacactcgtggaaatagttagaaa

SEQ ID NO: 3454 - DNA, 1501 bp, Oryza sativa
ggcccgtttatgaaatatgaacacgagcatagcataattaattacccttccagtgggtaattaaatcaacttaattaaattagggcagcatgacactgacgtgcctatcaaatatccaattaatcgggatgctgatgggcttcttctgggccttgaccgccctctcatgggccttctccttcatcctccggatcttctgcggcagctcgcacacgtagtcccgcgcgcgccgcccttcgccggagagccccgccgcgagctcctccacgcgccactcccgcaccaggtgctcgacgatggagcagtagtccgacaccgtgtacgtcccggcctgctcggcgagggacacgacgcaggcgtagaggtcgtcgcggcggccgtcggagatgggcgaggtcggcatggcgacccctcgccgtagcatgcgcgccaccgcgcgcacgccggcgtccgggtcggcctcgaggagcctggagacgatgcgggtgtaggcggcctcgtgccgcttctcgtcggcggcgacggtgccgcagacgcgggcgagggcggcgtcgccgtgccctcgcgcgccgaccagccgcgccgtgttgccgtgggcgaccgccgtggcgcgctcctggaacgccgtgtagacgaaggcgtggtacgggctgcacggcgggtcgacggccatgccggagcggatgaggcggtgcacggcgcgctccacctcggccatgtcgaagcggccggagaggtacatgtaccggttgagcacgtcgccgtggcggttctcctcggcggaccacccgcggatccaccgcgcccacgccgtggcgtcggcgccggtgaggtcgccgacggcgcggacgcggttcagcgagctctggtacgtgggcagcgcctcctccgtcaccatgttcgccacgaggcacaccaggagcaggtccggcacgccggcggcgcgctcccgcagctcggcgcacgccgcgtggaacccctcgccgccgagcaccgccgggtccgggagcaggtccgacggctgccacgccgcctccaccggcttcagcagcggcagcacgtgctcctccacccacggctccatctgcgtcagcacctctagcttctccggcgacaggtagctcctcatctcctcgtcttcctcccgccgcacggcggcggcgacgtcggccgccgccgacatgatcgcgctgccactgacagcactacccctgcacatcctgcatgcatgagcacgacaacttgcaagttgcaactggtaatttatttctttctcaaccagctgaaaataaatttatgctttgatcaaatcgatgaaatttttggtaagtttgcaaacaatatgtcaagtaagggagtgcacatttgttcttcgatgcagagatcgagttttaatatattttctaaagggttatactttcttcatcatttttaatgtgacgttggttagttaaaaatgaactaatgaacgttatttatatataacattggaagtatgtct

SEQ ID NO: 3455 - DNA, 1501 bp, Oryza sativa
gacatcctccttttgctccttgacatcattggcccatcaaaaaactactctcacaaatcgcattgtatttttttacattattggtccatccaaaatctacccccacaagtcactgtattgtaaaaaaagaaacatgtaatcaccaacaaattgaatcatgtttcctacgcaacgcaagacatcaagatttttttactccgcgttcggttctcaatttcttatgcacctatttttttttctttagaatttttacggtacaatatactctagtaatatataatatccggggacatctcctctgcgagtccctcctaccattgtgccgtcctttgtggcgccgtccgtgtggagctgggtggcgcgcggccctatggccttggacggagcaagctcgtttgttgtgggctccctctcttcattccatgtaggcagtaaggatggtgccgcgagcctgtagagctccgcggatagcatcggcgttttcttagagtccaactggatatccacctacgacggcgacaacgcacgccatgcggtggcttggagcacacaagagaggggcctctgcagggtagggaagcgaatttgagagaaggtggaagtgggagtggtttatggcaacaaaggagcaggatgccgagagaagcttgtcaggagccctagcactctccaacagcggtgctagcagtggtcacctcaaggtgctctgagccctggtgctctcccaaattaagagaatttttacggtacaatatactagtaatatatattaacattataaatgagggcacatttggaattcgctaccaaatttaaaggggtatttagtaattcgtgattcctcttcattccaatcgtcaaatcgatcttagatgcctatcgatctggagcggagagacgacccatggcattgaccgaacgacaaacatcggcggcggtgtgtaggcaacgacgggacggtggggaggccaggtacagcgggaggcgcggctgcggtggtgggcgtgttggccaacaggtgggcggcatagcacgtgccacgtactgctgctggcagcaagcagagcgcataaccatgaggctaagaagctcgcagttgaagccatttgcagctacaatctatgtcgttcgatcatttatactactagtatatatacttgtagtatattgtaccataaaagttctccaaattaaaggtgcagttgagttacttgttgttgcgctgcagaagctcatcggtgatgcgtccgcgctgccctgctcagctcggccctatctctgctgtcaccagccgcacgatgcgtcaccactaccgacaacctcggcccaagacactaccaccaccagctcacccttgccgcttaggtgctagtgaggccttctattttttctatgagatttacatgtgagtcccatgttggataaagactagccaagttgtcaagttagctaaaacgctttctaaatcaccgagggggtatagtttgcaccggttttgata

SEQ ID NO: 3456 - DNA, 1501 bp, Oryza sativa
taaaaatctaccgtacattcaattttttttcagtaatatttaggatgcaaattttttttgcacaaatatatcgtcgatctcgcataaccgttgcacaaaaatgatgtgggcgtgacatcgtgggcggtatcgcactgggaaagtgcaagaccgtgcgctatctcgtggaacggaagagcgaaaccgaatggtctcattgagccagagagcgatactggatttcaaaatggttaattagttattaattattgattaattaataatcgctaatcaagataattaatcactatttattattagttaatagttaattaggtaattaatcactaatcaaatgaagccgttgggacggtgtcgctgattggttaccgttcggtctccctcttccattccacgagatcgcgtggtctcatgccgttgccgcgcggtctcgcactttcttcgcgcgatatcgcccatgacatcatgttttttttgcgcaacggttacgcgagattgacaatatatttcttaaaaaaaatttacatcccgaatatttcaaaaaaaattgaatgaacagtatatttttaaatttaattcgagtatctctaaggtactacaattagacctcaagatatcatgcatgtaagctatttctatccatcatcgatatcatataaaaatgtaggagtatcattgagtatcatgggcgaatcacgagtatcaacattatgtttctatatggtgcttgattaatacagcttttcaattttaagctgggtgataatctataccgttttgcacctggttggttcaacgtggcatggttttttttccctagctaaaagttatttttggttgcttaattaattgagtcatgcacatgtctctttaatttggcttatagtacacactaaataaaaaaaaagctcgaataagacgtacgccaaggatttgacccggttgattaatttgacgtcgatgctactaatagttaaccttcttggaaaaccttaatttggatggtaaccttaaccccacgtttccaaatgttagccgagcatcctagctcccgaaacggaagaaaaatataacctgaactttcaacactagaattccctacctaaaaaattgcagctttactttaaaatttcattgctaaaatagtgtagttttagagtagtcgacggtacgtatacttttccaatattattgtattttttcctcatttttggtaattgaataaatactttcttctgttccttaaggaagggcataatattcttttaacatatttgtaatctaaatttgatttagttaatactatacttatttaaggtacagattctgcatgcaaaaacggtcatcgcacgataccgcgagccaggcatgcagtcagctagctagcagccaccaaccaattaaaacattttaattaagcaacagtatatataattaattaattaatcaaattaacacaagctctacacacatcgatcgtagcatatatatacccacacgt

SEQ ID NO: 3457 - DNA, 1501 bp, Oryza sativa
tcgatcgagaagcgaatatctttgcaaatttgttaccttgctgatgttcttttccttgctaaaatcgtcggaatataatcgtagttaatccaatgcgcgcaagcccctttcgctcgccggccggccactcggacaaagcggcgacagggagccggctggccggccttgtcgttcttgtgctcagctagctagctgtttaagggcttatttcgagagctcaagattctgaggagtaactggcggcgttgatagttagtttctaattttttttaaaaaaaaactaggttttccaattttttgtttagtagttagaagctcttaaataagtcctaagtgtaaatgcacaactagctcgccaacagctgagatatcgagctagtacctagttgcatgccctgatgcccatgccacggcgtaacgttaacgtacgtgtcgtcggtacatggtagttttcatgggatctttttgtacgtttttgctagctagttagctagctgcagggaccatgcacgtaagcaatcacacggcgatctctcgatcggtcgactgatcgatcgattagctagcttaataattagcttggacgatcggtttgcgagtcggcgtcctcaactttggccagctcttgctgatgacatgacctgtatggtacacgacgtacggcgtcgtcccaaaactcgcagcccaattgtttgattgttagcttataagccacaatcaaattagttttatgtgtgttctaaaacttaattgagctggttttttgaatttcttttcttaacgatggtttatttttcaccatccacttttaactcatcaagaacacaaataaagctttatttattctattgttttgtttattttcctatgagtcatcagctgttgaccaaacgatgagactgttgtcactgacgtggcagtggcacaacacgtataccggcaggggagggcagggtacgcaacgtacggtacgttgcaccggtcgcatgcaccatgcatgcacatcgatcgagtcagctgatcactcacactgcggactcaccctgcagctagcggccatgagatcagattggatggatatgatggagacgggcctccaaacaaagcaagttaagctatctagctagctagcgaccgagtgacgacgcttatctcgttatctcgtttgtttgtcatatgtaacacgtatgaataccgacgaggaagcgtatgtgcactgtacatggactggttatcaacctatgatttgatgatggtgggacacgcaccaaccaatcaatctccatttttacctttgcatggctaataatatttccaacttttgtatgtaatagggatacaagcgggacgggcaaataggtttttttagcccgcttcttctagtttatttttttcttctaaattttatactactatatgggaaatgaactagcaagcgggtttttatacggatagcgggactacccacttgcatccctaaattttagtacttttctcataa

SEQ ID NO: 3458 - DNA, 1491 bp, Oryza sativa
tttgagggggtgaaacggcgcgcgcgatagtgggggggcacgcgtaaggacttgggatagagggaagcggcggtgacacgtacacgatcggtggtggtaggggtgccggagaggggcacgggggcgaggcggcgttgggtgcacgttattaccatgcacggatgcgccggttggcagctaggcgtgcgcgcccatgcatgtgcagaggctagcgtcgcgtcggcctgtgtaattgtctacgatcggaatactaggtaggcgcggagcatggtgctcgcgccgcggggcgcggctggtcggctcggcgcgcgctcgcccacagctagcccggcacgcgccgtcgctgcgtcgctcacgcggggctcgtgcgcgtgcgggcgtgggcgcgcgcatgatgctgctcaccaaccaatgcaacggcatcggcggatcgacctcttcctccgtatcccttgtttaatttgtcgctcgttcgatcgtgtgcttcatgaagtcctctggcaaatgccgcaacggcgctgtttgaagagttttgagatttttaaaagcagctagtagtagtatttggggtctgtttggcatagctctagctccagctccaccccttccggagctggagctcagctaaacagtttcagcttcaccaaaactaggagtggaattgggtggagctctcacaaaatatactggagttgtggagctgggtttatgcagctccataactccattccagactcaactcctggagttatatttagtagttggagctgtatcaaacatgcccttggtacagctccaactcctaaatttagctcacaaattggatttggagtggagttggagaacaccctaaacacaactccacatttctactttattttgtgagaacgcttcacccagcttcactcctattttaggtggagctagaactgtttggctgagctctaaaactcgagttggagccgtgccaaacataccctagggccttgtagagctccaacttctaaataactacaggagttgggtctcgagtgaagttgttgagctgtctaaacctagctccacctctctagttcattttgtgagagaactccacccagttccgctcccattttaggtggagctaaaactgtttgattgaactccagcttcaggagagatcactactagaaaaatcatttttttcaggcaaccaaaaatcattttcgcaggctcccgtcacccatatataaattttcgcaggtggcctagtcacccgcctgcgaaaatcctctggacaaacaatgccgccaccgccgccctcccctggccggatccgggaggggaggggagccgcgccgccgccgcccaacgtcgtggaggggagggggaaggggagggtgcgtgtaatgtcccgcctctcccaggctggggccgcttacatctggcagccttcataggtcatagactaccctcacaaaccaacacaagtcttttctgcgcactctcagg

SEQ ID NO: 3459 - DNA, 1501 bp, Oryza sativa; identical to SEQ ID NO: 3457

SEQ ID NO: 3460 - DNA, 1501 bp, Oryza sativa
acgagtgaggccgtgtcggactcggtcacgtcccggtccagcccaaccacccggcccagctcgtcgtgcacccgagcctgcacgtcctgctgcagcacgagccgggctaagacccactcgatcagcacggccaccgtgtccgtcccgcgaaacaccatctcctgcacacgtatcagaaaaccgatgagaaaacatgcagaggtagtcgccggcgagaaaggttgggttcttcggtgacgtgacgcacccagagaacggcgaccatgtcggagtcggcgagcttgtcgctgccctgcagggagagcaagacgtcggtgaagtcgatggcggctgcgacgggagcagatgagcgatgctcgtcgatgatgcgggtgacgaagcggttgacgcgggggacgaggcgggagcagcgggcgcgggtgctctgcaggtcgaagcgggcgagccatgggaggtggtcggaccagttgagctggccgagcaggtcgtagccttcgtcgacgagggccctcagctcccggacctcgtcgctctccttgccggggtccagctgcagctcgtaccgccggccgaacaccgaccacatcacgttgtggagcgacgcgcggcgcaggacgcggcggacctcgacggcggcgccggcggcggaatcgccgctccggctccgctgctgcagcttgatggcgcggaccatctggcgcgcgatgaccgcgcgctggggcgcggacgccgcgacctgccacggggagaagaggtgcgtggacgccacccgccgcagcgcgcgccagtacgcgccgtggggcgcgaacccgatggcgcggtggaacagcagcccgtacgcggactccttcacggggcggtcggcgaacgccgcgccgtgcaggatctccctcgccacgtccgggtgcgccgccacgaccacccgcgtctccccgagcgacagcgccatcagccgccccgcccccgccgcctccgccgccgcggcgagcttccggtgcgccagcccggtcatgagccacatgctgccgatcaccggcagccccctcagcccaggaacagccgccacaccgcacggcgacccccgacgccgccgccgcgtccaccaccacctcccccacgccggccctccggggaaggaccagtgcagcagacatgtaaccagaccagcgacggcgcaaaccacgacgaacccaagaagccggtgaggctggccgtcgccatcgccggagcatttagccgccaaggagaggtagagcagccagctgccagtgtcctccggagtcgccatgactattgttgactcgactgtctagagacgtacgactctcgttcgttagctcaacgcttcggcttgacacaggcggaatgacggacgaggcgccggcttttataggcgcgggaaagtcgtcaacggcgcgcgacgcgagcgacggtatacagtttaacgcacttctacgagtagtagtactactagctgttttcatttcaacggcgattcggc

SEQ ID NO: 3461 - DNA, 1501 bp, Oryza sativa
cagttttagctccacctaaaatgggagcggaactgggtggagttctctcacaaaatgaactagagaggtggagctaggtttagacagctcaacaacttcactcgagacccaactcctgtagttatttagaagttggagctctacaaggccctagggtatgtttggcacggctccaactcgagttttagagctcagccaaacagttctagctccacctaaaataggagtgaagctgggtgaagcgttctcacaaaataaagtagaaatgtggagttgtgtttagggtgttctccaactccactccaaatccaatttctgagctaaatttaggagttggagctgtaccaagggcatgtttgatacagctccaactactaaatataactccaggagttgagtctggaatggagttatggagctgcataaacccagctccacaactccagtatattttgtgagagctccacccaattccactcctagttttggtgaagctgaaactgtttagctgagctccagctccggaaggggtggagctggagctagagctatgccaaacagaccccaaatactactactagctgcttttaaaaatctcaaaactcttcaaacagcgccgttgcggcatttgccagaggacttcatgaagcacacgatcgaacgagcgacaaattaaacaagggatacggaggaagaggtcgatccgccgatgccgttgcattggttggtgagcagcatcatgcgcgcgcccacgcccgcacgcgcacgagccccgcgtgagcgacgcagcgacggcgcgtggccgggctagctgtgggcgagcgcgcgccgagccgaccagccgcgccccgcggcgcgagcaccatgctccgcgcctacctagtattccgatcgtagacaattacacaggccgacgcgacgctagcctctgcacctgcatgggcgcgcacgcctcgctgccaaccggcgcatccgtgcatggtaatcacgtgcaccccacgccgcctcgcccccctgccccttctcccgcacccctaccaccaccgttcgtgtacgtgtcaccgccgcttccctctctcccccgtccttacgcgtgcccccccactctcgcgcgcgccgtttcaccccctcaaaactttcaccagcttgtgccatgcatctcgccaattcgtccggttgagaatcctctacgtgaattctactcttctactgctttacgtgtcactgcctataatagtactactattatgcccagttcgccacccaaaatatctcgtcttttcatctgccgaatcgccgttgaaatgaaaacagctagtagtactactactcgtagaagtgcgttaaactgtataccgtcgctcgcgtcgcgcgccgttgacgactttcccgcgcctataaaagccggcgcctcgtccgtcattccgcctgtgtcaagccgaagcgttgagctaacgaacgagagtcgtacgtctctagacagtcgagtcaacaatagtca

SEQ ID NO: 3462 - DNA, 1501 bp, Oryza sativa
ttaaacattgtcctaaacgacttcctttatgagtacggagagagtatttcttagataactttataaaattgattgtttaactttctaatatttaattcttttgcatctctgccctcaaataattgcgataaactcagtcatccatgagaactttagaacacagcctactcgtggatcttacatcttgggtcctagtgctacgtatcattctagtggccttgttgtttctctcatgctcttgggtaaccgctgcatgtgaccacaccacaccgagcacagaaggtgtttctgaatgtctgcctgcccgtgtaacccatcaaaacatacctttggcctcacctctgtcttaccaccgctcccgtgacccctacattttgtcccaccataacctctctctaattaccctccaaaattgtactacttcctcctaatgtatgaaaccgttaactttttattaatgcttaaacattcaccttattaaaaaatttatgtaattatcatttattttatcgtgacttgatttatcatatttattctttaagcatgacataaatattttatatttgcacaaaaaatttaaataagacgaatggtcaaacgttgttcgaaaagtcaatggtgtcatacattataatacgaagggagtaataattaggacatatcagcataacttgtacccccatccgaagatacaactacttcttgttccatttttaaaaaaaaacaaagtacaaaacgcatacacttatataagcatgtgcacgctcaccactcatatgagcacacaacacgtacgccctatccctgtgagcgctttcaaatattggtccgataaattttaagattcatgaagtcactactcactacagacgatttgttgtcaatagaaacgtcagttaccatttttctttaaaaaatagctgtaaatgcgagcacctatgtcagatataaaatttgaacagttggatagacagtttccacctctagaaacatagtcagttgagttacactcactttgcctctcattctgtatctggacacatatatttggaaatgtaataatttcttactatgtatttagacatatatatttctaacttttagtcatatatatatctagacatatacatatatttccaatttatattttgagacgaatttagtaaagcatttattatttctctatataaaaatcccgtacataattgcatatcagaatatagtatctgtgttaattacgtatatatctggagccataatccagccgtgagctaagcttgccgtttgctggctagtgaagaatgcgtgctataaatacgaagccccacgagagctatagctatctcagtgtgctcacgtcacgtgcatgctctagtgaggcggcgagtgttcgacgacatggcgctcctctcggctcccgtgcgccgccgccgctcgcgcgtgcgtgtcctgctagtgtgctgctgcttgctactggcgctcgcggcgccgtcggcggcgg

SEQ ID NO: 3463 - DNA, 1501 bp, Oryza sativa
ggggatcagcctcgggaggctactccttgcccagcggctcaaatgctagagatcagtatgcgttccacgccaggcccgagaaggagacatataactagcgagcctgaagccctgaaccacgacaagaagtcagatcaattcaacgatttcaacgccatcgaagccaatcaatattacggtgttttgagcatcgctttgaactgagcaaatgaccactctgaacttaaatacttcggtaccatcttggacaaatttagcgatgttaatggcttaattctttaagaactgaaaacacaacatgtggagaaactaataaataggttttaaagataatcatggtgagtttataacagcacatttgctcttgctcctcgatttgactatatagctttgttcagtagttctttgtagtattatctgttcaacggaggagctcgcacatgccggagtgggcactgccgccggagtcgggcgcacgcgagaacgaaagaagcggtgacacagacgaactgatcctactattaagaaaaaaaagtaaaagttaaaaattacccttaaccataaattagtaaaatactaatttgcccttataaattaatggctcagattgcttctacttgtagtagaatactacaagtagagagcaccatagcagtgctcatcttcataacgattagatttccatggtatttttttcgcgtgcggctattgaggtctatatcggtgctggtttttatagaaaatgggaaaatgcgttgcaatccaaacaagagaagacatttttctggtgactcgtcagctcagcgcatgggcaaagccccctatctcgttacaatccaggagtactagtgtttccactcggaacatatgttgctgccgcacgatgcaaggtggaaacagacagagaataatcgaaacccaagctaatgcttggtcaccacctgcaaatattactttctccactctactaaagcctcagctaagctttgttcctactgcacttttgcagtgctgtatatagctgtgcactggcatatcactaccagggggtgatgcacaaaaaggtttctggctcaaatgatcagagaattgaagcgcacacacacgagaagagactccagtggtgagacacttctgatctctctgtcccccattgcaagtttgcaacctcaaatgcagttcaatccccacacgtgcaaatgcagattgatcgaccaggccagtgggtatgtaggtgtgtagccactgtgtagtgccagttgaagcaatgatatagctcatcagcattcagcaagatgaatgtttcttttcgaaatgtttatcagattgatgaaacgaatgatttgtttcatgctttaaaagatatatttttttataaaaaaaatttatcgtattgtttggatcatgtacttattttaagttatttattaagtttatttgttaaaatattcaatttgtccttataattaagtagatcagccgcagcaacaattcactcagg

SEQ ID NO: 3464 - DNA, 1501 bp, Oryza sativa
gccgctagccgccgctaggctcgccgccgcaccgcgccgtcgtcgccgttgggttcgcaaggacgaactccaccccgtccgcccttccttcgtcgggattcgtcgccggaattcgcatcccctcgcgctccggtaagttctacctctaccgccgccttcggccatggatgccggccgccgtggttcatctccctctctctaatctctctctcctccttccttagggcaccccgaagcccgtccgccggttgccgtcgtcctcccgtggcttgccgtcgccgttcgccgtcatcttcctccgcgccggccaccctcggtgaggcgtcctctcccctttactcccctccctctccctcctagtgccgcgccgccgcttcaagtcatgcgccgttgccttcggccgccaccgccgcctcccgtgccgccggtcgccgtcgccgtcggccgcgtgtcatcgccgctagccctggccggccggccggctttgatgctgagccgagcccggcggccacctctatcgccaccgcccgatcggctcggggccgatctgggccgtcggtcccgtggaccggcggtggatcaccctgtggtcccggtccacggtggaccgcccccccttgagccgctgccgagtggggcccacgtgccgccgccccttcccctctctcccgagccactgaccagtgggacccacccgtcggcgccgcccccttgatgatgtcagccctgggaattattgcgcaataaatgatttaaggactttttgttatagtaataaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgcaatgtttgccttgtatgtcgctagattccggttcttccgacgctccggtgtacttcgaaatagtcgccgaggtttctccagcagcagagcaaggcaagtcatgcttgtcacttgatcatgttgatactatattgcaaatgttctaatgttttctttcaaatactacatttgttttgcaatatcactatgggatgtttacctattgttacagccatgctattttggtaccctgctccttttttagcttgggttataacatgaatagacgttggactaggagttgcttagccatgcttagttcaactagtacacagtggggaaaatcctattaatgtttagactgtaggttcatatgataatgttggtttagtaccaccgctttggtgttggttaattaaaatgaatcacacggtgggctgtgggtgcatgattttgctagtcgcacccatggcagttaaggaccggttcgcgggatgccctggaagaacttatcgtacttaccacaagccagtgtgggcaacggctgggcttgtagtgtagctttcctctagctgacgcatccaggcaagggtgggcgtga

SEQ ID NO: 3465 - DNA, 1501 bp, Oryza sativa
tcgtctctaccattgaatatgcccttctttcttttttttttccttgaccttacctactggaattctcatgctaaacttataaagacgtgcaatgtcagctggtactccatgaagcaaggcaccaaagctgctttgtttcttctgaacagtttatttatcgtttatttttatatgcgagagatatctaagcagcgtttcagttttgatgccaactactgaattgccagagcagcagctagcattgcagcaacagcatgcaaagctttttgtttctagtgacaaattaaagcagcaaaacacaaaaaaactgaagaaatttaagaacaagacaagaattaccctgacctgatatccatcgaagtcgcagtagaacgggcagccgccggccctgagctccgggtcgtcgctgtacgcgcccttgtgttcgtccgcgaactcgaacgcgctcctggcgccggcgagcagccgcgcggcgtacgccgggtcgtcgtcgcggaacaccatcgacgccgcggccagcgccgccgccgtctccccggccacgtccgaccccggcctcgccgcgctgatgttgtacaccgtcctcgctgtgtccatgtcctccggccgctcccagcacccgtggtccttcgttgggtcgcccacctgcattgccatcgacgccgcgctcacatggtcgtcgccgtcgacgaggaagacgacggtgcgcagtgcaatgtgtttgtgtgtgtgcttgcctgaatgaagatgacgccggggtgggagatggtcttgaggaggtagtcggtggcccagcggacggcgtcggcggcgtgggcgcgctccgcgggcggcatggcgtcgccgaactcgacgacgccccacgccagcatcgtggcggtgaacgccatcgggaagccgaacttgacgttgtcgccggcgtcgtagtacccgccctccaggtcgacgcccgccgcgccgccgtccgacaccgccgagtcccctcgccacgccgcgcgctgccccgccgccggcagccgccccgaccgctgcccctcgaagaacaggatcgacttggccagcgcgtcgccgtagtcatgccccgccgccgccgccgccgccgacggcgccgcgagcgccagtagcaagcagcagcacactagcaggacacgcacgcgcgagcggcggcggcgcacgggagccgagaggagcgccatgtcgtcgaacactcgccgcctcactagagcatgcacgtgacgtgagcacactgagatagctatagctctcgtggggcttcgtatttatagcacgcattcttcactagccagcaaacggcaagcttagctcacggctggattatggctccagatatatacgtaattaacacagatactatattctgatatgcaattatgtacgggatttttatatagagaaataataaatgctttactaaattcgtctcaaaatataaattggaaatatatgtatatgtctagatatatatatgactaaaagttag

SEQ ID NO: 3466 - DNA, 1261 bp, Oryza sativa
tgtagcttcaaatggcctcacacggtctatcatgacaaagctgtcactcgtccttcaccaccggatttggttcttcggcgccaagcaccttgattgcccttcaccgccgcatggtccatcgtgaccgagcttcgcttgcccttcaccgtcttgccatagtagccacttcgtatcccacatcttcaatatcttcactttgtcattcttggtatcgttaggtgtaattatatcacttgagcatcaacacctttgcaatccttgggacctatttctttcattcaacccaataaaattattagtcccaatgatccagttgtcaacctccacaagttgaccaaccgatcgcatgtataaaagaatatgaataaatgatgagtattaatcaataccacaagtgccatatactcaaacatacactcaaatgtaaagatcccaattaaatgaaagtgaataacttggatcaattacatgcataactaaagtataggatttgctccccctaactgtatgaaaaaaaatgtttgtgtgaagcaagagtatgcataaaagaatgaaacattaggagcttaccctatacaaggatagatggcatttatcaaatataaacattaaaataaatgtataccttcatcatctttaggttctcaatgtaaagagataaacaagagaaaagactcaaacaaaacattagtctcacatgtatattgttattcacatggaaatattatatatgaacatatcaatatgtacatggagagaaacagtgatacatatagcttgatctccatgcatttcatccttgtgatttaggtctatcatcaatgaatgtttctatctcaactcataagaagtccggtaatcacctctcacacactccactttcatgtccacatgagactaggcaaagaaatgcttataaaaatattagtttcacataattggatttatcattaatcaccaaaaccaaattaatggcacttgaactttcaaaaatgatgggtaatgtggtttttataagcgaggacaaagactactaattctatattgagtatgctaagggtaagggttttattgtgagcccaaaagcaggtgtgcacgcagaaatgctaggtaagatacattgttctctcaacccttaatatccatcgttatagaccagaagtagatcggattaagtagagcaagacctttaaaaactaggtgaagtggaaggattgtatggtcatatggagtcagtttgtatgctcaacttaaggctata

SEQ ID NO: 3467 - DNA, 993 bp, Oryza sativa
tccgagggagaggagcggcgcccgacggagtgtagttgggcggccccttagtccccgcccccgccgccaacgtggcgctccccttcccgtcccggtctcccctgccgccctcgattcgctcccctccccttcccccgccgaccgccgctcccatccccacccccgccgccgccgctctgaaacgagccggtgttcctgaggatgaaatggctaacctaaaaaggcaactagcgccaggaccttccacagctccaccagctccaagcactgctactgctcctgctaaccggatgatgaactttgtcagtgctggagtgcaggcataggctgagagcagcagcaggcaacaacaggctgctgctgctaacaatgaggatatcgagctgcctgatgagagcgacgaggaggaagacgatgaccaaattgcgaagaagagtgttcccgctgcggtgtttggagagcttggcaacagagctgcagagaacagggaggaggaaagctctggtgcccaggagaatgggcagcttggcgcccttgagaggatcaagcgaaggcgtcaatgatctgccactgtcaagatgcccacagagctggtgcccttgtaacaacttgtaaacatgattttgagtggtgtttttgctcttgtacaagaatttacgggagttattaatccgttattgatctgcgaccattttttcgtgtactaactattgggtacattccccgctttttattctctcttctaggctagaaggcaatcatgcattattcaattctttttcatttttgcgaggaaacattatttgatttcgagagtgtacactgctactggagtgttgaaacctgaaaaatggaactaggagacttcatttctgttactgtctcatgtggtttagcctttcatttgcaaagttattggttgagctacggttttataaaccgagtaatataatgatggtgatatgtaaacaaaactagaaatttcgttaactc

SEQ ID NO: 3468 - DNA, 1501 bp, Oryza sativa
ccatccccggtactcgaccagtcgacctcaccatgacagtaatggactagtggtagcgacgcctcgattcattgcgccaatgcggaagggaatcgccggacaccatcgcattcttgcaggagaagctctgagcatctcatagagatgtagactcatacgcgcgtgtgacgggcggccagagatgctcagatgcgtcctagacctgcaaactgcggtgccgagcttgttgccggggcctggaacgagatgcgaagcgggaggaggcaccgagcatgcgcgacgacggaggcacgggtcacgggtgcaacgaagacgaagggacgccgctaagcctttgacgccaatgtgcttgcgccctagtggctaggcctgataggccattatcgttgccatgggccatcggtcgtcgtgcctacgggccgttcgcgtgtcgtgtcggcccaagcacggcccactagtcgtgctgtgccgtgctatgccgctcgtcgtgcccgttgtctaggaccaggcacggcccacatacaggctgtgccagcccggccaatttacgggctgtgccggaccgtgctttctacgggaagaggaaggagagagagaggaagagaaagaaaaaaatgagtgagagaatgacatgtgggtcccacatgatgtcttattaggatagatcatgtcaaagcaccacgtcagtgaaaccactattaaaaaccgttagaggagttaaattacaccggtttttatagttaagggtgtcaagatatccggttttgtggtttagggatatgaatgaggttggagctatattgtgagggagtcaaaatggacttattcccagtatgaacactgcaatcctactagctgggccggtgatacggaagcagagaagcacccgtcttgatgggccgcggtttgatcacgccaacacccaaaacaggccgaaatgcagcccaccagttcaggcacaaacgattaaaaccaacgcacgccgttggatctaccaatcgtctcatcggacggatcacagcgaactccggcagcttccgcaatacccgttcacgtggctcgcccgggccgcgccaaagcttttctcccgtggcccacccacggttgccgggcaagaggagggccccgctcgtcatccaagcgtctcagcatggacccacctgtcagtgtcacgtgatcccccgcgcacttcgaagccctagccaagtacagaagccacccccgccgccgcctcacaacctcactccccctcgcttcaattctaatcccccccaaaccccctccaaaccctaaccctactacgacctccccttcctccgccgccgccgccaccgccaccgccaccgccacgtccagcctccggtcgcctgttcggatcgaagcggtgaggattcgcgcgtctcctcctcctcgcgttctcgccttcgattcgggccgtctcgtgcgtttcccttcgcgttctctgatttttttccggtttttggcgctctcgttttgcaga

SEQ ID NO: 3469 - DNA, 1501 bp, Oryza sativa
actggtgggctgcatttcggcctgttttgggtgttggcgtgatcaaaccgcggcccatcaagacgggtgcttctctgcttccgtatcaccggcccagctagtaggattgcagtgttcatactgggaataagtccattttgactccctcacaatatagctccaacctcattcatatccctaaaccacaaaaccggatatcttgacacccttaactataaaaaccggtgtaatttaactcctctaacggtttttaatagtggtttcactgacgtggtgctttgacatgatctatcctaataagacatcatgtgggacccacatgtcattctctcactcatttttttctttctcttcctctctctctccttcctcttcccgtagaaagcacggtccggcacagcccgtaaattggccgggctggcacagcctgtatgtgggccgtgcctggtcctagacaacgggcacgacgagcggcatagcacggcacagcacgactagtgggccgtgcttgggccgacacgacacgcgaacggcccgtaggcacgacgaccgatggcccatggcaacgataatggcctatcaggcctagccactagggcgcaagcacattggcgtcaaaggcttagcggcgtcccttcgtcttcgttgcacccgtgacccgtgcctccgtcgtcgcgcatgctcggtgcctcctcccgcttcgcatctcgttccaggccccggcaacaagctcggcaccgcagtttgcaggtctaggacgcatctgagcatctctggccgcccgtcacacgcgcgtatgagtctacatctctatgagatgctcagagcttctcctgcaagaatgcgatggtgtccggcgattcccttccgcattggcgcaatgaatcgaggcgtcgctaccactagtccattactgtcatggtgaggtcgactggtcgagtaccggggatggggatggctgatggccgaacggacgcagccatagcgtcgcgcggcgtcggacaccacctgcgatgtaccgctggacaaacagagagctcggactagtacttgtgattcccttgctcggttgtccttgccctgccccgctgctgtccgttcgtatcctggcatcaccgtttgccgcctcgccacgagcccacaaccgcaagacgccgtggcagggtagcgcccgccttggattgagatggagatgggacgcctggtggcagagaagcatgggcatggcgcatggccattggttgtgcgtctatgtctccatggagccagcaggcagcaagtgtgttttgtggtgtgtctatgtgcaagtgtaactagaaacaactagctcatgaaggcaatttgttctataaattcctcctcctcctcttcttcccagcaaataaaaaatgcagcacaaataaacagaacaaaagcaatatagttatttccctcccacaacaaaaatgtggggtgatactcgtcggaggtcgacctcatcgagacccccgcaaaggctcgc

SEQ ID NO: 3470 - DNA, 1501 bp, Oryza sativa
ccttgatcttcccccccgcgcgccgccgacgacgacgagccctccccgtgaatcagcatctcgtcgatcggcgacggccgcgcgatggggactcgcgctcgcgggaggatataaagcccgcggcgcgtgcgtcgtctgttcgcgttaggtggacggggcgggggcgggggcgcgcgagaggcgtttccggcgcgaggttttcttgggcgttttcgcggtggtttttccattcccccgcatgcgttgcgttggacgacacgggacgatcgaggtcgtggtccaccaaccgccaggcgcgcgcgcgggcggcacgcacgcacggttggatggggacgagctccaactcctcgctctctctctctctctttcctcgtcggagtccggtgttggagcatgcggttctcatccccgccgttacgggcgcacgctcgcgcatgtacggggggtgatgtgggtgtgtgtgtgtgcggggggaggggatttgctgggccttttcgggacgtgtcgttggaagtggaactggagcgcgcgcggctgcgctgctggctgttacgtcttctttctctcaaagaaacggaagtcgtggtgtgcgtgtgttgtgggatctttttatcgtgttgatctgtttaggtgtgtcgtgtgtgaggaccggcagtgatacataggtttataggtttatagtgagagtagatttcttttccttttacttatatatacatatatttttattattaaatgtgtacatgttgtaattgtaattttttaatatatatatttttttatctatgtgtccacaaaatatgtaataatagattggtcgattttggtttggctgtagtgtatgaaggtgatatattttgacttacacgaaaacccatatcttgtatttaatatacatttaatatagtaacaagtatttggtcgtgtcatataacctatgaaacttcatttctagatcccaaaagtaaaccattctagagacgggggctgaatcgtcttgtatagtaaaagggatgtaaaactttttgatggttaccgggggaaaatatgttacttgcgaaatgctggagcggtttaaccgtcatttaagtacgggcaggagcatcgtgtgtcttgccatgtttgggctggtagtgttgatggggactacaagtcaagtgatcagcacttccccggccagcgttggcacatgcagttctcgctgttacagccgcacgcatgcctatgcatgggatgatgtgggggtggaggatttgctggcctttttcaggacgagcgtgtcgctggcgtgagacgtgtcatgggagatggaactgcggagcgcggctatctgttacgtcttccttctgttaaaagggtttggcaccttgcgttgggtgtgtgatgtcgtaatgtatgtgattgttgtggggaccaatagcaaaaaaaagtgagtttataattatagatagcttgtttttaattttacatttttatattatatatcttttattgttgaata

SEQ ID NO: 3471 - DNA, 1501 bp, Oryza sativa
tcccccccgcgcgccgccgacgacgacgagccctccccgtgaatcagcatctcgtcgatcggcgacggccgcgcgatggggactcgcgctcgcgggaggatataaagcccgcggcgcgtgcgtcgtctgttcgcgttaggtggacggggcgggggcgggggcgcgcgagaggcgtttccggcgcgaggttttcttgggcgttttcgcggtggtttttccattcccccgcatgcgttgcgttggacgacacgggacgatcgaggtcgtggtccaccaaccgccaggcgcgcgcgcgggcggcacgcacgcacggttggatggggacgagctccaactcctcgctctctctctctctctttcctcgtcggagtccggtgttggagcatgcggttctcatccccgccgttacgggcgcacgctcgcgcatgtacggggggtgatgtgggtgtgtgtgtgtgcggggggaggggatttgctgggccttttcgggacgtgtcgttggaagtggaactggagcgcgcgcggctgcgctgctggctgttacgtcttctttctctcaaagaaacggaagtcgtggtgtgcgtgtgttgtgggatctttttatcgtgttgatctgtttaggtgtgtcgtgtgtgaggaccggcagtgatacataggtttataggtttatagtgagagtagatttcttttccttttacttatatatacatatatttttattattaaatgtgtacatgttgtaattgtaattttttaatatatatatttttttatctatgtgtccacaaaatatgtaataatagattggtcgattttggtttggctgtagtgtatgaaggtgatatattttgacttacacgaaaacccatatcttgtatttaatatacatttaatatagtaacaagtatttggtcgtgtcatataacctatgaaacttcatttctagatcccaaaagtaaaccattctagagacgggggctgaatcgtcttgtatagtaaaagggatgtaaaactttttgatggttaccgggggaaaatatgttacttgcgaaatgctggagcggtttaaccgtcatttaagtacgggcaggagcatcgtgtgtcttgccatgtttgggctggtagtgttgatggggactacaagtcaagtgatcagcacttccccggccagcgttggcacatgcagttctcgctgttacagccgcacgcatgcctatgcatgggatgatgtgggggtggaggatttgctggcctttttcaggacgagcgtgtcgctggcgtgagacgtgtcatgggagatggaactgcggagcgcggctatctgttacgtcttccttctgttaaaagggtttggcaccttgcgttgggtgtgtgatgtcgtaatgtatgtgattgttgtggggaccaatagcaaaaaaaagtgagtttataattatagatagcttgtttttaattttacatttttatattatatatcttttattgttgaatatgtacttcg

SEQ ID NO: 3472 - DNA, 1501 bp, Oryza sativa; identical to SEQ ID NO: 3471

SEQ ID NO: 3473 - DNA, 1501 bp, Oryza sativa
cgaggagcgctccaaatttataatttgaatctgtattgaatggttctattaatattaatataaagctcaagcggaaacattagtgccatggagtggtcaaaattagccattgctttgcgtttctaaatatctgcttaccttaccatcatatacttctaagtatcgtattggtagcgatgatctagaccattatttattatgctctaaagttcagaatctacatagatttttggtaaataataaagctaagtgttaagtgttacagagtatacctccatcccacgatatttaaatggaatacagtgatatactccatctgttttatattataagaggcttttgattttttttctaaatcaaactgcttaccaagtttatcgaataatgtagcaactcttacaatgttccattaaatcgaacattgaatatattttagttttatagttttatgttatttgctattaaaaattgctacattttattacaaatttggccaaacttatataatttagacttcaagagagtcaaaataacttgtaatatgaaaaagagatagacaaatgtttactacggagtatatgatactcccttcgtcctataaaatcaactactgactatgtatctaatttatatccatacttagctagaagtttgttttctattgatagtgggagtactacctctgtctcaaaagatataatgctagcttttgaaattacattacatggaaagaaagctacttagataaatggttgggattacaatggacaagaaattagaataaagattgattgtaggaaaaacaatatttcattaccatttataaaaaaagaataaatttcacatagacccaaatattatgtctaaattgcacaaaaccacaggagtttttgacacgttacatataactccaggtattatggccataaagtttcacaaaaccacaatattaatcattttaactttgatttaccatgcttttgagttctacaaccacatctcaaattttgatataggagtacgtcaatttgatatatgagactttaggaccataatatctaatgttacatgccacgtaccaaaatccatgtgattttgtctaacttggatcataatagatagatagggttttatgaaatttattcttaaagaaattaaaaaaatgagtaagttataattattatttttattacggagggcctaacaaaaattacaaaaacaagggaaattagtacagttgttttttttagccccgggccggcgtaggtaacacgcagaccacctggcgggacccacagcagccgtggccccaccctccccgctccaaccgggccccaccccaccaccgctggcggtggcggcgcctctcccgtggctaacaaaaaccctagcgcgccgccccctcctcctccttcttaccaccaacctctccccccacgatcgccctcctccccgaaacttctggaaccgagagcagcagacgttagctcttctcctccga

SEQ ID NO: 3474 - DNA, 1501 bp, Oryza sativa
tgtctatcttgtaatccgaataagctctagatataactatattttttgggtagggaaggaaatattatttttggagactaactagcttgcattccacagatttcagagtcgatattacacagaattttcaacccttagatcaagatccgacgcacatcaataacagctacagtaactacttgatgggcttcaacctaactggaccaaccaacggtgctcgcacgggctaaaaaaaattataaacagactcatagtcaaactttttttatcacaacttattacaatataactgtaatataattacactgaaactaccatagtacagtgtatctacaccataattacaaccatagtacatagtacagtgtatctacaccataattacattggagttactctgtaattattgtgtaattttggctatgcaactaaattaaattattcacttgttccactggtgaagtgcaagttctagcaattggaattcatatgctcatcccacaaaggcatttgctagaagattttgtcagcctacattaacactagtcggttactatggtcaacagacaagaaaacttatgttttgatgtggtaggtcaaagaaaaaaaaccgtgtgatttgaagtaagaaatccgtcgatatatttatagtaaaaccgttaattttttttttgcacctgctgactttatttttaaaatactacgacaaccagtatcagacaatcatttgggatagaataaattatataaaggtcctagatttttcaaggcaggacaaaagaaaatctaaaaaacacaatcaagaccttcttgatttgtcttacgcaattgcttcatctatgttgatgacaaaggtggcaagagcaaccatggcaagccgcaacagaacaagcatcggcacgtttccagacagggccttacatggccttgaccggtagagaatcatttagcattgaaaaaaaaaacaccgtcgaagatacaatgagcaggcaaccttgcaaccgatctggttgctagaacgatcccaccaggagcaaagagaagcaaacaagcaacaacagaagaggcctagaagcttaccctgatcggcctaggaactaaaatccaaagagtggaggtaaatgctccttcaaccattcttttctagcccagcagtaaacttatttttattgggcctgttcagctaccattattacggcaacgctgtagctgagacgttttatattgtacggctgcagctagctgcagaaaatgccaatcgaataggcccatcaagaccattgatatcaatccttgatgagcaattttttattgacttgatttgctataaggtattgtagtgttacagtatcataggacacgcaatccgttattcccaacatacttgtatcacgtcttttatgattaaaccattggcacatacagtttagggtatgttaggctcggctgaacaaattcaggttattttgccacggaaaaatatgagtaagtattaactatt

SEQ ID NO: 3475 - DNA, 1501 bp, Oryza sativa
caacttggatctgcattctcgttttgatcccccaaatccaggttagtctagtctctaatctttgatgtacattctcattttgtatttggttgtagacaagcagttagtgagaaatttggtttgatttcctagataaagaggagcagaacaaatataggggtgaatgggagctttcggaagttatgttttaaaaagcacaattggttgctaaggatgcaattttctgttttaattgcttcctttctaagcaaaacatgagatgtttttgttgtttgaagagcgagataattttgctagtgtcgaagatattacagaacattatcataatcgtgctttgagaaatgaagatcatcgaggtatgtcatatattccttgtaaatagttaagttctcataatttgcagtaatatcatttttcagattcaagttcagcctctctccatactgtagtgctgttgatggagagtgaagatcatgggggtattccaatgaaatgttaattcagttctttttaatttttactgtacttccgttccgtgtatgaattgtcatggtaattttagccctcatttttgctttttttttgacatttttactgtacttggtctatgtgtggtcatgggcaattttaatcttcaatttgagctctaggctagaagaaatcctaacgccaccactaatctgaagcacgaaacaaatcaattaaagaagccataaatgataaatgaataatccttcatgcataaaaatatttagttatccataaagagacgacagacgtatgcaacgttcatattaattgtcactctacagtgtcaccgagttgtcggtccaagcaattttacccatacatgaaaaccatctgagaaagggcatgagagtagtactgcgtcaatacacatgcagttgcacacagtagctgagagagcgagccggaaacatctggtcgccggtccacgatcggtctacgcatgggcttccccccgaccaggtggtgcgtgcgagcctaccacatgtccacatgcatgcacggtgatcgacatcccgatcgacgtgtcgacagtgcagccaccccgccgctcgctcgctcgcgctcgcgcagtcgcgctagcacggacatacggagtagtatatgcgtatgcataggcacgcgcgcgcacgcgcatgcagcgaaccagagcgcgccgcgcacgggcggaggcatagcttgcgcacgtacgtgtcgcgctccggcggcctcgccacgacgcgtgtcgcggaggcgcgcgcgcgcaccgagccgtccgcgtcgccgcgcgacacgtacgttgccggcgccctgatcccgccgcggagcaccgccccgtccgtcgccgcctataagaaggacagcgcggccgcgtcgtccatccccatcagctcaagccgcagaagacatacacacacaaacacaagccacccttccgatttgttcatcgatcagttcgcagcgtacgtcaggctagctaactagtgtttggcaa

SEQ ID NO: 3476 - DNA, 1501 bp, Oryza sativa
tgggagtggctcgttttatatggcggctgggtgctgggctttgtaggcgatttgggccttcgtcgtatccggacttcccaaaaggccggcaggtttacataggagtcggaccgggccgggcttttaagggttcagactttaaagcccaattctgataggaaaaacaaacctagctggaaaaagtacaccgagggtccctcaatttgttatcgggatacaaaattgcctccaaccgtaaaaccagatatgcgaggtccttagctacacaaaaccggtcacaataggtccatcggcggttttaattccggttttatcctacgtggctgttgagtcaacgtgggacccacatgagccccacatgtcagcgtggccacgtcagcttcctctctctttcctttcctcatctctctctctttcactcctctcttctcttttttgggcaatctggccggcggctggggcgggcttgccttgtcgacggtctcgtagtcggagaactggaggagctcgtcgacggcccagccctgtggcaggaactgcgcggcgagggcgcctgctgcatcctgcatgtcgacggcagcggtctgtgccggctgctgctgatgatgatgtggtggtgacgctcggaggacccatgggcggggcgtggtggtcggagtcatgggcgtcgctgccgccgtcgcagggcgaggcggaggcgaagccgacgcggcagaagagcgctagtgcttcctgcggcggctgctccggctaccggctagctagcaagcaaacaaatagtagtatatgtgaggctagctagcttgtcattctgtgcatgcatgagccatgcgaatatacgaatgtacatgccgtatatatactctagctagagaatcaagggctagcatttgctaattggccggtggagcaattacgtacgtacatgcatgcgccatgcatgcttatcgtattgagggtgaagtaattatcgtattttacgcgccgccggccggataaactcagtcgatcaaagtaaagattttgatttgatcaagttaaggccgcgacctcggcgacctcggcgttgctcatcttcgacggcgctgtcctcttccttaagatggtgctgagagatctgcctcacgctcatcatcgagccactcggtagaagaatgctactccctccgtttcaaaatgtttgacaccgttgactttttagtacgtgtttaaccattcgtcttatccaaaaaatttaagtaattatttattcttttcatatcatttgattcattgttaaatatactttcatgtacacatatagttttacatatttcacaaatttttttaataagacgaacggtcaaacatgtgctaaaaagtcaacggtgtcaaacattttgaaacggagggagtactaccctgccgaagcacgctcgccgagggtcgtcggaacaaggccctgaacgccgccaagattgcctgcatccatgaacgacgtcgagatacaggatgtcctcgc

SEQ ID NO: 3477 - DNA, 1501 bp, Oryza sativa
tgtcgtagtattttaaaaataaagtcagcaggtgcaaaaaaaaaattaacggttttactataaatatatcgacggatttcttacttcaaatcacacggttttttttctttgacctaccacatcaaaacataagttttcttgtctgttgaccatagtaaccgactagtgttaatgtaggctgacaaaatcttctagcaaatgcctttgtgggatgagcatatgaattccaattgctagaacttgcacttcaccagtggaacaagtgaataatttaatttagttgcatagccaaaattacacaataattacagagtaactccaatgtaattatggtgtagatacactgtactatgtactatggttgtaattatggtgtagatacactgtactatggtagtttcagtgtaattatattacagttatattgtaataagttgtgataaaaaaagtttgactatgagtctgtttataattttttttagcccgtgcgagcaccgttggttggtccagttaggttgaagcccatcaagtagttactgtagctgttattgatgtgcgtcggatcttgatctaagggttgaaaattctgtgtaatatcgactctgaaatctgtggaatgcaagctagttagtctccaaaaataatatttccttccctacccaaaaaatatagttatatctagagcttattcggattacaagatagacaaaacatattactacgatagaaatagaaaagaaatccaattgtaaaacataagaatgaaaaacaaaggaatataaaagctgagagcattcggattataggatatgaattaaaaaaaagagcttgaggtggttggatttttctcgtacttttcatgtgaaattagcattaaatgaaattttcctttggattttctacgatctgtttccacatccgaacagcaagaaaggaatttttttttaaaaaaagctctcatacacagtatcctctaaaaatcttgttggaatcctccaattcgaagaatataataatttcttcatctaagctcatctcaaccaatcacaaccatcgttgattttattttcttcagctacttattcatccaatcacaaatatcaattatttaattttatctcttacaatgttggtcacaaacattaggaattttctttaagattgaaagagacataggaaacacgtatagttatgtgctccctccgtctctaaatataagagatttttgataggatgtctattcagatttattttaatatgtcacattgcatgaaaatgatttagggagggagggaccgagggagtactccggtcaagcgatcacgccatcacggttggtcggatgaccggagtgcttgtgtagtactgtagtaggagaacaggcacaaggcatgaacacacgcatgaggacgaggccgaaaaagggtcaaaaacatcgcgttatccttccctcctctcgcctcggtggtgtgcgtcttccccacccacccccagtctccaa

SEQ ID NO: 3478 - DNA, 488 bp, Oryza sativa
caaactgcgttttggttggacttgacaggtgcaagtctttatctttgctttaagatgcttaaaaaatttgcatagtaataattgatgggagaggttggaaaatcttgttctggggcatccatactatgcgtcggcgtcattttttttcccctctctgaaatccatgtgtcggcagcaatttggcctctacttatcactctctccttgtgaatttacttgtgtcggtgaacaactgacactgtctttaccatgaaatgaaattcattgacagcatttgaacacctaacaccacttgattttcagataacagaacggctatcgctttcatttgttactgcatgatcaaagataaaaggataaatctcaacactgaaagccatattcttcttgaaccaccaatctctctctcaaacctaacctgacgcatcaatcagccaatcacagcatcacctaatgccagattgccagtggtgaatgaactccagcaa

SEQ ID NO: 3479 - DNA, 1501 bp, Oryza sativa
gcttcacaagttcgatcatattgtccatatggaatatatgcccaggagtgatatgatatttcttcagatgtaacaatctacttgttctgaagctattatttgtgggggttatgtgggtgatcgcttaccttaatggacacatcatgcccaactaaatccatatttgggttttcaattcttgttgagaacacagtacgtacttgcactgatttaaagataaccctgtctcaagagagaggagatccagcaacagtgttatgcaacagtgtcattcagtctctacacaagcagctgtcctagtgttctcatttgtccatttagcataatttgtacaaacatggcaggcaaagacaaaatccccgatctctaattcccatgtttgaaatttaacacgcccaaaaggacaaaatccccgatctgaaaacatgtagatggatttgtagaaagagatggggaaattttagggtttggggggaagataacatgcagccggttgggttcgtcatgtggcgtcgtcagctgcactcaccctcagtcgccatgcgccaccgtgctcgccctcagccctcttgagttggagggcacctgcaaggcgggagaagaggctgcggagacagggggccggacggaggaggcggactactcacagaatggggtggcgccgaggagattggcttccggcggcgcgcgtgaaggcggtcgaggcgggagaagaggcggcggagatcgggggcggggcgtgcgtggaggcggtcgacgagccggagattgggtcgtagtgtgccttcatcagctgccagcctgccctcaccctcagccgccatgcgccggcgaggcgggagaagaggaggcgaagatttggtgcggggcggaggaggcggacgcgaaggaaacagagatgggagacggcgttgagagggagagaaaatcgggggaaaggggtgtgtgtgcgcgccgcgtgcgatcgacgatgcgtggggcgcgtgcggaagattgaattgtgatctgatctgttggattcaagaccacgaggaggcgacgcagggaggagggcgaaggacgcggcgtggggaaaggagtgggcgtggcgcgtgatgaggagaggagcgatgggaggagatttgacgccattggatatgaaaatcggatggttgagattagacgtgtttgttagatgcgtctgctatgtcagaaatcaagaccaccactacagattttttaagtagtagagaaaatgagatttgctctagtccaacaaaaaatatcttaaggtagcagtacctcacgatatcaaatcattttttgatcgttggatctaacaatatctatcatgctcaattagatccaacaatcggaggtgatttagtattgtgaagtaccggtacctcgaggtttttttttttttttgaccggagcaaatctcactctatattgctgatgattgatctatcaatataaggtctttgcaaattgtgctttgttgattgattcgattaattgc

SEQ ID NO: 3480 - DNA, 1501 bp, Oryza sativa
tcgagctgagggttatttattttactttaggtgatctagcacctatagaatgatgcaacataacttatatactcaatctgttctaaaatataacaactcctggcctttaaagtttgtttcaaaatataataacttcaccaccaacattttcttttcaatcaaatacaatcccccaccattcaatttcctcacctaccatcacttttcaaccaatcataacaattataaccacttttttaataccgtgtccaaccctacaaatccttatattatgtaacaaagggatctttttttaagttagctggtcacaaattaaagtaaactagatgggtaccccgtgcgttgctacgggagaattttgtgataatatagtagatatgagttctaaaattttctttcttacctattaaaccatttatttcatgtgtttatgtatttttgtatcttcatcaattttagctaaggttataaatgatttttgttgtatggtgtgtcttttgggaggagagatgcaatttacatctttaatgaaccatccaaagactaaaaataattgagatgatgtggcttcatgagagaagagagaattagcattaattacatcttagtggggatgaattttatagatatataggattaggggtttgtcccaaccttttttttcatatttgaattagaacattttctatgtgtgattaataggagaggctgacgatggaaatcatatttattatgtagaaaaattcatactttcttcgtttcacaatataagttattttagcatttccacatttatattgatggtaatgaatctagatagatatgtctagattcattatctagattcattaccatcaatataaatataaaaaatgttagaatgatttacattgtgaaacggagtaagttcctaataaccagcatcagtcattcgagtaaactacgagtaccatcgatctgattacttcagttgatcagctggtacgtgtgtgcgcgcgatattcaccccactgaccaaagcgcatacataatccatacccgtagcttttgcagcaaattaaaatggttatcaataaaacacttggcgcacgattgatacaaataaattacaaaccgccacagtgggggatgtttgacaatcagaatctctatgatcagctgttgatcactcacgcacctttcttatgctcgcgtcattgcttggtcatgctgctggagactcctcaaaccacacctcgtgtattgtttgttattatatgaaaacaaaaaagaaacgcctctggatatggtaatagtcgataaagtaataatagacgtatttccattcgtcagagagacagtggctgctacgtgagacgaagaaagtgacatgagaacggggtcagaaatatcgtgcagggaaccattgaaaatgggaaactctgcatgcacatggatgattggttgcatgattggtcaatgacaaagtgcgccgagccgccggtcccacttcaagcacgga

SEQ ID NO: 3481 - DNA, 1501 bp, Oryza sativa
actttgtgaggcccaaatattagtgattgtggcggtgaggcagacttatgttttgatgtttataaaggagtaaagatatcattgcgatgatcctcatataaaaaaaaattcttgtgtgtcattgagtatttgctccatcattcccatacccctaaatttagccatgtttcctttatacccttaagttgttttgttcttttttatactcaatctgttaattgaccacgagatttttcacaaatactacctccatcccaaaatataagtatttttagctataaatctggacaactatgcgtccagattcatagccaaaagttgctatattttgggacggagggaataactatattgcctcttgtttctacattttaaaaatatagatctcaaggtaaaaacagttttgactctaaaaatcggagtggacatgatgatttgatcaaaaaaatgaaataaaaaatacttagaattttcaaaatattaaaggtaatttcaaccccccctacccctccatggaaatatttccaaatttggttgtggttaatttttaaaatataacatttcattttttttaggggagaaaaatagagaaaaatgtgattttgtaatttcccctttgaattttcatcaaatttcactgcaattcagttcaaatgtttaattttagattcaaaaagttggtcaaacatttttattccctacaatttgtatagctgaagttattcactttcaaattatgttttataagacgttagcatttaaactacaatcccgaaattacaaatttatagattcaagctatgttattgcacaattatggacttagaacccaaatatatcagtaatcacaaaattatctaatttatcatccaaaatcaacgaacaaagcagtttggtagtttacgactttatggtgtgatttttgtttgcttgtgttgttactctggtgcaaattttgatttgtaatgtcatcttaggtgcttaagaaatgaagttggccgagcacaaatataggtatatggtgtacctgcgtcatctgttgttcatgctgatgatcgaccatatatatctccatgaccacagacatgtgtaatatgctcgtcatgcaaacgaaacatgtcctgatacgcagacaacagggctgctgcctgttacgcagaccaagttcacgacgcaaggctgacgaaatcacgatatggcatggttggtacggaggaagagtcaacgatctatatggagccagcagcgcagcgcgattttgcagatcgaaaatattagcgtactctgccggtcaatggagaaaaccgccgtcgccacgcgcgagggtccactccgacacctataaatacaaccaaactccaaccccattcggcacacagccaaagcgtttagcaagaacagagcaaagagctagcctagctagatcatcgcatcgcatttgttagttttccatcgccgattgatacatacatcatccaagcagagcaatcaccaatcaacc

SEQ ID NO: 3482 - DNA, 1501 bp, Oryza sativa
ttaaaaaaaaagtaaaagggtctcattgtttgccttatgtttataagccaaagtttaattttgaatatgattttttgttttcttcatcatagtttattttacatcatttgtttttgagttgctatggacatgtatataaaattttactcataaataatttttatttgctaacaactgtggagattatgggtaccctatacccacacggcatggttatccgactagttataggggataacttatatctatagaatatgtaacagattatgacttgggtattacgtttccttgtatattacggaacggcctaaagtcctggtttgataagattgtaaagtagatttaggaaaccgataccatattggttaaggtttctatcttgtaatcctgccccccgtcctatataaagtgggcaggaggccctctagggggcatatgagcacatatgatcgttagatctaaactacatctggcggattcaaatcctcaaacaggagtagggtattacctctcattgagagagcctgaacttgtctaaatctttgtctccgcatccatccacttttaggtctcgtgcgctaccccttttattattgccgaattcatgtttcgacaacaacatatttggagtctaatcggtagtgcttactgcagcagcgcagccgcagccaaccagcccaaatctacacaaaacagttgatttgcagcaacatcaacaaggtgtgtgctacttgttggctgctgctgcactgtggcagccagcacaaactcaatgccttagataataagggagtgtttgaagagaaggggattgaggagattgggaagatacgcaaaacgaggtgagccattagctcatgattaattgagtattaactattttaaattttaaaaatggattaatatgattttttaaagcaactttcctatagaaattttttgcaaaaaacgcaccgtttagtagtttgaaaagcgtgcgcgcggaaaacgagagccaatctcccctatcacccctaaacgaacgatgcctaagtactttgagtaagcgaaacaatggaactggaagattgttttgaatttaaaaatacacataaaaaagtttgaaaagaagaccctgatttatcagcaattgagcatctcggcaaggttctcgccgctcggcgtcccggcccagccttttactcgtgggcataaaatagacagggccgatatcgtaatttcctccttcacaaatcccaaaccgccggtgccctagctatcgacgactcggcggcgacgcgcctccctggctccctcccgtcgctcctcctccccgacccacgaactccccccaatagggcagaaaggaagttcaaatttgctcctgatccgagcgccaaacgcctagattccaccacccaagcctcctctcccaatccgatctgccgttccctcttcgaatcggctcccccttctcgccgattaccgacgaatccgaggccctcctcctccttcgaatcca

SEQ ID NO: 3483 - DNA, 1501 bp, Oryza sativa
aacaagtaattgtggaggagcttagtcaatttcaccggactaaattgcagttgttcacatcagatttgcaacaggagtagatccggctctcagtacgtccggagcgatcgtattcctcccactggccatataattctagctagggatgtaagtgtatcaagttaccaacccataaacccacttataagtaaaatttagtggccgtagattaactcgtggattacctactaatttaatctataaataagtttatggatcgatcacttatatttctaggtatgataataagccggaccatgatatgaaaacctgttaattatcacttatttgatatatatataagtagattcacatgtcgacccgcttacatacattccgaatgtcttccaatcaacgagcagtccttccatgtttggttgtgtgacagccgcaagaggatgaccaaggatcatagccgagggtttgacacgatagccacactggtagcttggacaatctagaagtaaagaaacaatcggctcttcaaccaggaaagcagaacctggccggagatcgctagggctatgacgggtgaagcggacctttggtggatggctagggcagccataccggccatggtagttccttctttgatagatgggtcaccaaattccctagaagattaggctttctgtttttcttcccccctcctgtaccctgtcctcttcatttttaatttgttcggcccgtcttgtacatacatttattctttcttaataaaaatgcgcacctcgcgtattcccaaaaacatgtcgactcatcgtctcataaaaaaccaacctagaatttgagcatacctctgtctaaattcattgtactataatatgtcacatccagttctagattcatttttttcgggacgggggagtacatccctaccacacctttgacatgtcttgatcgcggagcaaagctaagcagccattgagcagaaaaatacggccagaaagcgtcgataacgataagtaagcccagctctcccctttccctttccttctcgccgcctccagaaaacgaagacgacgaagagaagagaaacacaaagcctctcttatgttgtttttttgcaggagtattttttttttgggtcccagagagcgacgcgcatttcgccgtgtgcctctagtggcagcaagctgcgcagcacagcacacttggaggattcccagcgttgtgtcgtccgtccgtcgcatcgtttcccttcaggattagcattgcaagcagccagacagcagcgcctctctctctctctctctctctctctctctctctcttccgttccaaaattccaacgagttccccgttttgctccgcttcctcctctgctccaggaataatattttgctggagaatagtcggatgcaggaggcgaaaaaagattcgatctttggaggccttgcctctggggcgcccgtcggagcggatcgcttcccgtttgatcctcgggagtattcgccggcga

SEQ ID NO: 3484 - DNA, 1501 bp, Oryza sativa
aaagaaatattaaaagatgagtctagagtctatataggaatatatataatttacaaataactaaaatttgatattaaaaataattaataactaatacgtatataaaatgcaacatgaatattatacattagtagtttcataaagttattgcaaaatttaaaattatgttgtcattttaatatatttgaataatatattgagaaaacatatatgtattatatgagagaaaatataatgatactagccgcgcaatctgcgggggccaccatgctagttgtcttaattagaggtattttgcaatgatttatagtaactatttatagtactagttgataccatgcgcttcattgcggtatatatggattaacgcgtattataatagaaatgatagatgtatatatttaaataatgtgaaatgatgtggagataatgattggacattgcttgcatattaaattctaaaaatataataaaattgtaaataatatatcatatttgcatgatatttaaaatactctaaataataattattgctaagaggtaatgatgtcacatatttgcatattgagttttagaagttaatggacgttagcttagctttatagtttgatagaatttacaatcttctttatagtactacttaactattgacagtagaaaaaccatttttctacttgaagtagaacttataaattaacccttgggacggtgggaccacttataatcgataataataccgttattacggagagttgaagaccaccgtaaaggtgctcattgtcttattgatatgagtaggggtgggcatatttagaccgaaccgaaaagacggagaccgagaaattcggttagtagttcggtttcagccatcaaaagaccgaatttatttcgggtatttcggtcattgggctcggttaaccgaattaaccgagataaccgaattgtggcccaataaacttaggaggcccaataagcctagtaacataaaccctaattccaccctctctctcactgcctgcccccacgcgtcacgccccaccctccctcctcatgagtcagcaccgcattcctccccattcatcgcacgttcgcgctcacctccgctcggcctccgcggctccgtctccaccgcgccacttccgccctcggcctccagcctccaccgcgcaggcgccggtgtcgcctccgccctccgcctccagcctccacccactgcgtcggcgccgcctccgccctccgacccatctcgccgcggccgccgcctctgcctcggtgccgcctccagccaggacgcctccgcctcggcgccgccctttcacctgcgctggagacctagatggctgaggaggtcggtcggggatgaaagcgatggtgggagatcgacgggatctggagcttgaggtggaattgtggagatcgatttgctttgatttgcttcttgttttttctgaatcatgctctagtggcatcatattgtagttcttcatccgagttgcttcga

SEQ ID NO: 3485 - DNA, 1501 bp, Oryza sativa
gcacaacgccggcatccgaatcgtcgtccccggccatccaccttggtgtgccggtccttgttcgagctccgcttcggccctagcccctgcatcctcctattccccgtcaccgccgccaccacctgcatctgctgctgctgatagtggatcctctccctcgcggcgtgcgctcgcatcctccggcggtccccacatcttccgcgcctccggcgcctcccctgtccagggagagagaagggggaggagagaggagagtggtggaggagaggaagagtagaaatgccacttacatgtgggccctcacgtatttttttaattttttttttcgatgactaggatgccacgtcagcaaaaccaccgtcagaaaccattaagggagttgttttgtactggttttaacacttagaggaggtaatatacctggttttgtggttgagggatgtaattcgacaaaggggaataattgagagaggtataatggacttattcctttattcggtcatgggcctatacgggcctatctgtgacagatatgtacgcttgtccacccagactgtcgtgagcagagcggatcgaagcccagtacacaaacccaaccagaaagagatctgcataatcaagaacgaactgccccgcacgacagtgtctcgcagagatccatggagccacgttgtgatttcgcggctcgcacgacctgaagaaggaccacagccggagttgagcgcgcgcgacatgagcgcgcgcccccgtgtgaaggcctgggaaaatattttctatacccaaatatcatggcgtctaggtgtatgcatgtagtttaaataattttataaaaatattataaaattagataagatagactgcgataatataagatactatacaaacatgtaagtctaaaatcaatctacatatgaagaaataaaaataacaaattttatctgcgttgtacgggtactattcactgtctgatattattatttttgtttctctagttcagttcttgtatgattgtgtatagacttgtatcatcataattgattgttttaattttttctataactatttaaatcacatgcaaatgatggatgccatgacacctaggcatagaataggcatagaaaattcttgtccgctcgcccctcccaaaattaaacaagcctctctcccggtttgcacgaccgggttcgtccgtctgtcatctgtgtggcccggagcccatcccgtctcctatctttgctcccgtgctcacgccgccccgccctttaaaccatcgcccgttgctgtctgcccatctctcctccctcccttctctggagacgccacgcccacgttcctctcgtctcgccctgaatcgatctcctccgtcgatcgatcggaagagttgggagttgggaagctatagctacggtgattcctcgagctggaccagaccgaggcctgaaggttttccatcgaccgatcggtgaatcacccggtgctagtatacgtaccccggccgcca

SEQ ID NO: 3486 - DNA, 1501 bp, Oryza sativa
tcttttttttcagcagaatcagaattcattttttttctggaaaaaaaaggagtaaaattctactagctggcagaatctccaacctccattgattatactattatagtgacgatccaattaaacgtgcttaatgtaacacgcatatagaataatcaaaagctgctagttagataactgcttccaagtcacaattgttgtcaaagcacgaaattgcatacatctttgtgaaaggggaaaaggatgagatagggagtcctatatagttatataagtgtgggagtgcatatagtttgtatttgcagtttttctttcaaaaaagtttgtatttatagtctgaaaaaaaaatacaaggacggaaaaagttttgccaacaaaaaagtacagtttaggggaagctgaataaagggctagttccatacagactatacagtactacacaacagaaaaaatataaaaaaactaacgcacgatagtacagacctaatagcgcgcgatttgtatcaacaaccactgtttttgagcaattggatcactatatttaatttgtttcgtctaaatatttgcaaacgacctcgctggaaaaggaataggaaagaaatgatgggctgcaacaaacacggcaactaacaagtgtctagttttagcccctgtttattcagcttaggattattataatctggattattaactgtaagctgaaacaaacaagtagattattatgctagattattataacatataagccagattactataatccaataatctcctctagagaagctagcttttttcagattattgagtggctaaagatccactactcttagatgcctctaataatccagagaaacaaacaactcatagcttattttatgtcagcttattataatacagcttagagtaatctgatttaataatctagattacaataatcttaagctgaaacaaatatggccttaatcgataagtatatcactcgcttaaaacttcttccttctaatataatatattgatgtgtaatatttttcgcattcgaaacaaaattcagttaaaacttaaaaccctgcccctcattggttgtgtggctaattaaattggctatactcaaactcggaattcggatccggtgcagttacagttgtaactgcaagttaacactgcacacaacaccagccatccgtttttctgatcaacggtttagatgtaaagctacagtggccatgtgaacagtacccgtgctacagtgctacagttcgcgatctgagctgtccagttcgcatccaatggtgctaatgctactgattaagttgcagtcactattgtgactgcacctgatccaaatcctcaaactcgacgccgtggcagctgggcggcagccacgcagggtggagatgcatctttttttttaaaaaaaaacggtggagatgcttggagggcgcaaatactcaccataaacggataaaagtttcactggacgacgcgtataaaaggcctgatcgat

SEQ ID NO: 3487 - DNA, 1501 bp, Oryza sativa
gagacgttctgctaaagttcaggtcttggtttcctcctccattttttgccacgagcactattgatggattttatgaatgttaaaatccattggtggagaactttttgatgaactgcattggcttattggtcagtacattaaaatcatcggatcaaatttcacactacaaagtggtagctactcaatcaccgtaaaattactcatgattcaacatgaatgtatcttgatcaattttatggtctgagaaggtaaaaaagatgccacatttgtagtacaaaatttgttaacaaaacttacactaaaaatttaatgtatctccctgtacctcccaaagtccataaattttttctatattttggttccgttttgaacttatttcatttacattatttgatggattattaccgtggattatctacttcattgtaggttatattaaatattttagaaaataaacacacaaatagcttaaaacaacctaaataatataatagcagaatttttttaagaaaaatatttttcgaagcgtggagaaaaatccgtttcaataatctaatgaataatcgaaaaaaagggccaccagaacactctgtccttgaattaggacatctaaaacgcaagagtgagaaaaggtcacagaaattgacactacctactaatgcaactgcataccataagttaatgatcacagtcaggaaacgactttagggagaccacatacgtatattttcttagcactagctagcataagcatatctttctgcagagtccaaaacccagtttgctaccctaacaaaatcccctcttgggggaaggattgtatttttaagaagcatggatctgtcttgtgcaatattaattggggtactagtactaaataaactccgtagagaaatgtcaaagaaaaaaaagtattgtgcaatactaaactccatagagaaatgcaacagaaagaaaaaaaaaaggaaatgattgtcaagcaatatgcattcacctactccacgaggtgattaagtttaagaaacagtcagcaaagccagcagcttagcctttcgtcgtttcccctgccctattcagccaaaatgcaaaagaaaatgctcccggctctcaaacttgagagttgagacaatatcaatcaatcaacaactacgcacatttttgcatggtgcattttgcgtccattttatcttgacgtggtcgtgatctcactacgactctagaaggagtacaaaaatacttgctcgttgtttgcatgcgtacacagcgaaagtcccctcctctctttgtagccgacagaagccagccgacattttgttccgtcaggctataccacttgtagtcagtagagtgatgttcagattgtgacagtgaataccaaatactgcacatgtctgtacaagtggcttgcgtgcttgatcgtataagggatttataattatataaatggagaggctaattcaagaaactagcccgtgaaaggacaaaacattacttcatgtat

SEQ ID NO: 3488 - DNA, 1501 bp, Oryza sativa; identical to SEQ ID NO: 3482

SEQ ID NO: 3489 - DNA, 1501 bp, Oryza sativa
acgccaaattcgacaaaactgagccagcaaagtactatactcactctcgacgaagacgacgagagccttggagtcatcggccggcggctccgtgtcatcatcggtcttggagatcaccggcgatgtcgaagccgccgggatgacggccttctcctcccccgcgttcgctgcggcgggcgtcgcccccgcctccttcaatgcctccccggccatcttcaccgcgctcacgctacgctactgactcggcgcggctgcttacaatgaaaccaggcaccgtactgcttttggtagctagtatactatacgtttggtcacgacgactcacgggctgctgcgtagtgcgtactgaataccgactgatacgctgaggcctgagctgtgggtctctttatatacagcttctacccggccgggcttctgcctagaagagcctggagtgagtgcgatcggtccatcatcaatacattagattttggatttgaatttgaccgtaaatacgagggatttggagtacaatctttctccatccatccgatcatcgtatttattgctaactggttgtcacatggctaacgtgattttttccaatcaaataaacttttagggacaacaacgtaatttttacttttttacattaaactctgctagaagcctagattaacttagatttattaagccgagcaggttattgtcacatagtattatctacttgattataaaagtaaattaaaaatttgagaaataaactaaacagatagattaaaatacgtgatcttaacaatgcaatggaacgaaatttaagtttagccgtaaaagtcatgttgggatagttcgatgaataatctttttaagagagaaaactgaaaatccattatagttatcgacggagagtgtacttattttagtaagtagtagtaagcagtagtaagcagtaacgtgactggagaaatatgcgggcgcgtacgtgcggcgcacagggtgccgtcctctccagctcgccgccggatcggtcgtgccatccatcctcaaccaagcgtaccgcgcgggcgatgtaccgcggctccgtccgtgtattccttgactacgtgcgttgcctctcagacgtggaaggcaggggagccgcgagttttccgaatgagctattctgctgcaatccgcaagctaatttacgttgtggctacttgtttctagggtgaaaatggactgggacgattggattatgacattcctattatcctatattctaacccatatttttttaaaaaaattcggaaccaggtacggataatgccgaataacatatcactcatctcatatcctatcccatattatttccttcgaatcggatttgggaacatgtctccatttgtatctctaattcatagatattaaatataataaggtactccctccatcccataatattagacatggtaaaagttacacggtctttaaaattaatctttaacttataatttctcatatgctataagagttgtag

SEQ ID NO: 3490 - DNA, 1501 bp, Oryza sativa
tgttggatatgtatctttcaactttcctttttttttaactggtagacggcaggagaactgccgtttatattacaacgagtaaaatagaggacaaataaaagttaaagttattacaaaggctaaaaaagagaaaagggctactgaaggaatgaaagaagaccataagctatttcagggatgcttgaaagcaaaatccctttgctttaagtcttctaaacttaggtttacaagggtagcacacgagatctaaaacaaaaagatactactagtagaccacctacattggagatttaatcaagacattttcaaagacccaattatttcttgtcaaccacagaaccccaacaaacacaagcccccccccccccccaaaaaaaaaaaaaaactattgcaaatgaaatttaaaatattcaaaacgttcagataaacatgatagttctaaagcatctctgatgatacaccacacaaatgtagcaatgggacatttgaggagaacatgattagtagactctttttcctaacacattttacaaaattctttttcattttctttttactagctgaacatcacttggccagcctctctctcccagccatgtatataaagtgtttatttttggaggaattttactcttctagacctccatcacgcccgtctctcacccatcgaaactttagcgatttgtacatttatagtgtttgttttataagccccttcttctaatgtggacaaattagctgatctggttcatctattaataagacattcctcagcttatctgtcgactcaactaaatctctctggtcactttaatttagattccttcttaactctaaaacccactatcctccattcttggtgctgattaatgtagtatagttgagaaacaggatttataaacggattttgtcataccactcattccctaaatttaatttgaacataattgcctcttttagctttcttttcagagaacaattgcacccattttgtgactcatgtaaacccttctagaactgggatcctctctggggatgaacttctgtaaaactagttcattgccccgcgcgttgcatagcaggtcattttgtcattttagaaccacaaaacatacttgcgcatatatatagtacgttagagatcatatcttatatttgataatggttaaggcataagaaatagtcaacaaatgaatatatttttgcaatcattgttcagtatattaaaacgtccgatcattgaatctttggacgtcaatttaacaataaaaaacaacagtaacaatatttagtaacgccatgagacttacggttccatctaagtatataaacagtctatgagattagccggatagcatacaccagttcaaaagaccaagaccaaagtattgcaaaatactccctccgtattttaatgtatgacgccgttgacttttcgaccaacgtttgaccattcgttttatttaaaattttcgtgcaaatatgaaagtatttatatcac

SEQ ID NO: 3491 - DNA, 1501 bp, Oryza sativa
cgtattcaaacgggcggatttgcccccgcaaatctcgtcggcgccattgatggcggccggacctcctgcgccggtctccttcccctccggccgctctctcccccttccaaccctatttaaaccctccccgcacctcctccgtccgtttccgcctctcgccgcccttcctcctcaccggattcgagctcgcgacgtcgctctctctctctccgccgtcgccgccaagctccggtccgccgccgtcgtcgccccggaccgcctcccaccttggtgccgcctccttcgggttcgctgcatcctcgccgacctcgtccacctctctgtttcgatcgccgaccgccggaacgccgtcgaccccgttgacccgagccgcgccgccgcctccctccgctccggccgcctcctccgtcgccgccgtcgccccggggtgagccgtggaccgtcgcctcctttcccccttccctcccctctctcggccgccgctccgccgcgccggcggtcgccggcggcaaccatcggggcgcgggcgcgctgcctcccgccgaccgcgccggcgtggccgccctcgggcgcgccgagtggctgccgcgtggggcccggccgtcagctgcccgcgccctcgggtgcggctgacgtgtggggcccacggcgccggccggtgtgagcccgggtgcacccggtccaccgtggaccgtgaggctgccgcgtgggccccactcccgtggacccggtccgcgcgcccctccccctcggctgacgcaataaacccttttaaaattaaaatttaaataaagaaattcgtaaatattcatttaaagagcatataaacttcaaatggccataacttggccatttgaactcagaattggaccattcaagtctctaatttttccttaagaagtcaagaacccatttttgtgctttgttcttgctggttatatggagtttattagagtaaaagccttttcttttccattggtcgtgtagacgctgcagcttcggaagatccgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgctattgttattatttccttgttcaccctagaataaacaaaaccccaactagtggacactctactcatggtaccactagtatgattttaggcagatgcttcgctggttaattaggcaacattatgtggttttacaactctagactttgggatattcatatcacctggacactacggaatggttggattattgtggaattggattcacacctccccctctattcaaaatcctcaaaatggttttaggctgggctcggggtgcatggttttgatagtagcacatcggccatataaggaccggt

SEQ ID NO: 3492 - DNA, 1501 bp, Oryza sativa
gccaaatcccaagaacttcaccccattcctatgggatgctgccaaagcagatgagcaaaggacatcctcctacggtcactagaggtacaatagtttttattgggattgatgttacttgacatgaccaagtccctctctcctatactaatcgttctaacgtggagtagtaaaggcaggagacaaattagctttaggtaaaaataaccaaactacccttaattattagttgcagatagttatttcaatgcttacgaaattgtcacaaaataattgcaccagccatgcctgctacccaaggaatatttctagcatggagtacaattatttaaacaaaaagttcgaataccccctaaaatatggcgctagttcgaattatcccctttgaattcaaatactaggcattttacacccgagttcttaaatctagacaaattacccctaatttaatcatgtgtagttttcagcttacgtggcacacacatggcatctgtcagaaaaacaaatactccgtaaaaatctggcggggcctattgtcggtgatgctttttttcctcaccctcaatgcctcgctctccaccaacaactcggaatcgaccagctatccgccgcccgtgctccaccgacaaatatctccttctcctctatacgatgaacacctagaggaggaacccaccgatagagggtggtgggacaccataacctacttgccttcctcttcatttcttcccctcttccgagcatgcttgggctttagatgctcaccgctgcatgccatccacccgactccctcagcgaagaggtcgacgcagatccaccagctccgtgcaggaatgagctcctcggcagcgacaacgatgagcttgatgcctactggcctctcctcaattcggcactgccggctatcaatttgatggggcggcgcctcgaacagaaggctaaggagggagcagaaggaggtccaggagaggcacattcgatggccagaggaggaggtggagccggtggtctcgatcagagtggctccgtcgatctagaccgcaccagtgcttaagcccactcactgaggtccgtggaggcgaattgcctccgaagcccaagccaaccaagaggaggtggtgtggatccgaacttggttcattgtcgagagatcgagtttgctctgcgatgggtggatccatcgctgtgatgttgccaccaccaaccaccgccattgttccacctctaacatcattcgccgccccgtgcacacttggcccacagccgtcactctaagtcccatctcggcaccgtaacttgggaataaggggagtcgagaggtacaagcccctcctaggcactgccctcctcatcggcaagcgcatgcaatggaaaagctgtgatgcgatgcatgcgctagcatgcttgtgatgctgaggaggaggcggcgtgactctttgtgctaaggtgatctttgtgttgatttgtcacgcccagaaattcactgatattttccgaacttatt

SEQ ID NO: 3493 - DNA, 1501 bp, Oryza sativa
accagtaaaaaaataggagagcaacatgcagcattagaacaagagaatagcacgattaaaaaattgaaagctaatagcctgcattgtatgtcaggtagattatttatctattgaatgagttggcaagtttttggagccatcagtcggcgccgttattaaacttgctctaagtgctagagctatactactactctgcctcgtcagcctcgacctcaccttagctgacatttgcataaaacctgaagctgtgaagaagacccatcctaaaggggaaactcttttaatcacacggtggacgtccacctgtttattatatgccatctaaataattattaaaaaaataagattgatcaatatgtaatatatccacaaacatacaagttcaaattcaacttctataaattgtaacaaaaataacaattaaaacttaaattagtataagtatatttgcagttgaatttattatttttgttacaacttatagaagttgaatttaaacttacatgcttgtggggtgatatattacatattgatctatcttatcaagtgttctgaaatttttttaaaactatttggttgacatgtaataaacgggtgaacgtccaccaagtgattagaaaccatcctaaagccactagatgcgagattgttaaggggcgatcgatcgcccctagcgggcccccctctcctccatatggtttctttttttggcaccgcattactttcctattttagtaaatttatacacctaaagtttacacatctaaagtttaaagacccaaagtttataaatcaaaagtttatatatccgattcaaatttaaatttgaattgaaatatttttaaatatagtatttatatacacctaaagtttatagatccaaagtttataagtcaaaagtttacatacccggttcaaatttgaatttgaattatatccgattcaaattgaatttgaattcaaatattttttatatatagtatttctatgcatctaaagtttatacacctaaagtttatagatccaaagtttataagtcaaaagtttacatacccgattcaaatttaaattcaaatattagtttataggtccaaagtttataagtcaaaagtttacatatataccgtttcaaatttgaatttgaatttaattttttttatatatagtatttctatacataatttttttcaactttatgttttttattttttttaaaattatggtgtagtaggaagagaaggagaggaggaaggaagagagtagtatataggggatgggaggtgattagccggcccccactagatgcccgaatctgttcccgtggaaaatcttaacccgagacgcacggagatgttggggtcgtccacgaccacgagtataccacgtaccatatactgattgtgaaacgaactatatatacgtacgctcctgaagtcctgatcactcctaaatgagcctgaatgtatatatatgtatagattgcaacgtacgctacgcatac

SEQ ID NO: 3494 - DNA, 1438 bp, Oryza sativa
  unsure (1)..(1438): unsure at all n locations
gcaactatgtaaattcctcagtacaacctagaccctagaagtgagaatctgtaacggggctataaatagccccctagggccatgtaatacaggggagaaaattcaagaaatcaatatacttcgtttctttccaaccactgttaagtaaccacgtctttcgacgtatgcggttgtcgtttcgataacagctggcgccgaccgtggggacctccgagcgaaaccactgagagcgaatgccaccgaagaaggtcgtgaaggagaaggttacaaggcgaaaggaaagcgacgccggggcggacatggccgccgaagaaggagcggaaccttcggcatcaatcgccgaagtgggaggagccccgtccgcttcggcaccggcaccgtctgcttcggcgctgatcacagcattgctgccttcggcccctgccacctctgagcaggcgccaagggtggatgaagtggcgaaggcggctgcagcggcaagggcgcttcagaccagggcggagatcctttcggcaggacagctgctggtgccccctgccgctccgtcgcagccaacagtggcccaagccgcactccctgccgtgcaagttcaagtcaactccgaccctgaaacacaagccgaagccgatatggaaactattaggcagaacatggcacgactccaagacatgcttcgccaaatgcaagaacagcaacaagcgtacgaggcggcgaggcggtccagggtcccttcggcaccaantcctccaatannttcggcaggggtattgtcnnccgnnnctcaagtctnngtccacaagtnngcagtccctagcnnccgtntccccgncnncgncnnaagtctcacaggcattcggtgcacttcgccgggcagccggcagccgcagcagtgcaccaggccccctatggacaagctcagcagatcgcggcccaagtgtagcctcaaccacttggccaggtgtcgcaaaccgtagcggaaggggcttcggctctgcaggcgcaattccaagctttccttcagcaactcaatcagccccacaacatttcgagtacagctccctcgactcgtccagaggggagtacaggtcaaggtgcacctagttggttgccgccgaaccagccgaatctgggggcttcgccatggagtcagacacctcagtacgacttcgtcaatgccgcccaggcgcaaactgttcggccgcaaggaccgacaccaggctttggaacaagccaagcaccagcccaagtcgccatgacatggtcgcagccagttttcgacccatccatggcgacccagcaagtattaccaatcgcaaccgggcagccgagcaccatggctcaaactcacgcgcaagccgtaatttcacctttcgccacgccgtacccgcagcaaggtgcagcaaacagagcggggggcgagaaggggctgccgctgagt

SEQ ID NO: 3495 - DNA, 1501 bp, Oryza sativa
ttgttatgcaaatatgaagttacataagaatattttttcctgcattgggatttatcaacagcattactcttttaaacataagataatttattccatagattgtgttttgtgatgtactgttgagacttaaaaattggacttatatgattatattttatggtgaattattgaccgttaagacttgagaattggatttatcagtttgaggggttttttattccgataaatttttattaccatatttgcaccggttctttttcgctccgttttcggtttcgataatcttcgattccgttttcgtatccggagtttccgattccgattttgattccgaaaaaaaaatatgaaaacagaaacgataaaggtggtttctgtccgtttccgtaccgttttcacccctaccgctacctgccacgaacgagctcatcgttgctaggtcaatggcctcaccatcgccgcagacttgacgaggaaagacgaggccggcggcggtagaaacgccactcccgaggctcgccagggccatatctgcaccatccgtcatcgccaagcatgccgccggccgccgccaagccgcccactcccccgcgcagccgccaccaccaagcaccactgcctcaccgtgccacctttgccgccagatttgcacgatccatcgtcaccaaggctgctgctgcgggccaacccctcccccgcgccgccacaactgagcaccactgcctcctcgtaccaccggcaccgccacctccttccgccgccgcttgccgaagaatcgagagagagagagagggagagagagaagtgattgagggaggggttaggtccggggttggtggtgatagccgaggaaaaaaagaaaagagcaaggggaaaatgatttccgtggcttggttggtggggatgtacatgctattttattctctcccacaagttttgtttgcggggcccttaggaccccgccgctaaaaattgattctcttacatacgacatattttaagagcactacttgtaaaaatagatgtatttttcatacggttttcttaatgctctgctagtaaaaattgatttttactagtgtggctaagttttcagggtcttatataagcgtgggttttttagtccgtccgttaaaataaattcaaagtgttgcgatggtgatctggtcacttcttgctaaacggaattaggtcatttcttgctggataatgtcaaattgtcaaccaagttcaacattagaggctgcaagttcgacggtgacgcacaatcctgagccaaagtcacgagatgtatatatccatctcttattctctttgcgtattgcataagaagaaagctgtgaggtttacctgaaagctccgtacacctaaaccgacatggctattattccgtcttgtcgtctaatggctttttgtccatctaattcgttcacctatcgaaagcaaggttccctagcaccttcaattttcacaacatggtataaaaaagaatcaaaagacgaga

SEQ ID NO: 3496 - DNA, 1501 bp, Oryza sativa
ttcttgtttaattggctacagtttcttaacgagcacgtagcggtaccagtggtgttaatttcatccatttgctaactggtggaaataacgcttagtatgtagtatagtgctaactcctttctaaaaataggaaaaaaaattctattttactcattcaaactattttaccggatcacttaacccttaagctattttcttttgctcatttattcccctaaactattaaagggtttagtttactctcgttatttctctctgtcctatatatgcctcgcactaaaatttagtagggttgttaggtgcattacaacttattatctcttattaagtattctttttaccaaggtttgcaattttgcatggattggaagcacacaccgagacatatttatttaaacattgagattttaaaattttagcgaacagttacggaaaaagattaaaaatatttcaaaacattgacaatggtgtcatctatggctaaacaattgcatattgaattacgaattgtataaagagaaaaaaagaagaaaaatggtattaagctgctaattgaatagtttttaatagctcaggagggaaaacgagaaaaaaatatttatgtgataagtgatccaacaaaatagtttgagagaggaaagtgaattgtttaagctatagaaagtgtattacactagctttttatatgatctccaccattatatatattgaccattaatttagttcataatatattattaacaattgcaaaattaatatcgtataaattatttttaaatacgaatataaaggtattacatccatcaaactaaacacatatttttacttcaattgttagtaataaattttatatagtgaattttcaagaaacaaaaacttttgagagtgagagagacggggggcagggaatggatatgcaatatattttagaaggttgattttatcatcattgaaaaagtattgagatgtatcatattttctagtgtaagatttgaaacgaaggtaccaaaaaatttagtgtaaaattcagatacctcgaggtactaacctctatagtgaagaattaatgttcaaacattgtagacaacactagccaaatcagagcaactgggctaactagctcccaaatcagaggaaacataagccaagaatagtttcccaaagtacaagcccagtctctaccacagaagtaacctgcccacattgcataggcattcttctttcacatcacagcataattcatctttcagctagctgatcaacctatttgctaccccaaaaaaataaaaaagtagaaaaaaaaccccagaatcaattaaaacctgcaggaaacaaccaccctcggttaccgcctcacccacatgcaccctggcttcacaacactagccgtcacagtgtcacgtacccccctataaatacccatctcacttccaaaagcttaacacgacgcaacacattctccactgacattgatcgatcgatcgatcgagtcgagtcgcca

SEQ ID NO: 3497 - DNA, 1501 bp, Oryza sativa
tggagaactgatctttgttcggatggcaaaaatcacattagtcccggttcgaataggaatcgggactaaagaatatgttcagttctggtttataagcccaacgacactttatgatctttagtcccggttggtaaacacaccaactaaatatcatttttagtcctggtttaattgttgtcgagccgtgtcaagccaccaatgatctttgactaaagataaacactttagtccaggttgtttataccaaccggaagtaaagataaaaaaaatggaacgagatagccgagccgcatgggcttatctcctcgtcgtccttatcttcttcgcacggctgagacaaagaacccccgcttcgccctcctcctccccctcccctcgatctcttcatatggttgagactacggcgacggcgggcggcgggcgcgcgctcctcctccgcatccctctcgctcctaccttacccctcgccgccactccccctcctcctcctcctctccctggcggcgccacccgtttctctaatgccgtcttctcctcctccccccttccctccgtcctcgatgacgacggatgacggcgaccaccgtggccaagagtagcgaggaggtgcccccggcgagagggcttcctctgtatcttcacccgccgtttccacatggcccagagcgcaaaggagagggggccgggctagggtgcggaggcagggcggcgcacgacgataggtacattgtcttctctcctatactacgtctcatcttgtcagtcgtcacgttcttgttctcgatccgagtttttggttcgcaggattttgcatttttcttttcagttcggctcccgatgtggtgttcggtcggggtgcttcatcgatggaccgccacccgccgcttgccatctccccgtggaggctccgtccacgctcgctgctcgccgtttaggaatttggttgagatgagcggatccatgtttcttttcttccctagcggttgttcttgatgtgctagttttttcttgtataaatcctaaggaattacctaaggaatggttgattatattggttgttgtgcgatgcatcgatgcatatctttttaggtatttagggatggattgtttggtccgatacaagcagcaaaaaaaaaacaatgaaaaaaagaaataaaaagacctttagtttcggattgaatgttccggtttacaacccaggactaaagatgagtttctcagtagtgttaattacttgataaattaaaagtcaaaaactagttttatatatcacgctaattgtaaccatctcttatattttggaaaagaggaagtactatatttctcataggaatcttggaatatcccaagaattcactttacagacagggcgtttgcaccgcaaaatttcactagtataaagctttgatatatacgtgcatgtacatacagctgtcatatatagtatatatagctttagtacgcagttacacccactacttatatatactgatcaactgat

SEQ ID NO: 3498 - DNA, 1501 bp, Oryza sativa
ccaagtagaagtataatataaaaatagctgaaattcagaattaaaaataagcaatattgaaagaagtttctatataagaacccaatacgagattaatcaaaatttgaaataaaaataaaataagattcgaaattagaaaaggaaaggagagtccaagtagaaatacaatttaaaaatagctgaaattcggaattaaaaataagcaatatcgaaagaagtttctatataagaactcaatacgagattaatcaaaattcgaaataaaaataaaataagattcaaaattagaaaaggaaaagagagtccaagtagaaatacaatttaaaaatagctaaaattcggaattaaaaataaggaatattaaaagaagagtccatattagaacccaatatgagattaattaaaatttggaataaaaataaataaatccgaaattagcaaaagaaaataaaagaagagttcaagtaggaatataatttaaaattagttgaaattcggaattaaaaataagcaatgttgaaagaagagtccatataagaatccaatacgagattaattaaaatttagaattaaaaataaaataatgtccaaaattaaaaaaattaaaagagagttcaagtaggaatacagttttgaaacaactgaaattgaaaataaaaaaaaagcattaaaagaacataatacggtattgactacttcctccgtttcacaatgtaagattttctagcattgcccatatacatatagatgttaatgaatctacacacatacatatgtctagattcattaacatctaaataaatgtggataatgctagaaagtcttacgttgtgaaacggaggaagtaattttttttaaaaaaaactgaaattagaaaaagaaaaataagatttcagctaggaatataatttataaataactaaaatttgtgataaaaataaagattattgaaagaaaagattgtccaaaacacatgatgagataaattaagtaacaggcctataaaggagtagagtgatggcggttgatacaacatataaaaattgttaataaaacaccaaatagaatcctaatgacgattaaaaggagggacatcaggcaggctgtgaagcaaacgagtaagacggttgccaggatttttagaaagtaaaaaaaatgaaccccattgataatcatattcgatttttaaaatctcaataacaataaaaaggagaaactgcgggcggggtgtataagagtatagttgcagagccaccgatggttgacgggacttctagaaactaaaaaatgaattccaacgatagttatgttcgatttttagaatcacaatgacaataaagagtaggcggcggacgggctgtagaggggcatagtggcatcgtttgatgggacttctaaaaattatagaaaataaaaataaaagtccaatttttaaaggttcggaacttctaaaaagtaaaagaaaaaacaatgttaatcatattcgattttaaaatctcaa

SEQ ID NO: 3499 - DNA, 1501 bp, Oryza sativa
ggctagccgcgtccacggccatctcctgccgcggctgcctcttgtcacactccttcttgacgacgtcgtcctgcgtgtcgttgacggcgccgcctcctccctctccccagcgttggcgtcggcttggcggtggtggcgaggcgggaggaccgtgtcggcgtcggcgctgggagctagagcggcaggaggcagggacaaactgcgttgcactccagctccagccccggccccgcccgccgccgaacccgatcccctgctgcttctgctgcgttgtcggcggcggcgtgaggatcgtcgacggcagctgcatggcgagacgtggccccaccgccatcggcatcccccgcgtcgagcccagcggcgcgcggtggaggaaaccaccgccagcgactccgctcagcggccggaaagaggcgaagaagaaggcggcggcaacgaggacggcggcgttgcctccccggccgccggaccccccgcgccgcgtggcggcttcgtccccactcgtcggtcgccctgccgcttgccctgagaagagagagaggatgggaaataagagagagatgatgacatggcatcttacatgtggggtccacacgctgactcagccgtcatgtcggataaaaccggggtcaaaaccactgaaggacctcaagcaaacggttttcttagttgagagacgaccggtatccagtatctgattttatggttggaggatgattttataacttgatgacaagttgaggaccttaggtgtactttttccaaggaattaccttaggagacatccaggtggtggcaatgggcagaaggcccatccgacctaggaagaagcggaattttttttatttttagattttttttaatatttacagaaataatctatcggtcaaaaaaattataaaaatagatcctgctgtccaccacttgggcggcaagctgacgtggcaaacgggggagggacaggcggtgacggagggagggttttttgcaggaaaacccttgccgccctctgttggggcggcaaggggtcccaatgcaaaaaagccagccgggaccggccattttccaggcggccccttgccgctctctggtcgggcggcaggcctcgctgcctataaaaggcatgccgcccagcccctagccctcattcctccccccacaaatctagtaaaaaaaagaagaaaggggaggagaagagaagaaggggcgaagccctgccggattcacacgccaatttcaggtaatattcattgatcctatatgtgactattgagttaaatattgtgtattttttaaaactttgtttgaataaatgcattatatttttagggttttagttgtactaatctagaagtgcgtattgtagatatcggtaactacgtagatctgctagtttggaatcagtactttaccgttgcattgtcatacacaaggagatattacgttgtaggtgtttattgcatgaaagaataatatgatctagttatttcgttgacagata

SEQ ID NO: 3500 - DNA, 1501 bp, Oryza sativa
cggtacacgagatccgccgccaccgccggagtcctcgtcgttgttgccggctggagagtgtgccgtaatgttgggggaggtcgcgccgggctcctcgtcctcctcgctgcagctgcccccctccccccccgcccccgcaccgtcgtcgtctcccccgctggcgccggccagttcacgtcgatcccccgcaggaatggcatctcgacgtcgaggcacgccatcatcgccgtcctcccccgaccttcgtaagatccatgcatgaaattgagacgccaagattgcagcatgcatgcacgcacaacatcgacgtagtccgtccatctatactcaccggaggaggaagaggaggagaagaggccggcgccgctgttccagccgcacaattgctgcgtctgtggggcggcaccacgggaaggctcgggtgaacccaagcctgggaagcgcgtgcaggtgaggtcccacgccaggtcgacgcggcggtcgccggcggcgcggaaccgcctcgtcccgcgctgccgccagaggagtcagggacggacgcggaaggccaagtgtctcctcgtcgggtgtgggtgctggtccacgagggcgtggttcctggagtccggcgctgagcacgacattgttgtcacactggacggcgaggtggaggcatcaatgctgctgctgcttttcgctcaatcagatgattcgatcacattcactgctactttccgtaaaaaaaaacattcactgctactcgagatcaagacttggtactactcatcgattaattaacttgtactcaagacactgatactgatcaatcaatcaatcagtggttagtgctcgtccgatatagaaaggcaaaagacgcaggcaagaacgaggagaggacggacaggaggttgcatagccatcagaaaaggaaaagagacgggagagagagagagagatcacggtgatggtcggagatgcggaggatagcgacggcgagagggtgcggctgttcgtcggccaggtgccctgcagcatggcggaggaggagatcctcgccgtcgaggcggtcacggcgtcgtgcacggcgaaggacaacgccgtcccgtcgggaggaagatggctgggccccgcggggacggacgctgccgtcacggacggcgcgcagcggaagcacgccgccatcgccgctccgcccgccgccggcctcctcactgaataagggaagagggaagagagaaaaaggaagagaaggagaagaaaaaaacgtgcagctggcatgtgggtcccatgtactttttttaaaaaaattgctaactagtgccacgtcctatatatactgcctacggactttgactgaacggtcgttttgtatagtttaggagtcaagatttctgattttatggttaagggaactcaaaaaatctcgctgttaagttgagggacctccagtgaacttattccccctcacaatcgccaccgattcggcaattcttacagtccgccggcgactgcggatgggata

SEQ ID NO: 3501 - DNA, 1501 bp, Oryza sativa
gtttagtaagaaaaatttaatacgtgtagcattgctctttaattaatactagatatcaatttggcgaccgaagcgattaaaaaaatggtttaattaatactagatatcaatttggcgaccgaagcgattaaaaaaatggtttaattaataggaaagcaaatccaggaggggattaggagaagaggcggtgcccccacccgagagggctcgtcgaggacgccggcgaggagcagccgccgggagagccaggcgtagaggcaggcgagcgggaagccgaggaggagcgggtagtagaacgggtggtggacgacgcccatggcgaggtcccccacggcggcggcggccgaggacgaggaggggaggaacgaggcgagccactcggcgaaggagccgaggtccgggccgaggaaggcgttggcggcgtagacggcgcagtggtgcggcccgaaccgcgccgccccggccagccgcgacagcgccgccccgcccgacagcgcgtacagcaggtgcgcccccggtcccggcatcacgtacgtacgcacgcctcgccaccgccgcggcgcgatggggatttggttcggtgcgagaggagggagacgtacgacgacgagttggattggagtggagcgtgtggtccaacttccggccggctgctcttatggggagttggaccaagaactccggcgacttgctcgctccgtgtccgactcgtatatggtaggtaggttgccgtttgtttgctcctcctcggcgtcgcttgcttttctcgtgcggttttaccgccaaaggtgcaggtggtttcggtttcgactagtacaaaaccaatctggttcgatactccgagtattagtatcaaattctaccaaattttactgattcgcagcgtcgataatcacgacaaaccttcgaagtcattcgaaagtttggaaggatttcgatatatgaaatccgctcaaaagctcgctcgactgatgtcacttgtaagaacagtcagctagtcaagcagcgctctttcgagaaaaagatatgtaagcaagtaagcagaccacctgcctaaacaaaacgaacagtggggatcgtcacccgtgggtgtccaattacctagaggctgagctaaacgctgctacctgctcggtgcatttctgcatttcatattggaaatctggagtgcaaagttccaggttccactatatgctggttgtactactgattgccctgtaaggtctggtttaatttccaactttttcttcaaactactccatccgtttcataatataagggattttaagtttttcttgtaacgtttgacactcgtcttattcaaaaattttgtgcaaatataaaaaacgaaaacttgtgtttaaagtactttggataataaagcaagtcacaaaaaaaataaataataattttaaatttttttgaataagacgagggatcaaagagtgcaaacaaaaactcaaaatcccttatgttatgggacggagggagtaaccttttc

SEQ ID NO: 3502 - DNA, 1501 bp, Oryza sativa
gtcaaacttatttaaatttgatcagatttataaaagatagtataataatattgttaacacaaaataaatatattgtcaaaatatattcaatgttatatataatgtaaataatttggtgttgtggttgttactaaatttttatataatttaatcaaatctaaagaattttgactagaaaaaaatgaaatgacttataacatgaaatagaaatagagagagtagatctgtggataaactaattttaaaatagactattttcctcagtgccaacattattgggtcactaataacactggcaccgacacccctttatcctccgtggtagccatttcattgacatggagaggatcggtgctaaagaggctaacactgatccctctacggctctacatctcgaacgcttggttgctaaggaagcgagggtgtctgcgctagtatcattaacgatgaaatgtttcaccccggtagcatcgagaaaaatgcccacttagtaaggttgtgctcagatataccaattcctaacttatactttctcgttttttcaaacacacgcttaccaaagtgctagtaagttgtttaaaaaaaatcatataacccatttttcaattttattttaattacttatttaatcatatgctaatagctcgtcctgttttaagtaaccatcgtatccgaacataacctaagtttaagtaggagtttatttacaaaataaagttttatagagaccaaagtgtaaaaaaatatctagtggttacatttgcacagcaccaaagcgcatctgaggaggtaggccccaccaatgacatgtggcccccgcggcagcgcatcgcgaccttccttcttcctcgtcggtctctccgtcctcctccaaccgggtggaggggcccacgcggcgacgagcggcagatccggcggcgtccagcggcgcggcggaagacggctgcggcgacgacgccgtcgtcgacggtggaggcgcagcaccggagctgcccggccgcgggccccgccaacgccaccggcgcgcgaggggggcgagcttcgggagctccgcccggaggacggcggcggcgccgagcggcggatctcgggaggctccccgagcgccccctactccggcgagccccacgcagcgacggcgagctccctgacggcttctcgctttcttgtttctcgtggagttgcttttttttttttctgacaaaagttgctgaggttcgtgtggccaaacttggtcacgcgaagctgttgggaagggtccccactcccctctctcctccagccacgtggcgcctagccccgccgcctacgtatataaagcaactgatgcgggtgggagtcgtgggacgccccatttttcccatcgcttttgcttttgctgagcgcagatccttcgccaattgggcgctaatcaggcgggtattttggatatttaggtttagggaggaggaagaggagaggtggttcatcaggtagaagaggagaaggaggatggcgaagg

SEQ ID NO: 3503 - DNA, 1501 bp, Oryza sativa
tttagatttgattaaattatataaaaatttagtaacaaccacaacaccaaattatttacattatatataacattgaatatattttgacaatatatttattttgtgttaacaatattattatactatcttttataaatctgatcaaatttaaataagtttgactaaaaaaatcaaaataacctactatttgtaataagttttcaagcagagctaaaatgtaaaaaaaaaacccacacaggaaactggggattggggaaagacggcgttgctggtttgatggtttctgttgcactgacctcccacccttggggtgggggcggggaggttgtcagtatcggtgtgtggggtggttgggggggggggggggggcggtgatgggtgtggcgagcgaagatgcagccagccacgaagacatcgatacgtgaggacggaaggaaggaaaatgaattgtgatcgagaccgtgtcgttgagaaaactggatgtgtcgccacgtgacgcggaccaaatcattggcttgaaagaaacagggcgctataattcctccaagtcatctacacaatgtacagcaacatatatacttgcaacgtaatactctctctctctccgtttcaaaatgtttgacaccactttttttaagtacgtgtttgaccatttgtcttatttaaaaaaaactaagtaattatttatttttttatattatttgattcattgttaaatatactttcatgtacacatatagttttatatatttcacaatttttttaataagacgaacggtcaaacatatgctaaaaagtcaacggtgtcaaatattttgaaacggagggagtatgtgtaatggaggagggttgctcttacttaatttactttactttagatcaagtttaagttgatgcgtgtgcgtaagtttgtattgaggggatatacacatggtgaaaatcgatgagttataactaaaaaattttcttgaccgggttcctgggtacccctcccatactctacctccacgctctgctaaggaatgggatatactacatgtatggcattaagcatatctattacggagtagtaatcaaccaatattattattctctctcctctgtctcttactagttatttcatccgttcaacaaagaatcaactagtattggatgtgccacatctagattcattttttatgggagagggagtaccacttcatcattaaaaattccgtgtggcactttttaatagattatgatgttacatcatttttttattgtcagatatatagagagaaaagtataatactatttagtactacgcactccctccgtagaaaatatgcacgggacccattcatcattcacacgaaaataatgtgggacccacatgtctatcctctttccttcttccttctccctttctctcacttctctctctctttctctcctctttctccttgtctgcacgccgaggcagttggctgagggccagagcgacggcagcgagcaggagggc

SEQ ID NO: 3504 - DNA, 1501 bp, Oryza sativa
tttcactgtactgcctgtttggactcgtaatgtgctgtggaattgtaggaacagtttaaaactcgtgggctactagctaatatgttcgggtattttacttttattttccctcttatagtatagcgaatgcaaccgaatctttttttcaaaaatgtatttcacttttctttgaatcaaatcaatccatctcttttccttgtgatcagatttcttgtgctattgaagcctctaaatgcacacacaacacaccgtgtcaaacttaaacgaaatcctgtttagctacacatacaaaaacatcctccttagcaatagcatggtttaatctcatcatcctgagtatgcattacatcagtgctgcgtacaagttcgattcaacgcaagctgccaatcaccagagcctttggaaaggccatgaaacggccctgtcagtttgattaatcgattaatatgatattttaaataactttcatatagattttgaaataacaatttaaaaatcgtgcacgcggaacatgaggaagatgtgttaatacaggctgccgaactaagcctaatatgtaaattataccttagattttgttaccacattttttttaactactaaacaatgtgctttgtacggaaactttctatataaaagttataaaatataaaataatttttaagtatataataattaaaacttgatatttttactagttaataattaaaactcaagtaatcatgcgttaatggttttatcgttttacgtgtgtacaccacttatatatgaaagctcatttttaataattaatattgagtgaattacaactatataataatagaaaatatgtgccgctctagctgattttcttatgtgatcaatcaaattcagataccatatgatgtcttgaaaaagatattacgaactctcacctgtacgctatctcccgaacaaacataaattctgtgtaaaatgggtgttttgaaagttgaaactatttgaagccagcatcactattcactccatgttctctcttcctactctccatgagcaagtttaatagtatagccaactgctagctccaaatcatctatagccaatttaatagctaatttatacaatagttgcttactatagaattaatgcatgatcccacctatcatacacacattatgtaatagttgcttactatacaattaatgcatgatcccacctatcatacacacattatgtaatagttgcttactatacaattaatgcatgatcccacctatcatacacacattatgtcttggaggttgtgctgcaactggctacagatatatagctcgctgttcttctctcttatcttttatctctttaaaatatatttataggtgactgatagtctgctattgtacttgctctaattgggtagttgggttgaagtgcgaggccgcaaagaattcaagacatggtccagagcccatatgaatggcccgagagaacaagtagccctcctaactataaggctccact

SEQ ID NO: 3505 - DNA, 1501 bp, Oryza sativa
acctcgtggcgcaggatgtgtgttggcggaatttggatattcttcgggcgagtgtatattgttcggcttgttcgaaaagttgttttcactagtgctactagtgtgctactcctatatggagtagtactactagtgtactacctcttttttgcgtgtgtgtgggtgtgtgtgggtgttgatggtgcatggagccatggaggacacagacacacggatggttgatgtaggccaacacttggtcgaatcaacctcgtccattcttttttgcaccccgtctgcccatctcaacaaacaaccactctttagtttgtattcacaattttccctaaaaaaaataaaaagcatgcattcacaatattactactgagtaccgacaacttaatatgacaagctacgtaattttgccaattaccacaacactatattagtactattaatatgtgggtgataaggaatcataaaatttagcgaatattttttgctttgcaacttgtatgattaattataaggaggaaacctaacgcttccagaatcctcctgacaaatatcttcacatccgtcacgggctcgctcacggtgtcaaaggttgtcaaatgagtcaattagatatttccaacccacactaaacccattccattccaccgcccttaaaccatacttaatccacgctaattatcctccaccacgagtccccacccgcccagatattatcgtggaccgcacgaaacgccaaccactagcccaccccccaaaaaaaaaaaaaaactcgcaccgctacacccgggcccaccccgcccatccccagccgcacgattaaacaaagcggaggcccacgcgcccatccccagccacacgatctcccccacaatcccctagcctcgccacccgccacgtgtcgtcccgcgcggccgcaagattggtccccttttcctccgggcctaccacgtgtccctcccgcgagagaaaatatcggcctcgagagccctcggctcctcgtcgcgatctcgcgggggaaacggaaatatcccaaccactgacgccgcgcacgccacgtcaacgtggggcccagcccgcgcgcgtgacgtggcggccccgcccaccggtcgagtgtagtacagatatttcgtgcgcggagctcgctcacgtgctcccacccccacccgccaccgcctcgcctcgctcgcccactggcgggtgggtccctctggttgactggcccacgtgtcggtgacggggagttgcctgtgtggtggtgtgggggtatatacacacgcctcctccccccgcttcggctttgtcgtgtcgcccacactggcatttggttttcgcgaacccacgaaccaatccattttcctagtggcgagctcgaggagagagagagaggaggaggagaggtggttgcgccttgcgcggtgaaagggtagttaccgccgcgggcgactccggcgaggaggggcgaggggcggagctagcggcgggggaatggggggtggagtggagg

SEQ ID NO: 3506 - DNA, 1501 bp, Oryza sativa
atgcaatcaatcagctgcttaattaaaggcagatgatcgaaacacagctgagagaccctttaattgggccccccctttccgttaaagaaaataaaaagcagcagaaaactgccttgtcaacgatccacagacagacagacacacacacagagcacagaacctgtcttaacagtatctatatatgctaaataatccggttgatttgtcccactgaaacgtgcatatatacgatagatacgatacctcccggtctattccttctcccctgcaaaccggggtttggactggaccactcgatcgccactgcactgtcaatcgatccatcacaccactgtttcctgctaattaatccaatcgaccccaacacgacatggatttcagctacgtcacgcgtaatatatccccactcctgcattggcttggtatctcactatatatatctcctttaattcgcacgattaaccgagacgtgatgtgatgaccgagtacaataagtgggtgttttgcacggtggatgacggtgaaatcgagcgttttgggtgggggaaacatcagaaaacccgcgcgaaacagggggagatggggggagccgcgcgcggatgaccgtggagtaaagaaaagagcaagctcccgtgttctccggtgtttgactgctactcaggccggcgcgcgccgctccgtgccgcgtcgtcgcacacgaacgatccggcggtgtcggtgacaacgattcgagatgaattgacatgttgagactgaaccagacacactgtcaactaaacaaatcttcttcttcctttccaggatcttttctgcgatcgaagacgcgtatacgtatgggcgtggctagcttggctggctttgaatattactacgcactgactatggcgttggaagggaggcatggaataactgaattctggagcacgccaacatatgctctctcgctgcatgcatacggcgcgggcaattaactccaccccggggtcgcatgctgcatgcagctagtagcagtgcagtacagtacagtacagtacattccaaccagctaactgtattcagaacgagagagagagagagagagaggggtgaggcagccggcaactgtaccctgccttttcccctcgactctctttctctctctcgcagcagcagcagcagccgcgttgccgtgtgcgcgtgttggtggctggctacctctccaactcacgcgcacacacacacatctcttttcctctcggtgcgatacgaagcgagagcgagagagagagagagaggaggcaaaggcaataaatggaagcttaggtgagcgcaggctccatggcggcgtggcagggcctctctgtcgcctcaccgtcttaactcgcggcagcgcagcgagctgagctgagctgatccggccgccgcggattaactcctcctggccgcgcgtgctagctactagctagtggtctacacgatcgagagagaggtttcggtttcttgatcggttcttgatctgctg

SEQ ID NO: 3507 - DNA, 1276 bp, Oryza sativa
ccacaactccactccaaactcaacttctgaagttatatttagtagttgaagctgtaccaaacatgcccttaatttagaaaaggggccttactctatactcctacttcaggattagcatccaaccaattgggtattcggaatctgtccatgagtacatgtacatccatatatcgatcatggatgagacttgatgagatgagatcatacgggatgacgatattaatggcgttatcgctgggtagtagtaataggtcaggaagatggatgcatagagtttagcattgtacagtaccggggcagcgaaaaatctgtacgtgtcacggatatcctcctctctttattactcctctgccattaagcactgtagcaacatgcaccatcgatccatcgccctttgcttgcccccacggcgacggtgccctccctcccctgattgattgcacgggtaagcatcgtgtgatcagcttcaatggcggaacgtgacagcgcgcgcggctcattagcactctctgtagtagtaccaaacaccacattgcatgcaaaaaaatttccaacaaatgaagttaaaattgggtatattgggcttatttcgtttggagccaatttttaccctaccaaactggtagtgccaaaacattggtaaattttggcactatcaaattgagtagtattcaatttgaactattgtgggtagaatttggtagcaaaccaaacattcacttgctactattgaagttaccaaaattttggtaaggtaataaattggaaccaaaccaaacaggcccattatcgtctgaacgttaacttatcagatactccctctgtctcataatatagcaactttggaccaaatgtcccgtccaaattcgtatgtactataaaatatcacatttggtattagattattatattataggacgaaagaagtatgacccaaacataaattacactcgttaaaagggtcctcatcgtttgttcgttagcttatatgcctagaataacgaaattttaaagtttattacgagggattttcattatccatttattagcgttagctttttaaaccagttagtattatttttatcgtaaaatttaaatcgagagcgctctcgatttagtcataatgagcgaccctatcatccaatcaaccgttgtccagatatgtcttgaagaatcttactttactatagtactaattgatcaagcaagtagaacaaatattcctatcatctatgcttcaaataaaattttctcttaaattactcatccgatttac

SEQ ID NO: 3508 - DNA, 1501 bp, Oryza sativa
ttttcttggattccatagaagatgcacacatacacatatcactatgcagtatacacacacacacaccccatacatccaaacaagtgctcctcctagcatatgttcaaagagggaccgacgacaaatcttgatctcgataaatttctattgaaatacattcgcgtgtagtacttgtgttggagttgtattacaatgcctgttttcttttatcattccatttaataatttattttccctcttcttaattactactatatacatatatacatgttgacacatggctacattagaggactcccaaactggttgcatatttaggcccactgtagctcagctagctacgtttagtacagcagcgagcttggcaattaggtcctttaaaatagaagggtaacttttgctcagattctctagtccctctgccttcacgatttccctcaattttactgtatcatcgaggaaatgcaagcaatcggagaatattaaggacggcgggatgggcgctcgctcgttgcgtccacgtcggattttgctacagtagctacggtgcgcacggggtggaaattatgcgaaaaagccctccgatttttcgtaataatgtataggtccctagcgtcctgtgtttgaagaggaataatcgcggacaggggcttttttgtgatatgtggaagaagaggggcttttccgcaaaacagcatccactaacgcataccccccaaagccctagctgccgcctctccctctcccgccccccctccggcgccgccgccgcttgcgcctaccctcgtgccgccgccgcctccgcctccccctccccctcgccccatccacgtcgccgagcgccgccgccgcctccactcccgccgcctgcgcctaccctcgcgcagccgcctccgcccccctccccctcgccccgtccacgtcgccgagcgccgcctccgccccctcgcgcgccgcactccgcctccccctccccctcgccctgtccaccccctcgccctgtccacgtcgccgagcgccgcctccgccccctcgcgccgccgcctccactcctgccgccgccgctgccgccgcagagcgccgccgccgctctccttgtcccgcgccgccaccgagtgcctgccatctcaccctctccctcttcttctcccgccgccgccgccgctgccgccgtcaccgagtgcagccgtctccacctccgccaccgccatcgccgtcgccgagcgccaccgctgccgctccctgctatccctttctcaccccgcctgcctccggtccccctgcttaccccgcctacctcccccatgatgcggcggcggcggtggcgacgacgacgacggtcgatggggtcatttcctccccacagaggtaggggtccacgctggctgcggcaaatttagtttgttcgcgctgttcagaaacggtggtcgcgtttcatgtgtacgggctgcgtttattggtgcatgtgaaggcacgtgtctttgagtgtgtctgtggcagc

SEQ ID NO: 3509 - DNA, 1501 bp, Oryza sativa
aaaaggaatattactttattttgatatcatcttttcttgtattgcaggttttggattcttaaactcgtagcgtttgctgtctatgtttagatggtatattactgatttgcagtatgagctaagcatcggtcatcttttcatttcattcttgcctctgaagataggtactgtgccattgaagatacatgtttgtgtgcaagctaaatcacacttatgcatttatgcatggttaattacattgtttgctctgttaatctacacaacatgatggcgttctctgcaatcttaagggatttatagttttatgcatgattatgcttttcaggtctttagtaaaaaaatggtggtcagggatttagtaagaaatgctggagcactaattgatcctctgctcaaattgatcaaatagtactgtccatttatgcctactcttttctgatcacatggtattgtgtcaaataaatttgatatttagctttggtgtccttaaatggcatggttgttttataagaccctgtgattttctacatgtcaccttaacaatcagtaggctctgttggatttgtgtggactcataaagaagaggtgcttgtgtttgctggttcatcaaacagctccatcaaagcggtagggcgtgggagaagccaaaggtttggctgtgctgctactactactagcatccattcacattcattactctgtagatcaatagtaccatttttatttgcggatcagcagtagggttctggacttacattgccgatcaaatgatttgcggatgcaaataatgaatttccatatgtacacctgtagtgggccgtatgataataatatatctggtacattgcagaaatggctttgtagtccaaaattgctcatataattaagttgtcaaattatgtgcacggacaatgcacctgatttgtctgcgataacaggtaatgacgtgccaaattgctcttcagcttctgcatccgatgtaatcacgtttctgtcaagtgacatttgatacttagatgctaataaactaaatctgtatgacaacagttacgggttgaatcaactaattttctgacagtacatgtgcttaagtgcacaacctaaaatttctttaattcagaagaacatgtaaccacattaggtataaaatttgcaagatatcgatcttaatggcctggtgctgctaggtgtatgcattaattctggtgcgctagatatagtttgcttgcctccaggattatatgataagttagatgtattttgttggcctgctggatgtatgcattcagctcctgacttattcttgatttatttgtgcatgccggatccatggaagaatcaacccactaaagtctgaactctgaaataaggcttttggtatactgtggcctatatattctgcacgtcatatagctttcatgtcacagtatatgtacaggttagcactggatggaaattaatacctcatttgttttctatcttttcaagaactttgctcagg

SEQ ID NO: 3510 - DNA, 748 bp, Oryza sativa
atttatgcacaattgcacagttccatgaaatccaaagataccgttaatgaatgtttctagattaggtatcgggactgtaaaccctgcctataagtagtcttggttatgcttatgccaaacttgtaatcagcgaggcctgtgtcctttgttcagtgtgatttggtcaaggcacaccacaacagtgtagctgtagcgaagcagtgccactagtagacgtccttctatgcctcctaacaaaactaagtaatctcaatcggtccgaagtttcacccgattgagatatggtcgcactgccatggtagatcggcataaaactagagcccgtcacggataacacttatctgtgacgggccatagttgagccccgatggagatgagggttccatatctcaatcggaacctaaaagtagcccgtcacaaatgacaatcatctgtgacgggctccaactaaagtctcgattgagataagtttaatgcccgtcacagatgacactcttctttgacgggcttttattaaggcccgatagagatacttgtatactcgtcacggttgattgttttagggccattacagatatttgttgcacagtataaataccccccaccacctagtgtaattgtatcccactatttactattttggtgggaggctgtagggggcgattttctgtcttttttccaaggaaaacagaaaattcctaaaagtgatcaaaatggagcaataaagtgagtaatattaatcattaat

SEQ ID NO: 3511 - DNA, 1501 bp, Oryza sativa
ttgttcagtgtgatttggtcaaggcacaccacaacagtgtagctgtagcgaagcagtgccactagtagacgtccttctatgcctcctaacaaaactaagtaatctcaatcggtccgaagtttcacccgattgagatatggtcgcactgccatggtagatcggcataaaactagagcccgtcacggataacacttatctgtgacgggccatagttgagccccgatggagatgagggttccatatctcaatcggaacctaaaagtagcccgtcacaaatgacaatcatctgtgacgggctccaactaaagtctcgattgagataagtttaatgcccgtcacagatgacactcttctttgacgggcttttattaaggcccgatagagatacttgtatactcgtcacggttgattgttttagggccattacagatatttgttgcacagtataaataccccccaccacctagtgtaattgtatcccactatttactattttggtgggaggctgtagggggcgattttctgtcttttttccaaggaaaacagaaaattcctaaaagtgatcaaaatggagcaataaagtgagtaatattaatcattaattgagcaatttcatcacgtcttattttagcaatactgatcttataagatgtgcctgtaattttttttttttttgcaattgatcgaagttccgtaaacaaggaaaaaaaactgaacaactccttagttacggtttactgtttaccttacataaaaaaaactgccactcttctcacatataattataattgaatgggttatgtttcatttgtattattttcttaattcttacacacaagtatatttatacaattagactcattaagaattcatattcccaaggggcctctgaatctcttatgtttacgaagaaaaatatggactgcatgtgtttgtgatccctttcttctcatgggctcataccatcaatcacacacattcaccttcatccttttaactcaaccaaaaagatctaaagcctctatttgagattattgagcgaattattactactgattatctatttataaatttaatattttgacaaatacatttaacaagatagctcaaactgcacggtttaagcaatactatatttcgaaacgtggtagtacaaataatccgtttcagtaatccgatcaataagcttaccaaatcatccttctcaaacggttcaagataagggaggaggtccatggccggagagagcagctgctgtactgatgacgccaactggcaatcaatcaaccaatcaccagcttacaattcggccacacataaactcgattcggactaaagacgccttgagaaaaaatccgctttccttactcgttggcgcataagagataaatacgccttcttcctcgtctcatagtagtatacacaaccaatcatcgcgatccgccctcgcaaacaaaaagaaaaaagaaaaaagaaaagaaaaacgaaacgaaagcttctt

SEQ ID NO: 3512 - DNA, 1501 bp, Oryza sativa
caagaatgagtacatgggatttaggagcccactcactctttgggccgcactcaagaagtggttcaagaagttgaagtacaccatcctaccccaagcagagcaggactaggttcgtcgacttcaaaagtgtctccgagtacaattccgcgatgcaccggatctgtaccaacctctccctctatggtaaggttatcacggacgcggaaaagatcgaaaagatgctctccaccttccaccctagcgtcgcttagagcacttgtaactacaggcaagtgtcatacaaggagtatgacgagatgatcgacatcatacaggtgctcgagtctcatgatgaggttcttcgcaagaactttgtctcccagacgcctagcaagagtgttggccttgaagttaatgcttaattagtgttgactcgacacacgtgcatatcccacaaccataagggctccctccgaaaaaaatggaaatttttagcagaggtacaagtgtagcctaaattccttgacaataagaaggattatttccagtcattcaggggaagagaaataacccttaaatgatactccctccgtcccaatatatagcaacctaggaccggatttgacatatcctaggactatcaaatccggtcctcggttgctatatattgggacggagggagtaaatgttaggaaaaatggtcaaacaaaggatgcacattttaccaagcaccagcgaatgcaaagtatgaaaagcacacatgagaattagataactgcctatcacttttgtgattcggagagcatgaccaagttgcattactcgaatataatacactggaggagggtgaaataccgaagaatgcaaaggtatacctcatcttgtctagaggcctcgaaaaaaaataggacaagaactctggctccttaaatctctaaagtaactggagacgtttggtgaaaacgggacgaaaatgaactctcaagctcatagtcactaaaagtaaccccagaatttgagggggagccagttcagagctggcaaatagtatgaaacctcaaaacatgcataccacatcttcccatcaaggaagaaacccagcagtcggagtgcacaccaacactggtaaaatgaaatagtcatgcccatatcaaagaatagaagcataaaaaaattgcatatccccatatatccatggatactcgcataagtgtcacatacaagtatacaaaccaataagaattggtaatgagacatgctatggacaatattctcttcatatagcaaatcagtggcagtcaacccagagttgaaaatcaactaaaagatcaaccggcaacgctgacctatagttgacaatgaatggctaaagaaattttggattgggcactgcatacaagcattaaaagtcccaaactaagttgataatccgaatatcatcacataaagaaagaaagctcattctttccgaacgagtttgagataaataggtagaaacctatgttgctttggcccgtaagcc

SEQ ID NO: 3513 - DNA, 1501 bp, Oryza sativa
aacgtatgatagtaaaccaagcaccccttcattcttttgatgttgtcacatcaatatcttaaatcattaataaattaaaacatcacaatttaatatgtgataacgatattaatagatttgcatgaaaaaagttttatttttaatgttttataaacatataattaatcaggaggcatgtatgttagagatcgtgttgacgttgaaaacaataattaaaagaaacacaggtacttcctccatttcacaatgtaagactttcaagcattgtctatattcatatagattttaataaatctagacacatatatatctattcattaacatctatatgaatatggcaatcctagaaagtcttacaatatgaaacggagggagtagtactttattttataggagtcttgattaagagtattaatttgagaaaattgtggtggcggaacataaatttacaatgtgggtacaaaatatagtacagaactttataaaatggtgcaccgttctgatcttattccctatgtaccacataaatttatatattagaatagtcgttttacatattcgtgcactaaaatacattggaattttcaccttttaattcttttgaaaaacttattttacaaatagacctaaaaagaatcattccaaaaatagatccttttcgcagcgtcacattattagcgttgtggtccaacatgacggccgccatccccttacccctcggtggaagctaagtcattgatgctgctcaagacctatttgtaatagaaaatgacctattttgaataaaatatatctacaaatagttcttgacagcaatagcactagcgtcaaagatatatttgtaattttttttacaaatatatttggatcacggtaccaatggcgtttagcgcccatgaaaaggatcatttctgtaatacctttttaggggcctatttataaaataggttttctaaaaggatcaaaaggtaaaaaattccagctaaaatacacctatctcttaagttcaactacctcaaacataatttactccttttgaaacagactccttttgaaacagactatgttccacttttgagtgtggtgatcaagagtaccattggggaataagttcatttgaggtcccttaatttggcaccaaatccaattttcatcctttaacccaaaaaccagatataaaggatccccaactttcaaaacgagtgcaaataaggtcattcggtagtattgtttcttgttttggctgacatggcacctacatggctaatttgacaagatcttcgtctcacgtgacattgacgtgacgcttacgtggcaatttgatttggaaaataataaaaatcgcgggtccacatatcagttacaccaaaaataataattaaaaacggtgggttccacgtgggccccacatgtcattctcactcccctcctatctccccatctcccctctcttcatctctctccgctctcctctctcctgattggacggtcaatggacagc

SEQ ID NO: 3514 - DNA, 1501 bp, Oryza sativa
gtgtttgagtgcagtaccgaaacctctccaagatggagatagtttcgcaataatgcacccggccacaaatttgtcaggtaagacacacttaaggagtttgagttccttagccatggtttgtatcttatgagcctgttcgactacagaacggttgtcagccatcttgtagacatgaaactgctccatgatatacagatcattactagcatcagtagcaccaaatttagtattcagtgcatcccacaactccgtagcgtcggtcatatgcatatacacctcgaccagacgatcgccaagcacgctaagaatgcatcccacaaaaagagtagtggcctcatcgaattctttctgctgatcagcattaagaacgcccataggcttgccagtacttacccagaagcatttcatagctgtcagccacagattgaccctgatctgccatctcttaaagtgcacactggtaaatttatccggcctcagtgcatcggcaaaaccagccatagtaaaatcacagcgtctataataaggtttttggaatgttgcgaatataggcatataatgatttaatatattccataaataaatcatgacattacagatgtatactagcattaacgcatcattagatctacacatgtaaactaagtagtaaaatatgaacagatcaaatatgcgcaacatgtcgaacacgtaccgaggtggcggaaagaccggttgctcggcatgaactacttgcggttgcgagcgtcgacgaaggcgtgcagcacgcgagcggagaggaaggcgaaccgtcgcggttgaacagggagcagtcgcacgaagcgcttcccaaaaaccttattgccgccttctcccggtgcaggacgtcgaaggcagaggttccggagacctgctctcccgatcgccggtgcacgctggcgagcgggatggagtagtccacgagcgacggcgcaacacagaggaggaggcaaaccctagattgatttcgcgtgtgttgcgtgaaggcggtggcacggtttatatagagataggtcacttgatcagggcgcccgcacgatctccactctgcataaccgagccggataagtcgcgcgtaacttatccggactccacgccgttttcacacaccggattttttggaatgttttcaacaacaaaacaaatccgaattttcttgccagcaaaacaaaactgtaaaaggaggctacatctgcgcaagggtgaggagccaatttttcggaccattcgacacgtacatcatgcacacgcgccgcctgccaagcgaggcaatcgagcgcgcgcgtgttgcccctcttctctccaccacacatgcttcaagtggctaggagggcatcctctcttttaaggaggtccccctctcctagaataagcaaggtggtactaaactccacatacatgccatcccatgaggttggcttttgtgattttccaaagaattaattttcgaatgggccttagcccatctattaattccaacagt

SEQ ID NO: 3515 - DNA, 1501 bp, Oryza sativa
tacgaattagtaatttttgtttggatgggatgtgtcatagtcctacaaatctggacaggaggcttatccagatttatagtactagaatacgtcccatccaactaaaaaatactaaaattatattttaggacggatggagtatatattaattatgtataaatgttagttgtatgaactccataaatgtgatctgcttgtgctgataaaaaggtctgctcgtggggtcacatatgaatcgacaattctgttacaaattaatttaactataagtaacgttgcaaataaaagagcaccatgccggcttttatacaagtagaaacgtatggctagctgataaatgtcccatgttgaggtaattagcgaatataaccttacttccttttagggaaaggttggcgtaaatcaggcaaaaaccacagaagtgtgatggttctactgattggcactgccgtgccgtgtcggctcgtctggcatgtcaatggtgccacgttggatccacgtggcaattgaagtcacggcctggtcgctctaggacatgaagacaatgtgaacctgccacattgtatttgcataatgtacatatattgtaaatgattgatatttttgtaagataataaaaatggtttacatgtttgacctctgcctacaagcagacatgcatccattgtattttataattgaaaatgagagaaaaatatagtgatgggacaatttccctcttctctgagaagatgatcaccagaattaaaagctaatataaatcccgtaaattatagcgattaattcgataggtgctactccatccaaaattgtataaaatacccttggctaccaattttaaaagtgtagcatcaccacgcatagtatctcgtttctcccatgatagcatcaaatacaagtatagcgttgattggtagacatgaagataacatgcatatgattagctattttcttattatgaaaaatatcatttcggcaccaaattggccaacatatgttattgatttgatcatagatggtagtacatatatctagtacaaaccatttggtaatcatttaatcaacaaacaaagaaacaatattcttggacctttaccctgtttcctttaacgccatagcaaatctagctttgtttggaggatatcgagatttgaaaaacagatcgtgagtagccagtcaatgaggatttgtaaaaattggattttataacttataattttctatttttggaattgcaattcatcatggtggtcttagattgtgttcttttagaatggatgggacttgagaactttttccttccgcacgcaaaatgaagcggtatattaacacataattagttaagtattagttaaaaaaataaaattattaatatggtttttaaagcaacgttcatatagatttttttttaaaaaacacaccgtttaacatatcatgaaatgtgtgcacgaaaaatgagggagtgaaaaatagaaaattggagaaaaaaacataaccttaa

SEQ ID NO: 3516 - DNA, 1501 bp, Oryza sativa
ggagatccctctcccgcgcgcatccgcccctctcgccgatccccaattcgccatggatccaccctacgcaggtcggtcagcgccgcccccgcatccgcggttttcgccttgttttttttttttgttgttgttgttgcgtgtgtgtggtggtggtgatggctcaggtctcgcggcggcgtcggggggagctcgatctgtttgttccggcgacgaatccgctgttccggcggtgtaattgcgggcttggtggtggaggaggaggaatttgtgggcgtggattttagggtgggaggcggtttttttttttttggggggggggtggtgtagtgttcgtcgagatttagactttttgtgtggatggatggatgggttagattatgcgcgcgtggattagattgcggcggtagagggtttgtactgttcattgattggtttgttgggttgatttggagctgtagctgatgcgtggtagaggggtggaggtggaagcgcgttggggagggtggatggcgatgccgctggtgtcagattcgccgctgcatgcggtgatgggtactcacattgcgccccctctctaccgggggaggtggcagcggagtggttcctgcggctttacgtcgttttcgtgggatttacgtccgcgggcgttggtagcagcagcctatcctcttttgggacgggaaaataatatggcgttaggctgtttgaggcctcctgttcgtgcgttgggtgttgcattggtgctgatttggtgggatcacggctgccgaaggcgggtttgtttgctgttagttgatggtaaggattggctgatacgtcgattatatcttctagaggagctgcgtctacttgcatgtcaaggttaccacgtttaggggttatatgattgatgatagtttctttgtttagtggtccaaaattagaaagactcatttctttttagttttctcgtttcccttagacagtctgtagagagttgactttctgcggctcgtgccagcttcgatagctctagttaacattgcgccttgtggtatcacaactgtgctttgtagttcacatttagtcctatacaatatggtacatgttgatgagcctttaattcttagattattgaccgaatcatcttttttttccgaggttaagacttattctgttgcaatgtgctataattataatttgacttctactccagtaagacagtgtgctactcacattaatttgattcagcatgtcgagaatttaatttcctttggaacgtcattcattgagtttttccttgcacgctaagttactcagtaccgtctcatagttgttctgaagaagagaaagaatgatgccttcaaaatatgtattcttctactggatctaatgaactttaaacctttccattctggactgtaaatatgaatgaacgtctaaatttccttcgttgtttgcttcttgtccgactggattttgtaactatttctgactttatcaaattgataataatagtttc

SEQ ID NO: 3517 - DNA, 1501 bp, Oryza sativa
ggctcgcgactcctgcctgcgtcgtcgtcgcctacctcaagccaaaaccatggctggggcggggctcccaagctggtgggcgctccctctcctccgcgtgcccacgtcgtccgccgtccgcatcatcccgtcgatcgccgccgccgccgcgcgcggccacgacctcctcctcctccgcgcctcctcgtccgaggccacccggggcttctcgtcgtcgacctccgcgcccgcggcaccggcccacgccacggctgaactgctccagccgcgcaaggacgagccccccgcaccagggtccgccaccgccgcacgttctcgtccgcggccacccgcgtcgtcgaccgccgcggccgcactggtcgagctcgagccgcagcagaagcaacctcccgtgccggcgtccgccgcggccacccgcgcctactcgtcatcggccgcactggtcccatctcccgcgccggcgtccgccacgaccccacccatgaagcagcgcacagggcagcccactccggcagcgatcaagcggcagcgccaactccaaccggcgccaacacgtgtggccggaccagccgatctgatcaacctcgctcaagcgggacgcgtcaatgaagcgatccatctactaagccagggagctcgcgggaattgcaaggccttcgaagagctcgccgcaagctgctcgactccagcactgaaggaggaattgaaagatgtccaccactacttcctgtgctccggctttcacaacgattgcggcgtgaacaacaagctcattgagatgtatcccaagtgcgatctgctcgagttcagtcgcaggacctttgatcaaatggcctatcgtacccttgactcttggcttctcatgatcgaggtcagctacaatgcggaagagtttgaggaggcgttctggcttttcaagcagctcaaaagtaattaccatgatctgcacaaaacaaagcacctgatatctccagttggatcggttgaactgatacaactatgccgatctggcaaggcaagaaaggctctcaaactgctagagatgggagtgcacgccaacctgcacgcattcttcgagatcgcagccggttgccgtacgatcgctgagctcaacctggtgcgcggatgcctgcaacgctccgcgttcagtcacaacactttcatcaatagcaagactgaccaaatgcaagccaagtttgagcagatgcacgccaacctcaagaacaaggacgggcacggccatccttagcccttgtggctaccaagtataccttctgcttcgtcacaaaagattttgcaatgttgttttgggtagtatctaggcatctctctcatgatggtagacgatagatatatttgctgacatgaactccgagcctcaaattacatacctactgtaagaaaacaccgtatgccacttggaacttaattacatgttcgtctctttcagcgtatgttagtgggccagctgctccaatagtggtgtaagtagaggttgttc

SEQ ID NO: 3518 - DNA, 1501 bp, Oryza sativa
tttcaggtgagttataattcattattctatttaatgcaggataagctatttttcctaagctattagcatttggattattctgtatcatcacggagttgctacaccttatttcactgatcgtatgtatttgtccatgtcaatagaactaagaagttcaaaaaattgtatgaacaataatagccttaataaagggacctctgagcaagaaatctactatcccaggggaaaaattttgtaatattttgaaggaaatgctatggtggttaaatacttaaatgtttgcatgttgaactgttaaaaacactcataacttgatgatcttttgacagaacctatacaaggaagggctcttggagcaactgctacagtcaactgctctactggttagttggtcacttggtcgtcacttgtcaggtagtatgcacaaccttttgtggtatatcatctgctttatctaaattagtttggctcatttttactaatgttataactgtgtgtgcagcctgacggtgcagcatctaaaagctaacttatacagtgtgctttatctctggtatggctgacctcagttgtaagttctgaattttgagtggtgttggttagaaccatttatctgattgctcttgttcatgatgaatggcaatataatgggattactcttactcaggcattgatggaaagtttcaagatttgtgcagtcaatgatggcatcataaattgcgtggatatggtaaaaatatatcatttaccagttttctcttttgctgaatcattgattgatctactatatttgatcttgatcaaatcatatttttgaactaatgtagttctttgacatgaaaaaagcttgatgttaagtacagaagaaccaggtatgcataatcattgtgtgggttcattttcttttttcttctatagagttgcatgcattttcctttttgcttcgcccccgccccctgaatagaagtgtatacggagaactactgatctttagaatatcagagaaaaggtctaatctgatttgtatgatctctataaggatttggaactcaccagaaacatccaatttccatttctaagatagacaattatctttaccttaccctgtaattttttcgtttgaccaccgataattctgattccacatggatcttttatgtactttctcatccgccatctttattcttgtaacagtggaaatgtacatcagagaagcccctagaactgctcctattacaaataagaccgtaacaagtcattaagctaatgtcttaagggatatattatgtactcactttataaatcaatgcagttcttagctaatacgtgctcatgtgatgaagtatttttgtgccttttcctttgctttctgcttgattgatgatttccagataaaagttttagatgatactaacaacagttttttcactctagaacaaactattaggtagtaatacaatgcttaagaaacactccattatggtgtaatgtcttcatttcc

SEQ ID NO: 3519 - DNA, 1501 bp, Oryza sativa
gcaggtcatccgctcatctaccatgttaatatatcttgccgacttgccgtgtacacgttgattgtggtaaaataatttataagaatcatgatatcacatttcaacaaatcatgatccttgagtagccacattattttgctgaatgatactacaactggcacctatttcaattgtcataggcagaagaaagacacgttgaggttatgggccatcttctttacgctgctaagaccattgcaaagcaggagaaccttgatgatggattcaggattgtcatcaatgatgggcctaacggatgtgagcataagcttgatcccattgagacggtgaggcctttcttattaagatagttggactgactttttctgtgttatgtaggtcagtctgtatatcacctccatattcatcttctagggggacgtcagatgaactggcctcctggataagttgtatattcccaaagaggtgctctgttatgaaaatgtaaccggtaacattctctttatctccatctgatgtgatgagcagtttcctttatggtatgtgctctgtaactgctatatactggtcttaaggttttccgtttcctgtttgcgacaacatagccatgtcaacagattgatctctgaagcagtggctaatttctattgacagccgcaagagcatccttcttctccctgaatgaatgttatccctgaaagaatgcagaaatgttttcgcgtgtgttctgacaattcctgctagataactgactttcgcatgttatgccagagtgcttgacaactctacctaaacttgacaaaaaaaaaacgcgacagcctgaaacagtgaaactgtgaaacattctaattatgctgtgttcctttttgcaagttctcaacttcttttcgcacgcacggttcccaaattgctaaacagagtgtcttttttagaaattttctatatgaattttgctttaagaaaatcatactaatccatttttcatttttttagataatacataattaattatttgctaaactattacttcctccgtttcacaatgcaaatcattctagcatttactatattcatattgatgcaacagaggaattacgtcgttttcccaacccatacctccgaaacacagccataactagcaatctggctttgagccatagttggaatcagagacaatctcagaagaaatcaccgtacttcaattttgaaacggcaaaattccaattttgcattcaagcagttcgagaatcatatgcgtcgattttttccaatcagaaggagtaggtctcgtcgctctcgcgtcgcgtccaggtgcagccgtcgttctgttgcaagcgcatcgcatgttgtacagtacaaaatggccacccacccccaccaaacacctttcactaccactcctgcacagcacagcctgcactacaccaaccaaccaccaaaacccttcttcccccatcgaaagcccatctcactctcctccccgccgccgccgccaagcctg

SEQ ID NO: 3520 - DNA, 1501 bp, Oryza sativa
ccttatggtatgaaaaatatataaatttttggagtatagaaatttgttgtatgagacttttatatccatgagtttctaatgtgaaatattatttataaaaaaattattttcagatatgacataaaagatttatatttatttttaatatttaaaattgtatatgtagcttattttctatagtagtacaacatatttgaatctatttatacgctacagtaaaataatttgataacaaataaattaatattattttttatgtcatatctgtaaataaattttatgataaataatatctcgcacaacaaactcacatatataagagtcttatataacaaatttttaccctccaacaatatattctataattttatatgtttgagttacaccaaaggacaaaatggtttttttatagaaatttaacggtcaactaacgaaaaaaatatgataaaaaatctaaactaaaactagagaatgagtaaaattcatggatacaagggtacaaggagaattttctcaaaataaaacatggtgctgaaatgctgaatgacaagcgttaattagtacgatgattcttcaattaattacacagctctagtgtgtaaaaggaactacgaaacgaaaaactattgtgtcagaactcagaagttaagttgtaatcgctatcatccaatcaataggtaatagagacagaatccctactccagttgtcatcactgtatcagaaacgaacgtgcagccgtatcatcatccaaccaacagctgaagcctaaacacacaaccgaaccaaaatttcactcacaccagagacaaagatttaacaaatttgctcaactaccgatcgaatgagtctgcagtacagtaatattcttcaacttggatcattgacatatagatctgttggttataagctcatatatcaacagcttaaaactagaggattagtattgtaaaggacgtgtttccctaccgaacactgccatccagcagaccaatttgcaacgatccaggaacgaaatgagccaccaatcaaagcttagtaattcggctgtaaaccggcctgtccctcctgtgcacagcaagtgcttggagcacgaccagcttgcgcaatgctcgtttacctgagaaacgctcaggagtttttcggctaactccaaaaggtagtgggctagatgatttggattcgaaatctcaccccttctaattatttgatattagattcttccctaatatttacgttcttttttcaatgctcgtttacctcggtgagacgcccgtgccatcgccgcaaatcggtgagacgtccgtgccaccgcctcgccatcgctgcaatcgcgctggaccaaccatcgtctagcaccaactaggcaactaccaactgatagtattatggacgtcttaatattgtcttcccgggctggatcacaaacatctctgatctctctgcagaaacacaatcgtcgctcgaatctgcttctcattctttttttcttgctgatcatca

SEQ ID NO: 3521 - DNA, 1501 bp, Oryza sativa
gcgtcgagtcgagttggatggagttggacgcgtcgcgacgtggatggatggtggattgatttgctgcgattgagtaacggtctgatgccgcattttcctctgcccttctctcttcttactgtactcattattttttctcaagaatctgcctcgttgtgcatgtcggattgtcggctgtgactgtctctgtgaccgcacctctacgttgtgagagcatatgcaatgggtaactccagctagtagcttcgctcacagcgtcaccgttccgtctatgagtcatgctcctgaaggaacgcgtgaccccaacaggggaacgcgcccctctggctcctcgactactcttttgagacacggctcgagtggtgccccgttcctcacctcctttctctatattttcccttcttgcccctctcacctcggcatggtgaggcggagcaggcgacggatgcaaggtagaaccagaggtgtcatggcggtcggagttagcagtgggcgcggtggggcagaatcgaaggcattgcggtggtcggagccggaggtgggcgcgggagtcgcggtggtcagagctggcggcgggcgcgatggggcggatatggaggcgtcgcggttgggcggagccgtccggcggcaggagcggtggggtagagtcgacggcgccgtggtggggcggagttagcagcatcgtagtggaatggaactggagacggcgcaaagcggagagatctgatcgccggagtggtggacggcagcggcacgaggtggggaagtcagcgatggcgacgggcagagggagagcgacgagcgagaggtaggtgagagagagacgggcggcgaagaaaaaaagaggggagaagtggatgatcagtggatgggctgagaaaatagctaggggtaggggaggaaaaacatacatgtggcttcgtgggctaggataggaccgttgtgggctagattatctctaccttgttgcctcagatttggtagggctggttggagtacttttcattgggtgccttagcccatatgacccacatgaggatattgctaggagtggcttacatggtaagtgccctaaattttaaaaagcattttttttcaaaggaggatttaccaaagcatttagtcacagcaaatcagtactagtagtagtaagcacgatcggattgcgcaaatctctgagtttttcactgaaactcgaaacgaaaccaggtttcgctgccgaacccgaacggcagctcgatcggcgtccgtgccactgcccccgacatagagaacagaggggcagaatgaatgctcgtctgcctcagcgagtcggttgttcactcgtcaggacgacgtgaacatgcgctggtagtcccaacttgggcgtgccagttgctgaggacgtcttatcgtcttccccaactggatcacacggatttctctgcacaaaaacacaatccagttcgaaccaaccaaccagcagccctgcccctgcttctcttctttctcttgcccatgg

SEQ ID NO: 3522 - DNA, 996 bp, Oryza sativa
aggagtaggacgcatgtcagggagggggggaattgttttttgggttgggttggggacgcgctgtttcgacgtgggggagcatcgtgttcccgcaaagtggcggatcagccccggtttagccgggtttcctttaccgttttgatgaataggagtatcaccgttacccagtggtaatcacagtgaaaaaccatggggggttaaaaactgatataagctcaccggccgccgccccttaccccgtcggcgagctacttgggaagaggaggacgatgaggggaagtagaaatttgatgtggccactttcacgtagatctatctcatgttgattaggatgttatatcagcgaaatcaattcataccgcaataagatctaatttaacccgattttgtaagttatagggttaagattttcagtagtgcggtttatggatactatgtaaactcgatgaaaagatgaggggtgtacagtggatacttattcccacgatgttgtcactcttcctcgcgcgtccacagtcgcagcagcccacggcccgtatcccagcccccaaccacagccatgcaaacatgcggcccactcctcttcgccgcatgccgccgccgaggccgaccgagcccaacggacgcggtgtgccggtgcccggtgattcatctctcagcgcggcacgacggcacgagcacacgccgcggtggtagtgtagctgctactaccgagccgtcgcggcgtcgtctactttgccgcgcgtgccgatccccacgcgtacgcgcagcgcatgcaccaccagcagctcaaaccgggcgaggccgcctcgctcccgcgccacctcctcgaggcccacgtcgtcgcgctcgtccgccgatgctgcccgggcctcctcgcgctccgcgccgcacacgcgcgcctcatcaggctccgcctccctcgcctcacagccgccttcgcgctctccaagctcctcgcctcctcctcctcctcctcctcctcctcctgcggcg

SEQ ID NO: 3523 - DNA, 1501 bp, Oryza sativa
atctttcatgctgaacatacactatccagatgtagtcaagagtcgtttgcgtactaaaagtctgagagaccgagacatcatacttctgaccacataatatgggttgatcttaactggtcttactaatacccatgaacccaccaggaaaaaaaatatcagcaagatatgatcgcatgacatatatactggtaaaatatgcaattgtggatatttcctcaatataagaattgcacagtccctaatgatcgtataggctaaaagactacttttcgttcatagacaatctatcgatttcaatacacaacagcaaaataattcctcacctcaccgcccttcccagcactgctattccgatcgttccccccaccattcagcatgggtctcggcgcaccagctccggtaccatggccgctgccgccaccgctgttgtaaccattaccaggggcgcccatcatcgggcggggagtacgggggccggccacgcccacgcccacgccaccaggtcgaaacgccccgccgccgttgaacccggcgtgctggacagggaaggccccgaactggttggggttcggcgggaaacctcccccggggaagaagggggcctgcggctgcggctggtgatggtgctgctggagcgcggcggcggcgaggaagccgaggctctggagctgctgcgcctggccgaagagctgcatcgcgaggaaagggttggccgccgccgcggcggccatggggttggcggcggcgaggttggggacgggcggagggttgaagcccgggtgcatggggaggggaggcggggcggggtcgccggggcgcgggcggtggggttggccggcgttggggcggggagggtggaaggggcgcatggtggcgtcggggaggggttgggaggaggaagcggggtggggattttaggtagggttttaggacaaccccaaccagggcagggtaggaccgtaggagacgagcttttgttccttcctggcttcctctgctcgtacggtctggtggttcagcttcaggcacgctttcatcaccgatttttctctttttttcatcaatattttcccttttttttaagaagacactcactatacatgtacactcacccctaaaaaacgcacgcacgtaaatcctacccctataagcatcttcgaaaactggaccggcactgcgactacaatttttttttgggtgaagtttgcttcccttgtctagttttttttttttttgaaatttgtttgcattctctactgcaacattttggattggatccgaaattacatggtcaaatatagagaacatgcagatagcttttcaaagatgaagtcgtctatggcctctatagagcaactctaacatgtcatcgatacctccaatttcgtgcatttgctttcttacgctggcacagataccctgaattttattttatttattggctatatcaatctactttattttattttgttttattttcttaaactcgtgtaaagattat

SEQ ID NO: 3524 - DNA, 1501 bp, Oryza sativa
ttgttaaacccaattgtcattaaaaaaggtcgtagacgcatacccatcaaatgactagatcatttgcattctttggttcttcagcatgaacttgtgaaaatgtgttggttcaccgaatggacggattgttgcgaggtgttatttattgagaagtagtagtatattgcttttcttggtactacgttgaaactgtttatatataactaaaacttgtcattggccttgtttgtatcctccgggctattaaatagccctccggaatcttgctatttaggagtattaaacgtagattaccgataaaatcgattccataacccctggctattttgcgagacgaatctaatgatgtatattaatctctaattagcagctgattactgtagcatcactgtagcaaatcatggattaatatacctcgttagattcgtctcgcaaaatagtttaggggttatggaatgggttttgtcagtaatctacgtttaatactcctaaatgggttcagtaatatacgtttaatactattaaatagccctccggatcctatcagagccattgttcatcagttggctaatctgttgtgagatgttatgtccaggaagaaaaactgacgtgatttgtacgttggaactgggttccgtttgcgattcacaatcatttcattgcacttgctgcacatgattcctggcttccaggtccgcaggagcaaatctttcctgcgttcatgggatcggggatctgcatttcgggatagtgtcctctcgttggcacttgcaatgaccggaataaattctctataataattggtcatagcttctttgaagcaatgaccggaataaattctatgatctaaaaatatataagagataatctttacacgagtttaagaaaataaaacaaaataaaataaagtagattgatatagccaataaataaaataaaattcagggtatctgtgccagcgtaagaaagcaaatgcacgaaattggaggtatcgatgacatgttagagttgctctatagaggccatagacgacttcatctttgaaaagctatctgcatgttctctatatttgaccatgtaatttcggatccaatccaaaatgttgcagtagagaatgcaaacaaatttcaaaaaaaaaaaaaactagacaagggaagcaaacttcacccaaaaaaaaattgtagtcgcagtgccggtccagttttcgaagatgcttataggggtaggatttacgtgcgtgcgttttttaggggtgagtgtacatgtatagtgagtgtcttcttaaaaaaaagggaaaatattgatgaaaaaaagagaaaaatcggtgatgaaagcgtgcctgaagctgaaccaccagaccgtacgagcagaggaagccaggaaggaacaaaagctcgtctcctacggtcctaccctgccctggttggggttgtcctaaaaccctacctaaaatccccaccccgcttcctcctcccaacccctccccgacgccaccatgcgc

SEQ ID NO: 3525 - DNA, 1501 bp, Oryza sativa
cagcagcagcagcgagagaggagatatttttggtctctcgggtggttggggcatggaggatactagtactaggtacaattcatcaactggtcacataaaaaacgcatcagtttgctattaattttaagtgcatgcatctaccgtgacttgttccatggaggaacactgcaagtacagtgtcgtgtagtggaccacattgtgaggaggtggtggttaatttgggcttaatccctggaattttttgattgaaacctataggtcctcagtttggtgcattattacagatgagatcctcttctgaaccttaattagttaaagaaatatgggaaaaccttaattagttaaggagatatgggaagtagggtaatattaataaaaagatcacgcggaatgattttcataaatgattaaccatgaataatatttcgaggttattattactcgtagtactccctccttctaaaagtttaacacctatttcattctttggtttttccaaaagtctaagtcctatttgtagttattatgtactaaattaaattgttgataggaaaaaaaagtattttaatacttatttgttgcatgtttattggctttgtcatatgataaatgaattaattgtttcttgttcttggtgaaaaagaaataggacaatttttttttgaaggagggagtactacgtactactccctccattccaaattgatctacatattttataggtacactaagaccaagaaaagctaataactctctcatattacatttactctagcaacaaattcaatacatgcaccatcatcactattttctagtcaatagcaaatcgagatattgcatgtgggttataaatacttgtgtgcatggatgcatgcatcaatgtccatttactctaatgcacaaataacgaatagacttaatgaatgaacacaaatatgtagatcatttaagaataacccaaaaaaactatatatagatcaatttggaatggaggaagtatcagtttactcatgattacgctaattattccactcaattctcactttctcagtgccagcaatcaatgctagccagcctactccggcagtcgatgcattcaatattcaaggagtaaaacgcaaaaatgaataaactgaaggtgcaacattgtaaaatgaccttctccgaaggggcgaactgaaaaactccaaaggcagcacaaatctcgtccgtacctgccccgcttctacccaagcgccttccgctgcaagcatccactggctgacaggtgggccccaccacgtgcccctcctccacctcccgccatataaaaaccccaaagccccacccacccacgcttctctccaatattttgtcgaaccgattgagggaaaaaaaaagagaaaaagaaaagaaaaaaaagaagaagaagagagaactcgaactctcgcctaccatttcgcccccctccgcaagcaatccaccactgcatcggcggcgagggctcaccggcggcgagcca

SEQ ID NO: 3526 - DNA, 1501 bp, Oryza sativa
gaacggcagtgatcatacatactgcttccatccaagaaattgccagggcgacccaagttacctgggaagcctgcgttttgctgaattacagcgcctggaggaagccagaccaaattatccacatgctgtggtgaatgaacctcataatgccgatattttggcgaatgccttacaaagtcatcaggaatcctctcatcaaaatcttctgctccaacttgaaaccttggtgaaatgggaaaatctcgaggatcatgcactccatagtgccctggagagatatatgcagggctccaaggagaatccatctccccatacctttggctatgtgaagggcgaggaacattcaaatgccgcagaccagcaatatcaggaattccagactcgttgcctccaataccaaagagctgctccacggatacaggagaggaaggtgttctaacatcgccgaggctattaagtgcatcaacatacctcctctctgtctctctctcatctccattgtaatggacagccgctgctgcggcctcatcgtctaagtgctgtgagaacaagaaaatcctcaaccgagtaaacccctctcctgcagcaatgagcttgtcgtactcctccatcatgttcaccacatcgtcatcgttaacaaccgagaccagggcatctagatcctcatcaggttgctggtacttgatgatatcagcatcctcatagagctcacgcatccgcgctgctaggtcagtgtaggatacatcacgcggcagcataacaatcctggtctcgccgccgacgtaacgcagacgcccatcaagtgggcggggcaggatgcttcctccaaagctgcagaggaacttggccatgcgaggggctccatcagcctcggcgctgcctgcagagacgctggcaggggcagcagcgggcgccatgcgtgcggagactgggaaaaatgctaccaagttggggtgatttgggtgaagtacatcacacgattcaaatcaaacagttggtattcactttttttttttgcgccgattagtctcttcctgaagaacaaaaaaattttaaaaaaaagattatgaacacattcaagaaaaaaaaatctccatcttttatcagaaggatacacaacaaacactcattgaattccaacataaccaacaaatttctctcttttttgtctgattacctcagatcagagtgaaagatcgcacttcgatccacaaaagatgaacaccaaacaatgcaaaggctgaaaaaaaaaactctgcccacaaatacctgatataaatccccaaaacaaaaaatcttgagacaagctgaatgcaagcacagtcaagaaaacatttcgatgattgcaacaccgtggcaaatgaaaggaaccccagctccggctaaattcccctcgagcacaaggggaacaaaagatcgcaaccgattccacccccgatgaatatctggcgccgttcagcccgcagaaaagaaaaggctccccttttttctcccgcagaaa

SEQ ID NO: 3527 - DNA, 1501 bp, Oryza sativa
ttagtagtttgggaagcgtgcgcgcggaaaacgaaacaaacaaactccctttgttctccaaacgaactcagcctaagttgtccctgaaacgaaattagatcccaaaacggtttaaactacggtttcaactgatgtaccgcctacgtggatggtttgacttgattcatgtcccatgtggcgttgatgtggcactataagcaatatttttttaaaaaataaaataaaatgtttgggtccatacgtgagataaacaaataaaaagtatagtggggaggcatatgtcggtgagtcccacttccttcaaacccccttcaccccccccccctctctctctctcttctctatgtcattccctttgctcccaagctattggcaaggaacacagcaaacaacaaagaggtaccgaggagggagtcgtggtgtcctgcggcagcggatgagaggacgaaggcaaggagagaggagctataggagccctcccacagctcctaatattcgtcactggagcagcttgccttctcgcggctctagtaaaactaatttacataatatttttttctaaagtctgatgtgtacctttttttaaaatttttaatgttatattttgttgttttgataatcaaaatagaacacatatgtgcctcttgtctaattcctatggaacacttcatttatttattttttcatttatgtagtatttttatttttttcttcaattaatatatggtaatttctagttatcgaaagtgaacatcggtgcttttcttttagtcccatatatctagcaattacacactttgtatttttaataaattttattatgaatttattccaaatttcttattttgaaggtttatttgaaattagtattgaaaatcaatttcgggatttattttattacttagttcggattttaattagtagtcttggtatgcagtatttatttatttaaatttttactcttgtttttgaattttagtgatattttaaagcttatttggaatctattttgttcttattcggaattttaattaatatattttgggttgatgatggagcggaagtgcggaggtggtgagatggggtccatgcacgcaaggtcgcgctggcgcgggcggcaggtaatcgatctgggccggccaggcctcagtactacgagtcaatacacgaacggaacggacgtctcggaagataagtgattcatcgcccgatccgatccaaccgggaacggatccaaggatcgcaggccatcagcttccttatccggctaactgacgataattatctttgaatgcaaccaactgaacttgctgcatgtacgcagtcactcccaccccacctggactggagcatcttctataaatagctacaatgatcagtctccctcccagttaatcacttcaccttcttcattcagttcatccaatccacgatcacttcctagcaattaagatcatggtgcagcgcacttcatccgattcggcggcgtcggctgaggcca

SEQ ID NO: 3528 - DNA, 1501 bp, Oryza sativa
tttagaattaaaaaaataaggaatattaaaagaggagactatagtccatatagaaatacaatttagaaatagctaaaattcggaattataaaataaggaatattagaagagaagactagagtccatatagaaatacaatttagaaatagttgaaattcagaattaaaaaataaggaatattagaagaggagactagagtccatatagaaatacaatttagaaatagttgaaattcggaattaaaaaataaggaatactagaagaggagactagagtccatatagaaatacaattaggaaataaccgaaattcggaattaaaaataagaaatattagaagtagagtatagagtccatatagaaatacaattaagaaaaaaaatagaaatttggaattaaaaaataaggaatattagaagtagagtatagagttcatattggaatttaaaaccaactaaaattcggaataaaaaggagcctccacgttcgctctcatggcctagaaattatcacattaatcagagaaaaagaaaaagcagagtccatatagaaatacaatttagaaatagctgaaattcagaattaaaaaataaaaaatattagaagagcagactagagtagttattacacattagtagttttgaaaagttattgcaaaatttaaaattacgttgtcattgtaatatattttaataatataatgagaaaacatatatgctattatatgagagaaaatataatgatgctagccgcgcaatctgcgcgggccatcatgctagttagatataaataaaaataaccggtaatgcacgtcaatctggatgtgtatatatgtgcacagcaacgaacacctcgcgaagtactgagtgataactaaagtatacagcatgcatgtaccgagaaatgtatacgatcgatcgaccttagagcagacgtctagcaataatatttgtatacaagatcctaatatataaaaatacttactcaatatatatatgcgcagtcagcagaaaagaatggacatagctaggtagctagctgcaaaacaatatatatgtgtgtgtacataaacgtacaaaattggaagatgatgaatatattgatgcgcgactagctagcatgagagtaaatagctagctagtcgtaaaacccttcccaggatgcatgctcatacatatatagcgtgcattatttaccagcatgacagacattattgttaattaacccacaccccatattagcaagcttgcaaacactagtagcgagttaattctgtaataattttagagatatgcatcatatcatatccctcctccacacccaaattaaagctagtgacaactcacgcgatcgatatgatggagcctggaggctggagctgtatatatagacatatgaaccacagatcgatggagaggacacctgcgctatagctagtcgtagttgtgaagatcgaagttggttgtgtgattagatagatatggcgatgcaggtggcggcgc

SEQ ID NO: 3529 - DNA, 1501 bp, Oryza sativa
tggctgctctctctctctctcagactcactcagatcgatctgtggatggatggattgaattgaatggcaggggcacatgatgtggatgcagcgccaggacgccttcaagcaaaagttcccctccaactccaaccacgacgacgacctcgccggcgccgactcctagctaggcagctactccttccattccatcccatctagggcttactgtactaccccagtagtggagctcctcccctctacagtagtacttactttcttcttcatcacttgatgggtagtagtactccgtagtagctaatgatcgttgaaaacgagtactacgtgtttgatgaatcgcctgcctgcctaattgaattgcttcttacatactcctactccgtagtttgctgctttgttggattcaggcagcttattagtaggagtattaaactgtcttgtatggactcactcgctcacaccttccattagatttacattttggttttggatcgattaattcatgtccttctccttccttcctcctactacggtacggttcaacgcgcaaacattggagtaacatttaacactgggcctggcctggaacaatggatcttgacatcttcttcatttggatgccgtggtggccgacatgttgatcgggtaaactgctcgctctctaagtagaaactgcaatgcacacagctactgcttgaacaagccaacccaacccaattaatcggttcatacttcatacaactagtagtatgatagtatgcggcatagcatagcacagatccacggggacgactgattccaggtcaattaatcgcagacggacggacgtgcagtgcatacagtacatgcatacaacttcagtttctatacaatacagctctgtcccaacttccgatacatacatattcaactgactagacttggtctctctctctcgccctgccctgtaggtaaggaaggaaaggaagatagatagatagatagatagatagatcgatcgatcattctctcttccaaccgtcttcccatgctgactcagcaattactcaacacttttaggcctgcctctgcctctgcctctctataaaaaccgccagagtagacaaaccatccattgcatgcttgcttccatctgatcttcttcttccctgtcctgacacagcctaattaggagatcaagctcatccaatccaagcagcaacacaacacacaacgtctcaacttggtgcgtctgcaaccttctctgcccccatcccctctctacgtaataatactactcctagagttcctagtatgatctgctcggctttgttttctttttcttaatttattttgtccatgctatgcctatgctagcctgcaacttactagtaagtcatttcctgccttccttacttcattcatagtactctgtttgatttggttcatctatgtcatgcaggcttgtttcatcgagcaacagcaagctccatttaagatttgattcaatattccatttcca

SEQ ID NO: 3530 - DNA, 1501 bp, Oryza sativa
cgtggcctaaatatttcaggccttcaacgtacgggaggcccaattaactggtcacccatctatctcattggacggatgggccagaacttcggcggcccataggcccatattcctttgtccacttactggaaatttggagctgatgagtaaaactcaatttgtcgctgagttcgaaattcgtccctcgagtgcaaaacggatacaacgcatccttcaacttacaaaaccgtgtaaacaaggtcccttggcagtattagagcaggtacaatagcgggcaataagccagttataaacatattttaaagagataaataaagagagagaagagcagtgggctacagatctgtagccagctgcagcacggactccaagacataatgtgtgtatgataggtgggaccagatattatagtatagtaagcaaatattatataaattggctatagataatttggagctagtagttggctatactattgaacttgctcttatgcccggttttggctgacgtggcgtctatgtggctccattaactaggtattcatctcacgtggtattgacgtggcgcttacgtggcaattcaatcttaaaaaataaaaatcatgggacccacgtatcagctacacacatgtcagcggtggctggagcaggccagcggagctaagcggcggtggctggagcaggccgggacaggcgaggggcaaggggcgacggcaccgcggcgccgaggggtgacgggcggagagaggggcggcgggcggagcagtggagagtggcggcgagctcctgggagatggcgacgggatgaggccgagaggacgccaacggcgaggtggagcacgcacctcaagaagcgggtgttgccggagcagaagaagggtgggggcaagagcaagaagaagacgacctggaccgacgtgctcgtcccgtccccctcgccgttgtcgtcctccaccgcgcgacggccaactgctccaacggcaactcagccggggcgcagagcaacacaagcaaggaggaggaggcggacaagatcgagatccctatgctcgacccctgcagcttctcatcaccgacgcaaccactgctgccgttacggccatggcgccgcctatcagcaccagaacttggtatttccctgaagaatctcgcatattgtttgctgctgctgctaccagggcagcgacgagcagtgccaagcaagacggcagcgaccgagtaaccattacagtatcaagatctactgcttgctcaagctaaaatcatcgcatccagaaagaatcaagaattaattggccagaatcaagaataatgacgcgggctgtcgtcctcgtgagcggcctcatctcggtcatctttagcgcccagcgccgccccgccagcccctgggcagcccactgccgcttgtggttccggttgcgctccacctcccgaagcgcttcctcgtcctgttcgcaatccaagaccacgaaggtgcctgacggtgacgacgtgtcgcctgt

SEQ ID NO: 3531 - DNA, 1501 bp, Oryza sativa
tcccacgtggcatttgacgtggaacttacgtggcaattcgattccggaaaaataataaaaatagtggccccacatgtcagctacacaaaaaatataaaaatggtggggcccacgtgggccccacctgtcaacctcgcctcccttctttcctctccccctctcttcaccagccgcacgccgccgcagaggcgctccacctccggcgccgacgactccctcagtctgggcacgtcggcgaccgccaccgccaccgagaacgcctcccaccacagcacgtcggcgaatagcggcgtgtacctatcggcgaccagcaatgtcacgcacaggcgacacgtcgtcaccgtcaggcaccttcgtggtcttggattgcgaacaggacgaggaagcgcttcgggaggtggagcgcaaccggaaccacaagcggcagtgggctgcccaggggctggcggggcggcgctgggcgctaaagatgaccgagatgaggccgctcacgaggacgacagcccgcgtcattattcttgattctggccaattaattcttgattctttctggatgcgatgattttagcttgagcaagcagtagatcttgatactgtaatggttactcggtcgctgccgtcttgcttggcactgctcgtcgctgccctggtagcagcagcagcaaacaatatgcgagattcttcagggaaataccaagttctggtgctgataggcggcgccatggccgtaacggcagcagtggttgcgtcggtgatgagaagctgcaggggtcgagcatagggatctcgatcttgtccgcctcctcctccttgcttgtgttgctctgcgccccggctgagttgccgttggagcagttggccgtcgcgcggtggaggacgacaacggcgagggggacgggacgagcacgtcggtccaggtcgtcttcttcttgctcttgcccccacccttcttctgctccggcaacacccgcttcttgaggtgcgtgctccacctcgccgttggcgtcctctcggcctcatcccgtcgccatctcccaggagctcgccgccactctccactgctccgcccgccgcccctctctccgcccgtcacccctcggcgccgcggtgccgtcgccccttgcccctcgcctgtcccggcctgctccagccaccgccgcttagctccgctggcctgctccagccaccgctgacatgtgtgtagctgatacgtgggtcccatgatttttattttttaagattgaattgccacgtaagcgccacgtcaataccacgtgagatgaatacctagttaatggagccacatagacgccacgtcagccaaaaccgggcataagagcaagttcaatagtatagccaactactagctccaaattatctatagccaatttatataatatttgcttactatactataatatctggtcccacctatcatacacacattatgtcttggagtccgtgctgcagctggctacagatctgtagcccactgctcttc

SEQ ID NO: 3532 - DNA, 1501 bp, Oryza sativa
aaaaataatttataagtaaaacgtttatatacgtgtttataatgatttaaaagcaaatgaagaaaataaactacgtacaatgaaatagctttaaaatcaactctaaatttaatgttcaaaatttaatttttggcttgtggtaatgggctatctgagaatccaatcctaatgagacgatcatacgagacaccgtgcttaaattttcttccaagagccagattcttcgaaatgtccgaatggtcggcgcccagatctctctccttctttatttatcctgataagctagtgattactaattagggtacgtgaagatagtaccggcctcatcttttcacttattattattattattattattattattattattattattattattattattattattaggaaaaagtacgaattacctctcgaactatcgcggtcgtccgaattaccccctgaaccacaaaaccagtcatttttcacccccaactatataaaccggacgaattagccccgaaaatgcttcgtatcgagcgtccgatacgagacaaactccggacggtcgatggggcccacctttccccatcttatcctcttccttctcatccccaacctctcgttcaacttcttctcaacgtctccacgctgcatacgcggctacggcgtcatcagccggcgccggtgccgccaccgccgctgtagacggcggggctgccgtcgcggatggccggattctggtgtcgccggcgacgttcatcagcggcgtcgtgtggcagacgcggtggccgtgttcctggtggcactggcaatggaggcgtcgggcggcgtcgaacggcgacgaccgcgcgccgctgttcttcagcttctccccgacgacagatggaaaaggaagcgtagggtggtgctcgtcgccggcgaggactaccatgcgctcgagtggtggccggtgcagcagttccgacagcgggatgcggtgagcgccggcaaccacattggcggcaacggggcagcacgacggaaatgcttgagacgccattacctgagagggttctgagctcggcgacgaaggtgaggaggctgcacactacatgttttttgttgcacatagtgtgttcctgatgttgcaatccattttttctggatgtttcttaaatcggtagtggatgttgcatttggtttcttcggatgttgcatatattggttttttttgttgcagacaacattatcgagtgttgcattcgattgaaacatcttcgataaagcggtgaaacacggtgaaacattcaatgaaagatgaaacatcaagaaacaatttttgttaaaacatttttttttcgagcggtgaaacattgcaacattcattcaacataatgtgaaacatcgtctggagattttatgttgaaacattttttttttcgagcgatggaacattgcaacattcattcaacatacagtggaacatcgtccggagatttgcaaatctccagacgtccgatgcgtagctttctcc

SEQ ID NO: 3533 - DNA, 1501 bp, Oryza sativa
taaacactattgaaattgccaaatattggtaaggtcaatttagatctcaaaccaaattagcccaaaatttagagctctacgtgcttttaatcttttcagccatagctagcgaaaatttaaattttaaaaacttaattttagagttgattttttttgttatcgtagtttacttttcagcattacctttttaagttattaggaacacatatccaacgtttggccatccgtcttatttgaaaattttaaaaaaaatagtcactcataaattactatttatattttatcatctaataataataaaaatactagtcattttttttaaataaggcggacgatcaaacgttgaacatgaaaacccaaaactacacttatttgggatggagggcgtgatattcagtagaaacaatttctcctagggggctgcaatataacggtatcccgtttttcgaacgggatgatcccgagtaagtatcaggtgttgtcggagatatggacccgggggtatgtgtgtgaagtagaggggaattactttccctccggccacgtgactctgcaagttagccccattcgtgcgtcacgcgagtcgtgaaagcgccgggggggggggggggggctcggggcatggcgtcaccccctcgggctatcccgcggcttcgccccgaggccttcacccggctgccacgcggcggagggagagagcgagagcacaggctgaacagccataaatgtgcgatgccccaactgtccctcaccgcatttaatgcggtaagggcagacgtgcggcgcgcctagctaacctctgtccaacggatgtgaccgatctgtgaccggcctgacaccgtcacatccgacggatagggcaatcatgtcctcacgtcgctcttgtacccggcggagtgggggtgggtatgacccgtcacgtccgagcgtcactcgaggaagggctgtcacaggtcatcgttcatttatgagggaatgacagggctgtccaccgtgtcaggcgggggccggcacctggttccactcgagaaccggttgttgcttagcttccgggagaaggcacgatttaaagcccaggaaaagtggagtgggatccccctccgagagagggtaggtagaggcggcgcatgtggtatccccttgagctataaaaggaggaccctgcccactgagacgggggggacgccgagaaaacctgaactccagaagagaggaagcgagtgcgctttctagagtgaagaaatctttgtaaaacacatccataatcccaaacacaggagtagggtgttacgctccatagcggcccgaacctgtataatccgactgcgtgcaagcttgccggtaatcctagggacgagcgagtgatttccaagagatgagcctccgccccaggccgaactcacaaatggggggtctcacgattccccgctattgaggatctctcctcgacaggtgtgatacctatcaggtatcagacgattctacacaacaggatgatccc

SEQ ID NO: 3534 - DNA, 1501 bp, Oryza sativa
caagagcgacgtgaggacatgattgccctatccgtcggatgtgacggtgtcaggccggtcacagatcggtcacatccgttggacagaggttagctaggcgcgccgcacgtctgcccttaccgcattaaatgcggtgagggacagttggggcatcgcacatttatggctgttcagcctgtgctctcgctctctccctccgccgcgtggcagccgggtgaaggcctcggggcgaagccgcgggatagcccgagggggtgacgccatgccccgagcccccccccccccccccggcgctttcacgactcgcgtgacgcacgaatggggctaacttgcagagtcacgtggccggagggaaagtaattcccctctacttcacacacatacccccgggtccatatctccgacaacacctgatacttactcgggatcatcccgttcgaaaaacgggataccgttatattgcagccccctaggagaaattgtttctactgaatatcacgccctccatcccaaataagtgtagttttgggttttcatgttcaacgtttgatcgtccgccttatttaaaaaaaatgactagtatttttattattattagatgataaaatataaatagtaatttatgagtgactattttttttaaaattttcaaataagacggatggccaaacgttggatatgtgttcctaataacttaaaaaggtaatgctgaaaagtaaactacgataacaaaaaaaatcaactctaaaattaagtttttaaaatttaaattttcgctagctatggctgaaaagattaaaagcacgtagagctctaaattttgggctaatttggtttgagatctaaattgaccttaccaatatttggcaatttcaatagtgtttagtgtttatttagtttggagccaaattttgatatgccaaattttgatcgcccacctgcacccgctcgatggcggcgacgtctagcggtgacttctggagttaagacaaggccagcatccaactggaggggaacgagagaggtggctggactgtattttcccatctatcagccacttgttctttctctccgtgacaaatacttatttagtcaactgagtttgacttgttttgggacatcgattttcggcctgacacatagtagccggcttctacaatgtatttggttcggttttttctgcccgcgtcggtttttgtctcacaccggagcatcctattagaatattgcactgaacatattaaaatatatatacaccatactcggcataagaaaccgaaaaaaaaaacaacacaatattcgtgcccatattaaaatttgctaatcaaattctcgaacttacgtcttctgcctttaaataagtgacctagtaacacctaatgaaaaggttatttctgttagattccgtttgtttcctagctacagatgaccaccaccaacaggcaacagcagcagcgtggcgccttgaccgtttgacctcgcaaccgaacacgcaaaagta

SEQ ID NO: 3535 - DNA, 1501 bp, Oryza sativa
ctgcttgggtgatgcgagatgagctagcttgtatagctagcaaatgatcgacttgatacggccgtgtttcttttatcccatcttttttttctcaacttccaacgtacgtaatactaccttcgtcccaaaacataataatatagaatcaaacgagatatattttctgtacaatgtatctgcacaggagtccagatatgtctcatctgattttaaattattactccatccgtcccagaatattataagttttagagttagacacgatattaagaaagtaggtactccatccgttctctaatgtaagagattttgacattttgcttgcactgtttgatcattcgttttattcaaaaaattttaaaattattatttattttatttgtgacttactttattatttattacccaaagtactttaagcacaacttttcgttttttatatttgcataatttttttaataagacgagtggtcaaacagtgcaagcaaaatatcaaaatcccttatattaggagttgcttgcactaaatatcaaaatcccttatattaggagttgtgattggatgatcagtggaggtaggtgggaaaagtaactagtggagggttgtgattggttggaaaaataatgctgatggagaagtagttatattttctgagggttgaaagttgttactccctccgtttcacaatataagtcattttagcatttctcacattcatagtgatgttaatgactgtctacattcattaatatcaatatgaatatatgaaatgctagaatgacttacattgtgaaacggagaaagtatatcttaggacggagggagtattatattttgggatgagggagttcgtaataggtgacgttgtacgtggtgggaatatgggatcgatcgattattcgatagcgctcgcaccgtgttgcgatcgctaggtttcgtgacacatgtgtgtacatgtttatcacgagtgatcatggtagacggcgacttctctagagatgctaaccaatgacgtggtgattaacccgtacgtgatggcgagcgtggtcgattctcgattgcgatgtatttggtcgcagcctgaaccgtaaacaaatggcaccctaaatgacacatctcgagaaacatatattccctgcatctgtacgtttcactgaattccccgttgctataccggattcggttcttctcgccgaagtaaccagcattcaaaactttcaacaaatcaattagcaactatcatatgtgtcacgtcatctggctgtggtactactgcacgagagatggaactaaccggaagaaaacgaaatgaaattattggtagtattaggctattgttagccactccctccactttatattagtatgttgtttcgatttttttctaatcaaaatcctttaggtttgatcaaatttataaaaaaaatttagtagcatctactatatcaatttagtttcattaaatataacgctgaatatatttcgataatatatttgttt

SEQ ID NO: 3536 - DNA, 1343 bp, Oryza sativa
aattcctgcagcccatatatatatatatatatatatatatatatatatatatatatatatatatatatatatatatatagtattcttttaggaaatcatgagctgcaattagaagtcggatcatcttaagttagcatgtaagttttttttaaagagatttcttatacaacttctcatgtatttaaaaaaagcgaacgaacttcaaaaccgactcatacacggatgacgtacaaaaagtaccggcaaaaatttttataatagtagagatatactccatccgtccctaaatatttgatgccgttgacttttttaaacatgtttgacaattcgtcttattcaaaaaaattaagtaattattaattcttttccaatcatttgattcattgttaaatatacatatagttttacatatttcacaaaagttttcgaataagataaacgatcaaacatgtttaaaaaagtcaacggcgtcaaatatttagggacggatggagtatatagcatgaagtctatttgtaacttgttactcccagaatataaaaagtgaaacgcaaacttgttaccctgcctcgcctcgccttgcctcgtagacgccgctccggctgttggtggcaccgcgccccgcctcgcctcgtagacagagataagagagctgacatgtgggcccaaggatacttttgacatttcacgcgatttctctctcctcttcaaccggaaattattattttaatggcgtggtgtccgctagcaaataaccatattttaagagtgtttttcccaaaaagtaactttgtgcggtgtcctggagctaaaaacacgaagtcgtgatgtcttgtagcaaaatttaccaaagtgaaaagatacatgagtgaaaccctgtaatggcttatgagttgaggatgtataaataaacgtgtccatcggcatgtgcttatttatattgtttattagtaattaaaataacaatctatgagtaaaatttttacatacatgttgttaactattaaaaaaccaatactataaaataaattacaatatttcaaattctggcttagggcctaatttgtaggaaaagtgtagaaaatttggatgattcaattcatatagaagcctttaaaacgaaggattgaatcatatcttatactttcaaatttctatggtatgggtaattgtatagaaattttaaagaaaagttgcaagagatcaacctattggaaaatccctttgaatctatctttcatatgattcctacgttttttctatgctccaatcaaacggtaattcctatattttttttattttctaatcttttattttacacttatatttctatcagaagttta

SEQ ID NO: 3537 - DNA, 1501 bp, Oryza sativa
tcctccccccgacgcttccggccatggccgccgacgcccgcctctcccccatcccctccacctcccggtgcgccgcgtgcgcgccgaccgccggcccgcccccgcgccgccgcccatcgcccttcctcgcgccgcgccatgcgtgccggccaccgacgtgtgcgccgctgccgctaaccgatgaagagagagaaagagagagggaggaagagagaaagaggggtctgacatgtgggtcccaccattaaaaataaaataaaatgctgactggattgccacgtgtacgccacataggccaaaaccaccgcggattgggtcgagggggggtaatttgtctggtttgcatagttgggggtgaagaatgtccggttttgtggtttaggggggtaattcggacgagcgcgatagatttgggggggtaattcgtactttttcctttttaataatctcaggctctctgcatatcctagggcatccatatcctagctatatgcagaggttgacaggttgtctcttagatcgattaataatatcacattgatgcaattaattatctgagatcaataaagtttttctttatgttaaattaatatcagtaatagatgctaagtccttcattagtagtatcccacatttaatcacagttggacacacaaaaaaaaaggcaatgccattaatatgccatctctcttgttttccattgcctaccaagtgccatatgatatcatcatcaggcacaccaatccataactagttcattagagcaagtttaataatagagctaactataagcttataatttatattggagtaaacatgtatagtaaatgagctataaggttatttctttttttctcctcctctctctatctcttacctatatatttaatgtatttgtcttgaagtatgtgaatagctagctcttgtatgagagccaatcctctgcattttttaaattctctttcctccacataagcatatagttggcttatagcctgctattatacttggtcttagtacactaaccccccttacatgcaatgcaagctgtctaattaaaagggtttcacaacattttgaatgccactactagctcccaaccacaaccacagatctagctagggtttgttcatttctctcctctctcctcctcctcctttccgttgtgccaattcatccaaagtcattgagagccatactactccatatcatattactcctacatgtgtactacatttatattgatgatctgtaagagcaaaagtattaatggggatcacaggattgcagtaacagcagcaggtaccccctcctttaacatccgcagttacgcctcccacctaccgtcttctctgccgatcgatgacgatgagcttctcctccgctataaatcctctcccctcctctctccctcctcctccaactccacatcgatcagcagcagcagcagcttgcacactcgagcttagcttagcttttgcaagagagatcgagctagaga

SEQ ID NO: 3538 - DNA, 1501 bp, Oryza sativa
gtcctttaattcccttcaactacaactacaagtataatgtcttcgacttacccaagaaaacattgactttagccccatcacgtactgacggctctgtttggagaactagccaagagttattttaagagctattttttacataacgaaatagccataagttgtttggatccaagggttattttgagagctatttggcttttaatgcactttcccacgaagagagagagaaaagacattttttcagtgggcccacccgaaatagccccaattagagcaggtacaatagcatactataagccagctataaatatattttaaagagataaaagaagagagataatagcagcgggctacgatctgttgctagctacagtatggactctaagacgtaatatgtatatgacaggtgggaccatgtattaatagtaagcaactattctatgaattcattggctataaatgatttggagctagtagttggctatactattaaacttgctcttagcaccccttgagaggaatagtttttttggatgggttatttccaaaaaagccctgaaatagctcacatgtttggaatttttgggctatctggggctacgtgagggagggtaaaaaataacccatggatccaaacagggccgacgtttagatttgctgaagcagagaaaagaaatgtttgttaagacccatttaaatttgacgaagataaagattatatacggatatgcaaactgagaaagccattagcatataattaattgaattttaatatttcaaacttaaaaaataaatttatttaatattttagagcaacttctatacttaaagtattcgcacaaaatacaccgtttagtagcttaaaaaatatattaacggaagctaaaataaaatatactttcttcgtcccaaatataagaacctaaatcggatgggatattttctaatactataaatatgaacagactagaaaatatttcatccgattttagattcttatatttttgaacggagagagtacatcttagggtatgtttagttcacgctaaaaattagaaatttggttgaaattgaaatgatgtgacggaaaagttgggagtttacgagtatgtgtgtagaaaagttttgatgtgatggaaaaattagaagttctaagaaaaagtttggaactaaactcgatgttaaaagaattgttcttaatgataacgccctaggctgtgtttagttcagcgcaagtttggattttggttgaaattgaagataatgtgactaaaaagttgtgtgtatgatatgttgatgtgatagagaagtactagtttggattcaaactccctactttggcttaaccatacctttattatccggtgcacccacccggaagtctgtgccgggcagcggatgcagtgtggcctgtggtgcagatggcagccaggaaagcgtgcaggcaggcatgtggaggggaaaagtctcgactccagccgagaaagcaacagctgaaata

SEQ ID NO: 3539 - DNA, 1501 bp, Oryza sativa
tatcaaaacatctaatccctccttctcattttaagcacagctatgagtttccttattcaactttaatcgtccgtcttattttaaaaacatttaaaaaaattaaaagcataagtcagcataaaataatattaatgttttattatctaataaaaacaaaatactaataatagagaaaatttcaaataagacggacgatcaaaattagacacggaaactcataggcgtgcttaaaatgggacgaagggagtatccttttaaaattaatcttgattggtcgcatatatatgcaggatatttcacaatgcacatttactctttatataaataagcaaatatatttttttgtagatggtgatatttttaaaaaaatatctcaaaaatcttagataataattaaattggtatagagggatcacggagaagagccgtaagagactagtgccaattcatctatagctaattcatataatagttgcttactatactattaatatataatcccacctgtcatacacacactgtgtcttgaagtccatgctgcagctggctacagatctgtagcccgctgctcttctctcccatcttttatctcattaaaatatatttatagctggctaataatctactattgtacctgctctaacgctgctgcctacggctaccaacatcgatcttgctcgtgtgtatcctggattcacggtgacataccctttttgccttttttatgttcacgctaacatcggtttatggccaccgtttgcttaccgaggctggataaagttggagcccatcgattggtctaataaatcaaactaaaaaataaaacttaaattttcgaacatagttttttaagatattttcaattttaacttctctatttagattcgtagtactatgatgtatcacatctctttaaaatcctttatatatattatgggacaaaggagtatataacataacgagtataaaagctaactcgatagtttctgggctgggagattgtcctcatgcacatcaataatcacttcatgcacatttcccaagccagctaggatgttggtttgcccaacccagatcttctcgccgtatagatttggccatcgagagtgacacaatagtaagggtgtaagtggctagctagcccataaaacccacttataaaacaaagcaaaccacttacctatttatttggatctatgagtgggttcatggattagccgcttacacccttacaaaataatgctcatgaattcgtttattgcagaaggccatcgctgctttcttttgatcgtcacatactcacattgagtcgataaacatcgttgcgatacaatggactggtatattcatctgaaccatggcattgaaaaaaatcagttgcaccatactagtgagtcaaaaaatggtacaagtttaataagtatatatagatggaagtgtcatttactcaatccaccctaatttatatctctacttctataaaagagagtaatggtagtga

SEQ ID NO: 3540 - DNA, 1501 bp, Oryza sativa
acttttttgaataatacgagtggtcaaacagtgcaatcaaaactcaaaatcccttatattatgggacagagggagtatcaaattaatcctcattggttaaggtgcttcatcgcttcatgtcctgtgtattgctcatattttaaatattgcataccattacacgaatagaaattattttttattggtttcatacaacaccatttaatgatgcatatttactctttgaaaaaaaacactttgttaaatgatgatcattttgagaagacctcaaaaatcttagaggatgattaaaatggaatggagggagtaataagagcaggtacgataacagactataagccagctataaacacatattgagaagataaaagaggaaagagaagagcagcgggctataacagccagctgcaacatagactccaagacacaatgcatgtatgacaggtaagaccatgtattaatagtataatactctgtatatgcttatagataactattgtaaatcgaccatagatgatttagaactaataattggctatactattaaacctgctctaattaatgaatcaaactgtcaccaatgaatgaaattagggcctggtttagttacaactttttctttaaacttccaacttttccatcacatcaaaattttcctacacgcataaattttcaacttttttcttaaaacttctaattttggcgtggaactaaatacactctaaatataaaatcctgggcaataaatgctcgggctaaaacaaggatggaacacgtcagcgggtccatccctatctcactcggtcggtgctagtactgcttccacgagatccatccgagcagcagcagcagcagtagccgccgccgatccgagaaaaagaagaaaaagaaaaagaaaaccagcaaccgaagcgacaactcctctcccgcaacttcaccgtctcgtctcatctcatctcgtctcgccccgctgtaatctcgtaccgcgtcatctcgcggagacgcgagaaaaagtccgcgcgcttctctctctctctctctctctccctctcgtgggccgctgcccgcacgtcgcactcacgaccggacgccagctcacgaatatccacccgatttaatcccgcccccttcgattccgccgctccgcgcgtatcgcataggcgagttgtcgtatcgatacgcgcacccacttatacataagccgacctccttatcgtagataagcaagtgggggtggcgtggggagagagaaaagggcgagaggtctgcaacgcatcgaagaaagcgagactaaagtttctctctcctctcctctctctctctttctttctctcgcgacctcctcctccttccacatctccgtctctctctctctcatcacgaggggaggcggcggcggcgacggggaaaccctagaattcggcggggtgaagcggtgaaggcgcccgcggcagatcggagccgggaggggggtttcagcggcggcgggggggcggcgcca

SEQ ID NO: 3541 - DNA, 1501 bp, Oryza sativa
ttagaaaaaaatagtaaatttttaaccgaagacaaatatattatgaaaaattattcaattatagatttaataaaactatgctggtgttgtaaatattactattttttttctacagagttagtcaattttagagtagtttgactttggtcgaagttaaaacgtcttgtaacctggaacagaaatggagggagtattaactatcacaaactataaaaaaagtatttgttttcaaagaaatttctctatagaaagttgacttttataaaatatatatatttaacaatctaggaagcatgcttactaaatcaaaacttgaaaatctagagttgcaatgtttagtttatttagccaaaactaaaccgaataaaacgactatactctcgatctaaaataaaccaacttttagagtttgaattttattccaaaataaactaacttctatcttcttacctaccatcaacacatatcaagaagataaaagaagagagaagagtaacgggctatagatttgtagccagctgcagcacagactccaagtcacaatgtatgtatgacttatgtgactatgtattaatagtgtattatatgtttataggtaactattgtatgaattgattattaagttgactataattgatttggatagttggctataataaacctgctcttagagccggtgcaacagtagatataaaccagctataaacatatttaaaggagataaaacaagatagaaaagagaagcgagttacagatttgtagtcagctatagcacggactctaaaatgcatatgtgtatgacaggtgtgaccatatattaattatgtaatactccctccatattttaatgtatgacaccgttgactttttaaccaacgtttgaccattcgtcttattcaaattttttatgcaaatacaaaaatacttatatcatgcttaaagaacatttgatgataaatcaagtcacaataaaaataaatgataattacataaaattttttttaataaaacgaaaggtcaaacgtttattaaaaagtcaactgcgttatacattaaaatacgaaggaagtatatgtttgtaggtaactattatatgaattgaactattaagttgactgtaaataatttggagccagcagtttgtcctattaaacttgctcttaacgagtagtgccctgtgcacgcgtacggctgcctaatgcagagcctgacgtggcgagctgccgccccggaagcccatagaaccaactccaccatagattagtagtactagtactagtattagtattagtgttaaagcgatgcaagcaaagaggctgttctagaagcaagcagacgccacgccacggaagaatctagaaccccacccccatcccccagcccaacccccacacgaagcgaaacgcaatttctctccaaaccaaaacacccgaggcggagaggccgaggcggcgaggcggcggcggcgaccgatctgtgcggggagggggatcgccggaga

SEQ ID NO: 3542 - DNA, 1501 bp, Oryza sativa
gaccagactgtaactgcttataatataacaagttgtggatttcttaattgtcttaccagaacttttgcactcccaaagtcacatagcttgagttgatgggtatgtgggtttacctgattagaagttcaaacatcaattataaagttacagaaataagagggtggtatttgagatgaatgggtaacaacattcaagcataccagaagattctgtggcttgatatctctgtggcaaactccgatgctattatggatgtaagctaatgccctacaaatctgtcaacaaatttcaaactaaattcaaagtcatctcggtatgctactggctagtttgtctgaatatagcctgctacacaacataagtcaaaagaacaaagtatccaaaaaggtacataacagaatattacctggtacatatacagcttcacatagataagtggcatacgctggttcatcttgttgtaatgcttcacaacacgatgaacagtttcaggcacatactcaagaaccaagtttagatacagttcatccttctcagttgtagagaagaaacagtgcttcagagctacaacatttgggtggtcaagaaggcgcatggtctgaagctcacggttcttgtagcgcttatcctgaagaaccttcttgatagcaactgtctcacctgtctccagacattttgcctgaaaatggtcaaaatgatatcactattacagacatgaagaacatttaggacatcttaacaagagaaggttatcgtgtatcaacaatttgctacatacaaaaaaagtggtgctagtagagttaatgatgttaagttagctacttagcttcctggtgattggtgaaatatatgaaaacccaaagatgttgcaactaacctggaagacaatcccaaatgaaccttgccctacaatacgctcagccatgtagctaactgtctgcaagattatccaagaatatcaattagaaatgaagattgctttataatcgatgaacaatttcagatcgcgacagtcagatggcatttgttctgaaatcacaacatggtatcaggaaatcacctgtttcggctgaccatttctgccaccagtagttgtgacaattatgtggccggtttctgttcccttgccgttaataatagtcgcttcaacttcctggatttaccattcagttcgacatgttacaacaaagtcaaatttacatggcacatggaagaaattaaacttctcatcatgatagacttaccttatcgtcccttatcttcagatcatgcatctgatcaggcaacttctcagcacccatgctggtgctactgctgttctttaacccagacggcgcaacccctactgaacccatctcttataaaaagctaaacgatggcgaatcagctttgcatcaacactcaactccgcaatggatctatcggtcaacctgcgagatcgtcaataacaaacatcagttaaaaagtggaaccacgcagttcacaaagcactgattcacca

SEQ ID NO: 3543 - DNA, 1501 bp, Oryza sativa
ctcggcgccggcgaacagcacgtacgcctccacgttgctgggcacccccgccctgtacatctccgcgctcgcctcgatgaacaccgccaggaacctgcaccggcggcggcggcgatcggagatcattagtcaccagagaaacgaatcatcagtggtggcgaagatgtgcacacagcatggacatggacgaacactagcgacgccgccgtcttctgcgggctcccggtggccttcgatccgcccgccgccgccgccggcggcgacaccctctcgtccaagaacagctggagcatcccgacggtggagtagaacgctccgagcagcggcggcacctgcgccggcacggcgaccacggttcagcaactccggcgaagagcagagcaaagatgcaaagaatcgttaatggatggaggatgtgaacgcgtcgccggtcatcaccaggatgtgcgtgtggagggggccgacatcgacggcgccgttgtggtagagctggaggccgacgcgggagtggatgccgtcgaggagcgggccgaggacgaacccggcgccgaagagcgcggcggcgacgcccggccatgcgcgtcccagggggctaccgccaccgccgccgccgccgccgttcccaagggcgcgcgcgggtgtggcgggcgcacgggtgggtggtgttctggggcggaggcagcggaacgtgacggagggcggccgcggcggcgccggcgaggggaccggcacggcgagcttggcgcgcatcgggtgtgttatcctgtggggctttaccagtgccacccgttgtaaagcagtacatctgcccacggttgatttggatccaacggtgctcagctccggtacagttttgctaaaaaaatatggtgccaattttttttttcggttttgctacttcacatgcgcatatttttggagggctgctaccccacggtattccgttgctcctagcagtcacgggataactaaaatcccgagagatttaataagcttcatcaatttcgtgtggaggcccacgctatcctgcgattccaccatatccaatcctcgtatcttgggtaaggtaccgaggtggtacctggtacattggtatcaactggtaccctggtatcgactatcgactgatacctggtaccctgggtatcgagctaatactaagtatcaggccttggtacctgggtatcgactgatacctggtaccctgggtgtcaagctgatacctaggtatcaggccttggtacctgagtatcgactgataactaggtatcaggccttggtacttgggtatcagcgtgatatcccaagagagaggaggaggaggaggaggagtcgtgggtcagggaagtcgagcagcggggcggcggcggaggaagaggaagagaaggcgatagatctggtgcctaccttgtgccattccgtcgctcgtcgttgtgcctcgctccaaaccgccgaacccgtggctccatcgacgccgcctagagcagctcctcatcgctca

SEQ ID NO: 3544 - DNA, 1501 bp, Oryza sativa
ccgtgatcttggggatcatgtaggcgatgttgcagaggtaggacatcttggagaactccttggcctccccgagcgacactttcctgaggagcctcgagaaggtcgcgcggtcgaacaccttgccgtcgctctcgtcgtcctcctcgacgccgcagcatccttcgtcgtcacctccaccgcacgaggcgcagcactcgtcgccgtcgcggcccgccgtgagcgcttcctggccgccttctcgagcggctccggtgactcccgcggcttcggcgtccgccgcctccgcccactgtggctgcacccgcagcatctgcagcacccagttcccctgcttccgctcgtccgcctctgcctccgccgcgcgctggctcctcgcctcctcgccgcgaaccgcaccaccgaccgcaccgaccctctcccctcctcctcctcctcctcctcctcctccgccgccgccgccgccaccgagcggccatagccggagcagcggcgcgtgcagaacgccccgcgacggctgctgctggtggtgccgctgcgccaccggaggcggtggcggctgcggagccgcggaggcggcggggctgatgccgcggacgaacctcagggcctccatggccgcctcctcctcctcctcctctcgcgaccgcgaggttgccgttaacaatagcggggttaagtttagccaaatcggcgatgatccccgtgtgctccaccactcgagatcaaccaaccaaccaaccaagttcactctcgactccggcgatcgacggcggcgggtggtggtgcgaggagaggagcagcaatggaggagagaaagaggatgggagggaggaggaggcctcctatatatgcggagacggcaacgccatgggagggaggtaggagagaggaaagagaggggtgggattgtttgtgggggaggagagagaaaccgtgaagaaaaatccgtccgtccccgggttgcttgctccgctctaatatctttggtaggctcgttttggcatcttgttgggttcctttcaccctctgatttgacgcattcacagtagttttactgtctgaatttggaattattgtaattttaggagtactctgtattctcacgcctatttcaaaagtcaatatatatactatgttaaggtgagtgaaattttattacgtataacaatcattattaacactacacgtaagcataaggtgtggtgatactgtactatttttaaacaaatactttcatacttttatatgtttttcttgccgtgttataattagtattttattttttaagaaaaactatgtggagtgtagaacgaacattttggtcagaggaaggtatgccatgttagtacgtttaccacgtgccaggacaacgttgtatgcgtacgagcgtatcggatacgagcgacacggcggaggctccatccgttttttgccacctaggccgagccgcagaagatcaggaggaggagtcacttccgtggacgcgtcgtccagcgacaca

SEQ ID NO: 3545 - DNA, 1501 bp, Oryza sativa
atgattcacattgtaaaatggaggaagtaactattatttattattttatgtattttacacgataaaaatatattagatttatttatatatttttattaagagaagaagtatgtttcatttgtcccggccccacgtatcaatgaaaccagaggatcccaatcctctactcctagcccaccccaaccaaaccatcgtgattcccgagccggacggacccgaaccacagttcacccgtttaggtcgccgcctcgccgcttcccactcccgaaccctcccctcccccctcccgcccgccgcgtacggcgccggcggccacggcgagggccctcgtcgtcggaggccccctaccactggcctggcggggctcacccgccgccccctcctcctctcccgaaggccgaagaggcgcgcctccatcatcagcaggtcagtttgggggtggtggtggtggtggtggtggtgggcgtcgtgtacctgcgtatctgtggacgcgtggggtggccgcacccggtgggaaccaatgccggcctagagccgtcggtcgcgcgcggcgcggatgcggctcttaggggtagagagggggtagggcgaggcggattggctcgatttgttcgcgcatctgttcttttgttttttttccctcgctcatagaaatagcggggatggatagtgttccgcgcccttctgagttggggggcactgcgtatatttgtccaaggttaaactgatagacgcgaggatttatgagatggctagggattgcttatgcggacgctggtagtggtagggttcggaatcgatttgctgctttttcgctctctgtgaaattttagaattttctacattagaaatgccatgaagcatgaaagaaaagaaaatctttagtcgtatatgccacttgtaattcagaactgtatatatatattattgaaatgcgcatgagttcaatatcatcgtgaaagagatattcattggctgcttttatgaacttcatgagaagcatgtttcagtttgtggcttttagggaaatgtaggtctggagccaatttttttgatcgaattgaacatgtcctgtatgatatcgactagtacgtgcatcctagtagcttatatgaactaagggagaaagcaattatgggcctgcttgggagcgattgctgtggcttttggggctgcagcggcacagcgcagccgcttggctgcatctccaaaaggccacagccattgcatcaatcagctgttgcgggagaagctggctagctgctgcagcacagcgacaggcagctgaaatgaacaagccctatggttcaaccaatgacaaaaaatgccctctaggaactatgtttacttttatgtgcaacagcttctatttatttacattgataagcaaacatcactgcagacttgaaatatttcttttgccttcactaaacaacttcttccttctatttcctcagcttttcatagcaaagactagcttgaatagattattatctgccaa

SEQ ID NO: 3546 - DNA, 1501 bp, Oryza sativa
caacctatccttttaggcccatttgatggataatagtttggaggaaaacgttcacattatgtcctccaatttatgggttgagtttcatttgcatccctcaaccgtaaaatcaggtatatagcgcccttcaattatcaaaactagatcaaattgggtcccctctcagtggggcatgcatgtcagtggggcccatctctcttccttccttctctctctctctcaccatcctctcctgctgtagggcggtgatgacatgtgcacacatgatggaggcttgcaacatcgggtagaccagcagaggcccactgggcaggggagctcgatgtcagctgctgctctgctcgtccttccattgaggctcggcttcttcccaatcaacatcaacgtgcagaggggatccccattcccccgtcgaaagcagagcgcctcccaccttgatggaagaggcagtcaacggcaacgaccttgcatggctgttccaggaggccgtcctcaacctcaagcgcaacgccaatgaggtcctagctaggcttctccttgccattcatcatcgacacctctgcgcccatcgctattctgcagcgctcgccgtctttggccacatagggaattgtcgtcaaggcgatagtggcggcttggtgtcctcttcatcctcaagggcttgatggtggtcatgggacaacaagcaaacccctttccttggacacgacagcgacagtagtgctggctacaccaggtacttcgaggcctgctaccccgtcatcagtagcaaagccggtgaaggaagggacctgttgagcgtgcatatgttgtgaccacggcgatgattggaggagatattgaactatatgccacttttagatgtggcaattaactgtttgccactagactcacatgtcatagacacatgtggacccacatgtcattgagatatgtgtggcaaatagttaattgccaaatcgaaaagtggtaaatagttaaatgccccttattggagatagagaaaaatggaatcgtaaggggaaagagtgaaaggtcccacatatattttttgtttctattttttcaactataattccacatgaaccccagagcatattagagaccatgacacattatgaaaccaccaaccaaaccgtgagggatgtaaatttaccccgctttaatagttgggggtatccttcatatctagttttaccgttctagtacatgaatcaaactggggctatcgttgagggatttaaagtgaactttttcctagtgtggaccagcgttattgggctggggtacagttaaaaaatgaattgctcctactatagttgaactaacatttttcactctgcattatactccatatgttttgcatatattttgcattatactcccctgtttcttgtctgaggctgagcagattcgagcagggaggccatgcatagggcagaatagatgaaggtgaagttgtgcactctggttgctctgtagtggacagggaagaagaggg

SEQ ID NO: 3547 - DNA, 1501 bp, Oryza sativa
ggagcattgttgtacgcaagcatgcatgtgtgcacgtgggcagccacgtggcaatataaaaaccaactcgtctacatctttgagatgcagacaagagtcaatgccgttctaagaaaaccatgagatatcgtacgagtagaaaatagaattgagtaaattacataaattttctaaatattgactaagaaacagcacactaggagtaggggatatgcttcccagcggtctaaacatgtataaactgttcgttccttacttttttatgtgcccgtgatttagatcccgcgtacctcctaagaggccaaatctaaaaaagcggtttgttctgctccccgctgaaagagctcgggctccgatagatatataatcgtagttactttcttcgggttaatagtatttatcatcttgatcaaagctgatgttaaactttaaaatatttgattatatcatagaaatatgaacgatatgtatagagtagtattagaaaatactacaacaaaattgttgatatttctagttacattataataaaaaataatagttaatgctatttatttgaaacgataaatactgtcaaacctgaagggaatatggtactagtgctacacaaaagcacacagttttgataaattctacttataaatcagacctgacattttagatggtaattttatataatctgacagaaactctaaagtggataaaagaacttgtggatcttacatgtttgttttgggtttttatgattttagttttgtgaagcacggatactgtaatacctaggattatgtatcacgtgtaaagataaacttgtgattttatataacttgaacaacaacgctataagattagtgcaatttactgaataaaataaaatgcaggacaaaacatatagtagcacaagtagtggtagggggaggagcagcgtacgtgtggtttgcgacgtggtgtgcgtgggcggtgcggtgggcatgtatctgcatctgcatgatactagtgtccaccacatattacgggactattttcatctgctttttatttattcattgattgattggtactactactgctagaagaaaaggcggtttaggctgtgtttagttctttttttaattttttttaacatatacgaacatacatttaaaatattaaacgtagattaataacaaaataaattatagattccgtccataaactgcgagacgaatctattaaacataattaattcgttattagcaaatgtttactgtagcaccatattggcaaatcatgacgcaattaagtttaaaagatttgtctcataatttacatataaactgtgcaattgatttatttttatctacatttaatgctttatatatctaaatatttcgcaaccttagtttaggctggtggcagcaaggtgaccgttgcgcgtccccatccaaacccaaccccccgtaccataccatagatatccccaatctccccctctcttagctttctctctctcgagacttcc

SEQ ID NO: 3548 - DNA, 1501 bp, Oryza sativa
gatttgtaataatgtgagccccttcttgaactataaaaggaaggggaccatatacggaatggggggtggactctttatatcaatattctcgcttgtagcctaaaaaggcttctttgtacttcactgatctagggaagacaataaaaaccaacataggagtagagtattacacctccgagtggcctgaacctgtataaattcttgtgtgtctcttgctgcgcggggtggtcggaccccgcgaatcctttctgatttgcagttcgttcgtgcctctcacaatcaaaccccctggtcggatcttcacactcgggggggggggggggtctccattccctaccgtctgaggaatcgcttcctcgacaatggcaacctctctcccatggtggcaacggatcagcctcgattggggagcaaaccagcgactttgtgcgtctccattggttgaggagtgccacaccctgatttttcaaatatttaaaatcatccaataatttatttatagaatttataataaagtgtatatcaattatcaagtgaaaaagatgtaggtcactggctttgttcccgttctatatatgtcattgagtttgttaagttctacaatatgtcatcgtattttgcttaacttcgataatataccatcgttgctaattagttttggttagtacttataattttgtcctaatgtccgaaatagctttgggatgaaaatttcgaaatattagcatagaagagaagttgtccatctcaaatgcagttttaaagtaaaaggggaaaaaaaagaagaagtggagtacccttcattccctcgcggcgtaaaagaaagagaaatctcccgggggcgtctcgtcgtctcctccgctccgctccttgcgccaagacgagtcgcggctgccgatctccatctgcgcgagcagagcagagcagagcagggtatcctggacctggtgagcacctcccatcctctttctgattcatctctctcccaccgggagctggaatttgcttgcgttaaccctagcttctcttggagtagatctggatgaagctcttctcctccttaattccagagccttaacctctcttaatacaagcaagtagtaacagtttgtttgtagccccaaacaagttggatccgatcgaaactgtgtagggaagatggaggagatccagatcacttggagaaggaaaaatcaggtagagagggaaaaccattccgaccgcgccgccgtgcccaattccgttgatgcatcgatttcttaatatttttctattctgagaccaacaacacctgtgtgtgtcgtgctcaacacctgcagcagcacgtaaatggatgaggagagagagcaagaaataaatccccatttacctcaccgctatgttatgcgtcctagctccaaattcccctggagcagctgatcgaattggttcgatccttgtctggcagggcccactccttgtgattaagggattgtcccggggagcttggtgcacacagtga

SEQ ID NO: 3549 - DNA, 1501 bp, Oryza sativa
cctgtttcaatcagttttatttaagaaacatgatggttcactggcacttaaagggccaaggcctcatatgttggtccagacccccacattgtcattctcacacaaaaaaaaatatgcttgtgatagtattttatttaaaaatttatccattgtaaacgtgtgtttggattggctttggtgaatgaaatggtatttggtcctcacctcatccccaaaagcatatactaccaaataggagggggaaaaaaggtaaaaatgcagtttctaaacacaccccaaataaaaaggaataatatgaattgacttctcaaaccgagctagaaattaaccgagctggtgtgtttagttcacgctaaaattgaaagtttggttgaaattgaaacgatgtgacggaaaaattggaagattgtgtgtagagaagttttgatgtgataaaaaagttagaattttaaagaaaaaatttagaataaattcggtagaggtgaaaccgagagaaccgagtagttgtacttacacatgagatgagatgagatgagatgagatgggatgggagtgcagtgtacagtaaaatatgtttggtgatgagggggtagagtggtggcagcacaccactggctgagcgcgtcgccacgtgtccacgccatttccaaggcaggcccccatcaacggcccagacgtcagcacgtggtgatgtcaacacccctacccactgtgtcactgacaggccggggcccatcctcctcttcgtcctccacccgccagccagccagcgcctcctcccctctcctccccacgcaacccgatccattcccaaatccctcctctcatcaactcgactctcggtcggcgtcaccggcgtcggaggcggaggcggaggcggcggccgcgtcggcaaggtagtgctgtgctggatcgagtcgagcagctggctgcgcgcgcggtttgtggctctctgtgtgagtccggcgctgctgcttcaattccttcttccccagggcacctcccgtgagccgccatctccctccctcacctacctctggattcgctccagatccgcccatgagtaggcccccacgcccaccgcctgctcgccatcgcgcctccactccaccacaccatgccgatccccaccacctctgacactactccgcccctccccctctctcattcccatggaggacctcgccctgcccgccgctcctcctgcccccacgcttagcttcacgctcttagccgccgccgccgccgtcgccgaggccatggaagaggctctgggcgccgcgctgccgcccctcaccgcccccgtccccgcccccggagacgactccgcctgcgggagcccgtgctccgtcgccagcgactgcagcagcgtcgccagcgccgacttcgagggcttcgccgagctaggcacttcgctcctcgcggggcccgccgtcttgttcgacgacctcaccgccgcctccgtcgccgtcgcggaggctgccgagccgagggctgtggg

SEQ ID NO: 3550 - DNA, 1501 bp, Oryza sativa
tgttcggctgtctatttgcggtggttgcagctgcggctgcgccgtgtgtgtgcggcactgttagtgccggctgcgccacaaccacagcacaggcagccaaacaggtccattattgcgtgatacgaactctaaagtctctaatacactcaaacaaagctttttttaaaaaaaagtgagttaaaaattgatgggtgaagtttatattagtatgattcatattgaaaaaaaaaattataaaaacgaagaggaagcggaggcgtagtaagaaacgtaggggtgaaaacggagcggatattatccgatccgatccgctctgaatctgtccgatgtgaggatatggtaaggatttttagatatctggccggatgcggatgcggtatgaacgatatccgacggatgcggattatccgatattttaatcggattatccgatgtactgtttggcggataatccgcaaatttcagaccacacaacaactttcaggcccacctagctagcccaatagcccaacccggcctaatctaatcctctcctcatcccccagatccgtctctggctctctctgtgtgccgtccctcagttgtcagtcgaggagtcggagagagtagcgcggcggcacggcacgacggcgaccctgcgcggtggccgctccttcccaacacgcgccaggccgatcctcctccccaacacgcgccagccgttcctcctcggctagcgccaccgccggctgcaggaggctgctagcgccgccgctcactgttgtgtgttttgtgctgtacacctgtactactactgctgtattcctgtatgcagtatgctgcgtgtagcactgcataggggtgctctactgctctatgcttgctgttgttgtatgcttgtatggcttgcctcatgccgatgacttttatttttacattttaagctatgcagtaaccggtgaactattgaactgaacacttatattatgtttttgatggatcgtggatatatcttggattattttgactagtgaactattgaaccgaacacttattacttatagttatactattgctattgaactgaacgcaatgaactaatgatgttttgccatcgtattggggcaaattgtattgccgccctcttgatgtatggattgaatacaaacttgacatccgataactttttgtccgtttctgaaccgagttcgcaccgaatccgacgtccgaaataatccgctccgcatccgcatccatacgtcatccgcatccgcttaaaaaatatggtttaggatatagtatagctattattcatccgaatccgttccgttttcaccaataaagaaacgcatcctgttttggttttggttgtattgtggagcagtacagcagtatcccgtttcgtttgggcttttggtgggggttgggtgggtttcccgtctccttccgattgctgagtagcattagcaaaggagcaaaggaaaggaacctcgatctccatctccatctccgcccccaaacc

SEQ ID NO: 3551 - DNA, 1501 bp, Oryza sativa
caggatctggaggtatattccgcacaagaacctaaaataaatcatttgaggtgcattcaacaaaccaaccagaaggaaattaactcatcgtgtttattcaattgagatatgaaaccattcccgtctacaacattgctttagataatataaaccaagtcagtgcaaagtgagtatcagggtgctcagagacaaaatgcttagccacaatctcttagactatttccagtggtgaatagtttcagtccattaatattacaattttttacccttcttgtggatccaatgtaaacatgttggtactaaatagagaggggatttgcaaagttgacaagatcatactgtaaactggtctggtcgccgtttctctgaagcaagaaaccgcaatctcatcgttgtaattatctcatactctcggaacagtacatagcaggtccaaaacgtgacagcataagccataaccaagtgagtaacaaacctgtaaaacagatggaatgttcatcatgaacagcaaagacatgtgctagcatcaacagaaattaataaatgaaacctagaagttcagtgtggatgaatttattttcaaccagagcaactgccacccaatattgaacttggcagggcagctgctaagtcccaagcacacaggccaaaatagagtgcttgtaccttactaaattagacagtcacacaggcaagtggcatatttatcaaatcacccaaaaccataagatgataatgctcctaaaaattgtaccaagtacatgtgcataatcagcatgaagataagtaaaagtggttggatttcaggtgccgcccaaaacttaaaaaggttgaatctgcatgtaaaatgaatcactatacagattttgtttgtgtaattggtggaccaatgggcaatcttattgatgttttacgtacaatttatattgaaccagaccaaaaaaagaaacatttatctctacacaactcatcaaaatacaccgcatccagatatcaaatgatttatggaggcttacctgtttgacccataaggtatgtttgatattgaaagtttgtcaattttactgtggactaccttcatgctgtctagggtgtcatttgtccagttcacagggaacagaacaagcgaagctaaaattgatattggaacgaatatcttgatcctgtaaaaggtcaatacaggtatatcaatacacaggcataattgaagttaggcacaaatagattttgacaacaatgatacgattcatattctcaggtttaaattaacatgggaaaaatgcagagtgataaatttgctcatcatttcttcattagcatctcttattgtttagaaacaataacaaagtgaagccgcaggcctttacccattggattaaatgctcactgtatcattaactaattggcattatttccacaagtatgacttggaacaaaaaatgagatggcaacaaggaacaattgagaagagcagaaacataaaagatggaaaggaacagac

SEQ ID NO: 3552 - DNA, 1501 bp, Oryza sativa
atatatagatttgtctttcaaaatactataataaaaataaacatgcatttatttattgtgtatattataatagaaaaataatgttaaaggtatattttgtagaccgtatcattgtctaaaacaacaattaaaatgaaaccggagggagtactatatatctacttgttccattaaggttgaaagtagttgttgtattacagtggtataaaattaatgtttctcttgctacccttgtcaaacccttgacctataataaagttgcccagctaccccaaaccactagaccatcttattggtctgctactataatatatggatttccttcgttttaatataaatacaactctaatatagatgtgacatattctaatatagacaactacaaatttattaaggtatgcttgagatatcttaagattacgaaaatgagagaacaacgtctatattattttgttaaggtgtgcttgagatgagcgctaaaaggttggtgctgacctcctatgtcaaaagggttggatttagaattgaaggtaacaattggtcatactctaaatagcttacataattaatggccgcgatgcacaccacgcactcctacgttgtgctggtagctttcggtatcggtagtccattccactatagtaagagtcattatcatcagagtgatttgcactttgggccatgttttattgttaaagttttactttgaaccaccctgtacataatctttttactttggattaggtaactttttctttattacataatggaccaccctaactcttttcgctagtgatgtctagcgtctctttcgacaaatatatggtatgtatatatatatgaaaatttgttggcacgtaggtaacaatttccttgaagtcattgaagtattgaagatgttgcttggggtggtttattgtgcaataaagataaagttatctagtttaaagtaaaaagattggacaaagggtagtctaaagtgaaactttaataataaatcatggcccaaagtaaaattaactctcaccataattaaacaaacaaaatacttcaacttcctctgctcctaaaacaaaacaaaacaaacaaattaaaggaagcaagcaattcaagtgctagctggcgcttccacgttcgtatgacggccggccccgccccgcccccagtagctaattccacccgcgcgcacacacgtcatttggcaaggctcgctatctaggatgttaggatttgtttagtttacgttaaaattaaaagtttgattaaaattgaaatgatgtgacggaaaagttaaaattttgtgtgtgtagaaaaattttaatgtaatagaaaagttaaaagtttaaagaaaaattttgtaactaaactcggccctagctacatactcgatcgagtgtaaatactctagatatggcttttcttatatatcatatcaatcaaaggctaaataatatccgtagctagatagctaggttgacagtcaagcatgcactctctccat

SEQ ID NO: 3553 - DNA, 1501 bp, Oryza sativa
tagtacgcaggactacttttctcttcgatctctcttctccacgtcaggaaaaaaccaacgtgaattgctcgcatcaacgtcggttttacggtcctctcctacggtaaacgggacttttgtccgtccatctctcctttctcttctcccacacggcaataaatagcggattactgcctcaaaaaacaactcgatcatcattcacatgaaagtatgaaacccggctctgcgagaaattaaaactgccatccacattccacttaacttaattactacgctagactttctattattttgtatttatacttataaatgtgtgtaaaatttagagtttgaccattcacaccccctataaagcacaaataattaattactactatttcaaaaacaagagtaaatttcacctaaccctacgtaaaaataaacctattacgggatgtgatatattagtatataagtatgtccagattttgtagtactaggatgtttcatatcacgtattaggtttgttttttatgggatagagagagtaagttgtaaaaacacatagaaattctgacacatgacacaaaacacatagaaattctgacacttgacacataaccctatgacacatgacacctaactctatgtattatgattcactaataacaatccggtctaggtggggtcggctgagacctaataatttaaggttgcttggacccaaacagttcttaggcacacccatttgaggaaaggtccaatctccctaaaagactaatccaatagggaagggtggctctcccttttaaggtggcttccttctcccaagctaaacaaggtgggattattcagaggctcacatggtcgccgctcgacttttgcgtctttgccagtgggtaatagtggaggattgttaggcacacccactcggggaaaggcccaatctccctaaaagactagtccaataggggaagggcttcctcctcccaagctaagcaaggcgggattattcagtggctcacacggtcgccgcccgacttttgcgtctttgccagcgggtaatagtggaggattcttaggcacaacccactcggacttttgcgtctttgccagcgaataatagtggaggattcttaggcacacccacttggacttttgcgtctttgccggcgggtaatagtggaggattcttaggcacacccacttagggaaagacccaatctcccaaaaagactggtccaataggggaagagtggctctccccttttaaggtagcttcctcctcccaagctaagcaagttgggattattcagagaggctcacacggtcgccgcccgacttttgtgtctttgccagcgggtaatagtggaggatgtcctcatcataacaatctggcccaggtggggtcaaccgaggcccaataacttaaggttgcccggaccccaacagttcttaggcacacccactcggggaaaggcctaatctccctaaaagactagtccaagaggggaagggtggt

SEQ ID NO: 3554 - DNA, 1501 bp, Oryza sativa
taatgattcgactctacatagtaacgatggaagtacaggcggggaaacgaattagacacagttttcgtgttccttccccccggcggggtgggtgtcccttaattaaataacacgatgcaagtactacaagcgtaacacaacacacttgagcctaacgaatcaatttaattatctccatgtgtttacaaaaagagccacacagttcgctcttaatttactcccttttgttgaaggggaagttaatttacttggtgagatttgagcaaatccacaaacttgaaggtggttggcagccgaataatatgcgtttagttgttataggggctgtttagattgatgctattttcagccatacaaagttgacaaaaatttgttaccaaatttggtaaatatataaaaaatgctgtcaaaattttggcaatattgccaacttgatagggtttattttggctgcaatctgaacaggcctatggaaggaaggtaaaagaaagagggaccgacgatatatagatttcttaatagaagtggtgagtaggagtaataaacaatggagtgataatctctatctctatctctactattataaaaattgaaatgtttatgcggtccatcatccgtgtttgaggttcgtcatccgtatttgaagtcggttttctttggttttaatctatatctcttctctactattacaaaaactgaagatgtttttgcgggtattttgatacatcatccgtgtttgagtcgggtttttaaattcatttgcttttggaaatacaaaaggaatcatataaaaatctctttaaacaaacttgtatgctaacttgagatgaatgtcgaactcctaattgcagctcatgtttttctagaaaaaaaatccaagcgaattcccacggtggattaacagttataagattaaaatagcattcatccgttgcaacgcacggacattttcgttcacttttggtaatatagaagaaatcatataagaaatctatttaaaaaactcgcatgctagtcgtgggaagaaaactcgtgaaggaaggagaagattttgcaaagagataagaattgggcgtacacgtgggcggggcagatcgatcttagatacatacagattgaaaaagaaaaaaaagaaaagaagaaggagaggttgagggagggaaggaagctaggaaaaagggaaatactcctaaggaacgcggcggccgtttcccgaaccgtcgcgggcgttccctagttggactgggcggttccatcccagacgcaacgcgcagcggtcgtaggagtaggtgttttttttttgttttgcagttgccttctctcgaggccggggggctcggctatatatcctcctcctccccctcagttccgcacaaacacaaattaacctcctcctcttcttcttcttccgctctctagctttgctttgcttgcttcatcaaaccccacacacgcacacaacaacaacaagagtaatcaaagtagaagaagatggtttcgg

SEQ ID NO: 3555 - DNA, 1501 bp, Oryza sativa
agtggtggtggcgtttcgtccgtatggtacttgctgaagaaagctgttcttatcagcaagcagggcttatcgatcctaattcttttactgattaaagccccaccctctaatctgtatgaaactaaagttatcaatctaaccttccacctaatcatcaagttaataccttgctcatttttttaattataccttctgagacataccttttatcacagaccgttagatggcaactggcaagtaatcaacggacaccataactcccaagcaccggaggaagtctcagtactataataagcaaaacatctaagcgattaattacttagcataaaacacctaaatcataaaactaagaaaatctcatatatatatatgcctaaattctgcttagattaaatttgatgatgtaggcagctacagctagtcgtcgaaggcccaggcgttctcctggcgaatcgccgcctcctcctccggcgtgaagtcgttctcgatcgaaaacgtctccctcatctgctccggcgtcttgccggacatcatgtccgccacgcgctggcacgtcatgtccagcaagctcttgatgttcaagaaattggccgccaagatcagcttgaacagcaccggattctcgagggcttgcaccaactcggcgtcgaacttcttcagctcctcctccgtgcttgatgctttcatggtgtcgccggcggcggcggcgtcgccggcgtgcatgttgcagtagtcgacgaccatggtgaggatgtcgccgtcgacgttggggagacgcaccccgttctccgtgcaatcgtcctcgatcatgttggatatcagctgcgattggctcgccaccgcctccgtcacctcgaagcgtttcccgtcggcgctgatcaggatgatcatcttgccgccgccatcggtcgtggcctccgctgctgctgccgccattgttgatgaacttctgacgataatctaatcctgaagtagtattatttggtcgatggcttggaaagtttggtgttaatcagatagaacctcgcggcgtgattgtatttattgcataaagcagcgtgagataattaaactccgagtaggagtcgtattttaatctcattttactactgtaataattgtaaattaattaatatcgagaaataattagagtactcgtttccaaaaggagtctaattagactatggaagaaggttccgaagatcagtccagttaaaaatctctcgagtctcgacgacgtacgtacaccaaactaacgcggaaatcaccgaaaatcaattgaattcggattggatttcgactccacatgaccgaatccgagttgtttttgcgcggtttcacgcaataaaaacacaccacctcctctctcgccatgatccaagcacacccaacgtttacgttccaagaaagacaagaaacagttgagctttgcaatccgcgagtttcgtccgtccgtgtttcaaagtagcgagatcaatggcggcagacaagaaggaggttg

SEQ ID NO: 3556 - DNA, 568 bp, Oryza sativa
gggcgtgagagggagttacgcgcgcgagagagagggtgccaaggtgggctcggggaggagcgcggagggaaggggggactcatctgggccactcgattatttgtagatgaatactgatagttggatttgatgaatgagtaatgtaggtgtaagaatgagttggtgcaataaagttttgttttgtttaagaggaattttactatccttgaggagtctcaaggtaccaccaggtatctacctccttaatcaattgatatccaccgttaattcacaaaggttaatttagggacaaaatttattattaacaaggatagcttagtaattgaccaatcaccggttctccatccactgccaagcgttcacgatttcctttccacgatttcagtgcttaaccataatcaattccaatcccaattgaacgagctcggaggcaaggagcaggggctgcgcgcgcgacggcggcgaccagcaagcacgtgcgaggcggcgaccggctagcgcgagcaatggctatgaccagcgtgcggcggcggtgatgtcgactggctgccgcatacgtcggctacga

SEQ ID NO: 3557 - DNA, 1501 bp, Oryza sativa
gcggcaagatgatcatcctgatcagcgccgacgggaaacgcttcgaggtgacggaggcggtggcgagccaatcgcagctgatatccaacatgatcgaggacgattgcacggagaacggggtgcgtctccccaacgtcgacggcgacatcctcaccatggtcgtcgactactgcaacatgcacgccggcgacgccgccgccgccggcgacaccatgaaagcatcaagcacggaggaggagctgaagaagttcgacgccgagttggtgcaagccctcgagaatccggtgctgttcaagctgatcttggcggccaatttcttgaacatcaagagcttgctggacatgacgtgccagcgcgtggcggacatgatgtccggcaagacgccggagcagatgagggagacgttttcgatcgagaacgacttcacgccggaggaggaggcggcgattcgccaggagaacgcctgggccttcgacgactagctgtagctgcctacatcatcaaatttaatctaagcagaatttaggcatatatatatatgagattttcttagttttatgatttaggtgttttatgctaagtaattaatcgcttagatgttttgcttattatagtactgagacttcctccggtgcttgggagttatggtgtccgttgattacttgccagttgccatctaacggtctgtgataaaaggtatgtctcagaaggtataattaaaaaaatgagcaaggtattaacttgatgattaggtggaaggttagattgataactttagtttcatacagattagagggtggggctttaatcagtaaaagaattaggatcgataagccctgcttgctgataagaacagctttcttcagcaagtaccatacggacgaaacgccaccaccactgatgatccacaatgaccatgaattttgtatacatacacagattcaacaaactggttgatcgagccatacttgtctttgtgtatggacgaaagaggattatatttgtttctttggagtctaaatttagatgaggacctgaagaatcaattagggaaaggggattttggacaagtgttaggatttatgatctcatgtactaaaacgcaaaaaaaaattgaattacctagaaacgatgcgaacgacagaatcggagataagtaataacttgatgcaaaaaaagagatagacggttacatgtaaaaggagttaattatcggtgtttattaatgttttctattcctaagttgcccttaacagatcaacggtgggtgattaagtagtaagggaggtaccagaaagtagtaagggaggtacctctggtacctctcaagcaccttaaaagctctctatagtactatgtacatttgtaatcttttcgaatcctaatttatagagatcttcttctgtgcttggaattaattaggatcgtttatcactaatgatctaacgctctaagagagaagtatcaggaaaaatgtattaaaagtgtggaccaggtatgg

SEQ ID NO: 3558 - DNA, 1501 bp, Oryza sativa
aacaatttgacaacgaagcactctgtatgtatgctttctttttgaaagtaactgaggtcatgttcactttgatgccattttcaaccttaccaaattttggtaaagttgtcaaaaaaaatagttatatttagtttgctgccaagttttggcattgctaaaatttggtaaggttttttttttttttgcatcaaagtaaacagaccctgaactatcgattcacagtagctgttgaatatatgttccaatccaaaacctaacaagatatcaagagcattcattgataacctaacaagatatcaagagcattcattgatatagcattcattgatgcatatctcaatgtatatcttaatgtagtaataacaggacaagacctgtcactgtaggaatgtggatggaatccccaatccccaatcgtcgctagctcaccacgctggtgaggtaccaaattctacccgggaaaagcgcatagatcgatctgatattgtgcgacttgacgcaggtcgattttggcaacgtataatcgatcaatcttagccgcattcaaaactactagtggtaaacactaaacaagacggattcgtgagcgggaggcgaacctggtgaagtcgggcttggagaaggcgagagccggccgccggtcgccggagagcagctccggcggcggcggtggcggcggcggcggcggcggggaggatcctcttgtgcagcagggagcgatacgacatggatgccgccggatcttcggcttggcttagggagaattctcttttttttctaacacccccggttctgtactagaaagagaagaagagttcatgtcgtgggcgacccgacgaatttttttcggttttagattttttttaaatatttacagaaataatctatcggccaaaaaaattacaaaaatagacccggccacccacctctggggtggcagctgacgtggcaaacgggggaggtacgggcggtgacggagggagggtttttttgcagaaaaacccttgccgctctctggtggggcggcaaggggcccgaatgcaaaaaagccagtcggggcaggccattttgaagaaagccccttgccgccctctggcaggtctcgctgcctataaaaggcctgccgcccagcccccagccctcattcctccctcctcaaatccagtgaaaaaaaaaagaagagaggggaggagaagagaagaaggggcgaagccctgctggattcagacgccgatttcaggtaatattcataaatcctatatgtgactattgagttaaatagtgtgtattttttaaaaatttgtttgaataaatgcattatatttttagggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttattttgttgacagata

SEQ ID NO: 3559 - DNA, 1258 bp, Oryza sativa
ttatacgcgtgcactctccagggacaaccatctttttccttaacacaccgaacttcatattgcgaccggttcgacttggcaacccaaaactctctatgaagtgacactgcaaaatattttaccgcctccttcatatcttctgctctactataaatcgctccctgaataacctcattttctttgtactcccatctcacactatcctcttcagagacgattagcccagaaaaatcctcactagcccattctgctggattaatatccgtctcatcatctgacgaatcaccttcctctacacgctcgttgtcagaatcctccctctccatttcatccacaatggcaccgacagtctccccctcgtcggccactccacctggttgaatgcccactggagctactacgcccccgtcctctcgtgcgttgacctcctccacagaattctcatttacttcagcacttggtccctcgccatcatccatgttcatctgcacacttggatccttcgggtgaacaaacggaaccaaagctagaggccacccgcgttgcaatgcattttccaaataccatctccacactcgagagttttgaactggcattagttcccaataaaaaccctcggttgtccgacttactataacattgattgttatgtcgcttgtctgtggatcaattctcaagcccctcattaaccatccttttatagaaggtacactcctctcagccggtctatcaattcccctttctgatacaataaaatctgacagatctaccccagttggcccgtaatggacgtttcctggtccatggtaaacttggaatatttgtttgttcgacatatctgtcaacaaaataactagatcatattactctttcatgcaataaacatctacaacgtaatatcttcttgtgtaagccaatgcaacggtaatgtattgattccaaactagcagatctacgtagttaccgatatctacaatacgcacttctagattagtacaactaaaaccctaaaaatataatgcatttattcaaacaaatttttaaaaaatacacactatttaactcaatagtcacatataggatttatgaatattacctgaaatcggcgtctgaatccagcagggcttcgccccttcttctcttctcctcccctctcttcttttttttttcactggatttgaggagggaggaatgagggctgggggctgggcggcaggccttttataggcagcgagacctgccagagggcggcaagggg

SEQ ID NO: 3560 - DNA, 1501 bp, Oryza sativa
ctccaagatcacgttgccctgggacatcatgatctgttcatcattaacaaaccaacacaatcattgtgtggcaataagatgaattagttaggttaagggaagcttttcatatggccgcattgaacattctgtgcctactcaagtctaaagccgtaaacttactcttaccatgctggcctcgtgcaaactttacaacgcacaggcacagcaatcctaaagcaatcgatccatactgtttagtcttacaaaaaaatgattcatatatactcttggaaaataatggatcatttttgtttgaagccaaaatatgctctggctcgttaaatagtacattgtctatgtctagtttgctaaaaaaaatgtgcgatcaaggcagataagctgtcaaaatactggcaataccaaaacttctctacattttagcatggtagcaaactaaaacaacccaaagtaatcaactgtgacatcctttacctaccctgcataacttcattcgattactcaaaataacctatataataatcattgcaagtctcttgaagatctgatagtacatcatattgacaaacacattgactgagagagaatagactgacctcatgaacagttctcttccccaaccaggccaactaaattaattcctcatgtcccttggatattcgccagatcaatacaggaactaatcagcacacagattgcttgccaaggctttaacttactttatcaacatctgcatgatggagtatgacgtcagaaatatcaaacatgaaaagatttgattctgcatcaaagacctcctctcttctctttttttttttctgttgcccctgaaattgactgaatgcgacagcacacagctagcaccccagaaagtgcgttcactattggtagagcaagaagataaaggccatccacaatgggtgccctcgacccgtcccctcacaaacggccgtttccctcccgtccctttttcagcgtgaatcgtctccccagctaggagcgcggcgcctggcaaaggggcgcggctctttgcaaggagcgcccattttttgcagagcaacgaccctcgacgctgggaggagacccactgcaggctcctgtctcctcgctactccccccaaatccctctcctaccctcgcccctggcccctctcccatggcgccgcccgctcgtcgatccgctccacgggccgccatcgtgacgacggggaggagctcggcggccttgaagaggagggcgagccagtcgtcagcgaggcgacccgcgaggcgatgttgggcgggggtgccaggggcggcgaagtcggctgcgctgggcggcggagtcgtcggcgacggctagagggagaggggagcgggaggagggcgacctgcgaggcggcgctgggcggggatgacgggggcggcggagtcgtcggcgacaggcggagggcgaccgggcgctgacctcgccggcaagccgccgtcgtcgctgcccgaggccagatccggcaagcccagg

SEQ ID NO: 3561 - DNA, 1501 bp, Oryza sativa
gtacatgcatccgactgtcctggttgtgtccttcgctgaaaagtactcagctatcagctaaaaaaaaagatcaaatatataactgtagccaagaaagaacacaatcctagcacgacttcggagtagtattactgtaccctatcgtacaagttatgcatgtcccctttgatttccaagggcatacacatattaattcagcctgacttgcatactaacggtccaacctatatatggagttatggacgatatccagacagatcaatgggcggccacatatgtcataagtgtatgcccgttcaaggcgatcgacggcgactaaacgtgtacagactttggtttttatcgcctccgttccaacctgccgctcaacctggtcttggttttgggcccccatgaacagttggtttgagagtcggcgtcagggtcgcctccatcgcaaggaggtcctgtacgctgtcgacctgccgtttgggcaacgcaaaaatatgagcagaaaaaagaaagggaaactcgtttatagttactagagcagatgttcactcgatcagtgtatattaactaaatatttatatattttttataaaatagtgatataaattaatatgtaatatatcacttcacaaatttataagttcaaagtcaacttctacggattagagaaaaataataaatttcattgtggatatacaaacttagggtttaattttttttacaatttctagaggttaaatttgagctcgtatgtttattgagtgatatagtattacatattaatttaacttactattgttttttttaaaaaatataaccaactagttgatatatgataactgcaagcatatatatttaaatcaacgacatgccatatatagaaaattgctatgcatataacttaattgtccgactcacgtacgacaaaatttaattaacggtggtaaacggctacagtgtatataaatatgttttactttaattgatatatagttacatgtatatgagttgtacaacggatcgtacatatagcggtactcccatatataattgtgctacaagctggagtatagagtaaactaatagtagcaattaatgcagcatatgcctaatgtctattagctatgcaagattgcaagcatgcatggaaggaataatgcatgtactacaggtataattaagcacctacctaattaagccttcaaaacttgccaaacttggtcaagcaaagcacgtataatatctgtgttaggaaaaaactggcaactaatttgatgttgatctgatcgaatgatcgtgtcctccgacgtgttctaaattccacggagcatcgatcgattctggcagcaaagtcgcacgcgcagaaaaatctccacacgtcgtccccgtctctctatatatacctccttcctgtttggatctttaattagcaggtcaataccagagtctctctagctacttctcctgcttgctatagccctgtgttgcgctaggctgtgtcatataatgg

SEQ ID NO: 3562 - DNA, 1501 bp, Oryza sativa
ccaccgcgatctctgcccggtgtcgtgttgctctcaccggaattgaataggagtagctcggtgacgcgcgcgtacgtacgcgcgccagccaccaccaactggaacccatcaccccggcccgcgccggaaaaagaccgagcgccgcatgcaactcaacgcgcaaccaccgagcgccagagagagaggcttctcgattccactacccgcgatggcccaagcgaaccgcccggcgcccgtcagcgcggcagcttagggtgtgtttggttcacggtcatgcataaacgggatatgaccatctatattttatattttgttggatatgacgatccagttttttgtttggtttgtatagatatgacaatccaattttttatttgattggagggatatagcatggatggaaaaagccaaaagttagtgcgacccatttgtcatatatatttttttatcaaaatataatcatctgagatcttgttttaaagatttaattgtaacaaatataatggtgtaatcaatcataaattagataaacggtttaggagaaaaagtcatttggagcttacttaacagaaaatcaaaccaaccacagccaatcagaacaggacacatcacccagaccaaaactggatggcttcatccagccaaatcggccggatgcactcatccagcatatagagagaatattccctattctgggccgccccattcatcctgccctccaaccaaacaacacagaaaaatcaagcggccatctcccatccagattcatccacccaaccaaacacactggtgtggccgccactgcagtctgtagtaataaacgcaccaaagtaccaaacgctggacccacgcaacgctagtgtgcagggtaaacacacacaggtcgagaaaacggactactcctaaatgtgtgcaccgcacagtggtcgaccgatcgatcgatcccgagtcccgacgttttttttgtgctcggtggagcactccggggagcgaggggacatgaatggcaccccactagccattcattcaacccgagccaactgggaacaccacgcggcgagtccaccgcgacgacacacacgtactgataccaatatagtagatacgatattctactcctcctaccaccactattgctgtttactatacgggttacgggtacaaagtacaagcacgcagccgatcgtgtgtgcgtgcgcgagtcattagtgcgtcactagctcgagcgccacctaatgattgctgcgtcccgggaaaagaggggcaaaagcgtacgtgacaaccaacgagccagatcgccttccgctctctcgcgcgcggtcgcgccgcgcgccgctcgctcgctcgccacctcccgccctttttaaacccaccaccactcgcaatttcgcctccccaccaccaccaacgccaacaccaccgccgccgctcccccgcctaacacggccacgcgcgctcaggtgagcagcggagctagcttacctcgctacggcacggtgcg

SEQ ID NO: 3563 - DNA, 1501 bp, Oryza sativa
tttgtttggacaattgtttaggtcatggatatagatggccataaggcccgcccggcacggcacggcccagacacggcccaccagccatcgggccggcacggcccctcccttatttttggctgttacatatgtatagcttaaacaagtctatttttcgtccctcttctttgggctgacatatatatagctaaattaagtctattttatgtccctattctttcgactatggcatatgatgtctattttactccctattctttgtgtgttggacctggttgccgggccggcccaacgtgctagtggggagtgggggccaggcacggcctagcggtcgggcggggcaggcatggccccgacccccgtcggccggaccggcatgggcccgacccctgtcaggctgtgccgtgcttgggtcgggccaaaacgtcgtgccgtgggccaggccgtcgggtctcggcccttatggccatctatagtcatggaccacgtagacgcaggagactaggttcgtgcttggggactcgtgaaaagcaatgacagtatgctgggactgcttgggtattactacggtttttctttggaataagttcaatttaggtcccttaatttgtcgcttagtctgaaatttgtccccaaaccacaatactccctccgttttaggttacaagactttctagcattattctcacacacacacacacacacacacacacacacatatatatatatatatatatatatatatatatatatatatatatatatatatatatatatattaatgaatctaaacacacatatatatctaaatttattaacatatatatcaatgtgggcaatgctagaaagtcttataatatgaaacggaggaagtaccgaatataatacatcccctaacttacagtaccgtattaattttggtcatttggcagtatagtggccggttttggttgacgtggcgagtgggacccatgtggaccctacatgccagctgccaactcttcttcctcccaacatattctctctccctccctcacttttctccacacacatcacctgctcgagagaatgtctgtgaagaaaaatctccctaaccgctgaaaaatatcttcttcatgtcttacccgtgttcggccgtcacccgcatccttgccagtcgttgcaccgcccgctccatcgccatcatgcacctttccacacagcatcgtgccgcatgaactccgtgtctatcgtcaacttcctctcgttcgcttctccccactgccgcacgagggacgatgatgacgacacccacagcgacgaccgtagcgattgttaacaaccaaatttggtaatatcggcatcgggaaagaagattagatcgaagcaaagtcggaggcggagatcgagttcggaaacagggcaggaatcggctggagtccagatcggctacgattaggatcggctgggtctgagtcgggctaggtaagccgatgcagccgattccgacaatgcaacttgg

SEQ ID NO: 3564 - DNA, 1501 bp, Oryza sativa
aaggtgcaggcttttgcagtgcggtgtacggttctcagaaatgaagacgatcgcagaaactgcacgcgaatgggctgcatcggtcgacggcgagggagaccgtttcacgcgatccgaactcaagtcacgtgtgagtgtgtgattagtggcgtcgagatgagccaacgaaccattgaccatgtttttgtttcttttttctttcttcaaaatcggcgagagagagagagagagtttacagagaacaagcagggaacgagagttcactggaaacaaatagcaaaagaaaatatctctaccatgttactccccctgtcttaaaatataagcatttgtagctataaatctcaacaactgtgttcagattcatagctaaaagttgttatatttggagacggatgtagtaatacataatcattctcctttgcttttcaccctattccactaaaaaccgctaaaaaacggttagaaaaaaccaaccgagagaagaggtatatatgggagaagagaaatttttcaaccatgttcgcccgatccgtccagagataaataatggagaagagagataaaataaaccatcttcatcagatttcatcccgttacaacactactccctttgtcccataaaaatcaacttctagttacgaacctggacgtaacgtgaagttggtttttatagtacggaggaagtatttaccaaatcttgtcatgttgacttgtgtttataaaagggagtacttatttcgaacatatgaagtctacgataattcagtacaaaattattaatttcctaccgtcccatactaagttcaattttggctcatctgccttgtcccaaaataagtttatttttttgttatcattccatcggagttggtgagagtaaaaaaaaacttgcgttgagaatagataaagtggagaatagttatattggaatttaataaagtaaatgtattttagttctttttattttgtattggtagtatatgagatggattaaaaatgaacatattttgagagtgggaatatgaaatttcaggagaactactccattcctaacagggccggaagggttaagacccagcagtactaaaatggcaagttgcttgtgacagttatcagtcgcatctgatggcagtgtagctccggagctgcaaagatcgcctctgaaaacatgcaaccatagggaattggtaattcctgagatattttttggcaacttggatgaaataacaaagatcccagtgcagaatcgtgttagtccggaagcacatgccctggcagctggaatgtttcttccagcgcagccagagagagaatatcacctactcaccacttgtccagagagagagagagagagagagagagagagagagtatattgattaacaagcatattcgtcctggaaaatacgactagtatacagttaaacaactcagcaattaaccaagtagcttactacaaaaatgcaactcgttgacctgccaatccgaagtaaaatgta

SEQ ID NO: 3565 - DNA, 1501 bp, Oryza sativa
tttttaacaactaaaatttaatttataataaaatacagctttgaaagaaggcaccacgttcactgtgggggctagaaatttccacattaatcggagaaaaagaaaaaaaagaaaaggagagtccaagtagaaatacaatctaaaaatagctgaaattcggaattaaaaataagtaatattgaaagaagtttccatataataatccaatacaagattaatcaaaattcgaaataaaaataaaataaaatccaaaattagaaagaaaaaaaagagacccaagtagaaatacaattttaaaatagctgaaattcggaaataaaaataagcaatattgaaagaagtttccatataagaacccaatacgagattaataaaaattcaaaataaaaataaaataaaataaaaattagaaaagaaaaggatagtccaagtaggaatacaattttaaaatagctgaaaatcagaattaaaataaggaatattaaaaaaagagtccatataagaacccaattacgagattaattaaaatttggaataaaaaaaataaaatctgaaattagcaaaaaaaaaagagttcaagtaggaatacaatttaaaattagctgaaatttggaattaaaaataagcaatattcaaataagaatccatataagaatccaatacgagattaattaaaattaagaataaaaaataaaataatattcaaaattagaaaaattaaaagagaattcaagtaggaatacaattttgaaacaactgaaattaaaaataaaaaataaaaatattaaaagaacacaatacgatattaattaaaatttgaaaaaaaaaataaattctgaaattagaaaaagaaaaataagatttcaattaggaatacaatttataaataactaaaacttgtgataaaaataaagactattgaaagaaaagaccatctaaaacacatgacgagataaattaagtaacaggcctttaaaggagtagagtggtggcggttgatacgacatataaaaactgttaataaaacaccaaatagaatcccaatgacgattaaaaggagggacgacaggcaggccgtgaagcaaacgagcaatgcaattaccgggactactagaaagtaaaaaaaaataaaccccattgacaatcatattcaatttttaaaatctcaatgacaataaaaaggagaagtagtgggcggggtgtatagtagtatagtttcagagccgctgatgtttgacgtgatttctagaaaataaaaaatgaattctagcgatagttatgctcaatttttagaatcacaatgataataaagaaagagtaggcggcggacgggctatagaggagcatagtggcatcgtttgacgaggcttctaaaaaattataaaaaatgaaacccaacgagacaataaactctaaaaactacaaggtttaatttttaaaggttccgaactttgaaaaagtaaaaaaacaatgataatcatgttcgattttaaaatctcaa

SEQ ID NO: 3566 - DNA, 1501 bp, Oryza sativa
gcaagcgaccgagtccgcaccgcaggggccacgaattaggcaggcaatcactcgatcggtttttgccgcgggcgcacgtccaccatggcgaagtttaggtaggagtaattggggacttggggggttttggtgttttttgtcatgctctgctgccgaacataataaggtcatcgccaactggggtttgctgccaaacttctgacctgttgatccagtaccggcggtaggattggtagtgatcactgagaggctaagctataccgttggtggtgcagtacgaccaagcacactagtactatcgtgaggcatatatacctttgctacgattacaatggggttttgctacgattacaatggggttgcaaggagaaagtggatttcgaccagatcgtatgtgttttgaggggggaaaagagctaggttttggtcctcgaaactttagcttaaaagaaaaactaaatgaagatataagtatataacattacttaaagataggtatacagcttagctataaagaataatccttttagtttagataactaataaagacgaatatcactatagatgcattttagatctcaggtatatataaacttaccctatgacaacttactattacctttgttttttaataacaccattgacttttcatataacattggtccattcgttttattaaaataaataaatttggtatacacatgtaaaagtataagttaagactatagtttctttgatgataaaataagtcacaacaaaataaatgatatttacatatttcttttttaataagatgaatgatcaaacatcacatcaaaagtgaacggtgccacacattataaaaccataggtaatttgttgcaggttatttttgactcgattagagcgaaaaattctttaaaaagacaaaaatactcctacggtcaaaagcttttgagctaagcctaaagtgaacatggaatacgatgtatgcataatttataaattttcactctaacaccatgtctgaagcatgtggtgggcattttcgtctttctcgaattcatttctctaattgagtcaaaagtgtcatttgtcgttttgtcgtgacatattttttcgatgtctatcagtaaattatataaattttaaatgttatgtagcaaaattcgcaggatacgaaggaccaaacaatgtacatttaggctgggaaggtatatacgcatgactacgtctaatctaaacagcagcattgaaaaattactccgtctagtacattatctactccagtgcctactactactactggtcaataataaataaacctaagccaaaaccagccttaaaaagccttatataattaaaaaaacaggtaaaaaggaagcgagaaagaaatctcgctctcgcctcctcgccaccgttctccgtccatccaccgagtcaccgacaggaggcgcgtctcctccctcctcacctccatctccataaacacagcaggctcacgcacacgcctccgccccgg

SEQ ID NO: 3567 - DNA, 1501 bp, Oryza sativa
ctgccgcgagccgcagccaccgttgcccgcgtgccctcccgccgccgccggcccctgtccctcagccgccgctcgccgaagagaaagaaagagagggaggatgaggagaacatggtttatgtgggccccacatgtcagtgggtcccacccatacttttagtggatgacaaatgggtcccacacatttttttatttctaatgccacctaagcgccacttcaacgctacgtgcaaagaagaccgagtcaataatgccacgtatgcgccacgtcagcgaaaccgccctccaaaaccaccgagggagtcaaattgcaccggttttaagagttgggggttgagatatctggttttatggtttagggtcacggtttagatttcgatcatttttaagggtcacaaagtgaacttattcctttgctgggccaagagaacggctcattgaacacggcccagccaaaggcatcgcacctccgcgtgcgatcgaggccatcggcggcaggtacaatcgaaaagccagcgcgtctcgccctcgccctcgcccagacatctcgtgaccgccccgcccggcgcgcggcgctcgtgcagccagggaaagcgcgcgcgcgcgcggcgcaataatcattgacgcaatcacgcggcgaagcggacgtccggcgcgcgcgggcgcggcggccgctagctggttgggagttgggagtggacggacgacggacacatgcgcgcagcgcgcgaggtggtgatggacttgatgggtatcgtagtagcggaagcttgtggagttgtggacggcgtcgcgcgcggcatatggatggacacggcacctgcatgctcgctcgctgtttagagatcgagattgacacacaacgtggttcacgcgtgcgccatctatatattcatctatccatgaatgatcatagagacgatagtgtggcacattttttttaacgcgcaaaaatattgcacgccaatatattagaagaaaaagagtttttttttatacaacacaatcggccagatagatctatatatatataccgtgggaagaaagaagatgagagtatgacacacaactaaaattttgcagtgaccgattaattttgtactccattaatttacgcaattaattaattaatcaaggttgtaaccacacagatcgatggacacaggagttcttctgattactcgtggccaagaaaactcgagcatctactttagcatctagctcacgagcacgagctaggcgtccaaacacgcagcaatctcggtgacactgcatggccaattgagttagtcattgcccattgttcgatatgatcttaattagccaatggatgctgagagcctgagagtgagagtaatctagggcattcaagcgacctctccctctttcccctcccttctttttccagctcgctccgttcctcgtcgatcatgtcacgggctcatcatccacgccgacgtacgcaatctgatccgcgctcgctcgctttcccgtgcacggc

SEQ ID NO: 3568 - DNA, 1501 bp, Oryza sativa
agccgtcgatatatatcttcctgatacttctgatgatactccttgaaatctttgtgataccttcgatatactcgttaatatacggtgatacttgctggcaagtacactatgatagttgttgatattcgtatgtactatcttaaaataaaccatatgagaaaaaaaagggggatacatagtaggattatatcctgccataatgggtcttaaaaaacataatgagtgacaaaaagataagcgtggtcccctgtttttgctagccgagcacatttttgtgggcctaaagttcacaggccttgttattaacaacaaagttatccaggcttggaataagttcactttgggcccctctatttgtcgcttagtccgattttcgtcccttggtcgcaaaaccgggtacgacaagtcccccaactttcgaaaccgtttaaatgttgtccctcggcagtattgcatctggtttttgctgaggtggcgcctacgtggctaggtctttgtccaatgtgtcaatgtggcggttacgtggcaattagatccgaaaaaataatagtacacgtgggacccacatgttagtcgcacacaacttaaaaaaatggtgggcccatgaggacccagacgtcatcctctctatcctctctctccctgttctatcgctctccagccggcggaacgggatgggcggcggccggagcgggcgacggcggggcggagcggcggcggaggcagagcggggcggagccgaagggcgaagcggggcgggcggctgccgaagcggggtggagcgggggcgagcggatgtcgtcgagccgtcgccatcctcgccgcggcggacaccgtgaacgacgacgtgctcgcgcgcgggtggtcttcaactcgggggtgtccaacccggggaagggaggggggggggagctcctggcgccgtggttggaggacgccgaccgcgcccaacgacgacgagcgcgcggagaaggatgaggcggcggaggctgtggtgttcatcaacggggaggacgatgaggcgacgatctgtccgggttcaggggcctggttcttgatctctcttataggtgacctcaacgacctcaacttgatctgacgatatcatccaaagttgcaaactattttgtttatgatagaccaaattttgcagtgatcgtgttagaaagagataaaaacaatttgaaggaattttgcatttttacctcgaaatataaccaggcctgtgaacgttgtctgctggaagcgcgcaatttgtttggaattcatggcgaaggttagcttctctgcttccaaaatcatttttaacttcaccatcagttattcaaagttcattatttgatccaaaaacatgcaacagcagcgctcagaggggcagagcacacggcggcgatggcaggagcttggcgcttcgacggcgtcggttcttgaccccgtagccgacgacggcgaggagcgcgacggcggtgaggaagacgtagacgtcgtcgtcagcagtagc

SEQ ID NO: 3569 - DNA, 1501 bp, Oryza sativa
tttggaaagagcgaaacgcaagggtgttcgaagggatcgaggcaacgattctccatctttgttccgccatgggggatgaatgggagacttggatagctgcaggtcttgttagccccatgtgtcactctgtagcaactcattctgtgagattttagctttctttttatgtctgtaatggtggtgcattgactcatcgcgctaccttgtacatttcttttcttactcttaatatacattggccggctattctctggcccggcgaaaaaagaaaactcaagtgagaatcatggctttctggagaaggcaaacacacacctcggattgtagtttgtagcatagcataataacctctgcccactggattttggagtagcaacggttgctgtaagtcaccagtgcaacaatgataatgtgcaggagtatttaattctcacactacaatacagctagtgtcattctgataaggtttagttcatccctaatctggataagatctggtaatccagccgtttggagacgcttcaagtcatgctatgatagaccaagaattttccttttgagtggatgtcagtacacttcacagatatttaagaatctcagctcctttccttaattgtgaaaccatcggttgcaagaggagaagcttgacagaagctaaccaacttgtaacttgagattagaggaactaagattggcaatcatcatccaatcaagtagtaaaggatagcaaggcaaaatgtactagtacgtcatatcaatttactgattagtttgttactcgtccaattaatcaggcttcaacacgtgtcagattgctccaattcagtcctatctgaaaggttggaggaggttgttggagactctgagaaagaaatgtatgttgaggccgactgaatactgtttttatgtgaccatgtatgtagtcatgacccattctgcaatttcttagtactccctccgttttaaaatatttggcaccgttgactttttagcacgtgtttaaccattcgtcttattcaaaaaatttaagtaattatttattcttttcatatcatttgattcattgttaaatatactttcatgtacacatatagttttacatatttcacaattttttttaaataagatgaatggtcaaacacgtgctaaaaattcaacggtgtcaaacattttgaaacggagggagtacttggtagtagtagtacagtccaattccaaatatattctgttgtgcatgtttgaattggatagagttaaatatggatatgctgatgcttacagatgaaaacgaatacgttaacaaggacgttgatgtactgttttttttttcaaagaagcaatactctacttacctctgagccataagaatatgtagaggattgatatatgatgagaagacgagatgataaggaaaaaaacaaatactgtactgtatactcctatgtagctacgcctcaaattaagttcctgtgaggcaggcaaatcccatgttgcgatgatg

SEQ ID NO: 3570 - DNA, 1501 bp, Oryza sativa
ctgtttctacattatactataataagagtatatctgaatagtatatctagtgcagtttgctttctgtctccttcgatagtaaactaatttccatgaaaccctctcctgttcttggtttgatcgaaccttcctgtcaacctgcatatgcagaaatcctgtcttttttcagatagctccaatgactaaacaaatcatctcaacaacagtatcacaattcacaagtggtgaacaacattaatgccaggaaaattgaaaaaaaagttttttcccctcaaaaacacaaagttacagcttgattcttcaggcaaattaaatttaaaaaaacaaaacaagaaactaatgtttggtcgcgggctaaacgtgggcattgctggatggatagatcatagatggatctttccgtggtacgttcgtcgttggctggctgcgcggcggctggaaaacggaaaggaggagcaaaggtaggaggagagacgcctgaaaaagatcaaaaaaaaggaggaaaaagaaaaagaaaaaagctcgagctaagctaggcgacgcccatggcgagttggcgaacagcttgcagcgagctttgctttgctttgctttaatccaataatgccggtggtttcagatctcgcagccgcccctccccagagctcagagctctcacgtgtgtacgcgatgatcgtacgcgcgtactcatcacgtacgtgttcacctccatctccatggaaacgcagagagagaggagaagaagagagagaagattcagaaaagaaagtggaaaaggctatggtctggtctggttaggcatgcagtctcctcctttcttcttcctcgtcgatctctccgtcttttctttgtgtttgtggagaaagagagtgccatccatggcggctcgtgtccttctccttccttggtagtagtacacagtgcagtgcagaggtgtgggatattcggtgtagaggaatattctcgtgctagaatgtgattttcctataaatcatagtattaattccatattcccattaatcaccctgcaactgcaagtatgcaatcataagaaaacgggagatgggtaagaattctcaaaggtgtttctgcttgaccagcactgcaaaacggacacttcgtataagcccaatgatcacgcaatgtaccttttagaaaaagtccaccttgactcccttaaatatcggccgaatctaatctacaaccctgaaccgcaaaaccggataggacaactcccaaactattaaaaccggtgcaatttgactccctcgacggatttggagggcggtttcgctgacgtgccacatacgtgacgatattgacctggtcttcttccacgtggcgttgacgtggcggttaggtggcactcgaatttaaaaaatacgtgtgggacccatttgtcattgacaaaaaaaaatgtggggcccacgtgtcaccctctctcttccctccttcctcatccctctcccttctctctctttctctcctcacgccggcgaca

SEQ ID NO: 3571 - DNA, 1265 bp, Oryza sativa
acgcctcccgttgcaagccgcgcgcgcgtgccgtggtggccgaccgcccggtcgccgccgccgtcagtctctgcacgcgcctgtcgccagtgtcgccgctccgctccaaaccgccccgccgtcatcgccgtcgtcatcgcctcagccccgccactcccgcgctagcctccaagggacggaggcagggcctccctcctccctcagccgcgcgcccccgctcacctcctccttttcccgaatcggcaaaggggcaagccccctttctccccctccttttcccctttttcctcctcgccggcgtcatcctccctgtcgccactttggccgcgaccgccgagcgccagctcgcgcccttgaccgcgcaagtcggttcccaaaccgacattgccgcccatttaaaccccagcctcccctttcccttcctcttccattcgcctccgtgccattgccgccgcccccgtgctctgtctcgcctccgccgtccttcgccaggcgccgggagaaccggtgcgttcgaggatgcggaaggggacttcggccgcgccctcttcttcctcttccccggcccgaggccggagagattactcccgcgccgtcggcctctcgtcacagcgccccgtcccgcacggtagtgtctccctccgttcttcctcctcgctccatctcccccccttagttttcggtggtagcacgagtagactccccgtagctagccggcgccgccccaaccgttgccgtcgctcgccgagtgctcgccgccgtcgccgctcgagctccgtagcacccgcacgtcgccagcctcgctcggcgtagctccgtccaatccgacgctagcatcgagttcccgtagccgcatagatgctctcaccgccgggaatcgacccctcgtggcctcgtcgccgtttccctcttccctccccgccggttgtcgccgccgcgattcgccgccgtcaagctccctccggcgaatccgagccgttggctcgtctcccctcgtcctgtgcaaccacccggtgtgctcgctttcgcctgtatcgccgtggttcgctccaccgttcgccgctgtcgtccgccgtccgttccggccggcgtcgtcgtctacctcccgctagcccacgtggcagccacgtaggcgccacgtcggcgccagctcagccgaggacgggacgggccgaccccggtcagcccctcccgtgcgcgcgttccaccgcgagccgtgaggctgcgcgtgggcccgccgcatccgcgttcaccgcgaaccgcgc

SEQ ID NO: 3572 - DNA, 1501 bp, Oryza sativa
tcttgtctttctaccattaaaaaggaagaaatgattgaagcaaatattactagtcaagatcactaatcaaaagaacaaaatgttgatgaatgatcatgcatgtgtatacgtacaaatgtacgtattgatacgtgtatgtatgtataccttagagccgggagggaggacggccttgagggcgaggaagctgtcgttgagcttctcccgccgcttccgctccgagatcatgtgctgcagctggttgccggacggcggcgcctcggccgccgacgccgacgcggcggcggctgccgcctgctggtagtagtactggcggttgtacgtcgccgccacgtgcatcttggtgagcaccgacatggccgtcttgaacatcctctgcccgcaccctcccggcttgggcagcctcctcgggcggaggtgccgcgcgtaccgcctgaacgcgccgccggtcgccggcgtagtagtcgccggcaactctggcgccggcggcggcggcgagaggacggtggtgtattggccgtgctgcggctcgtagggcggcaagggtagtggcaacggcgcctgcgaggagacctccgggtaatggaaccccgccgccgccgcggacggcgccggcggtccgaggaagtgcgtcgtcgccgccgccgagctctcagggctgcacgagacggaggcggagcggaaggaggcggaggaggacgtcggcgaggagtactggaagctgccggcgccggcgtggtggtgcggcgacgaggaagccatgaggaggacgtccaccatggaggcgccgtcgtacaccgccgactcgtcatccatccccatctgcatgctgatctgcatgccgtaataaaacgcgacacctaccaaattaaatcctaaaatttctttgattttatgcattgtttcttgatcgaataaattgcaaatcaagcttgcctggttgaggtggtgctcaatctgcgagccgaccagctgttgctgctgctgaaactctactgggctgcagctgcaaacacgaagtagctaattaactaactgatcagccaaaccactcaagaacagagacgactaatttacagatggtattatcgtcgtcgtcgcgatcaatcgatcgatcgtgtcacggtgatcatcaagatgtttgaacacctacctggcagcgtagccgcacatgaagccgttgttgccggcggtggcgttagcgttggcgtagccatggatccagctgctgcaatcctccatgatctgctcgttaattataccacttcaccaggtcaatcagtttgctcaagctagctcgattggtcgaacgatctatctatctatctatctatatatgtgtaaattaattcgatcagcacagcatattactgcatgaggttgattctgctcatcactagtagtagctagttaagatggagcaggatgctacatgtatgtgtatatatagttagagatgcaagactggtagctaggcagtgagcacatatctgcgtattta

SEQ ID NO: 3573 - DNA, 1501 bp, Oryza sativa
ctcccgagccatggagcgaggcttgtgaaaaataaaaagattttttttgtcttgataatctttgatgatacactattatgtctggtactgagattgactagtgcacgttgggctcccacgatgcctgatttatatatggctcgcaagtaccatgtaccatataagatacatgtatgtatcatacgtgatactcaggtatcaaattatcatacctgatacccgatactaggtatggcacatacgagtaccaggtcagatatatatagataacgggtctgatactcaggaaccggatctggcactagtatcactgtatgaaaattgtttacagcggatgctctccaagcaacagcgtagaagatgatgacatccgacatgcctatgattttcactcgagctgttgtcgtgagatttaaaaacttctaaattctaaattctaaacgtcgaagatgaaattcacacggttttcggttgatgccatggtaaccgtcttgctatgtatgtgtacaccaattttaatacacgaaaatccacacattttcaaccaatccgaatcttcggaaatgcatctaggcaatttaaattcaaattttgaccaaatccttactaaattacgtagaaaatgcttatttttggaagagggcagctaccgtacgagattccgttgcaacgtagcagccacgggataagatctccactaccttgtctccttccctttccctccacaaactctctcacacaggagaagaaaacgagaggcggagatgaagttggccaggaggaaggggtcgtcgtcgtctccggcggccgtggatgacgacggcacggcgtcggcgaggtcggggcggcatcgagggtgatctcgccgcacctccacgacgtcgtcctccgcccgctgcggcgccgcctccgcgcgctgtggcactgcttcttccactggcgctctcgtcgctgccggcgccggggcctctcccctcctccctcgcgctccttgccaaggtcgccgtcgtccttgcccgctgctcccgccgcctccttgccggtgagcgtaggtggctcctcctccgccgctacagaagcagaagaatctggcgatctcggtgtctcggtcactgcaacgccggcggcaacatgctctggaacctctacctcctctccatcctgatacctggtaccttggtatcagtcggtaccaggtacctttggtaccgactgatacctttggtacctggtaccaggctagtacctagtatctggtaccgggtacccgtgatatctagtacctggtggcctggaggaggagagagaggaggaggtagccgcgtggtggagcaggagaaggaggtggcgcgcgaatccggtggtcggcgaggcgaagcgtggaggaggcagcggcgaatccggtggtcggcgaggcggggcagccgatgagaagaccgacgagagcggggagccagagcggcgcggcaagggaggcgagcttgagggcgacccttgccga

SEQ ID NO: 3574 - DNA, 1501 bp, Oryza sativa
aatatatcttataaaaaattatatttttaagttattttggtggcttacaagaaacgatgggatcgatatattccttcgaggggaaaacaaggaacatttcccaatttgccattaatctactctcactcatcacagtcatcatgctagttgatctgcacgctgatccgatccggccggaaatttcgaacttaattagcacgtggattaattagttggcaaaagctaagtacaagtcattgtgtggtcaattgatcgactgatctgttgctccccgcttctgcggctttcattggctataaatacgcagatatgtgctcactgcctagctaccagtcttgcatctctaactatatatacacatacatgtagcatcctgctccatcttaactagctactactagtgatgagcagaatcaacctcatgcagtaatatgctgtgctgatcgaattaatttacacatatatagatagatagatagatagatcgttcgaccaatcgagctagcttgagcaaactgattgacctggtgaagtggtataattaacgagcagatcatggaggattgcagcagctggatccatggctacgccaacgctaacgccaccgccggcaacaacggcttcatgtgcggctacgctgccaggtaggtgttcaaacatcttgatgatcaccgtgacacgatcgatcgattgatcgcgacgacgacgataataccatctgtaaattagtcgtctctgttcttgagtggtttggctgatcagttagttaattagctacttcgtgtttgcagctgcagcccagtagagtttcagcagcagcaacagctggtcggctcgcagattgagcaccacctcaaccaggcaagcttgatttgcaatttattcgatcaagaaacaatgcataaaatcaaagaaattttaggatttaatttggtaggtgtcgcgttttattacggcatgcagatcagcatgcagatggggatggatgacgagtcggcggtgtacgacggcgcctccatggtggacgtcctcctcatggcttcctcgtcgccgcaccaccacgccggcgccggcagcttccagtactcctcgccgacgtcctcctccgcctccttccgctccgcctccgtctcgtgcagccctgagagctcggcggcggcgacgacgcacttcctcggaccgccggcgccgtccgcggcggcggcggggttccattacccggaggtctcctcgcaggcgccgttgccactacccttgccgccctacgagccgcagcacggccaatacaccaccgtcctctcgccgccgccgccggcgccagagttgccggcgactactacgccggcgaccggcggcgcgttcaggcggtacgcgcggcacctccgcccgaggaggctgcccaagccgggagggtgcgggcagaggatgttcaagacggccatgtcggtgctcaccaagatgcacgtggcggcgacgtacaaccgccagtactactaccagc

SEQ ID NO: 3575 - DNA, 1501 bp, Oryza sativa
gaacccgtcggaggagatgaggatcaccaccggcttctcgagcttcacctgcgcccgcgcggcggccgcaggcgccggcgcggcggagaggggcgtgcgggggaggatgaggaggaggtaggaggtcgcgacggcgagcgcggcggtgaggaggaggtggaggcgggaggaggcggaggaacgccggggcgcgggggcggcgccggcggtggtggtggtggtgcgggggagaaaacaacccggtcgggggcggcgagtcgccggcggcgaagggcggagcagcagccgccgccgccgccattggagtcggttctagtcgagagttgggagtttggaatcgtgtggatctgtgcgtgtgactgtgtgatcgtgtactagacgtgtgtacgtacaccgtatatacgcaggcaagaacacgttttgttttactcgtgtacctaccaccagtagcgtgggcttggagtatgggctatgtgttggcccaagatcagtcgcatctattttcttgtgggctcaaagcccataggatagcgacatgccgacataaaggttggtttttttggttggaaattggaggaacacgtcaaatatagttcagaaattggtgatactcgtagatactcgtcacatatatcaactatataatatcttattatcaatacagcactgatatgcgtacgacggattcgtacgacccgcgtccgaccataccatgtgcatcaatcaccatctttggcttctctccagcgaaccaatgcaagccgcaatcggatgcatgtcgtacaaatccgtcggacgcatagctatttccttatcaataccatacctaaataatattagttgatacctagggtatcaggtcgaagctgaaaagaggaggaagaagagatggggatggttatatgcgctgattctcccacccggagatgatgataatgagcttgagcaatgtcggtattggcgttccttcgtcctcccttagcgcaatggttgtggcttccctcgtcctcccaccgtgagtacttctggatcttgcgacgttgttgagtgcattacgcataagacgacatagaatcaatgccgtgaattgtctgctgctagctagctagtgataagcggtggcatggacgagagtaagttgacaaagaagctgcgaagggaggacaagaagaccgagatattggagctagaagcgcaaactggggacacgacgtaggtggcggcgtttgctgcagcaactttatggtacctagcaacggtaaggatggcgccatcttgttcggacggtcatatctatctctgttgtagctttctcctctttcaactttattctttattaacattctagttactagctctacgtgcatgcacatacaactttggcgtaatgtgagtatagtggttacatggacaatctcgcgacaaatggagtgaactatctgcatatccgagagatgggatagtaaccgattttataggaacgaaatagagtacaaagaca

SEQ ID NO: 3576 - DNA, 1501 bp, Oryza sativa
ttacatcggatattatatagggctgggtgtcgcatgtggtgttcgggcactaataaaaaaaccaattacagaatctgttagtaaaccgcgagatgaatttattaagcctaattaattcgtcattagcaatgtttactgtagcactacattgtcaaatcatggagcaattaggcttaaaagattcgtctcgcaaattagtcgtaatctatgcaattagttattttttagcctatatttaatacttcatgcaggtgttcaaacgttcgatgtgatatggtgtaaaattttggggtggatctaaacaccccctaaacatattatggtacgccatgaacacacctcttgccctatgcctcatgcccattaccatataggctgtttcatttccttgtgttgggaactaattaatctcctccacatggaataaaacgagatctcttattagcgcattattagttaataaaatttgctaaaaaaacttgaaaagggaaattaatatgatttttaaaacagcttttctagagaaacaatttatgaaaaacacgatgtttaactgtttgtgaaacgtgcgtgcagaaaatatagtgaagttggaaaagttgtgcaaagaagagtttttaagtagctacatctgcttcaagagagtctcccacttctccaaactaccaaaattgttagacttttactgcacacacctcgcaacttgtttctcagactctaccgctcttccaaatgtcctatatatgaaatgcaacatttccaattttagatacatatatgacatcgttggttttcttaatttggctttttatagataattgtgcaaatacacttgaggtacaagtcacgtttaaattaattatgatgatctattagtaattttattcaatttatttatttatttgaataatatcattggccaaaatttagagaaaaaccaatggtgccatatatatttaaaatagttggttgagctcaccaaagttggagaagaagatatcaatccgagatggacaacaaatctgtataatcctaagatcatgaaattcaatatttcttaaaaaaatattatttggtcgatgattaaaaagatacaattccctctccatttcatattataagtcacttatttaagtttgaccaaattttataaaaatgtatattagcacttttaacacaaaccaaacatattatcaaaatatattcaatactactagataaaactaatttaatgctctagatatttctaaatttttctataaactcatccgaacttgaaaagaatcccagggactaatttgtatggccgatgaatggaagggacctggctaaaaaagaatccccaagaaaagcaggcccacaaccgcaaggcggcccaacaccagaaaaaattcaccgcattcttctgctccactgagcactccccctggccacatgcatctcgccgccgccgaccacccccaccgcggcggcggcggccgcgccgccctcggcctcggcc

SEQ ID NO: 3577 - DNA, 1501 bp, Oryza sativa
ccaatattcgaccagttccgtatgtataataaggctctacgtatcgtcttttctgtttttcctcggtccatctaggagatgtgccaaagtgcacatatgtcgagtcctggaaacagcaggagatatggggacgtcgtgactgaatcgcgcaacgcgtgcacttgaactcacaacgcacactgattaggagtggaaacaaagacacacagcaccgaaacaatcgggccagggccgatggatgaaaaatcagtatggactcgagcaaggtaccaaaatattagataaaaaaatatttttaatgtttataatagtgaagattagttatcgcaggcactgcacttcagggtgaacgagaagctataggtaatggcacactatgcagcatagacgtgcaatctctctataccactcatcctcttatgggattctctatggccggatcgattgcatggtagggatgcaagggctaacgacgactattgcatccgtctcaaaaaggatgtgtttctactatttaaaatttatcctaaaaatattatacctagaacctaataactaattaatttgagaaagctaattaggtgaactaattggctgaacatacctagcgttctatgcgggggatgtgaaatttctttatcttccattttaagtttactggttcacttatatatttgtccttgtaaaattaacgggttgtttgtctaatgctctttcatctcaatgtgttaatagtatagggtttatatgctgaatttgtctcaacttttttaatttatttttggatgtgtggtctagctagtttggactgaatataaaaaaaaatggagaaggaaggaatcaaacctagggtggctatactaaccgtgctgctagccattaggcccaagttagttttttttttgactaaattttgtcgagtggtaaattcttttgagaatttttcatgaatggttttcgaatacataataggatatccctcgagggttcaaatgtgttaccggccgaactgcctgcatacaactcccttgtggagtacaaattaatggccgcccagaattctggattccggtagtgtatgtatatatgtgacctattatattcccacttgtattaattcttttacgtgtttaattatatcgactttaattacctctcacaaaccatggtatgcatgcaacaccatgtaatctagattctagaaggatatatatcacccttaattagcctttaaaaagactctcccctaatctccaaaacgacaaaccaaaccaaaccaaatctttcagtccttgtcacacagatctcagagagcctcaagtctcggtcaccacagctctactgtctatctagctatctatcagctgccttccatcgtcagcacacaaactacacaagaatctgcttatttataggccaccttgtcccttctacaatggtgcaagaacacacaaattcacacacacactgacacacacaaaccgatcgattgattgattga

SEQ ID NO: 3578 - DNA, 1501 bp, Oryza sativa
caagcgaaatgcatatgtaactgcaaaactaaaggggaaacaccatcataataacctgaaccaacgaaggcaaaaccagcaaaatcccaaaaccacgacctcaaccttaaggatggtaaatcaagaacgtgaacgactcatcgacaagcatgaaaaccgaaaaactcggaaggattctcctccaaaatgagaccagaaactgaaagcgcaaacagaaaaatggactgaaaatacaaaagcaaaagagaaatccccttacatagtgtatgaccttgtgattacgagcaagcgcgtgactaccagacgaaacattccccaaatattgtgttactgtatgcgctttgcaatgaaaaaaaaaagaaagaacaagaaaaaaaaacacacacacacacaaccagaggaagcagaacgaagagctatccttccactgcatccagtgccactaaacagcaaaaaaaaaaaacgtgtttttccctcacaaattggtgcaagcaaccctagttaacgagaatggcatcgcaacccaactccagaaaagaaagaaagaaagaaaccgaaaatgtcacgcggcgaactaaaagaaagccctgaccttcccgggaagggccggagatgaacgcgggggcgctgagggcggtggggacgccccgcgcgtcgcgcctcgtgatcgcggcctcccgcttcgccaggtacttgatgaagccggggagcgtccgcacccgccgcgactccgcgaccgcgcgcagcacccgcgccgccccggcctcgccgagcaccgcgaggtggcgccgcgcctccgcgccggcgagctgccgcagcctcccctccagccgctccagctccgcggccaccgccgccgggagctcggccggctcccgcgcctccgcggagccgatggggttgtacatgacgagggttcgggggcttctagcccggcccccccgcgcctctcggcggcggcggcgaggagagccgaggaggaggaggaggcgatcacgttggcgttcgcgttggggcgcgcgatggagggaggaggttgggaaatttgggaggaagacgcgcggaggtgttgaaatggcggtgggtgttccacatggcagtgggaggtggattgtcgattgtgggccatgcggggtgtggggcggggcccaaggaggagtaattcgggtagcttgctcggcaccctacccttcctctgtgcttgactgcggctgtggttgacacggtgcttgtgtgttgtgctgcggtagaatcggtacggggggattgaggattcggattccatttccactgtgtcatacatcgactcatcgaatttaatgttgtgtttagttccgtgtaaagtttggattttggttataattcgagttaatgtagctgaaaagttgtgtgtatgatatgttgatgtgatgaaaaatgcctgaagtttggatctaaactttggatctaaacatagcctaaggtggtgtttggatccgaactttggatctaaacaaagcct

SEQ ID NO: 3579 - DNA, 1501 bp, Oryza sativa
tgataaacctatagtgccaccggaacatacttcatatactaactagtttgcccgtgtattgtcatggaaaagggatgaattagggagcacaaaaattttatcgatattgaggggctcaaatgttagtgataaaggatagtggtggtatattgttaattttaaagtagtatagatatgcataagatatgcaacatcatttatatcttttgtgtaaacttgaaggtactcccagtaatttctaacattattaatttccagttacctatcttgtcttgcacacatagagtaaacctaaggggttccaaaggttaattaaggtctagattatgtgatggagtttgttgagaggtggatgttgcactcacctccactagctggtacactattaactatgcattaaggcccactaaatctagtcatagcacgtgaaccactcctgatccctatgacatcctgtgctcccctacatctggtaaacagtatccatgtccttgcttaacgtctctctcccctccttaattataattatttctttcttgttttaattagcttatcttgtgttctagtataaaactaagttattatatatatatatatatatatatatatatatatatatatatatatatatatatatatatatatatataaaacaatgtaaaacacaaccgctcatataaacatgcatatatcctacttctataaacacctccaaagactagaccgatctatatatcttgagattcacagaattatcacggatgtgttactgtcgatgaatatgttttataccattaaatgaataaggaattatatgtgctagcacaaccttataaaaacctcagtcgaccactcaatctattagcttgcctattcttttttttttcatttagatggatagtaacataatgttttaacttaaaccttaataatgaaatttcttgcacaattttagttcatataaaaagatatgcttttggctttgtcttatgttatgattatctgacaaagccatcggtagttaaatcgtcgtagcgctgtcgttattatagttatgcgccgaaactgttgagagataaaccatatttataataactgaaacataatccgtatttcgtagacaagattacatctagaagaaaggtgaagaaaaaaagccagttgcttggatgcatttaggacaaaaaggagaaaaatccgtggaaaacatacaaattaactcaagaaatggccaaattaaagtttgggaaagaaaaaaacaaccctcctccaagcttttttgcgacttataagaaaaaaaatggagggggcataaaataggcgagggaggtggggcccacacataaatagcaaccaaccgctgctaaataaagccaactcgcgtctcctcttcccttcgcttcgctcctcttcgcgaacccaaaaaaagaaaaaagaaatccatttttttcccattatttttttctctttttctttttattttttcgttctcgtcgccgcc

SEQ ID NO: 3580 - DNA, 1501 bp, Oryza sativa
tcatttaatggtataaaacatattcatcgacagtaacacatccgtgataattctgtgaatctcaagatatatagatcggtctagtctttggaggtgtttatagaagtaggatatatgcatgtttatatgagcggttgtgttttacattgttttatatatatatatatatatatatatatatatatatatatatatatatatatatatatatatatatataataacttagttttatactagaacacaagataagctaattaaaacaagaaagaaataattataattaaggaggggagagagacgttaagcaaggacatggatactgtttaccagatgtaggggagcacaggatgtcatagggatcaggagtggttcacgtgctatgactagatttagtgggccttaatgcatagttaatagtgtaccagctagtggaggtgagtgcaacatccacctctcaacaaactccatcacataatctagaccttaattaacctttggaaccccttaggtttactctatgtgtgcaagacaagataggtaactggaaattaataatgttagaaattactgggagtaccttcaagtttacacaaaagatataaatgatgttgcatatcttatgcatatctatactactttaaaattaacaatataccaccactatcctttatcactaacatttgagcccctcaatatcgataaaatttttgtgctccctaattcatcccttttccatgacaatacacgggcaaactagttagtatatgaagtatgttccggtggcactataggtttatcaaaatatgccagcttttggctatgaaggtatttgacatgatttacaactaaaaattattatattttgggacgagacgacatgtgtttaggtgtattggcaggcatgccgtgtgtgaatgtattgatgacatcgtgagagagaagaagaaaaagtaactcttgggagaagattgctaaaccataccagtgtaaaaccgtgtatttttagcttcaaatccaagagcacggacagataacaagtgatgtaaaagttgatcaaggttgtgcatacacttataaaaagcacatgagctgcacatgatgacatgaacatatatatgcatagaaaatttcacaactcatgctagctccataattcttgcttaggtactatctccttttgtcccttctgttggacatttccacttcaatttggaaggtctataaaaaaaatgatgcaaatgtttatagcaatgccatgaattttactcagattatatatatacacaacaaattgaccatggatgccattctttttagaaccgttccaaaattaaagggacatatacaggaaagtcggagtcatggatgcatggattgatacaaatgagaaataataaacccatattcttagaatcttaatagcattttcaggtatagttatttttcctagaaatccaaatattaacttttgaagggccctagtacagaaattgctata

SEQ ID NO: 3581 - DNA, 1501 bp, Oryza sativa
ttgcatgcatcgaccaattcaaccaaaaagattaagctgatagagaaatgtgagcaattcactttatattccaacatccctcctcacgtgagaccccctcaaacatctagcttagaataaatgcgaacaattcactttatatttcaacacactccttcacgcctcctttgcatgaggccccctcaagcctatttaagctgatggagaagggtgggcaattcactttatattccaacactccccgcctcacgagaggccctctctaacctctaacgtggaatagaggtgggcaattcactttatattccaacactctccattacgcgaggctcccctcaagcctcgaacgtggaatagaaatgggctgtagtttttatttaattacgtaccaatcagaatttaaactcaagactcggccagtaagatagcagtgatgtagtggtgaggagtatgctagagatgaagatgccaaaaggggtccaaagtgaatcaaaatggcaacaaaagggagtccaaagtgaaaattttgatgaaagagatccaaaataacactacggtaatacaaaaaaggctcaaagtaaagtttactccgatgtttatgtgttatatcgactgtacaattaatacaaaccgtccgattctgatccaacagtagagaagatcctaaatttatattgcgatcaatggtatcgaactatcgatcttattgaggacttggtggaaatggtagagatattgataaggatctttctgcaaaatacagcgaaggctttgatcggacggctgaggagagacgcagctctggtcgcggacctcgtctggttctccgccgccgcggcggccgccggcgattactccgccgcctttgcccgagctcgctgcggccacggtctgcgcagtggagggggaggaggaaggggacgagagcggctggaggctaggccgaagcgggggtaatgcgggtgagtcgattaatctgagtttttttttttggcaattatatggaggggtatggattccccaatccttgtcgtttctgttcgagccgtatgattttgatgcgatttctagcttagctgtacgtttcgtgagggccaaaccctctcgtggatttgataggggtttcttcatgattgttatcttcttcctccacattttagtgcagtagcagttgcagttcatgaatcgtgcgattggatgccttgccactgcctcctaatgctgatagatccattcttttattgtgaattctggtactgtataaaatttataaatcttggtcggcttcgagctagctaaaccaaaaaaaattagataagaaagaaatgttgggctattctgttagaatttattcattcatttatttttgtttggggaaatgaaatgttgggctctgatgaatcccctaatgatttttatcaaaatcattaagttaaggtagatacacatcttgtcatatgatcaaatggtttcgccaaaaatcaataatcagacaacaaaa

SEQ ID NO: 3582 - DNA, 1501 bp, Oryza sativa
gttttagagttggacgcagtattatattaagaaaataggtagaactaaatgatggaggattgtgattggttgaaaagtgaaggtaggtgataaaattgaatgatggagggttgttattggttgataagggaatgttgatggagaatttgttgtatttaatttgggacaaattttaaaggctaaaaattattatattttagaatggatggaggatatatttatcagacggatattaattggtcgttcctctcttaaaaataaaatagaatgggacagattgatgaagaattttcaatacaagatcgcaaggctaaagttaattaatcttccgcaactgttggcgtgattcttctcgatctcctgaaaaagccaatcgagagataactgcatgtgtgcacttaaatacctaatcaccatgatccccatcgatccgggcacaatgtttggtcaaaatcagcaaataaattttctacacaaactaaatttattggcttgtccctctgcatatggctatttagctgatttcttaaatggaaatgatgacgactaaggtgctgcgtggccactgtgattcacttccgaatctcctgagattacatggatcgtgcggccatgtagctacagctttgagaacatgtgtgatcactgttttgatcagctgtaaatgaccaaattagcaagctaataatatatcatcatcaactgattgtacttgataaaatgtacttgggcatgatgtaacaaagaaaatagcaactttttttttaagagcaagcaatcttaatttgcttccaagataaacacatcaagtgtccaaaacctccacaaacaatatatctacatcaggagctttatatctaggttgagcgttttttttttttgcatgaaaaatgggtaaaaagtttggctgccaaatgctctgcaggattttagggcttccgtttgttaacatccctgaagataatatatggagtataaatatacaattaaacttatattagtgcataaagaaaggcttttttctagctagatacatgtacatgtatgcatgatttatggacactttggcataaaaaaatagttgtatatgtgtgtacatctcatctcaatcagttgcaacaaggtttcttcagagtccaaacattcagttacatacatatacatccctaattaattaaatattccagctatgtttaatttgtccatcaaataaactaagttgtcaagtcacaaagcattatcagatgatcatcagttatccttccatttttggctataaaaatgggcatcgttgcttcccatttctaggcgtgtgcttcacacactctctctccctcttcttccaaagctccaagctcgatcgatctcgccatggcgatgcagatgaactcggtagtgcacgtgtccacctcgccgtcgccgtcgccggcgacgtctcctcctccagaaggtaagcaagaacacggcgaggtggcggccgtccatgtcgtcggcgtcggcg

SEQ ID NO: 3583 - DNA, 1501 bp, Oryza sativa
gacatgtatttgagaatttaatggacggaatgattgatgtacgttaattttatgttgaattcctgattggtactttagttaattccagactagtatagtttaaagccatatatttgacacgcgataaatttcttttattaaagggaaaagtccattttataccctctaacttttgtgcttgtctaaaatacacccctgaattacaaaactggaaataatacaccctacaactattaaaaccagacactttaaccccttaatatgtttttatggtggttttggtatgcgtggatgtcagctgtataaatgctccacgtcatcagtggttatatgggccaaagccctttcggggtttgccgtgaagtgcagcggccagcagccgcgcgcgtggcttgccggagccggcggcggcgttagctggcagaggcggtggcacggaggaggatcagctacgtactgaattgttgggttgttcttggattaattctcgattttagcttcatgtctatgagcacgatttgatcaacccaagctgaccaggttcctcttgacaaagttggcaactttagtcaaaaaaaaaagttgccaaggtaaaacaacaaaccaatgtgctgccaccattgctgccatcacggtgatccggtcgggatttctagtagagatgccgccggtgctcctccttggcaacgagacaggccatgccaaccctctgcctcactgcatcaatggagctctggtcgacggcatggccggtggcggcggtgacatagaacacaccggagattatgtcgcccttgattgacagtcgcacgccggtggaacaagcagatcgagaaagatgactggctaaggaacaaccagaacgagatggaaatagcggctggtgagcctcccgctgcgtcgtctacctaacgcgaagcccacccccaagccgagcttgaagaagatggcgttggcgccgagcccgcccctttgcccaaggagaagaggtgatcggcaatgagctcaacagagaccgctcccttcgccaagctcaggagaatacaggcggcggcgtgcttgctctccttggctaagctcagggaagcataccagagctctaagcctccgacgagttctcccggagggagaggaaggaagaagatgggccagtcctcctcctccccctcgaccacggtgtagagcctcgcccccgccgaagagagagacatctggctttggcctataaccgctgacgtagatcatttatacacctagcatatacgtgtaccaaaaccaccataaaaacaactcaaggggttaaagtgtctggttttaatagttagaggggtattatatccgattttgtaattcgggagtgtattttagacaaacacaaaatttggagggtgtaaaatagacttttccctttattaaatttcgcgtaaattgagttgattcgatttcaaataatttttttctaaaaaaatgatctacgtggcattctaaaaataccccgtgt

SEQ ID NO: 3584 - DNA, 964 bp, Oryza sativa
atgattattcattcgcaaacgttaacctttggtttgtagaaaaaataaattacaaataactaaaagcatttcatgcataatattatcgaagcatactaacatatataagtatgaaattaattaactttcgctcattcagaaaagaagaaggtagtagtcaatgccaccagctaatagaaaatggaggaaacatgaattaaatcatgttcaagaaatcgatggcacccatagctagaaaacacacaagaaatgtaagatttaaaaacgccaatggaaaaaaaatgccatgacaaaagttaggcatgccattaagcaagtgtagtttggttcatcgcaactgtggttttaccacacttttgcctactacatgtaatgtgaaggatgaaacaaaacacgatattatatactgcaagataattacgtccaatttaagaataattttgaaacacaaaaaacaaattttaggtgtttctcctgaatggaacacgtgtacggcaggcaaatttgaagtcgtctatatccattgacacgtaacgtagtcaacttcaatataaattaactggtatatatacacactttaattaaagtataaattatcgtacccatacaaatcaggtttctgtatgtctttatgtagacgtgggcaatgacaataacaggaaatggatcattctacgcagcgagaaatataccatccatccatgcatggttacacgcatatattgtgttgttccatttaaaattaattagggcatgtttagatccatttggaatgacaaaagttttggtgacaaaagttttggcattgtaaaagtactagttggtgtttagatgcatgttaaagttttaccattctagcactaaagtgagagagaaagagagtgggagtggtcccaaagcactttttggcacaatttgctactatggactagcaaatgccaaattgccaacttttgctactagt

SEQ ID NO: 3585 - DNA, 1501 bp, Oryza sativa
gtaatggcatatatacatgtgagtgtgctcagccatatacacatgcttggttaatatatacgtctgcatgttatcgggcggcaaaccaacaagaagctagctaggctatagctggtcgtctccatgcatgcatatatatgctcgtacgaagacgcatgtacatgcggccatctgtacccggtgtatatgcgtatgagctacgacgtcaagtgctaccgcgacgtcggcgaagacgacgagggtcaccgcgcccgcgccgaccaccgtccacgacgccgatggcacgccgagcgtggacacgctcctgctgcagctgcgcgagctgggcgtccgggagggccatgggatcaggccggcgacgctgccgccgccaccactgtcgcggcgtcagctggcacttcgagccacctatgcacggccactgcgacgcctggccgatgccgccgaacggccgcgccgtgtagcctcgcccatggcgacgacgacggcggccacggcgcgcggctgctccgcccgtagcctccgctccgccgccgggctcgcccgccgtccgctccgcccacagcccgccaccgctctgctgccgcgctcggccatcgcgactgcgcccgccgccagcctgaaggagaagagagaggagagaagagaaaagagaagaaagggagaagaaaagagaagaaaaaatatgtgcagctgacatgtgggccccacgtaccttttattttttttttgctgagtaggatgccacgtcagcaaaactgggcaaaaatactgccgagggacctccggtgaacggtttgagtaagtttaggggtagacatttctggttttgtggttaagggacctcaaaaaatctcgctgttaagttcctccggtgaacttattcctagtttgccaccgctcgctgggattgctcttcttggattattattattgggccttgagtttttgtacagacgggctgctctccgacggcccacctggttatcaatcagtacggccgggccaaccaatgtgcttcccgacggcgacggctgcgaagaggataagcaaagcagcaagagtgagctgctgctgctcagctcggcgatgagatgatgccaccaccagttcaaaccctacgcctcctcctcctcacccctttcccgccacctcctcgcctccgcttccaccgccttacggccacagggaggtccgacaatgccgccgcggcgtccggcaccacggcgagggagcgccgcctcgccaaggtgcgggaggagcgccgccgccgtcagcacgagctcgacaacacctatcccggctgggcaaggcactgtccttttaccctctacatactctgctcctggatctggattcgcctcccttccctgctcactcaaatccatcttctgcatcatcatcaccatcatccatacagatagatacagtagatttgtgggctggtgctaatgctgcctgctgtgcaaatgcagggttctggagaatgcctgcagggacg

SEQ ID NO: 3586 - DNA, 1501 bp, Oryza sativa
tcatagccaaaagctggcatattttgataaacctatagtgccaccggaacatacttcatatactagctagtttgcccgtgtattgtcatggaaaagggatgaattagggagcacaaaaattttatcgatattgaggggctcaaatgttagtgataaaggatagtggtggtatattgttaattttaaagtagtatagatatgcataagatatgcaacatcatttatatcttttgtgtaaacttgaaggtactcccactaatttctaacattattaatttccagttagctatcttgtcttgcaaacatagagtaaacctaaggggttccaaaggttaattaaggtctagattatgtgatggagtttgttgagaggtggatgttgcactcacctccactagctggtacactattaactatgcattaaggcccactaaatctagtcatagcacgtgaaccactcctgatccctatgacatcctgtgctcccctacatctggtaaacagtatccatgtccttgcttaacgtctctctcccctccttaattataattatttctttcttgttttaattagcttatcttgtgttctagtataaaactaagttattatatatatatatatatatatatatatatatatatatatatataaaacaatgtaaaacacaaccgctcatataaacatgcatatatcctacttctataaacacctccaaagactagaccgatctatatatcttgagattcacagaattatcacggatgtgttactgtcgatgaatatgttttataccattaaatgaataaggaattatatgtgctagcacaaccttataaaaacctcagtcgaccactcaatctattagcttgcctattcttttttttttcatttagatggatagtaacataatgttttaacttaaaccttaataatgaaatttcttgcacaattttagttcatataaaaagatatgcttttggctttgtcttatgttatgattatctgacaaagccatcggtagttaaatcgtcgtagcgctgtcgttattatagttatgcgccgaaactgttgagagataaaccatatttataataactgaaacataatccgtatttcgtagacaagattacatctagaagaaaggtgaagaaaaaaagccagttgcttggatgcatttaggacaaaaaggagaaaaatccgtggaaaacatacaaattaactcaagaaatggccaaattaaagtttgggaaagaaaaaaacaaccctcctccaagcttttttgcgacttataagaaaaaaaatggagggggcataaaataggcgagggaggtggggcccacacataaatagcaaccaaccgctgctaaataaagccaactcgcgtctcctcttcccttcgcttcgctcctcttcgcgaacccaaaaaaagaaaaaagaaatccatttttttcccattatttttttctctttttctttttattttttcgttctcgtcgccgcc

SEQ ID NO: 3587 - DNA, 1501 bp, Oryza sativa
gtgctagcacatataattccttattcatttaatggtataaaacatattcatcgacagtaacacatccgtgataattctgtgaatctcaagatatatagatcggtctagtctttggaggtgtttatagaagtaggatatatgcatgtttatatgagcggttgtgttttacattgttttatatatatatatatatatatatatatatatatatatatatataataacttagttttatactagaacacaagataagctaattaaaacaagaaagaaataattataattaaggaggggagagagacgttaagcaaggacatggatactgtttaccagatgtaggggagcacaggatgtcatagggatcaggagtggttcacgtgctatgactagatttagtgggccttaatgcatagttaatagtgtaccagctagtggaggtgagtgcaacatccacctctcaacaaactccatcacataatctagaccttaattaacctttggaaccccttaggtttactctatgtttgcaagacaagatagctaactggaaattaataatgttagaaattagtgggagtaccttcaagtttacacaaaagatataaatgatgttgcatatcttatgcatatctatactactttaaaattaacaatataccaccactatcctttatcactaacatttgagcccctcaatatcgataaaatttttgtgctccctaattcatcccttttccatgacaatacacgggcaaactagctagtatatgaagtatgttccggtggcactataggtttatcaaaatatgccagcttttggctatgaaggtatttgacatgatttacaactaaaaattattatattttgggacgagacgacatgtgtttaggtgtattggcaggcatgccgtgtgtgaatgtattgatgacatcgtgagagagaagaagaaaaagtaactcttgggagaagattgctaaaccataccagtgtaaaaccgtgtattcttagcttcaaatccaagagcacggacagataacaagtgatgtaaaagttgatcaaggttgtgcatacacttataaaaagcacatgagctgcacatgatgacatgaacatatatatgcatagaaaatttcacaactcatgctagctccataattcttgcttaggtactatctccttttgtcccttctgttggacatttccacttcaatttggaaggtctataaaaaaaatgatgcaaatgtttatagcaatgccatgaattttactcagattatatatatacacaacaaattgaccatggatgccattctttttagaaccgttccaaaattaaagggacatatacaggaaagtcggagtcatggatgcatggattgatacaaatgagaaataataaacccatattcttagaatcttaatagcattttcaggtatagttatttttcctagaaatccaaatattaacttttgaagggccctagtacagaaattgctata

SEQ ID NO: 3588 - DNA, 1501 bp, Oryza sativa
ttacaagtacaaaggaagaatagttttgatcgatgtgacagtggtttccactagaatgaacttcaattaaaagttggcatctgcatggagtgaactgaagaaaaaccagttcaaacgaaactgtaaaaaacatgtcccaaggtgcttctggtccggttttgtatttttcacccaaaccgtctatagttcagggtgaaaaatagatcgagtaaagatcaataattaaaaatgaactttacacccataaaaactaatgaggtgtcccttgtttgctctatggcttgataaggtatggaaaagagaaaacaagagtagaacttagtgatttgaaagccgatgccaaaaaaaaaaaaacccctcaaaatcaactctaaaattaagtttgaaaattcaaattttggctatggttgataaactaaaaacaaccaaatggtgaagtactaatgtttttaaaaactattttattgtgtttataattttgtaatatttcatatattaacaaatctacaaaactccatgagtataattgattattattttaaaataaaatggcgtgttaggttttcactttacatggttttacatgttgcgtaagttacttgcgagaaagtgtttgaggttagataaatatctattattaaaaggaaaaaccttttaggttatcttttaaaagacgatgaagtgccgtatatgatgaaaacactcctgtcattagtatttctagcaataaaataaaaaccgtacaacaatataactctagcttcaccaataaccataaatcttcatcgaatgcccttgcattgagggtaacatatcatatgaccagttcacttgagagaaataaatacttaggtgcaatgtattgagaatttagctagttcgtaccaatatacaaacacatggcggcttctatatccgtgattgttaacactattatattgttatatagcactgccatacaacaatatatgagcaagttcatatcgcccttagatcattgtgattggctggattacatggacccgtacaaaagtgcattggttcgcccctagtgttatacagttacaactacaccatcgtagcacgtgtaaaacatcacacgatataaaagttcacgtggaaaaaaacaggagacgccagtttaaaaacaactaatatttcactgctgcaacagttactaaaaacccatcaataatgaaaccaaaccttaggtggactagagtgattaacttaatttggaagtaaataaaggctcctccaaaacttccttttttttcttttacattcctccatgtaaaaatggtttctctttcctctacacccttttgctcttccattcttttgcccttcactcctctctcatcttttcaccctttttccacattttttttcacttcaaaaccccacacaactgacacaagagagagagaaccaaaccaaaaacccctcctttttcttccttctcctgcagcgagagagaggatggcggcggcggcggcgg

SEQ ID NO: 3589 - DNA, 1501 bp, Oryza sativa
ttgaataaaacaaatggttaaacgttggtcgaaaaatcaatggtgtcagggagtaatttagagtagctatatgtgtgtgtacgattcacttgcacagacacaattattacagtatttttctaggcacacatgaaagatgccgaatgcaaggatcgatagatgagacgtggttgaatgctcgtacgatatggtcgtatgtatatcgtagtactctaaatttaaccaagtgcgtgttttagttcacgtcaaaattagaacgatacgatagatagaaaagttgaaagtttgtgtgtgtagaaaattttaatgggataaaaaagttaaaagcttgaagaaaaaatttgaaactaaactcggcctaagctaatgcaaggcagtgaagcctaccctagctgtgatttatcaggtgtataatcaaggagatatttaaccatttactatatttagatgtggcaattaacttttttatcactgggcccacatgtcatagacatatgtggacccatatgtcattgagatagggatggtaaatagttatttgtcaaatctaaaagtgtcaaatagttaaaagccccataatcaagtgatccttggctgtagcttgtactgcgtgcacgtacgttgccaatcataattattttgctagctccatctcatcgatcaccagcttcgccagctgggttattatttggaagtgaatgccaagccaagcaacgcaaggacttagccctcctttttaaaaaaagtttttaaacattttaataaataatcttaacagataacttgttttctaagcaatacaatattttttttgtgaaaatatatttttcaaaacataaagcaaataatctttaataattcgatgatgttaggaagcgcgataggcaaacaaacaataaaaaacaataaacaatagatcaatcacagaagacacaagatttaacgtggaaaacccttctaaagcaggagagaaaaaaaaccacgggcgccagccagcagaatatcttcactgtatcagggtgaggttacaacgccgcacggcagcttacaagagatatatatatggtggaacctaaaagggatgacgatttgtaccgcgggggctccgcccctgcacccctggcccccaagcctccggcaacggacctacgctttgctacagcagaagttattctttactaagtgcaaataaatttgaatcacgattcaacacatgaaaaagtaaaaaaactgagctcgggtacaaggtgacatgagatctttaatgtgtttttatcaattagaacagtgaactaacaaggttgctttttgcctgcacctgcaggctgcatcaagaaagctgcagttaacccagatgggcagattcttttccccctgagatcaactgtgattttggagattaattaattacagagcccaagaagttttcgagggacactaccctctcgaatcgtagccgttggatctcagatctaaccaaacctgtggctgcgaattaagg

SEQ ID NO: 3590 - DNA, 1501 bp, Oryza sativa
cgagacgttctttcggtccagggagttgaaaattttgacagcaatgtcagttctcccgcacttggcatacatgtcaataagagcagcaccaagattgtactcgttgttgagcaccatcttgtgcttgtcgatgaaggcatggacccatcttccttcttccagtgctgttaaatttgcgcatgctgaaagcacactcaccatggtcacctcattcggctgtacattgctctcagtctgcattgcgcgaaacagctcaagggtatcctgatagcgtccagcctgagcataccctgaaatcatgcatgtccaggaaaccacatccttctctggcatgacatcgaacaactccctcgcgccatccatgtcgctgttcactgaataaccccggagcattgcattccatgacaccagattcctgactggcatctcatcgaacatcttcctcgctaacggcagcagcccgtggcgcgcgaatcctgtcaccatggagttccatgtcacgacattcctcccaatagctggcatccgatcgaacatctcccttgccacatccagctccccggccgcggcatagccccccaccatggtgctccaggacaccccattcctccgtggcatttcgtcgaacaccctcttggcactctccatctccccgcacttcacgtagccaccgatcaccgtgttccacgacaccacgtccgcgaccccggcgcacgacccgaacacctctcgcatcgacgccgcgtcccggagcgcgccgtacatcgcgaggagcgcgttgacgacgaagacattcgccaagaacccgtgccggacggtctgcgcttgcacctgcgcgtccgtgcgcgggaaggccgggagcttacccacccaaccgaggaggggcggcaaggtgaacctgtcagggacgagcccgcaccggaggagggaggagaaggcggcgaaggaaaggcgcggggacgcggaggaggcggaggcgcggatgaggatgttgtggaggaaggtggcggaggaggaggggaagagcgggaaatggacggcgcacagggcggcggcgaggtgggggtgggaagggaggagcgggacgatgcggcggaggtgggcggggctccggcggaggtcgccggagacgacgaggcggccgaggaggagcgggaggaggtgaggcggcggcgccatttttatcttctttttttttttctcgccgcgtggaggggagaaggctttatttgaatatttgaaagcttgtgattaacgtgagccgttggatgcgcatcggatggctgagatcagataaagctggagaaaaagaaacatttatcactagctactggtttttctatactactgtatgagtggaaaattgtacacattttatgtgcagaactttcattagtacagagttaggcttatcctaagtcaaacctatttaaatttgatcatgtttatatgaaaatatggtaacatctacaatatcaaattagtttcattaaatcatcaa

SEQ ID NO: 3591 - DNA, 1501 bp, Oryza sativa
cgtacgtgctggtggctgctgcgtgcggcgtacctagctagcctggtttcggaccttgcatcggcggcccacgcgtgccgcgcggctgcaggagcgtcgtcgcgactgcagggctgatcggttggccaagtgcagtacaccgggtagggaatcagggagacagaggatagaattggggaaactattttaactcgagtggatgtccaccgttggttacatgttatgaaaaaatataaataagatagatcaatatgtaatgtatcaatccacaaatatacaagttaaaattcaacttttacagattgtaacaaaaattacaaacaaaatttaaattaatatatgtatatttacaattaaatttgttatttttttacccgatagaattgttcgtgtgtctttgtccggtgcacctacggcggcagcggtgtccagtttttttatttctttttgccgttctgttttggatttattttctgattaatttttctttttgttatttagtgtacacacgcaagaagagctcaaaagtttttacacaagatgcacaaaacaagagaatgtctctttggaacaaaaatccacttcccactatacgccagaatgctatacactgccatacgcggggcaacgcagtgctgctgctgctgccgccgaaaagccaaaaacaagcggtcgttgtggatttttcccgatcgcgagggaggagagcaaggaacaaaaaaatccatgttatttgaaccaactcatttcatgatgactccctctaaaagcaggtacaatattttaagaagataaaagagaagagataagagtgcggactacagacttgtagccagctgtaacacgaactccaagacgcatgtgtgtatgactggtgggaccagatattgattgtgtagtatatatttataggtaactattatatgaattagctattaagttgactatagataatttgtaaccagtagttggctatactataaacttgctctatcaatgatctactctctctctctctctattcagtgatcgccctcgtgatcggcaagatcggcgggagccggaaaaatacttatgccgacatggcagagtgcaactttaccttactcccagtagaacgagcgacgcccttgatcaggtggcccgcgcgcgagactccgtcaaaaaggcgatcgaccgaccgatgggcgccagtctgggtgaccagaccgcaccgaaggaagggagaaaaaaaaaatcatggttcgttacaacaccacgccgcgcgccaaccatcaaccgttcaaagctcttgagcttgagctgggacgtgtcaagggctcaaggcgggtgcatgcacgagctgcgcgcgcgcgcgtaggtaggcatacgcgtgcagcgtacatggacgagctagcgatttggatcgatcggtcgccttttgaaacggtggcgccatcattaaacctggaccaaaccgtagaaagttagtggcgaggtgattcaaaagcagcgcccgtgt

SEQ ID NO: 3592 - DNA, 1501 bp, Oryza sativa
ctagatgacaggagatgtacaggaggttttgcagtattcttaggagataatcttgtgtcatggagtgcacggaaacaagctactgtttctagatctagtacagagtcagaatataaagctttggctaatgctacagcagagattatgtgggtacagactttattggcagaattgcaagttgagagtccatctatggcaaagttgtggtgtgataatttaggagctaagtatctttctgctaatcctgtgtttcatgccagaactaaacacatagaggttgattatcattttgttcgagaaagagtttcaaggaaattgttagaaattgattttgtgcctacaggagatcaagttgcagatggttttacaaaggctttgtcagttcgacagttggagaattttaagtacaatcttaacttaggaaagttatgattgagggagggtgttaaacatgtgatatgtatttgtgtgatgcacacggcatggttagatggatagatatgattagataaggctagattgagtttgttgtaatagaataggagcatatctatccatccacctgcgccgatctctgtaacctacagcggtggttattatcgctaatataagattaacaaaggtacggcctgagagggttgaacgcttctgaacctctgatgtttgataaacaagacaagaccaagaccaggacggctgggggcggcaacatcagggcgtggattaaccgaggcggattggttccggccaaagttgaccccaagtctaccggcctaggctggctgagttggaaagaattcaatgaatcgattgcgacgagtttaaattctactatacagacacgtaaaacacaacgaaatttctctgtttttgtcatagcttacacgccgaaaacatacgctactactagtagtactagtttttttgaacgtgtagcttgcacacgtaaaacactggatgcaggttgttaatactccgaggaggccgtataacaatcataaaaagcgtcatgtggcgcgaggtacagagttcattgcgtttctgcatgaatcacacacatcgaacgctacgctggacaccacgtggccacgccaagcttagcaactcataccgacggccccacctgtcatgcgtacaggcttgttgtgggacccacgcccgcagccctgttccctgcagagaatcattatatactccctccaatgcacgaacccaaccagagcacattggatcccccgttcccccgaacccaaggtccaaccaaccgcaaactgcaaacatatcacgctccctattttagtaccacctcgcgaaccggaacgcatcgcgtccgataaaaaactcgtcgccccacaccgcgcggcactcggagctcagctcgcacggcacggaacggaacacaaccctccctgtgtctctctccctgatgcgccgccccccatgcggcggccccgacccacttagcccgcggcggcggatgctgcggcggcggcggcggcga

SEQ ID NO: 3593 - DNA, 1501 bp, Oryza sativa
cgtcacaatacgtactagtataaaattccagacaagataaacttagcaatccaatgaagattgcagctgccgaccggtagaaccaaattatcctttacagtaaaataatccacaaacataatcagtgttatcctggctgagtatggtttgggatatagacgtatgtgatttctgttgagattatgggcatataatgatttaatttattccataaataaatcatgacattacatatgaaaactagcatgaacgcatcattagatctacacatgtaaactacgcagaataacatgaacagatcaaatatgcgtaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaaccgaaccggataagtcgcgcgtaacttatcagcaaaacaaaactgcaaaaggaggctgcatctgcgcaagggtgaggagccaatttttcggaccattcgacgcgtacgtcgtgcacgcgcgccgcccgccctgccgccctgccaggcgaggcgagcgagtgcgcgcgtgtgtttcccctcttctctccaccacacatgcttcaagtggctaggagggcatcctcccttttaaggaggtccccatctcctagaataagcaaggtggtactaaactccacatgcatgtcatcccatgaggtgggcttttgtgattttccaaagaattaatcttcgagtgggctaaggcccattcattaattccaacaatttcatagcatgcccgcggcaggtatgcaaggaaatgttgagcaaaacaatattagacaatgtgcgacaatcacatcaggcagattactgaatttgacgacctgttaatttattttgagcctgcatgcgcccatagctcgaccactagatgcactcagaaaagcggtcctcaaaatctcaagaaaggaataaagctgtgtcggtttgacatctaatttggtcctcgtacagcttacctgacggaaataatctacgccgtccttctcaaaataatataagtatttttagacttcagcataatttttgagatactactttaaccaataatatttataaaattaagatattttaaataaaaaaagttgcatgttagaatagtttgtttaataataaatctagtgacatcaattttacatgattgatttttttttt

SEQ ID NO: 3594 - DNA, 1501 bp, Oryza sativa
tctcttattccgtgtcctagtagttcaccggttgtagaaatgattgagttaaaattctacctctaccaatactgtctttctccttgcaaatcgcgacactgacgctgaactgatgatagcgcctagcaagcggacctcgtacgttcatcacggcaccaaccaccagcacggttcggaacgcacgcgcgtttcggcaattttttttcccgaaaggcacccatccgattcggacctttccgctcgctggcgagtggcgacacggcgcgcctagctagacgccgagacggtaacggaaaatatctcgggcctggggggtggggggtgtttacgagcggacggacggttgggagggcgtcgagaggggggccccgatgggcgccacgttcccatcgagccggtgttgggatcgacccggccaaacgggccggaggagatttcgatcgccccggtggaatcggttggtggtttgcccccgaattggacggtcgagacgggggcggcgttgtggcgagcggccgcgaggaccagtcctaggtcgcgcctgggccacccccgcggcccggccccgcctcgcctcggcgtcgcgcgagcgacagcggaaacgtgagccacggctagccgccaagcgagggtgtgcaagttgcatcgccatcactgtacgagtataacttggatttcctctccttgttgatgacggagacgcctggtggttgtttttcttctcccctcctcccaattatactcttcagttttttttttcatatttacagtggtatgtcgggaacatggtgcctattaatgacaccagaatgcatatattcatattactcttcttttttctggagagaggcagagacgaattaaggatcgaagtgctacttgtaatggaatgaaagggagagaaagaaacagaaagtagatgtgcacacccttgcagcaagttgattttgattgtttctgtacaagtaactttccttcctcagtgattttgattgtttcgctctcttcctcctgatgggccctggagcaacgatttgatgttggctcgattgcgttgttctgattcacgacagtatcagttggatggcccagattttgaactcgaaggtagatacgcatggttggattcatgcgtctttcaatctagatcagtgagtgcttccgattaaccaggtttaaaacgccgagcttaccatgtatctgttctgaactttcagcaagggtgtcttctcgtctagatgcgctgtcctactcttctaccaacatttttggtagtactgctcaagccctccaatcattttgggatggagtgaatctacttggggaaagtttacggacaaacagtagatatcaaagagagatccagcattttgtgtggttgcagagaaattccgtctcccttcctgatcgatcaacctatggccagtagaaggttttgttttgatccttgcctgcatgtcatgttcttttccgcggcctggtagatatgaacaatatttta

SEQ ID NO: 3595 - DNA, 1501 bp, Oryza sativa
tcagcgcctcggcgcgaacgctcgcctgcatcctggtagcctcatcggctatccttttccagatgaccagttcgtcctctgtctcctccacggccattgcttctgacacgggcacggcctcctccgcgccagctcccggcgtaccctgtgacgcatcctgcggcaacaccgcgccgctttgccgatttgaccactcgtccgagcgaccgtcgccggttgccccggcgaccggccgcaccttgccgccgccgccgctgttgccacccaccgaggccgttcggccgatggacaacgtcttgagcgaggcatggtcgaaccgctggtgggaatgagactgctccgcgtgctgggtgtcgaccatcgccacagtcgccgcggggggctggggaggcgggagcgtggcggcggccgcgacgctgtcgcccatggagtagacggtgaagttggcgagcagaagcatcacggagaccatgagggcgggggtgccggagaagatgtgctggaagagccacacgaaggaggcgtgcatctcggcgtggacgcgcgcgagcacgcgctgcaggtcctcgtagaagagcgcctgccgcatctgcagcgtgaagctctgcagctcccggatgatgagcaccatcgacgagaacgcgcgccccaccgcgccgcgcgcggactcgccggcgcagtcgatcagccgctcgtcccaccggccctgctgctgctgctgctgcttcttccgcttgagcatccgcagcgacagcggcaaccccacgctgctcgcgctccgctccacgctcgccggccacccgcagccagcggcgccagggtgcagccccaccgccagctcctgaatcctccgcaagaactcctcgtcgtccccgccgtcgctcccgatgctgtcaatgctagcgctgagagcgcgccttgccatctggtgcccgccggcgcgccggcgggtcataccgacgctccagctagccagcgacgactgccctctcgacagcctgacacctccaagaacgccatgccgccgcgacgtcgtcgcggcggcagacgacgaaggcgacagcgacgacgacgacgacgtcgtgacggcgcatggcgacgacgtcacggccgcgacctggatgcccatgggtcgcagcgaccaccctcccggccacccaccggagcgacggttgggaaatggcccacacagctccacaaccgtgggaggctggctaaatgcgagggggtggcaaaggaagaggaagaggaagagggggagggggaaacgagcggtggccttatttcaggatccgggaggcgtgtcctggtcaaccacccccacgcagctcgtgaaggatctagcactcctgctactgccgctaccggtgacaccagtttcacgaaacaaaatagaaacgatacggtacgcccctccttaatataggcttgagccaaaattaggcgctcacacactcgagatacgaatggcaagcagtatatactttggagggggggggga

SEQ ID NO: 3596 - DNA, 1501 bp, Oryza sativa
accgctcctccgtcgccgcgaactccgccgtgtcctccgtgtccagcttggcctccaccggcgccacgagctgccccagtgtgtccgggtccatcagcgcctcggcgcgaacgctcgcctgcatcctggtagcctcatcggctatccttttccagatgaccagttcgtcctctgtctcctccacggccattgcttctgacacgggcacggcctcctccgcgccagctcccggcgtaccctgtgacgcatcctgcggcaacaccgcgccgctttgccgatttgaccactcgtccgagcgaccgtcgccggttgccccggcgaccggccgcaccttgccgccgccgccgctgttgccacccaccgaggccgttcggccgatggacaacgtcttgagcgaggcatggtcgaaccgctggtgggaatgagactgctccgcgtgctgggtgtcgaccatcgccacagtcgccgcggggggctggggaggcgggagcgtggcggcggccgcgacgctgtcgcccatggagtagacggtgaagttggcgagcagaagcatcacggagaccatgagggcgggggtgccggagaagatgtgctggaagagccacacgaaggaggcgtgcatctcggcgtggacgcgcgcgagcacgcgctgcaggtcctcgtagaagagcgcctgccgcatctgcagcgtgaagctctgcagctcccggatgatgagcaccatcgacgagaacgcgcgccccaccgcgccgcgcgcggactcgccggcgcagtcgatcagccgctcgtcccaccggccctgctgctgctgctgctgcttcttccgcttgagcatccgcagcgacagcggcaaccccacgctgctcgcgctccgctccacgctcgccggccacccgcagccagcggcgccagggtgcagccccaccgccagctcctgaatcctccgcaagaactcctcgtcgtccccgccgtcgctcccgatgctgtcaatgctagcgctgagagcgcgccttgccatctggtgcccgccggcgcgccggcgggtcataccgacgctccagctagccagcgacgactgccctctcgacagcctgacacctccaagaacgccatgccgccgcgacgtcgtcgcggcggcagacgacgaaggcgacagcgacgacgacgacgacgtcgtgacggcgcatggcgacgacgtcacggccgcgacctggatgcccatgggtcgcagcgaccaccctcccggccacccaccggagcgacggttgggaaatggcccacacagctccacaaccgtgggaggctggctaaatgcgagggggtggcaaaggaagaggaagaggaagagggggagggggaaacgagcggtggccttatttcaggatccgggaggcgtgtcctggtcaaccacccccacgcagctcgtgaaggatctagcactcctgctactgccgctaccggtgacaccagtttcacgaaacaaaatagaaacgatacggta

SEQ ID NO: 3597 - DNA, 612 bp, Oryza sativa
tgacatacaaagttacaaaccctgcgtgaaagttctctatcgtactcttgtttttggagcggggtggggggtggggggggggtgcaggatatagggagatgaatgttcacttttaattttccccacgatagtttatctaaggtcactgaaaattcagtgttgagttgttgattgttgtttatggcacttttatctgcaaaagcatggctaatcatgatatcatgcgaaacccagtagatataacagaatataggtaagtcaatccttgaaatgcatgaataattggttcattttaaccatgtcaaactgatcattgtatccccgaaaggcaagcggcagatcagtatggcttaagttaattctaagtcagatgcctatgacttcataagctagtagcttttgcaaacttgcaataactttttatttgggatatgtacagtagtaacttatgtatgagcatcacatagaatgtacggagaagcaggatataggcatttataaataacaataagttctctttagcctttctggtttggacattatatcaaacaatcacactgtacttgtttactgtgagacaccatgttcaattgctcatgttatgttatttcc

SEQ ID NO: 3598 - DNA, 164 bp, Oryza sativa
cccccacagattgttgccgccgccccctcagattggcgctgacttggaccccctcaaagcgctgccgccgccgccctccaccacaacgagtgggcgccggcggggcagtgcttgacgccgccgccgccgtcccctcagctcgccgccaccgccgcccccttagc

SEQ ID NO: 3599 - DNA, 1501 bp, Oryza sativa
tctaatttcttgaaactgtctgtgaaaattttgagtgggatgtgcaagggaatatgctcgtgcaagactgcctcaaacggattacggatgcatgcggttgcaaagcgcaagttccattgtaatgtccattactccagtctccattcaatataactagctgggtggcccgcgtaattgcgcggctagcacccaaacaaaatcatatattttttttaagtatgattttacttaaaatttattaatagctatctcattgtcttaagactttgaaagaccaaaccttatcatcctcgtgtttctaattatatattttttaaaagtcacaccagttgctaccccttatatcatcttcttctttatttgcttgctcgatctaccactatttttattcattcttcttggaacctttaaaaattggattttatagtttttagagtttattgtcatgttgggttttatttttataatttctagatgtcccgtcaaacgttgccattatactcctctacgggccatccattgtctctactctttattgttattgagattttaaaaatcgaacataattatcgtttgggttcatttttattttctagaagtcctgccaaaccgtcagtagctttgccattgtactcctctacggctcacccgctgcctaccttctttattgtcattgagacataactatcgttggaattcattctttattgtcattgagattttaaaatcgaacataacttatagtttcattttttataatttttagaagtcctatcaaacaatgccactatacccctctacagcatgttcgccgcctacttctttattgtcattgtgattctaaaaatcgaacataactatcgttggaattcattttttattttctagaagtcccgtgaaccgtcggtggctctgcaactatactcttatacaccccgcccgctgcttctcctttttattatcattgagattttaaaaatcgaatacgattatcaatgcagtttgtttttttactgtctaagaagtcccagcaaccgccttactcgtttgcttcatgtagcgcccgttccgtcttggcgcctagcgggaaaattatctcttaaaaaccctaattgcgaaatttgtttctttgcttgttgtctattgtccgtgccatctcaagatctcaatccccgatctatcgtcgagttcaattccgaatccaaatccttccaatcaaattcctccgcaaaagtctattttgcctcccccgaggtcgatgggccgaatctcgctcggcccatcttcccctcttccccggccccctctctccccgggcgctctctctctctctctctctctctctctctctcgcgctctcccatctctccccccccccgctcggcctcgcccgcacgccgcgcgcgccgagcgccccctccctttcctctcgctctgccgcgcctgcagccgcgcagccgctcgtcctcgcgagccagcgtgtgcgcgcccgcgcggacgc

SEQ ID NO: 3600 - DNA, 1501 bp, Oryza sativa
gctgaaattcacatagaaattttattcggtagtcagcagtcagcatacgaaggttagcacgtcagatattttctaaacagcaggcaatggtcacactagccaacaacacatcccttgtcttccacgttgcaagtttccacgcgcagtaccgctacagttgtcctgatgtgcagtagaactgtagaagcactgtctgcttgctgtagctagcttaccaaacattgcacggaaaggtttaagatctgtttagtatacgagcctgaagtagacaaaatcatcagaaaacttacccatgagacgatgaaacatgtcctacaatctacacttacaccgaataagtggagatcttatagttttcccaaaaaaaaaaaggtggagatcttatgaacatcactggccattttttttttcttgacagctgacagggacgccgtaggtgtgtaatcgtgccagcgatccaacattccaacgccacccctcttatctccaagtctgccggaccttctcactggccctcttcgctatcgccttcccggccgtcctcctcttgtctcacgtcctgcactcctgcccttcttatcttccatgctgttaaacaccctatctgactagtctccaaacgatccagtcaccgtacctgttacatctcgcccagcggcacctatcctcgatcgatggctgttcaatctgcatatcatgtttcatttgaatggcttccagtgtccacacaccctcacgacaataatatctgcacatatgcgttttcatttcctctcgtttggaagtagggatgcaaacaaccttcactatattggtaatataaccatatttcttcgaagacaaaatcgaaaatgaaaagacccaaaacgaaaacagtgtccaaaatatcagaaagtcggaaatgaaattgtatgaacagaaacaattcaatatcaaatgaataccattaataaatatcgaaaacattgagctatagaagcacatatttagcttaacattactatataatatcatcaattatattcgggcttgtgatatttggttgaagagtatttatatatagatatatatagctataaaagcacatattacggtatttatatatatggatcatagatattacagtatttatatatagaaaaaaaaagtccgaatgacacccctgaattagcggggttgatcgaattaccccctaaactcaaataccagtcatttcacaccatcgactattcaaacggaacaaatgacaaccctaagtaagtccacagtgattttggtcaatgttacgaataaggcatacctcctattttacgacttatggaatatacgagtatggtataacacgggttgtttccgtatgcgtcgtaggaatccgtcacggattatggaaaatatctctacgggtcgagtgatttacaaagtcctactcggtatggatagagctttcattgtatcatatgagatccaatgtctccgagtcttacttagagatcaagatgat

SEQ ID NO: 3601 - DNA, 1501 bp, Oryza sativa
aggtctctttattatagagtaggagtacagtcatgttgggctgcggacagatcccgagctcacaactgcattacaaaagggaagcggaagccaagacttggaccaaacatcacaggcgcgacttggggactaggccgaaaccctaaaactcatcgtagccggcttgctcctggaagaactcctcgtcagcgggatccgcttcatcttcttcagcaactgggggggttatttatatagagcaagggtgagtacaggagtactcagcaagccatgggaaataagtgtttaatgcaggcttcaaagaaaggctgttgtttttgcaattgattttatttgaactcttttctgaaacaactaggtgagtgtttctcaaacgacacggatgagacagtgcgtctcgtccggtcggagtatgtgcaatgtatcagtcttttgaattgattaagattggcacccggccaacagctttcaaacggccacccgggcctggctgatctcatcagccgcagattttccaaacatcaaacccattccacaacagcaaatttcacaaggcagtagtcaaacaaaactacgctaggaatcacctcacatccgcccatgaccgtgggcacggctgttcgaacagttttaataacctctgcagaggaggtacactttacccacacgacattactaacccggatcatccagtccgtgcagaacggccacgactagagaccttaaggctttcatgacaaggcatttcgaaagccgacacaggttcaccatatgccaacgagaggggtcccagaccaacaccagattaggtccagaccatattgtgccaggaagcccaggggtcctccccgacacaccccggcgaatccacatgtctcttagcatcatggctcccccaataagctagttactcagccaggggtgtcccattccacccatgtggtcgtacttgtcttatgttcggatgaaattctaaggaaatggtccttaagtgcaagagcgggaaaccgtacacccggtacgttccccggtccacggttttggaaaatcatttagttcgcaagcaccgacccaggtgtcgggttttccaagtcttttgtaaaacccaagttttacccaagatgttttttagattttaagtttgaaggcgaccgtcgatactcgtgcagagtgcacgattaccgaggcgcaactgggtggttacaagggaacatggtataacaattaacaaaggaaggatcaaatgcaacaaattaggtaggtccgccgatctgccttgcagacgggacaagcagattaagtgcgatcctatcaatgcataatatttttcaagcaacataattaagttcaaatataggctcaagatgttcaaaggtggcttgccttgctcgagatcttgaccttgatcctcgaaatcctcgcactgcgggtcttcgggctccgaaactacatgcaaaacgggacaactcaacaaacggcgaaaataaagccctattattga

SEQ ID NO: 3602 - DNA, 1501 bp, Oryza sativa
gcgagtaggctgtgcttgtgcggcagtagcttccgggagatgagtgccgttctcgcccccgaagacctatatagctggagcctggagatgagtcccagagcttcgtcgccttattagatccactcgcccccaacctccaaacaggccgcccggatctagccgtttctattcttcttcattttcttctttcgatctacttatactatttttctcattgtgattcattaaggtggtgtttggatccatcgaatatttggacgctaatttagagtattataaattaattataaaactaactgtataaactaattcgcaagacaaattttttaaacctaattaattcataattagcacatgtttattgtagcattacagtggctaattatggattaattaggcacattagattctcgtgaattagtccagagttatggaatgggtttttatcattagtctatatttaatacttctaattagtatccaaacatccgatgtgacatggacttaaaattttagtctccgatccaaacagcccctaaggagttcggaactctctgcatttcccttttttttcctggcgtgactttttaccctcacgtttacatgttgggagtagggatgcaagcgggccgaccagcaagttcactcataggtcaaataaatgataattcatgggttttcgcgtcgtggtctggtttgctgtatctagatatgtaagtgggtcgatccataaatctatttatagatcaaattaataggtaacccgctggtcaaacctatgggttatgtactaattttgcctataagcgggttcgcggacaaacccacctgcacccctagttgggaggacttatctatgtagtactacctccgtctcaaaatacttgtctctttgagtttttgtctataacttttgatcattcgtcttattaaaaaaaatatggaattattatttattttgtttgtgatttactttattatcaaaagtaagtatgacttatccttttatatttgcaaaaatttttaaaataaaacgaatggtcaaatgtttaaaaaaaggtcaaagcgactactaatttggaacggacgtagtagtattaagggtatatatgagaaggagaaaaaaaatattgaggttgtcagttggaaaacagattagtataattttttaatcaatttttttatagactttttttaataaaaacacaccgtttaaccgtttcgtgtatatgaaaaacgaggaatattttctagaacgcagccaatcgtttatggaacaatatggatttttatgttatttattatataattgtttttttctcgttcccagtatatctgaaaaacctcatcccgtttcaccattttgtttcaccattacagtaggattgaatattgaattctctctagttccgccacgtgtccgccagaggagaggggtcccacagatcggtgaaggactgcataatttttccccttcttcttcttccccgcgagacgcacg

SEQ ID NO: 3603 - DNA, 1501 bp, Oryza sativa
aaatatatcattctatttattagagataacttgttccttgatgggtgtattgagtgagacaggagcaaagaatagatcaaaggaatatgatagagctaatcagggctgacacatatgatatatggagcttcttagaagaagtctacagaaaagatataaagcaaagcaaaagaaaagctaatggcaatctggtccaaacagcacaacaaagtttatatgctatatgccaagtatgaagtgctatgctgtatggactttattaggggtgtttttgaactcttgaaccaataactatctctgtgaaataaagctgaaatttatctaccgaaaacaaattttgcatagtagcttagaaaatatgaaaagacatacacagtttggactttgatattcatgttcccagagcatagcaagcacagtactgtggaatagacataattggatttctactttgatttttgtgctttactaccaatattacccgtgcgttgcaacggataaagacaattttaaaataactgaacaaaattatctcctagcgaggagagcgcgccatcgccagctaccccttctttcccagtgaggacaccgtcttctggttcccaaggtgaggataagctgtagctcctagctccctcgccctattgccaatgccgaccgccgccgcacagctcgccctacaggaagggcgcgcgacgtgctccagtggcttaggctgacaccacagggagagcggtgtggtccggtggtagatgacgtgacctgcttggatccgctcgctcgccgcccatggcttcctcggcggccgccatggcataggaagaggggagaggactcagaggagggtcgaggccaccccgccgcggctctgcctcgagcctcgaggctgtcctgccaccgctttgccttaggccgctatgtggggaaagtagagagaaaaaaagagagagaggagtctaagagaggagacgcgttagcaaaaaccaccctcaaaaccaccaagagtcattttgcactagttttaattttaatagttggagggtcaaaatatctggtattgcagttgagggatacaaattaggttgatcctatatttgagggagtcaaagtggacttattccatatccctgcatccttgccttgggcaggcaggcccacagcctgccatgcaacaagcagcaccagagtatgagcccattgggctctagcgaatagtttggattcaccgtgttgtaccgctgcctgatttccgtacgaatgacagaggaaaaataatccatgtcggtcatggtgacagaaaaaaattcacgaagacggacaaacgaaaaaaagaagaagttggaaacattttttttttttttgtaaataggtaaagataaagatttgtatagagcaactataaataaaaatttatcatagctacgtttaagcaaaggctgtttgcttcttcatgaggtaactactattatcctcagttatgttacatattccaccaagttta

SEQ ID NO: 3604 - DNA, 1501 bp, Oryza sativa
gagctgtgcggcggcggtcggcattggcaatagggcgagggagctaggagctacagcttatcctcaccttgggaaccagaagacggtgtcctcactgggaaagaaggggtagctggcgatggcgcgctctcctcgctaggagataattttgttcagttattttaaaattgtctttatccgttgcaacgcacgggtaatattggtagtaaagcacaaaaatcaaagtagaaatccaattatgtctattccacagtactgtgcttgctatgctctgggaacatgaatatcaaagtccaaactgtgtatgtcttttcatattttctaagctactatgcaaaatttgttttcggtagataaatttcagctttatttcacagagatagttattggttcaagagttcaaaaacacccctaataaagtccatacagcatagcacttcatacttggcatatagcatataaactttgttgtgctgtttggaccagattgccattagcttttcttttgctttgctttatatcttttctgtagacttcttctaagaagctccatatatcatatgtgtcagccctgattagctctatcatattcctttgatctattctttgctcctgtctcactcaatacacccatcaaggaacaagttatctctaataaatagaatgatatatttttattttatgagttccattaaagctactcaaatatctcgtttggacattatagtgccatttcgtaatcatacacttggtaattactgcacgcaagttaaaaagaaaaaaagaactagagttttttttttgggtcgttgttatgaattgaaatactcaggatactacaattttattttcagtaacttcagccaggatttggcatgcaatgcttggcgtgccagcttcacagtatgcttgttcgcacaactgatgcaacaaaatcaaactcccaaatgagatttccaggaaacctaccttgagaaatactatagtactactacaacgggatcgatcaaacacagaatggtacaagaccgtagcaagtcaacggttttgttctattgcaaatcaagaactaactatccttaatccttctgtagcatgtagtctaaatccagaaggcaacaaggaagaaatcattgccactaacaaggaaaagataggtgtaccaaccggccaatcaatcctcgaagtaaatgataacagaagagtgggtaagaacaagagggtttttcttttcttttccatttttttttcataccttgtggctcctcacggggctggggatacctaggccgaaaccccagggggctcccgcggcggcgagggggaggaggggacgcgctgccgccgcggcgcctcggcgccgcgtgcggctgctgcggcggcggcgtctggcgcgactcccggcggcgcatgaaccctggaggcgagggctcccgcggggggcggcgtgcggcgggcgggggatcgcgccggcgctccagccggtcggccgcgccgtgct

SEQ ID NO: 3605 - DNA, 1501 bp, Oryza sativa
caacggctcatctggctccggggcgaccaagactgggggagaactgaggtacgccttcaactgagtgaaggcccgctcagcctcctccgtccaggtaaacggcccggagcatttgaggagcttaaataggggtagtgccttctctcccagcctcgatatgaaccgacttagggcggccatgcagccggtgacgcactgcacatccctaagcttactgggggggcgcatccgctctatagctcgtatcttctcggggttggcctcgatgcctcgggcagagaccaagaacccgagaagcttgcccgcaggcatgccgaacacgcacttatcggggttcagctttatgcgggcggagcggagactttcgaaagtttccgctagatccgagagtaaggtctcttggttgcgcgtcttcacaaccaagtcatcaacataggcctcaacattgcgtcctatctggctacccaaagaaattcgagtagtacgttgaaaagtaggacctgcattctttaacccgaaaggcattgtcgtataacaataagttcctatgggggtaatgaatgcagtttttcctcatcctccctagccatgcgaatctgatgataaccagagtatgcatctagaaaatacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttccggggcctgccgccgcactttctgtcggaccggccttgcgcccggccgcacggcgagacggtgctcaatcacctccctggggaccccgggcatgtcagaggtcacatcgaagtccacccgctccgtgcggaagttggcggaaccaccgaaggtgaacgggaggtcgatatgacccaacggccaggtgtgccccggaaaacccaaaatttgcgagtaccaatgatagtacattccccttgtcggtgacatggggccgggggtatcgtgactagaggcttgggtagccgcggtcacccacgtggcctgaccccctcggggcggtcgggcccgagggtgacgtggccacccctccctctgtctccccgaggggtcgggccgctcccgtttcggccccgagggctggggcgccccgaccccctgtggttttggcgccatgtgtatgggttaggtgagcacagcgggctcacctaaccgcatttatagcaggttggacaagcgcgccacgccgcatttaatgcggcgcagcacacgcttatccggtccgtgaccggtcgcggtgtgtgaccggtcacagaccggtcagatcgcgggttaggtggcaacaggcggcctgtcacacgcctcgccccgtcccgtcggaa

SEQ ID NO: 3606 - DNA, 1501 bp, Oryza sativa
aaactagattataataatcctaagctgaatcaaacagggccttattatcccctacctcctccactttcaccacatgcgcctctccatattgagccaccgctcgtgacggagctaggataaaattaaagcggggactaaaccaaaatagccaataaaaattgaaacatgtctcatataaattagctatatttataatacaaactataaatatatggattataattttaggggagtattatgggggctctaatacgctgtctccaccgttggccaccaccaccggttgccttctttttctacccttgttcctcgtttttaacagtataaattccactaaactacttagtatatgctttcatcaatctatcacataactatatatttaaatattatgtaccataaaaaactacagatttaatatcatatctttttactatatatcgacatatcatataaaaattacacatttaacatcgttttatcatcaaactacaacttctataacctcaataatactacggatatatactctaaaatatgtggcttttaaaaaaactttattactcaatttgtaattttgagataactgtcatctccgttctctcctaaactcatttttgttttattgtgcatcttctagagactagccaatgaaagattcatttctatatctcctgcacattaattcaaatgaaacaataaaatcccattgggaactacgagcttgttcattttcttaccatattcacaccttattaatttttggtatgctaacaaaccaaacatatccttaccattgtcactctaccaaactttggtaattccgaaagtttccactctcaagttaaacattctaccaaattttagtaggttaaacatccaacacaaccaagttttgataacactaaaatgtgccaaaatatgataagattgaaagtgctaacaaagtgaactagccctacatatatatcaaccattcagtctctccttttttttaactttggaagagatgactaggggaggatgctcaaatttggccaatcaaaaaaaaaaactgtccaatgcatttggatatatatagtctgttagggtatgttttttttccttggttggtatatggctaacctcaatctcttagagtgttcttttacgtgccttgaaccaattttttttcacaggatagattgaaggaaggtgtgttggcaacaaaacaagctgaaggcacaacggaaaccaaccgtagaggggtgccgggtgcaaatgcaatgcagggtgggtgaggcatccctatccgcgggattttttacattttggttcttttaaaaaacttatttcacaaatagacccctaaaaaaacttatcctagaaatggtccttttaggggcaccagagtggctggcgccgtcatcaacgggaccgtcctcctgccaccgtggcgcacgcgaaccgaagtggcaggaggagggcgctagccatgctggcgccgccccagggaggaggg

SEQ ID NO: 3607 - DNA, 1501 bp, Oryza sativa
gttgacatacagatccacgtcttacaaaaatataaaagattacaaatgcagcggaaaagataaaacgagctaaacttggaaacttgacttctacagtggggcgactctattccacaggcaatccttgacggcagcgacgaaaccaacttcaacaggacagctcccactaggaagatcttcagctctagtgtgggggaaaagagagcaagactgagtactacccactgtactccgcaagtcataccggaaaaggaggtaagatgcatgatataaccaaaggaggttaggggttcatttgcacaaagctagcatttaaaagcagtagttgaaagcagtaaaacaattgtagtaattaatcaatattaaccaatcactgtccaacgctacaccacgttgcaataggcccaaccaaccacttgaactacaccagttcattaagctaaacaaggggtgagactaatcacggtgaatctggttgatcgcccataaccgcgggcatggctattcgaatagttttactctggccagaggtgtacaactatacccacaagacacgattccacacatgtcgccatgccccgaagtatcaccatgatactgcgaagggggaaatcgtgacaagaccctccgcataaccctcccctaaccatccacaccacgctaaggtttcacccccacccctcaaaaggcagtggacggtcccctcttgagtcgcggtgaatccggcagctagacaaccggacaccccgaccgacccaactccatcacgcccaccctcgccaccgatgcctaggaaagggtcgagctatattttagatcaagcagttacccactcccgcttgtggtaaacacggtaagtctcccagggtttcccgtgaaccggtccttaattgccatggtgcgaccagcaaaaccatgcacccacagcccaccattcagtgtattttaattaactaacaccattgcggtggcaccaatccaaagctatgctaatagtcaaagtctatgcaataatgtgatccccatttgtatactagttgaactaagcatggctaagcatttcctaaaccaacatctagtcattttgatacccatgttatcaatggcataaggtaaacaatatatggctgagtaaggggacccatcccacatgacattgtaaaagaatgtaacatttaacagaaatgcgggatatttgtaaattgggtacaatatgatcaattgtaatgcatgacttgccttgctctcgcacttatgagaccttagcaacgtcttcgagaaaccgcggatcgacgaaacggccgagatctatgcgacaaacaaagcacacaagcaaaacatgctataagactactgaaacaggaaacaaaaccatttttaatggattctagggatttttatgaatttactgagacttgaatggacttaaacggagctcggatgaattacttatgaattttagaagataatctatgtttttactaacaaagaaaagtcctta

SEQ ID NO: 3608 - DNA, 1501 bp, Oryza sativa
atccgatctacttggtaaaacagtcaggcgcccaattgataggtgccttgaattaaactgctttaactctatatataccttaaatgatacgggatagtattattatattattaaataaatgaagcaggtgaaagagatatgatatgtaacaaccgtaattcgattggtaaaacagattataacgattatgtgttttcatttgtatcataattttaaaaaatatgtacaccacaatataatacaataataaggtcagtatagctagctcaatcttctgctatgaagtaaaggtaggtcggtcccaccaagtaaaaataacagtctcgtgaactccatcgctcgagataaatctatgttccatactaaaatctctactactataaatattatttaagatgtttttgttagggattttgtacgtcgtcccgtgtgcggcatgcgcgcaatgatttcgtccaagacgcgcgtgccgttcaaccgtcgattgcgtccgagtccatttcagccgcgcgcgatttgttttccttgccgggcgccgtgatttgtgcacgcccactctgattcgggagtggattttgatccattgagagagaggatgtccacttatttttttacatgtcacttaaatagttataaaataattttaaaaaattgagaagatgtattagcataggatatatcattccacaaacatacgagttcaaatttaacttatattgttctacatctcgaaatgaaaaaaacaaatttgactgtgaatatacattaatagctgtagtttaatttgtttttttcattgcgagatatagaagttgaatttaaacttgcatgcttgtggagtgatatatcacatgttaatacattttttattttttttaaaaaagttataactatttgagtaacatgcaaacaacgaggggcatcccctcgagggatcaaaacagtttcccctctgattcagccagagtccattcgatgccacatgcactgcccgctcgcggctgcctcgcacaccgcctcgcatgagcacgctgcacaagaccgtttccaattatgtataatactacacactttttacatatcgacaagattcttgttttttttaatatccgtactaaacagttagcttggacctaactttgaaacaccaaatccttcgcgtttccagatatatcatatatgaaacaccaaatcttttcttttctcattcacagtgtatgttgcacatgtcatgtcatgtccattcatacatgtccacatataattttttttactcatctacacccttttctccgcctttaaatgttttttctcctaaaataattatccaatctacatatgattacatcattgtattcacacgattatattttgataaaaaatcaaacgatgtttagaaatacaacatttaaaaatttgggctgcaacactagcaaccacttatatgaaacactgagtcctaatgagtaaaacaaaaaaaatcatatcagagatacaatat

SEQ ID NO: 3609 - DNA, 1501 bp, Oryza sativa
ctctctcaatggatcaaaatccactcccgaatcagagtgggcgtgcacaaatcacggcgcccggcaaggaaaacaaatcgcgcgcggctgaaatggactcggacgcaatcgacggttgaacggcacgcgcgtcttggacgaaatcattgcgcgcatgccgcacacgggacgacgtacaaaatccctaacaaaaacatcttaaataatatttatagtagtagagattttagtatggaacatagatttatctcgagcgatggagttcacgagactgttatttttacttggtgggaccgacctacctttacttcatagcagaagattgagctagctatactgaccttattattgtattatattgtggtgtacatattttttaaaattatgatacaaatgaaaacacataatcgttataatctgttttaccaatcgaattacggttgttacatatcatatctctttcacctgcttcatttatttaataatataataatactatcccgtatcatttaaggtatatatagagttaaagcagtttaattcaaggcacctatcaattgggcgcctgactgttttaccaagtagatcggatatgttttactaaatagatcgaaaatattttagtctttcaaaaagctgaaacacaatcaaatcatctcataaaacattttgttacaacgtatgaaacaacggttttcaaaaaatcagacgttgtttcaccttatataaaaataatatttcagcaaatagcaaaataatgtttcaattcttaaaaaaattgaaacacggtcagatcgctagatgaaataatttagttcaacgtatacaacaaacgatttgaagccattgtagcacttaaattccatatacatcaacaaaccatgtgtccatcaagatagaaaatattaaacagtataaaaatccactgcaacatttcatcaatgcatagtgaaacattacgagtatacttgctgaaacattgttagtggaataaaaaaagaaatggattctcttaataggacgttttcgtaatatgtgggtgatttgttgcaacggcgcgtgtggtggtgcgtgtggtggggacggcgcggatgcgcgtcgccccgcgcgaaggggcgggcgcccgatttgaggcatttccgggtttaatttgtcaaacaccgaaatatctatccaagaaaatggttgcaccatcatccatcgcaacatccaacggaggctaactatatggccgagatcgaccggatcaatactcgatctgttcgatcgaattgggtcaccatctatcacttgctctaccaacgccgatttttactgcatgattcgacgcgaatagacgccgacgacttcacgtagacttcaacaataatccagattatttcagaatcatcatctatatatgttgtagtaacattgctcgattaatcaccgagctaattaagctgagagcccgagatcttaattaattcctagaagctccggtgcattggcgccatgatga

SEQ ID NO: 3610 - DNA, 1501 bp, Oryza sativa
gaggaggaggtcggcggtggcggtggagcgatggagtgagtccctagacgccatcgccacccgctgaagtcgaaaggagaatgaggcatctgtggggggcaagaatggaaattcgtgtgcagaagaggtgggactgaactgctggcgtcaaataaaaaaaacgctttgagattgaactggtgcgtcaaataaaaaaaacagagagagagagagagtatggccctctttgtttagacttataagccaacttataagtcgaaaagtctaagccaaaacaaacaagcagcttttttatttggcttttttgaagccactaagccactctaacactgttaagccaaaagctatattagagaagcttttttggcttatatgagatagatgtatgactccaccactaaatttaggacattaaatccattgacttataaatcatataagccaataaactgacttaaaagtttaggccaataagcctaagcctaaacaaagagggcctatatatacataccctacatagtacagctctattctacaccttatacataccctacatagtacagctctattctacacctccccctagaataactattctacatcccttcccacctcctaggtccagcccatccctccctccctcactcccggcgcaccctcctccccccctccccctctcgatctctcttccctccctccgatcccccctcccgtattccctccccctctcgatctctctctgccaaccattttctctccctcacatctcttatttttcctcctattcttttctttttttagaaaaaaataaattggtgaaactaagacttgaacccatgatctcatggttcatggcaagcttttctaagcaattcaccgtctaatgttatgtgaatagaaaatattgtttgcatgctttgtatgtctgtttaaattgtgtgataacaaatcagttatgttactgcaagaatcataccttattactgtgattcggcagtaatattatcacagaaaggtagtaacatgatacgttactgcaaaatttatagtttgttactacaaaatttataggttgttactataatgttggcagtaacaacatgacgaaatttacagtaacagagaacatgtagagtaacgggtggcactattgtagtaatttttttgtagagctaaaatattttaaatctcaatctttagatagcagtaacgtaaatgccatgccttatttttctaacccgtttgcatcatggcgttcgtaaaaaaaattcttaacaaaactagaaccatcgtaactactttttaatgtcggtactgcgaaaagcagtcgtgttactatacattggccatcgtgttactacgctgttccagtgagacaagaactaaaaagaggtaaatctcaatctttatagagcaatatctctcacatcatatcttgtttttctaatccgtttgcaccatgatgttcataaaaaaacgcttaacgaaactagatccatca

SEQ ID NO: 3611 - DNA, 1501 bp, Oryza sativa
ccacctgatccaataatgatctgttgacggcatgattgccagtagaattgaacaccatgcggccgctgttgatgcgcacggtggcttgggggatggcgatctcgagcacctgcaccgtgccgtcgccgaggaatagcctgggcgggctgtaggagtggttgcaggtgaggttgaagcctgggtggtagcagccaggctccacgcagaacgggtactcgatgctgatcccgcctgcagctgctgctgctgctgctcccgcctgcagctgctgctgccatggcaaagaacggtagcaacagcatcagtagcgaggctgctaaacagcagaacgacgacgacgacgtcataacttctcggccgcttgctaccctctgcatcatcgatctcttccgatgtctgtatatattaccatctattcaaactattgcatctacatactattacacaaacggcctagttggcactcctggaaaaaccattttttcagacgagatacctacaggaggacgaaaattttaccaccactattccgcatgcaagatgggaagggggcaagatggccgtctgcctacgaaaatctatcttccggccgggttgggggaggaggagggggtggggcggcgaaggatgggacggtggcgttttttttttgttcgccgagaacattttcgcaggcaggtggctacaacgcttgtgaagatggagataccgcctatcaaaatcagccaatgtccgcttgcaaaaatcatgtattttcataggtcttgaagtgcaggcggggtggatggccatctggaaaaatcattttggcccgtttgtaaaaaaaaaatgttttctaatagtgtggtgaaaataactataacaacttgtaaatcatttgctggtccatacaatcaatttgaacaatttggttatttgaaatgaataatataagagagtgtaaggttttatattgatataaaaggaaaaaaaatcacaagacaaacattaattcattgaaggctatgatcatttattacaaatatgatggttaaagctttatgccatcagtacttgtaagtactaactaagtactacatatgtcccataacaattgtatttttaggatttaaatttgtctcaaaataattatcataatagagtactaacgatgtgttaacgaccaaatttaatatatcatagattggatttggagtcaaaaccgaagcggatttggaaggagttcgttattctcggaaacagagtacgcatcggatcgtttgcaccggctaataccgaatcggatagggagaagccgatgtagccaattttggcaaagtgatcttagaatcattgtcgggattgatttaaatgttccacaaatattgccaagcatggattgagtccgaagaaggcaattgtatctattaattaggatattctagtagtttcttcatagattttcggtaagagtctgcctaaagtacttgttcgtattttagagttgtaatagaagtggagt

SEQ ID NO: 3612 - DNA, 1501 bp, Oryza sativa
gtgcaatgtaacatagcgtcacaaacagtgaagtaagcaatatcaatgaacactttgcttttatcatgctttgattggttgcttggcttgattttcctttttcccacgcgaagggatagaaaaaagaggttggtcgcagattgttctttttcctgtgatcttctagtgaacaatctttttcctgtgatcttctagtgaaatcgctaatataggaaaatttcctatgtatttcctatgaccgattccagtaatccgaacgatgctaaagtggcttaatctcgatccatacgaaaatgcttctcctcgaacgttcggactgaacaagaaaaatcgggcgggctgactctaacacacgtccttttaagcctacacacatatacctttaacgatatttaaaacaatttttctcgtaaattacttatccaatctacaatccgatcacaccattgtattcgttttacaataagatatcgcatgattatattctgattaaaattaatcatatgtttcaatccattaacactctttgtttcatacgcgatagtgatatgttttaatatatctcttcagcatgtttcacaaatttcgtgaaactacatttcactactctctcctctctctccacctcatacatgcacgcatgtatgcattttaacgagcttcaaaacaatttgtctcataaactaattatccaatatatgatccgatcacaccgttatatttgttgtaattaaatatttacaacaagatatcacataattatattttgatgaaagaaaaacatatgtttcaatccgttaacactagttgttttatatgtgatagcgatatgtttcaacgtgtatcttcatcatatttcataaaatttttaaatgtttcagttgctgattttttgtttcaccatatataatttgatgtttcactcattggtcaactagaacatttgacaaaccaattttctttaggacttgggacgtcggataggaagattcctcatgattgaggagtgaagaatgaagtgcaacaacatgcacatacacaatcgagctgggcgttcgatatttggtgatatattggacgtccgagccgtagtgctctcgcaatccataggaactgaaatccttcattttttcccttcatttaatctgaacgatgctgaagtggctcattcggattgagccctgaatgttttttcatgtcgagaattgtgttcttcttggtatgctagcatatcagcacataaatgtgagagagggcaataaaatcatttgaaaaataaactaacggtcaatttatgaaatgggtaagatgagatcgaaatgaaaaccaagtggatgcaaggaataagataaaatttagtggtatataagaaattgagaaaaactcaaggacacgaaagaaaattttcccttttcataatgctacgctgcaaggttggggaaaaatggaagcatcaagcatgccatgctagagccgtggtcattgatctaacgtgtttgca

SEQ ID NO: 3613 - DNA, 1501 bp, Oryza sativa
gtttcaccaactaaacaggaccatacagagggaattaaaggagacgacatgacccactcgctgaaaagcaaaagcagcaagctgcatgccgagacactgcgtgatacacgatgcatacgcacccaagtataattaacaaatttatatttcctttatatcatcattatactatatattatctgagacctccgtgtagaatggaacgtatatatgattgtcattgactgacgacacaatccattcatcttactacatactagtagttaatttcgttagttaggcacggccgcacgatagggactacttcagtcgtctagagtacatctgtatatatagttagttacaccggagattaattacaaaccagagattaattacaaaccagcaaatccatatcaggatcagcattgatagaacgttcgatacataatctgttgcgataaaacatactccctccgtttcaaaatatttgacaccgttgactttttaacacatgtttaaccgttcgtcttattaaaaaaaacttgtgagatacgtaaaactatatatgtacatgaaactatatttaacaatgaatcaaatgatattaaaagaataaataattacttaaattttttgaataagacgaatggtcaaacgcgtactaaaaagtcaacggtgtcaaccattttaaaatggagggagtatatacagagatggtcagggtggtagtgggcagcaggagagtgcatgttcagttgctgattctgcagctgctggccgcgatggtggctgcggcggaagaacccgcggtgccaaccgcgaagaaaatcaagagctgcaccaccagctgcggtaacatcagcatcgagtacccgttcggggtggagcccggctgctaccacacagtcggcttcaacctcacctgcgaccactcataccacccgcccaggctgttcctcggtgatggcacggtgcaggtgctcgacatctccatccccaatggaaccgtgcgcatcaacagcggccgaatcaatctggagtacgatggccgtggaagcgcaaacgggacatggggcggtggcctcccagatggcgggccgttcttcctgtcggagtcggggagtagcctagtgttgatgggccacgatagccaggtcgacgtctgggggctgggaggggacaacccgatcgcctcctgcagtgtcatctgcccaaggatcccatcagcaattttcgggataagtgcgtgctcgggcatttgttgttgtcaaacaaacatcattttaggctactcatcctatctcatccagattcacggtgatgcaaactttttaaatatctacatggtggaccagggattcaactataccaatttcattaattccaatgtcgatctcattatttttgattccgacagagatccgcaagcgctcccagccttgctggaatgggtaatcagtaattcgacaagttattgtcctagaaattcatctgcccccgagtgtcgcagtgcccatag

SEQ ID NO: 3614 - DNA, 1501 bp, Oryza sativa
ctagtagaaaaacagatatacctgatttgtatgataacaaataggccaatcacaacatcttgaactatcgagttttgcttacgtgccttttgtttgatgccagttgaatcccccaccttcagaagctctgaaaagaatgcacatgctagcatgtgacccaggcataattgcgatcatgaacaaggtagcaatattttcaagtggtgtttctgttttttatgtttgtgtacattcgttattttacagttatcctgttggccttttcagcatagatggcgagtgggaatcatgactgaaatggcaccagtagggtatgtaggcgtcagtccaaaatgcattctaggcttcaataaggttagtataactgtataagctttttactactgcacatatggatacttgtcacacaacaatttctgaggttatatcatcatgtcttcctcattgttaatacagaacatgggagaggaaatatcccttcgcctacgaactgatgacttgaaaggatttaggaaatatgaaagtatcaagagaactctactccatgaacttgtatgcctccttggttttctgctttcatgaaatggagatttcttatgcagatcttccgtttgtcctctgtaatcatgcctattgtatattaaacttgcacttggtgatttcaggcacacatggtgcactccgagcatgatgcaaatttttttgctcttaataagcaggtgattttttttcctagacaatcctttcatgattggctactgtctctttatgtttttgagttaatctgttctttaatacaatgtcaatttcagttgaatgatgaagcagcttccttggactggaccaagtcaagaggtcatgtgctgagtggtcgcaaaatcttcgattcctatgaagacgaatttgttctggagccagacagtgttgttgttggccacaaacttggaggaggatccagttcactggcaagtgctcgtgtgttgtctgggtctgctgcttataagcgttttttgaatgcatcagcggatttagagagttctaaagacagcgttactatacctggaaatgaaattcttgtgcctaacacaaaatttgagcctgatccagatgatgttggtcaagatttttctcaggacaacactaaggtggagccagacccagatgataatgatgacatgaacgtggatgtagggactggggcatcttggtcctcagtttctagatcatttacagaacaagataccatcagtcactcagagcctgaccctgatgatattcaccagcaaagcactgctggttgcctagaacctgaccctgatgattcctcaaatgttgatattcttagccaggagttgacgattgatgggaagcagaatggagaacctgatcctgacgataatggtactagcaaatttattcccgaacctgtaaacaagatggaagtagagactgaattgggaagtaacttcgcagttcagaattctgaacctgatcctgatga

SEQ ID NO: 3615 - DNA, 1501 bp, Oryza sativa
cgataaatttaacactgaacatcaaatcatatatttatattcgtaggccacaactaggctgcattatccaataaaagaaacaataacactctcaaccatcaaatactagtatatgagcaaagatgctgtacacatatgaaacttttggaatactacacagaaaccaaatgtgcggcttcattttaagcttatatattttgagtttttacttacaatgcttgaccattcgtcttatttaaatttattttacaaatataaaaaacaaaaagttatgcttaaagtactgtagataataaagtaagtcacaaataaaataaataataattttaaatttttttaataaaacgagtggttaaacattgaaagcaaaaactcaaaatcccttatattatgagatggagggagtacttattagtcaaaatttaaattttcaattttaaatttgaaattgattttaaagtttttttttatcaaagtttatttttagcatttacttttaattcgttaaaaacacgcatataaaagttttattcacaaatgactttttctttgcagatatgccgatgggcacccttatcatcgactcatcgtagtattagaatttattagagaaaacaaattgcggtaaaagaagggtaagatggacggcgtcagctatatttcccaagtctaaaacgtccagccgtcagctattacgcaatcaccaggagacggacggcgtttataaaccttcctccgtgcatagaatcgtcgtcccttccctccgagtgccgtacggccgctgccgccttctggaacattcgcttgcctccgccaaaaaaaaaaaaaaaaaatccctcctcccctctcccctcgagtggggcgcagccgcctcgctcgtcttccttcctcctccaccgccgcgcgtgcgcgagtgcgcagccgccatcgccgtgcgcttctctgcctcccgatctgcggtgcgaccggtgtgatcgcggagcggcggccgacgagaaggatttttttgagggaggggggcgagtggtgcgacgccgctgacctccttcaattccacctgccccaatctcggttgggaatcgaatcgaaaggtattcccatcccctcctgcttggctgagccatacggggctctgattgattcatatttgactcatattaagcatccagttttattctggatttttttttggcgcgtggtgtagtactactggagtagcaacttgtgtcccaaaataaaattgagggtttagccgccccctgctcattagatgcagtggccttatactttcatattgatatagcaagatagggtagtaattttttttcttccctgtcttgttgataacttcttggtaggtgccactatgatcttctgttataacatcatcatactatgaaattagtttgatggcataacgtgtttttttttcttatcaggaataagatggaagagaagagaatagctcggatttcggtcacttggagaggcagacagctcg

SEQ ID NO: 3616 - DNA, 1501 bp, Oryza sativa
tcatcatccaggatttggctcccagggcgttcagggtgtgcttgccaagctgcgctcatggccaccacgtggtgtcacacctcctgactcccaggtggctccaggtctcgactcaccgccaccgcctagagctatgcatgggtcggccactgcctaggaacgcatgagtcgggagggcaagagaggagggaaaatgggaagttggaggtggcaaaggggactcccttcgcccttagccggcgcaccatgccacacctccctggagttcctccgtcaccgccgctctattgccaatgccccgcctccccgctaacgcattgctactgctgagaagacgatatggggagagagagtgggtagagaagggatagagtgttgggatgacatgtgggccctactcttttaaaagtgtatttgataattgggttgccatgtgggtgtcttggtcatcgaaaattgccgttaatattgttgagagagtcaaattatactagttttaatagttagggtcaagatatatggtattacggttgagggataagaaacacattaaacctatattttagggagtgaaagtgaacttatacccagctttgtaatatgggactattgttttaaggccttggtgtgagcatatgggctgcttaggtgttgggttcaacgggctttttaactgctatgggctttctcttaaaaagttgatacaagtttttctttaatcagcttttatgtacgcagaagtcttaattggaccatgtcgaaaaaaaaaaaagagagtctgaattggacgcaatgtagtccagaaccgccagagcctcgaccaaatctattggatgtggactgccccaaagttcactgaatcagacatggcaaaagagtcagtcgaagctgctcacatgtgggtcgggtcctcattcttcagctatacagtacacgatacaaagcgtgattctgtgattctgtcaagaatggctgaactatcctggaattttcaaatcccttctcaaccagcttgtgctactcgcgtgaaaatatctgttacatatattcctgatcaagtaccgaagatgtgatcggtaatcatgcgtagcgtagcaaaggatgtcaggatgatgataatacatgcacaattcgtagctaatcagcttcaaaagacggaaatcccaaagcaaataggcttattctgccacgtgcctctatcaatctcgataaagcaagcaactactaagctgcagaatgaaatcatggagcacccctctccctcctccggcgcttgtcatcatcccattgctgcgtactaagctacactaatattctgaacccccacacttcgccatggatttttcctcttggaaataactcaaaactctggaccctagctccgtcagaggggccatgcgagatcgagcaacacggcgaggctcatgtcgaggcctgatcaagaacagcagtttagaataagttcaggcacaatcttacactctgcaggtggcccagagca

SEQ ID NO: 3617 - DNA, 1501 bp, Oryza sativa
atctcccaggcatcgtgttttctatcaacagtatgttatagggctcaacatataagcatattaaatcatcaggtctgttcagattgtaaccaaaataaaccttaccaaaatttggcattcttatgtatttaccaaatttggcaacaaactaaatgtagacatttttatttaactttgtaaaaaaaagggtatggttgaaaatattatcaatctgaacagccccatcatttcataatattttaacatatatttatctatcatttttatgatatttatcatacatttattcattcgtgtatttatagcaaaacatattataccatctggtaaatacaactgtgaaatattatcagtggatagtaacacgtatgtagaagtacttaagatcacgcccccgtacgtttgatgtgggatgttagtgcttgcaagattaccgtacatgaaactaacaaaacaattaatccaatagccaaaacaacacaagcatacaaggatgtcaaagttgggtgaataggtggtgaacagattgtgtagctgatgccttatttattgctataaccccaattcttaccatattaatgaagaaaaaattataaagaaataaatatcattggagtatattcgcccatgatctatagctgttcgtagctttgccagagcccttgtagtggagacgtcagcaccggcgctgtctacaggccaacgatgacgtactgtgatagaacggtggtggggtgagaactagagaagaggacagagctggcgaatgtcgaccgggctatacgtgatgtgtgcaagtttgggtttttgtgatcgattttacctggacattgacgatgtagatgtaggcatccaagggacgggtgagttttggacaatgctgtactatatacgacaatgttatagtacgatcgcaattacagttgatgggctattacaagagtaggatggcatggccccccctcctctcctcacaagacgaatcactgtaccaaactcagtcagcaagagttcttccacagatttttttttctagaaaatgtcccaatgaatttcagagagaaatttgcatatatgagtaaaaaaattgtttcactagaataccatcacttagttttgataaaatatcatggtcaaacagaggttgtttgctagaataccaacgtggacgacattatctttggatcttcttcatcctccctataacataggagtgaaaacgggtcgagttcggtcggatctcacccttcccatatcctaacccacattttataatcggaatcgattcagacacggatagtgctgagtacagatacaaactcggataatgtcgggcaaaaatacggaacgaatacgtaccaaaatggatatgtacactatcggttatgaatatttattcagatatcaagttgaagcaacaatcttatatatcacatagacaataaccattcaataatttcatatatccacgatacgattatattatgccattaggacctta

SEQ ID NO: 3618 - DNA, 1501 bp, Oryza sativa
ccgcctccgccccagccttcggctcctccctcttctcctcctcctcctccgccgccgctcccacttttggctcctccctattcgggtccgcccccgccgcctccgccgccgcccctgccacctcctcatccccatctccgtttggcttcggatccaccggcttctcgttcggccaatccaccgccgccgccgcgtccgccccatccatcttcggcgcgtcctccacccccgccaccgcgaccacccctagcgtattcggcgccgcatcatccgcggcatccacccccaacatcttcggcggcgccacctcctccccggcgaccaccccgagcttattcggcggtgcttcctccgcggctaccgcacccagtcctttcggcgccacctccgccgccgccgccgcacccggtctgttcggggccgccgcgtccgctgcttccgcgccaagccttttctctggcgccgccacgggctttggctttggctcagctgcgtcgggcaccaccactgccgcgaccgctgctgcctcgacaccgtctttcggcttcgggttgaacaccggggccgctgcatcgagtaccaccactacttcggcttcctctccggctctagggtttggagcaggcaccggctcggcgctgtttggatccactacctctgcaccactcttcagcaccaccaccgcctcgtccccagcgaccacggccacgaccacggcgtcctttggcttctcatcgtcgccagcgaccgccgcctctgctccgtcgttcggcttcacaccgtcatcggcaaccaccacgaccgcgagcaccgcccctgccttgttctcttctgcatcttccgctcccgccttctccttcacgaagagtagctctgctgctcccaccacgccagcgtctgctccatctactggcttctccttggccacttcgccggcagcacctgctccctcattgttctctaacaccagtgcagcagcaagctcgtctgccacttctctcagctttccgtttggctcatcttctgcttctgcaccggcatttgcttctgcttctgcaacgagcgcatccacaccgtcagcagctactgcttcccccgcgacatcagggtcattgttctcagtgccagcacctgcttcttctgctggtggtttcagtttcacagtagtaccatcgtcatcatcagctgcggctactacagctactaccacaacagtcacaagtgcatcgacatctgcagccatgacaacgccggctccttcagcaacaacaactgctacactatttagccagcagagaactacaccagcttctgcctcagctccatcaacacagacacagtcaatattgtcattcggtgagtgctcatgttcttgttaaaactattgttttattttcagtctaatttgaccataccatttacataccttgatttaccggcagtgaacaattaaatgtcaccctcatgcaagtaaccatttagctcataacatcgcaaataa

SEQ ID NO: 3619 - DNA, 237 bp, Oryza sativa
tttttcttccccccaaattgccaaaacccgcgaatccgcgtccgtcgaagcgggaggcggaggccgcaggccgcagccaaggagaggcaaaaggcgcctctctcgctcgcgcacgccacgccgcgcgcgctctcactctccccccttctctctctctccaattcctccctctcgcccgcgatggcgacgccccgcgccccgccccaggcggccgtccccggaggaggggccggtgcc

SEQ ID NO: 3620 - DNA, 1501 bp, Oryza sativa
attttaccaaactttaaattttgacgtgaactaaacacacccttcgttaaaaaatgtcaagtttatttttagtcaatcaaactaagaaatacatatttaattggagcctacgaaatacaactaaagtacgaataaggggcatagttatttctcttcactgatagtttgtctgaaagttgctagaaacaaaatctttatagcacctgataaacatatactgtactaataattacttcctccctccttaaatgtaaaagattctgactatgaattacatgtttaaattatgaatctggatatgcacaatctgcatatgcacatagatagatttatagatatggtccataacatttagagtcgaagaaaatagtacactatggccctttttgaatcaatgagttattttttagcccgcccttaaataaccccaaatagcctaaaagttccaaacacgtgagctatttcagggctatttggaaataacccattaaaaaaactatctccctcaagggctattttaggtgggacttactgaaaaagtgtcttttctctccctctctcttcatgggaaagtgcattaaaggccaaatagttctcaaaataacccttagatacaaacaacttacagctattttcttatgctaaaaaaatatttctcaaaacctggcctacagagagaagatgaaaacgtaaaaaaaaaaaaaaaactgaaaggtctttgcctcttgcctcctggaaggccagtccaggccgctgagccgaggcggagtgttcgttattataaagccgcaagcgtttccatttccctccccatcttcctcttccctcccctctctctccatcaccagctcatccctctctagcgctcgttcgcccgcccctcccccctacggccctacgagcgccgcgcttctctttctagccccctcttccgcattactccctcataaaggaggaacagaggaaagactgggcagaggagaggacctatagctgagaagaagcagagcaagtgaaggagaaagccccgtaatcttggccatcctcctcctcctgctgctgctgcaactccggctctgcctttaaacagtgcagcccgggcggcgccggccacgacgctcgtactcctagctagcagcggagaacgaacagcgtgcagggactcgcctcgatagcacagtaaattccattccatatcatataccattccagccatcactctccaccggcaccctgcatttactgctcccccatcactcgccccggcttccttgagcgcgatctccagatcatcttttgtgtagcgagaaaggttggtgctcttcttcttcttcttcttgctgctgcagctggtggtgttgttttttttattggcggggtcggtttcctgctctgttttgttaagtcatattgtgctgtcctggatcttgatccgacgtccgtccgtacgcactcacgcagctgacgacggggaagggcggcgtggtcagcatggtgccgc

SEQ ID NO: 3621 - DNA, 1501 bp, Oryza sativa
attttactcaacctgtcaacataatttaaatctctagtgttcctttcttaagatgtctgtcgtctataaagttagtctgtgcttgctgttgtgtcatgtttttcaattacacaaccattattacctgccactttgggtttaactaaaaggtagcttgtggcagatgtgggaggaggctaatctcatgagattgttgaacactagaacttgatgtcgccattatcaactcaaaaaattatttccatgtcagttaaaagcgtgtagggtagaaagatgtactgtgaatgttacacatgcataatgtactgagccttgtggggtatatatagattacaaatgcaagagtgtagggtagagagatgtactgcgaatgtcacatatgcataatgtactgagccttgtggacggtatatatagagtacaaatgcttggatctcaaagaatcatagagacaaaaatcaatcacatcctaccataacaaccggatcatttccgttcatatccatatactcttaacatcggtgatacatgggccgtttaacactggtgcatagtaatatacctaacctttcggttttgcttgcaactatagtacatttttgtttgttttgagaaaggtatcgtctgattctccttctattgattcttttccgatcaagatgtatggattcatatgtctacatacctagattttggtcatgaattaacggaaatgtgcgagagctttatttgcctttgccattctatgagtcagctcatacctagattttattcatgaattaacgaaaatgtgcaagagctctatttgcctttgccattctattctatgggtcagcttgcattttgcgtatgacacccccaccctctttagcagcatctactaactcggaacttaatttaaaagccatattttgacccagacgcttttgggatgcttctaataaccaacgaatggcaaatgatctcccttatctatatcctattcaatcagaactttccgcatcgatcctttttattacgtcttgtttttactcctatattcttgtctagatcctattcaatcggaactttccgcgtcgatcctttttattacgtcttgttttcactcctatattgggatttaccagtaatagtccttcctttagtttcagatccttcaaggcttcaatcctccctcctagaaccctgttccctgcatttgtatgtcaatgaaatgaatgttcgggtgaactgtatgtctatcgttttatctactcccatcatacgtgtattgttggctgtatatatccacctatggatatagaggctggatttctatccattatcttaaaaaaaagatcatacgtgcattgttgtcaatgtctgcagtgcacactttcatttgctagagcaaataactcacgcggtcatgccctcgttccctccggtttgtttgcacttcagttccagctagcatccttttcttctgttgcattgatgccgaagcgagaaggcaagaaac

SEQ ID NO: 3622 - DNA, 1501 bp, Oryza sativa
cacctagctattgttacaagggggttagttacagttgtttattaaattgaactaaggtaaaatgagaactacacaattagttggttgctagttatgaggttatgttttacgcatgataaagaagccatgtaaagtggtgaagcatacaataaatagtgtgagggaatatagaaataatgaggaatgagtcgtttatattggtagtatctcctgctttaacagcctattcattggatcttgatccatggttttactggaaatgatcgaaaattatcatgtcctatatttggagatagtagttgtgctcagtggcgaatctaccatggggcggcagggtctcgagcctccgacccctcactaccaacgttttaaccatggaagtctctatttaagtcccgctaaaattttctgtcatacatctattaaaaaggttatataattttgtatagtttattcaacctttcctttctggatcttcacctggttgttctatatacaatgtgctgcttcgtactatagttaataacttcaattgaagactcaacatctcaaattgattcactaaacaaatcctaggatatcctctcttccagtaccgattgcattgataagttaatatcaaagataatgccgtttagcattaattccttgaagcagctaaattcatcacaatagcatgttaccttacctagcgtagaaagtggatactcgttgatacggtggtcttgttaattaaatttctcactttggcaaaaaaaaatccatacaaaaatgaatatgaacaccaataatttgaggacctggcttttttgaagcctaattagtcctgctaacagaaaaaccacctttgattccctatttgctagaaatttaaccaccgagaaagattttgtacataactaatcgagctaaccgatatttcataatatttttatcgacccatacataaaaaccgatatacatctgacaatcaaaacttacatgtacacatcgccaaccatctcaaggagatatcacttcctccctccatttcaaatatatatatatatatatatatatatatatatatatatatatatatatatatatatatatatatatacctgcgtgtttttaatacgaatttgggccaaattaattttgaaaaacacgtgaaaaacgctggcatgttccaaactttcacaaagccttagaaaatgagccgaaaaacccaggtcagagttctcaaaaaaaagaagaaaaggtcagctatcacaccttgctactcacacaggtcaacctaccaaacatacacaacacagaagagaaacttttagaaagaggagaaaaagaaaatgggtaaaaccccatcagaagccacagtgccggagagggtccaaaccgcaaaaggcgcaagggcgttggcaccgcaagacgcaaacgcaaccaccccggccccgagttggcagaagcgcaccaccaccccagtctcctagagtcccagacctcctcgccgtacaca

SEQ ID NO: 3623 - DNA, 1501 bp, Oryza sativa
cagtctcataaaataatttatactgttttacaaccatattctagacccaatttctataccaaaattttaaagttgaaaccctaccgagcatacctcgatcgatcatgggaccgtcacacggcttcggcgtcgaaatccgggagcaacagccggtgtttctgcaaattgcaactgttagctagagggaaattaatgattgcgacctgttggccaaactaataattccatgaggatcatgacaaggcctgcaactactgatagtaatagtaaatagcaatccctttcgtcatggacctacactactacacaaaatccttggacaaaaacacatttagattgcatacggagtattactggtcgtgtttagaaaaaataagcccattttcacgtacggtcgcattgaaaaatacccacccctctttccctcctacccactttaaatttttccccctttctcacctcccctctttttctcctctccttccctcctatccactttctccacttccttccgtcccgtcctctcctcccctcccctccccttccctctcctcccctccccttccttccctccccgatggtggcaatgggcgtaggctgcggctgcggcagcggtggcgcggcgatcaatgacgcgcgggatccggcaggcggtggccgtccccgcatggatccgtcggccgggcgccctcccctacaggatcccgctctcctcccctcaccttcctttcctccctagatccggcagaggggaggggcgtcagcggcggtgcggccgaagggaagcgcggaggccgccgccgggagcagcgtcctcggccgccgcggggaggccggatccgtcgctggccgctgtggggaggccagatccgtcaccggcaactgcagggaagacggcagcgggtctcgggcaaagtggcgacgacgatagtggtgacggcgacgacggtggtgacggcgtttttgatttttttttgattttttattttcccatgcaggcagtttaagcgcccgcgtgcgggtgtgtcacccgcacgtgaaaatcgtgattttcacagacacctcgttccagacgggtggaagatccacacgcaaaaaccgattccgaccacacgaaaaaaatcgttagtctactagtgttattccatttttagtctctcttgtttaccacaaaataaatttaatttaaattttagcaatcattataccaaattttataaaagtaagagataaatgcattgactgggagtagataaagtgagagataaggattcgatagagcagaagtagtgtatgtggaagtgtgaaatataaatttatttagaacagagtagtgtgtatatctctttataaagaaatactactagaagtatactagtatatctctttagagaagaactgctagtataatacttcctcattttttaatagatgacgccgttgactttttctaacatatttgaccattcgttttattcaaaaattttatgcaaatgtataa

SEQ ID NO: 3624 - DNA, 1501 bp, Oryza sativa
agttggttaatacaaagtcagaggtatatacgcgtgttttcacctgcccagatgcatggtttcttctcctgaaaaaaaattatattctagctctatctgcaggtcgaactagcatgaagcaatcaagagtaagttaaatcccgtttgtttaaaagtttgaatgatcatttgcagtactaaatgagcagaggaatggaagcatgtactactatataagtaaaggccaaaagacaagcgggaaattaaagaacaatagtactttataaacaaacaagcacctctctatcccaagacttgacaccatttaccaataaaaattatcatgacaatctaagttggggttatcaaattcttcgttatacatttaacaagcgcaagcaaatcctgccattttcttttcaacgttgatatgtgagcgctatgttggaagcgaatcatactacaactatgatttaattattttcggccattcccacaactctacgagacataaaacgaggcaaattaattgattattaattattacaaacatgaacacgggcggtctacttatgttttaatgaaacctctatagaaaagtttttgaaaaagaaaaggaacattcagtaatttaggaagcccgctaacgaaaaacggaaaagttgccactgctaatagcccaaacaaacggtgctagctgcaacataacagcttataagttgatcataagttggtcaaatactatttaaaggccagttcttttcgtttatgtttatgcttataaactaaaatttgaattttcaacctacaatttaaatgtgatcgtgaggtttttctcattatagtttatttttcaacctttactttcaaatcgctaataacatgtatataaaagttttatttacgaattatttttcgtttgttaatatgccgtttggacgatggagttcttaaaaatgaactgcatctcatatttaaaaataacagaggtagcacgcggtaaacgataaaataaataaagtactctctccgtcttaaaaagactgaatttttaggtttacatgtccaacgtttgaccgtccatcttatatgaaatttttttatgattagtattttcattattgttagatgataaaacatgaataatactttatgcatagcttatctttttaaattttttcataatttttttaaataagatgaacgggtcaaatgttagacacggaaatcgtttttttttttacgggggagtatactgatagctaggagtaacaaccaaacagttggagacaagcacgcggttcgagcgagcgtcgtctttgtggtgcaatttctcgggggacgccaagccccgctcggttcacgggcgtctcactgtgcggtgggcccatccccagccgtcccctcgcgggccaccactctctgatgctgacaggtgggtcccaccctctcgccctcttctcccctatatatacatatagtacaaaatccccgtgtgccaaactgccaatattctctctgc

SEQ ID NO: 3625 - DNA, 1501 bp, Oryza sativa
agaagttggcaacaccatgccctttccgtcaccaatggccaagctcaagtggatggtgagcagccacgaacaccacctcaccaagggtcaccacagtcgctccctctcctcccatcaccgcaaaagcctccaacattgccatgtctcatcatcggtgatcaagcatcacaggaggggtgcagtggccaacgttgccacacctagtcatcgcataaacgctctgatcccacccattcctgcacctccatgtgggcgggcttgcctcgccggtccgtcactctgtacccacaccgtcgcagcccaaccgagttgcctctcatgtgccaggatgccactggccgccaccacctcaggtcacctcaccgtcgttgccgtagtccctgttaaatatgtgatccgaattttaggcctacaatatattcggattagtttcctagtaggactccatgtcttttcctattaggtgtctttcttttctctcctatatatactcttgtaagccgtacagaaaggggtgacgttcctattgttatttccatacgtttgtaatcaactattcaatagtgatcattgcttgtcagcatttccacataaaattcgtgtctccattgtgcatatattttcgtaccagtcccaatgagccatcgcggcagcccatcaactagatcaagtcaggggaggggtcatttggacttggtctctccaaactccaattagctaatgtcctctctctctctctctctctctctctctctctctctctcccacacacacacatacaatcaactcgattgtcatcgatgctacctcttgcctttgcttggactagggtttgcaagcttgacccaccaacacatactgcagaaagacaatgaagtttgacgacttccttttgtgtaaggaaagggcaaatggcaaacgacatatttacaaacgaaaaataatttataataaaacatttatatacatgttcttaacaatctaaaaacaaaaggctgaaaaataaacttcaataagaaaacctcaaaataaacttcaaatttaagaatgaaaattcaaattttggctgataagtataagcataagtaaaaaataagactgcaagctccaccaatcagttatgggggataaagagggtacgatgaatttaaatccagctgacccctcaggtacaagcaagtagtagatgagcacacattttcctttcgttaatttaatgttttatagtacgctagcattgacttgacctctcctagtgcaacttgatcttcaaattgaacactgatcgacgtcgacgccttaactaagctaacagtgaacaaactcaatgcacactttagtggttacgatggaccggacgtcgacgaatgaacatccggtgtgcacattgccagctggtacgtactggctcaatcatctcaatcgcatataaaaggtagttataagtagcactttgtaagcaggtttgaggcacactgcgaagaatcaaagatggagaaac

SEQ ID NO: 3626 - DNA, 1501 bp, Oryza sativa
gcaatataggggcgaggggcaagatgactgtccgtctgggaagatatccattttaagagctccgcttatatctttgtaggcagcgtgttatctcgtccgcatgagaagattgacctatatagtattcttcctccccgagttgagctttgtagagtttacaggaagtttctctattcaaaaacaagcaaaatatagaaaggagattttgaacttgaaattttcgatgaaattttctacaataattagatcatacatttgcgcgacagcctcaagcacgcggatatggatcctctgcagtactacacatacagtagctgccactgacaggtggaccggtcccacatgtcagtggtagtagcgtcccacatgtcagtggcagctactacatatacagtactgcagacaatccccactgcaagcacgcacatacgcaagcatgcaaaatcgatcgatcgatcgatattaggtcgtcgccgacgatgacaggacactcccggtcgattggccgcgaccgtttgtcaatggaatatctctctttctttctttctttctcgacgagtccaatcacatcatgattcatgcatggccatcaacggcgtgcgtgcgatcgagccgatgcatgcgggcgcttgccggccgcggcggcgacggcgatgcgacaggccggatcgatcgctggtgttgctcgctttttcttccctttccggcgaggtcgatcgacaacgacgacatgaatgaatgattcgtgagtcaaatgtacggtggacgaccatgcaccaatcagcccggctagtgctagtgctagtgctatccccacacgaccactctctcgagttcccctagatagatcctgtttcttttttcttttcctgattcatggacgttttccatcctctttggttatgaaaatgcgccgttttagatattggcacggtctcaacatatatttaattttaacatgtcatttttaattttttatgtatctgtacagctcggaaatacaattttaactcctatcgtaaatatttgcacatataactggaagagcttacgatattaaaagaatgcgtgtttttttttcattttaaaagtttgactttagagatagtatgttttcatggtcataaccagactagcatagtacttcctccttccaaaaatctgagacctattttattctttggtttctctaaaaatctgagtcatatttggagtcactatgtgctaaattaaattgttgaccagaaaccaagaagccattttagtacttattggttgcatgttcattatttttgccacatggtgagtgagttaattgcttcttggttttgatgaaaaagaaataggtatcagatttttggaaggaatgagtagcatataatattatggtgatgtttaaaaaaccaccattatatctctattaatttaaagcccattcgctgctccccatatatatattagcacccaaccattgtcttcaccaaaaaaaaccaagcaattg

SEQ ID NO: 3627 - DNA, 1501 bp, Oryza sativa
tatacgaattgttcattttaacaaggcgcgacatgtatataaaattcaagatgggcacccattcttccgtaggtgtgggaaacgcaaagcagaaggcagttgtcacatgtaattctgtacacagagagggaaagaataaaagaatatcgaacgaatatgtcaaaaggaggcaacacgttcttgtaattttctacagaaaataaagtggtagcaggtttcactgtttcagcatgtctgcgggtattactctcagttttttttaaaaaaaaattatacgtattgcggattgttttttcttgatgtggattattacgggaatgaaaacggtgatggaatttcagcgttgtattacaatgtcattaaatagttaatgggtagatatagaagttgcagaccggatcaaagatgatgacccccgccacgtgcatcgccatcgaggagttgccacatcagtcttggcctccgggaacggcctccccgcgccagctcctcccacacgacacgcgcaaggctcggcccgtccgtcgacgtaatccatcacgacgtcgaagcatgggccggcgacgccgccgatgcccctcctcgtctcccggtccgcggcgccgttcccgggcgggaagaggcggcctggttggtggtgttgtgtggtctcttacgtggtgtttttttttttcatgaagatgaagattaaaaaaatgaggtgatattaacgtatgattgattgagttttaattattataaatttaaaaaatatattaatatgatattttagagcaacttttatataaaaagttttcggacgaaacgtaccgtttaataatttgaaaagcgtaccacataaatcttaatatttatctaactcttattggaaaaaaggagatactctcttgtttcggttacaatatcatgcggatgcggctggagacgcagggagtgaagcgagtgttgctgctgatgtcgggtggtggtctcggatgatgctaccgaggtgaaggcccaggcgacgcgaggaggctgatgccgtcgcattcctcgccatcgatgctagcgtcctggctcttgtgcccgatccgatcaccgtggccaccgtctcctacagaaacagcagcgccaccgctgccacgaactcggcgatcgccgcgtgatatacatccccatctttcccccccccccccccccctatagccacaccgctggccctcccaatctcccacagccgctggatcagtgcttttgtcactgacatatggatctgatgtctccggacctagtgacaaaggcacggtacaatgactagaagaagaaaaggcggaggaggaagtggggctgacaagaaggcacagcaagtccggcccattagttagctaaacagcccacaggcctagtcctacccctaataaataggcccaagtagcgtacaaagcccttataaatcatacctttgtgttagcaaaccctctataatacacatgtaggattttcattttggcaaaaattgtta

SEQ ID NO: 3628 - DNA, 1501 bp, Oryza sativa
tagcttgccctaagaacagaacaagaacttacagccttgtggatttgcatatcagtgtcccgcacatcgcttccagtggagtaccaacccagcacatagaagtcggggaaaaccttcttatctgcacggccacaaccgcaatcacgaatcaaaccctcgtaccactagatttcgccgaaaccctaacaaaaagcgcagaagattcgccggaatttcactcacagagctcctgctttttctcgaggaaggcgcggtcgagggtcccggagacagggtcgaggacgagctcgaagctgttgaagatctccaccgtccgcccgcgctgcaccccgatcacgcacccgaacaccctcggcggctgcccccccgccgccgcagacgaggccccgtcgccggagcacgccgcctgggccttcacgcgggtgtggtggtcggagacgttcacgatgacgagggggtggagcttgaaggtgaggccgctgctggaggacgccgccgcggcggcgcccgcctgcgggtgggtggccacggcggggtcggatggcgccgacatcgtcggagtcgcgagcctagcgccggcggcgagggttgcggcggcggcgacgacgacggcggtggtgaggcgagagagagaggggagggttttgggttgtgcttaggtttccttctcgggctttgttgtacgtatgcgtctcgtgttgggccaattgggcttacttgggcccccatgggcttagaggaaatccttgtgctggtacagtgtattccgctcactccctcggaaatttcgtacccatatcttactatttaactattcgtcttattttaaaaaataattattattatttatttattttatttttgacttactttattattcaatgtattttaagcatattttttcgttttttatatttgtaaaaatgttttgaataagatgagtgatcaaatagaataaacaaaatgtcaaaattcatgaggacaaatttacaatctacaatataaaaagatcacccaatatcgaatctctgatattctacgggaagttcgtggaacttaaccggacaaaatttatttctgtgagacacagtacaaagtctcctattcagtggtaggagactctcagaaaattcggtcacaatttcgtggaacttaacgaaacgaatttaaaactaatcgattgtctccacccttctcgcatcgtatagaaactaaatttaaaaaacaaaagttttcaccgcgagaaaaaaacaaacaaagataaaattaaattaaaattaaaattatttgaaggaaaaagaaaaggtattctcaaccaaccaaaccagccatacgtatatggagtagcacgatctttcacgtgtcctggtcttatcggggtccaactgcttaccgctactactcccctcccacaaagccaccgcgacgctgcacgactcctctctctctcctcgacctcgacctcgaccggaacgcctctcgccggcggcggcggcggaga

SEQ ID NO: 3629 - DNA, 1501 bp, Oryza sativa
gcgccgtgcgtattattcgcagcgtaatgcccatgagagcaatgcattcaggcggtgaaatccctgaagcagagcagcagctcaggcggcctgacctcgttgatgtcagtgttctgcatttgctttagcttcttttgcctttctggtgtattgttccttgtttagtatggaagaatttttgaatgttgtacaacgcattgtccagatgttttgaatccatatgttttagtaacaatttttgccaaaatgaaaatcctacatgtgtattatagagggtttgctaacacaaaggtatgatttataagggctttgtacgctacttgggcctatttattaggggtaggactaggcctgtgggctgtttagctaactaatgggccggacttgctgtgccttcttgtcagccccacttcctcctccgccttttcttcttctagtcattgtaccgtgcctttgtcactaggtccggagacatcagatccatatgtcagtgacaaaagcactgatccagcggctgtgggagattgggagggccagcggtgtggctataggggggggggggggggggaaagatggggatgtatatcacgcggcgatcgccgagttcgtggcagcggtggcgctgctgtttctgtaggagacggtggccacggtgatcggatcgggcacaagagccaggacgctagcatcgatggcgaggaatgcgacggcatcagcctcctcgcgtcgcctgggccttcacctcggtagcatcatccgagaccaccacccgacatcagcagcaacactcgcttcactccctgcgtctccagccgcatccgcatgatattgtaaccgaaacaagagagtatctccttttttccaataagagttagataaatattaagatttatgtggtacgcttttcaaattattaaacggtacgtttcgtccgaaaactttttatataaaagttgctctaaaatatcatattaatatattttttaaatttataataattaaaactcaatcaatcatacgttaatatcacctcatttttttaatcttcatcttcatgaaaaaaaaaaacaccacgtaagagaccacacaacaccaccaaccaggccgcctcttcccgcccgggaacggcgccgcggaccgggagacgaggaggggcatcggcggcgtcgccggcccatgcttcgacgtcgtgatggattacgtcgacggacgggccgagccttgcgcgtgtcgtgtgggaggagctggcgcggggaggccgttcccggaggccaagactgatgtggcaactcctcgatggcgatgcacgtggcgggggtcatcatctttgatccggtctgcaacttctatatctacccattaactatttaatgacattgtaatacaacgctgaaattccatcaccgttttcattcccgtaataatccacatcaagaaaaaacaatccgcaatacgtataatttttttttaaaaaaaactgagagtaatacccgcagacatg

SEQ ID NO: 3630 - DNA, 1501 bp, Oryza sativa
taattaagtcatatcacatcaattgtttttagcctttagatgattaatctacggtccaaactatctttctgcttttctttttccataaagtcatgccaccttactttttacgtttgaatcaacattctacatactatttaaatttaaattatcataaaccatattaatttacttaatttgatgttatctaactatcttgcacgttatttttttattgttatcatactaaatttccgcagcaatgcgcggggtttcacctagtatctcaatgttcacaccacaacacattcagagacaaacatccaccaggtgcccccatgagcggaaactctaatgggcgatcgatcgcccatcccatcgggtagcaatcgccccgcgccccctcccccctctctcccttcacctggtttccatttttttcaccgcattacttttctattttagtaaatttatgcatctaaagtttatacaccttaagtttacacatctaaagtttagagacccaaagtttataagtcaaaaatttatgtatccaattcaaatttgaatttgaattcaaatatttttttttatatatagtatttttatacatctaaagtttatagacctaaagtttatagacctaaagtttataagtcaaaagtttatatacccgtttcaaatttgaatttgaattatatccaattcaaattttaatttgaattcaaatagtttctatatatagtatttctatacatctaaagtttatacacctaaagtttatagatccaaagtttataagtcaaaagtttacatacccgattcaaatttgaatttaaattcaatttaaatttgaattcaaattttatagacctaaagtttataaactttttttatatatatagtatttctatacatctaaagtttatacacctaaagtttatacacctaaagtttataagtcaaaagtttatatacccgtttcaaatttgaatttgaattatatctgattcaattttgaatttgaattcaaatattttctatatatagtatttctatacatctaaagtttatacacctacaatttatagatccaaagtttataagtcaaaagtttacatacccgattcaaattttttatatatagtatttctatacataaatttttctaacttttgtttttttaaaaaaaattagtggtgtactgtaataggaagagaagaagggaagaaggaaggggagaagtaggaggaggtacgtattgcctataggcggaggggtggtggcggatgagtcgaacatggaaggatccgagccgtctgcccaatttaatggaagcttccaagcgcaaccgccgaatcctcctccatcttcggccagcatagctcctgcctggccacccccaggtttgctctcgcggctcttccctcaccggtgcgccgcaccgtccaccgcccgccggagtcgccgtcgtcgccgccgagaagagggacgcagctgccgtgcgcggccgagtggatgt

SEQ ID NO: 3631 - DNA, 1501 bp, Oryza sativa
tgccggtcttgtcgaggagcgcgaagaggacgatgacgccttgctcgtcgtcatgtacgcgcccttgaggaggaggaataagcatgcacacttctctcctcagtcgccgccccctcccggcgtcgaatcttcgccgcccgcacttatctccgccgccgccacccctccctgcgccagatccccgccccccgtgcttctcttcgccaccaccgcttgcgcgagctaccgacggtggggagggaggaggagagggagctgtcgccggtgagggaggagggctgggtgggtctagaggaagagggggagttgggaaaaggagctgaggaggaggtgttgggtggcggtggattttttttaatgtggcgatattttcactagcaatgctctctagtggccaccaacgaaaatcgaatttttgttgacggctgtttaagtgggttgccagcgaaaagttgtacatattcgctgcggctaccagcgaagatccattttcactggcggtccatagcccctcatccctcggagtattttcattgacggtgatcatgtatggctgttagagaaaaaaaataggttgacaccatgaaaaatcgattttttagtagtgataatatgatgttgtagatgttgctaattttttctacaaatttgatcaaacttaaagaagtttgactagaagaaaatcaaaacggcttgtaatatgaaatggatgaagtagctttgaagtttattttaagatatttttaatctagtttcttttttatcattgacttttaagttgttaaaaacacatatataaaagttttacagaaaaaatattttttatcactaataaaccgttaggattataattaataagcttttgggcaatcaataagaccctaaacatttatctcacttgatcagatttggttgtcaaaagtataacaaagtttagccaccaaaacaacccgaatttagctggtccacgatttaacaacgggaggatgttagcaatatagttggaaatgtaatttcataagctatatgtctgcagcggacgattatttagctaccccacgataatagtataatttggggacattaattatagtattattttggagatgtaattttgaattgaaattaaaaaagttagctatattttgagacagatgcagtgaaattaaacagttatatcgttctaaatatgcatgggaagtttcatatatataacatcactgtcatcaaccgacgacccaccgaatctagtgcacaaatatgatatcttgacttgatcagatacttaaatctaatcaggtatgtcgcatgctaattaatagtttcatcacttcagtattttatcctatcctgcgcaacaagattcccaaaacgtgcatggtggtgtagacacgtatgtacagttggagcaagccatgtgagcttgtgttggtcagttggtactaaaatattgtccaatatatgtcttctatggataatttaactatattacgttccgact

SEQ ID NO: 3632 - DNA, 1501 bp, Oryza sativa
ctagatgacaggagatctacaggaggttttgcagtattcttaggagataatcttgtgtcatggagtgcacggaaacaagctactgtttctagatctagtacagagtcagaatataaagctttggctaatgctacagcagagattatgtgggtacagactttattggcagaattgcaagttgagagtccatctatggcaaagttgtggtgtgataatttaggagctaagtatctttctgctaatcctgtgtttcatgccagaactaaacacatagaggttgattatcattttgttcgagaaagagtttcaaggaaattgttagaaattgattttgtgcctacaggagatcaagttgcagatggttttacaaaggctttgtcagttcgacagttggagaattttaagtacaatcttaacttaggaaagttatgattgagggagggtgttaaacatgtgatatgtatttgtgtgatgcacacggcatggttagatggatagatatgattagataaggctagattgagtttgttgtaatagaataggagcatatctatccatccacctgcgccgatctctgtaacctacagcggtggttattatcgctaatataagattaacaaaggtacggcctgagagggttgaacgcttctgaacctctgatgtttgataaacaagacaagaccaagaccaggacggctgggggcggcaacatcagggcgtggattaaccgaggcggattggttccggccaaagttgaccccaagtctaccggcctaggctggctgagttggaaagaattcaatgaatcgattgcgacgagtttaaattctactatacagacacgtaaaacacaacgaaatttctctgtttttgtcatagcttacacgccgaaaacatacgctactactagtagtactagtttttttgaacgtgtagcttgcacacgtaaaacactggatgcaggttgttaatactccgaggaggccgtataacaatcataaaaagcgtcatgtggcgcgaggtacagagttcattgcgtttctgcatgaatcacacacatcgaacgctacgctggacaccacgtggccacgccaagcttagcaactcataccgacggccccacctgtcatgcgtacaggcttgttgtgggacccacgcccgcagccctgttccctgcagagaatcattatatactccctccaatgcacgaacccaaccagagcacattggatcccccgttcccccgaacccaaggtccaaccaaccgcaaactgcaaacatatcacgctccctattttagtaccacctcgcgaaccggaacgcatcgcgtccgataaaaaactcgtcgccccacaccgcgcggcactcggagctcagctcgcacggcacggaacggaacacaaccctccctgtgtctctctccctgatgcgccgccccccatgcggcggccccgacccacttagcccgcggcggcggatgctgcggcggcggcggcggcga

SEQ ID NO: 3633 - DNA, 1054 bp, Oryza sativa
tacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctggcctggcctggcagggcaggcggcgcgcgtgcacgacgtacgcgtcgaatggtccgaaaaattggctcctcacccttgcgcagatgcagcctccttttgccttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcaccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacaatccaaaaaccttattataggcactgtgattttacta

SEQ ID NO: 3634 - DNA, 1501 bp, Oryza sativa
gcgaaatgtaaaaagttttagttttatactaagtcaaattattcaaaaattaattaagtttagtttatagaggaatattaattcatccctttgtttacaaagtatttacaaaccctaaaaaggtgccacattcttgaagtgtattacatcctaaatgtaagtataaaacttttgttccctttagtttaacgatttttttttgaaaatatccattttttttaaaacaaaattgcgtttatataaactagggcgaaaaatttgtgaaaatatacctattctgcagatcggttccgcgggagcgctaccaaagcgcggcgtggagcggacgacggaggcgctcgcgcggaatggggctgtgggaccgagcttgtcgtgaacttggaaccggctcgctctcgcagcaccagtgtgccgaaccgcggcgccatcttttttgttgtactgcatggcactgtgttcgacattgttctagtacttttgacactgttcgtgggtcggttccacacaatgaggacacggtactgatgtatgaacattgtcggacagtacttgaagtgtcggaacagtgctacatagggttgaaatcgctgggcaccgcggttccgtgtttgggaaccgcgggaccgtcgtcgttccgcgttttggagctaggggactgtgatggtcccgcacgactgtaccgcgggatcgtcggtcccgcgttttgaatctgtgggaccgtcatggtcccacatttctgtcctgtaggacggatatacttttgcaaaacctttccgtacatgtatataaaccatacatgtatataaacgtaaattattaaaaaaataagtatatttgcaatttttttctaactaacatcaaagagtaatgcatgatcgaagttaaagttgtcagttaattaaaaataagagattaacatctaccatgtcaaataacgaaacaatgaaaatatatttcataacggatataatgattttcatttcatatcttaaaaattttataaactgtcaaacttacgatagttatttcagaggaaaaaaaacatcggttttatatgttaaggatagaaggggcaccattcttgtgagattattggtaccggtagcctgggactcttaattagtaccaatcacccaatcagccaaccaaaccttgtgttatatattaggataattattcaagatagcttgtcttgttagcctttcttcagaaagctccacccatggacatatcggccaggctagcttcttgtgcgattgaaaacgatgcaggcgtctctcacgttaaacattcttttgtgtaggatatagcaggtgatttatcttgtacttagctcagtagtaacattttacatatcattggcactcttctgcagagaaaagcctgagagttacctgtaaggttattgacaaattataatcgacagtgattatctggtacttatcttatattttcaccggaagactgaacgagttcatccgaacgtattaaaaaggagaat

SEQ ID NO: 3635 - DNA, 1501 bp, Oryza sativa
caagcgagcccgatccacgcgcgcgcaggtgcagcgactgattcgtgggggcaaaagcgaaaccctagtgattcggagaggggaactggggcgggagggagggggagggggaggggagggaagggaggatggggggttacggacgagcgtctgggcgcagtcgtagaggccggcgtcgacgagcgccgccattgactcccgcgccgcctccatctccggcgacggcgacggcgaggctactcggggaaaaagtttttgaattggaatttgtggttcggagatttgtccactccactccgctggcttcacttgtcagctttcgtttcaaaatggatggggtttgcgctgtttggcggcacattttggcccgtttcaaagttgttttttgaaattaaaaggtcaaattaagaaaaaaaatcaagtcaaattaagagttattagtgtgtactccatcctaatagaccaactttatactaagatacgacaacaactctatgttcagataaattggttatgtcaatatttattttattagatgtgtcacgtttttatatgaaattagttttttttccagacagagggtgtgttccaaccaggggttcccaacactaagtgcccgcacggaaaacggagtagcgattagcgggtgattaattaattatttgctaaaaaatttttcaaaaatagattaatttgatttttttaagcaactttcgtatagaatttttttaaaaaaaacgcaccgtttagcagtttaaaaaacgtgtgtgtggaaaacgagagagatgggttggaagaggggctgccgaacacaacctctagtagtgtccaaaagggccgaaccggcatcaccactgtatttaaccaaccagtaaataaggggacccaacaaaaataagcatatgttgttgaaagtttttcaaaatatttactcccaccatctataaatatagggcatttgcaattttgcatcgtcttttccaaacaagtaaggcccctttgatttgtaggaaaaatgtaggaattttagaggatttcaatcctatagaaaaaatcctatgaagtcctttgaaacaaaggattgaatcatatccaagcttttaaaattcccatggaatgagtaatcctatatatattttagaggaaagttagcaagagttctaacctcttggaacattttctctaagtctatctctcaaatctctctcatttgattcatgtgtttttcctgtggcccaatcaaacggccattcctgtgttttccctgtgttttgcaatcctctgttttacaattgtattcctgccagaatcctatgttttttctattcctttgttttttcattcctacgattcaaaggggtcctaaagttgtgtaaggcatcaaacgaatttcatctcaaccttaaacactgctagaaaacgtagagggagcagtcaatgaaatctgtgcaatcttccaaatgcagaaagtagagcacgtccaaatgaaagcaaactagtg

SEQ ID NO: 3636 - DNA, 1501 bp, Oryza sativa
atggcaaaagcgatctcggatcgcggcatcgcttgctgtccatatctggtgagaaaactagtggggagaagagaagcctctgctgcttttggagattcgctttaagttattggatagagcagcactgatcaagtggttaatggccattgttgttcttgagggattctgtgtggaatctggctcccctgattgctgatctgacccttcgagaggttgattctgggttaatacggcagaaactgaaattgtctgtaattatcactagctgtggttcagacttgagaacattgttcttgagctgacgataactctaaggaatgatgtggtctgaatgtgaaagtaaaagataagagtaagttctgtgacaatttgataatccaggtaccacagtactgactgaaattactgaattgtcaagtatagctgacatgaagtacaaaatgtattagtttcctagtatttctttgtccctttgcatcagatgtctgattggatcagtccctatcccggatccagagtttaatagcctcacaaatgtccaaggatgctctttagcctttgttgtagcttcagtgatatacctgcagaagtagcttttgttgtacgtagcaaagcaagattttgtcagtttggctgctctgtattgtctcaaatgaaacaagtttatcagaacataggataaactaatttaattgctgatcttctttgactcctaagatcatcataacttgcaggtctctttacgtatacgcatgtcggcatgtgtagaccatggattaagttaatctgacagccagtattcacattggttatctctgatcgtgtgttaattcactcccaaacatcatacatagtaccgagttacattgttacgtatcgacagtctagtggattgctgatcatccttaccggataaaagaaagaaatcataatcgaaaaagtaaccttgcacagcacgatcatcgttcataacaaaaattatcaggtgtatcaggccttttcaaaatgcagccaccttttgtgcaaaaaaaaacgccgcaaatcgtttccgtcgccgccaaaatgttccatattccttaccaacctatctatcagctcatctttttcacaacccagaaatggtgccaagcattatcccaaaaccaaaagagagagagagaagaaaaaaaaaacccgcagaaatgcataaatcgatcgatcgcctttaattattcctctgaagattctttaactccatcttcacccagcatttgcacgcgcgatataccatttcgccaacatgcataagaacactatataagcatgccttccctaacctctcaaatgcaagcacaaccagcagatcagcatcactaacaagtgacacaacctcgatcgatcgggcgatcaccgccggtgacatccatccagccaaagatcccggcgcattccgcggccaggtcgtagtcgccggagacggggaagaagacactaggcacatagacatttgcatatatagaga

SEQ ID NO: 3637 - DNA, 1501 bp, Oryza sativa
aaatatttgacatttcttatgtttgatacaagtaaacttctatgctggattttcttagtatattttatttacattgattattgaacctcaaaaccacttttactttcgaaacttattaaattggaagagtgggaatgaagtcctttccttttcagctctatgttaccattgtatgaactgagcccacttgtggaacagttctatcatgcacagcttttaactcatggagttcttttccctgaccacaaataatttgtcaccactgcgtcaacaaatgcacacctgcacttctattgttttcttgtagtggggatactgtgatcaatactagaacattaggaagcaccatgatattgtacctactgatcacatgcagttgtatttttttttatgttgtggatttatcagaagaacccattttgttccgctcacagctacagtgctgctttagatttgggctcaattatgtataagagtttccttgcaaactctacttaactcatgcagcatacagttgatcatacttattgttcttgttattggttgactcaaacaattattgacttaaatcattgttttcttaacagcgctatgttgaggcccaatgttgcattgcttcacatgattataaaggtgataaaatagcattaatccaaattcatttgacagttctaaacgtaagatgcacttattttatttttgtcattgtcaaaaaatcgtgttgcatgattacagaggatttccactactaaacaaatgatatgtagtgttaatgtgttatatcaccctgtattgtcatctatgtcttaattttctgttggcccttgttcctttggtgttggtccttgtgccactgggtaaagcttgatagtcaacatttcttaacttcgatttgtttgcttgtatcctctcatctgttaagcataaacttgaagaagtaatactgatatgccaaattcatttatagtggtcgcaaaatataatcatgttatttttttgtttaggtggccttgacatatatctagacttaatgcagcgattcccgaacaatgtgcacatcttgctggaaattgctaaggtttgtttttcttcaagcattctgtttatgttttatgtgctctctgtaacatgtggattcttgatgcattgagcaccatggctatgtcatacttcttattgtttatgtacttcatgtttggttctgctgtgctcctctgtcctgtctataaaatttccttttgttatgtgttgaaattttggagttcctcttaaaattttcatttggtggatttaattcccctccattatgaattgatcctgaatttggagcttattatttgaaggttgaagccatcataggtaggaatgatgaagctatcatgaactttgaaaaggtaaaattaacaagtatagacttggaaccccttaaaacgtaagtatgtggtaaaattatttgcttccttgcaggctcggttaattgatccaaacatcatgacatata

SEQ ID NO: 3638 - DNA, 1501 bp, Oryza sativa
gaaaattttagttgataacaagtagaaaagttagaattttatatacgattctattaccgaagtaaaaaatttctctactaacaaagcacgtgagaaacttctctcccaccgctgcataggaaaaaccatcatgaaatagagtcagcgtggtgatctaatacaataagtcgtgttcgctaaaggaacgtcatagtcaccctaaaagggttgttgccaaagaatcggaggagcacgtggttgcctgggaagcaattgccgatgatagggagacaatgtctccctttaaagatataacagagctattgggaatcaaactaatggtgagatcatttgtgagattcgagattttttaattagctaacaagtatactaaaattgtaatctatgtaatatgtttttaactaccaaatcaacaaagcacccctctattaccgattcatgcgaggaatttgtctcccactatccttaaaaacacttcattgcgaaatgcagttggtacaatgctctcatgtgacacgattaaagcagtatgcttagccactcctcaaaatttaagtcagtgcactcgaatagttatccgaggagaggtgtggttgccgaagaagaagcagttgcttttagagacgtacggtgtctcaactctcaagattgaaaaaattcgaaaaatattgaatatcaaaccaacaaaattatcaattatctgtgatttgggatttatttaatcgctcaacaaatagcaaagttacgatttatatatggttttattaccgaagcacgcaaaaaaaaaatctctcatactcccaccaataacatactgatacgttgtaatgggccaatcccatataattagagatgtgtcaggaaggtgtttttaagagaataaagcagtggatccggtgattttaagagagtagaggtaacatgttaatatgttataacatgccaaacccatataattagagatgtgccatgagggtaacttagagaaaacatagaatttggtggaacggaaggatgacgactctgattatagaatggatagagataaagaaattcatacaaaataattcgctgtaaaatactctcattgtcaatttagaatcggatgagttattttttaatagtacaaatttgaataaataaatctaagttattatattttgaaatagagtatatccagaggatagcctcgacccgatcacccatgcaattcgcagcccaatttcacttgcggatttgtgtgacagtgtgacacgcttactacaccgatataagcggtatacttacccccaaccgcgtcaccgcctcaacttgtcatcagtctgccgctccctcttcctctctctctctctctctctctatctctctcgcccgcttcctccccatttttctcgcgcggaacccaacccaaacccacgcggcggcgtctctcccctagggtttggtccgcgcggcctccgttcaccggcggcggcggcggcggctgcggcgatggcggggc

SEQ ID NO: 3639 - DNA, 1501 bp, Oryza sativa
ttataggtccaaggacttgttaaattgtgttatttcgatctcaaactgcaatgacctcatagggatcctatatagtttgccacatagacgctgacatgctataatcaactatcctacctcgagtgacaagtgggtccactaagagttcttttttctttcttttccgtttttcttttgtttccttctttttttttctctttcttttcttttcttttctcttcttctgctcatggtcatcgtggaagccatctaggggacaccaccagacgagggtggatggatagcggaggccggaggggacaccactatggtggcgaagcaagaagggtgggagaacagcggagcctggaggctaggatggacaaacgaattgtagaggcgctttcgtcaccgctgcctaggaagcaagagcaaacggtggggagcgacatggggacaagggttggtgggatggctatagcaaattctggagcaagctcttgctgtctagtgctagcgaaaagacggaaggagggacagcgccacccgttactatcaggtgccggaagaacaagtcacggctgctcgtgagattgtcttagtgggagggggatatgtgactatcagttggtgtagaattagtgataataccacattagcatccatgtggcatgccacgtgagcaccacatagatcttggaggggtcgtggcggtttgcgacacaaaagggcacaatttaataggttttgggacttagatctgtgttttgagagtttaaggacatatatgacacggccacgtaaagttttaaggactagctgtgcactttactattgttcaaaagaatatagtaatagtagtaggagtttagtacactcatcacaagtgcgttaggtcatatatggcatgacacaactccacgttccacgttggatttagagtttaaaagttaaattagagttatttccatgttggatttagagttatttcaatttgtatatttcatctaaaataaaaacaaaataatttatctaaatattacttatcaatataatcacagctacggttcaccgatttctgaagctgaacacccagctgtcagtcataagaaatcttgatctggagtaccacgggacggtttagtgtgcaaccgtagatccctagatgccaactttctggaccaccatcagtgcgcgtccaaatcagtgctccagcctccatgtggtagcgactctgccattggcgacaacaagggaacaggatgctattgcacagtgcacacaaatggattgaaagaaaaatggccacaaaggctctagctacctctatgatggaatggtctttttttttttttctctcctttccttttgcgtttttttggatgattggtccatagtggagcaagatgccttagctggaggctatccatatccctggtatagcataaatgtcttctgtggcgtaggttatgccaacttacatagtagaaatttaggccctgtttaattctatgggtgaaaa

SEQ ID NO: 3640 - DNA, 1501 bp, Oryza sativa
ttgcatgggtgatcgggtcgaggctatcctctggatatactctatttcaaaatataataacttagatttatttattcaaatttgtactattaaaaaataactcatccgattctaaattgacaatgagagtattttacagcgaattattttgtatgaatttctttatctctatccattctataatcagagtcgtcatccttccgttccaccaaattctatgttttctctaagttaccctcatggcacatctctaattatatgggtttggcatgttataacatattaacatgttacctctactctcttaaaatcaccggatccactgctttattctcttaaaaacaccttcctgacacatctctaattatatgggattggcccattacaacgtatcagtatgttattggtgggagtatgagagattttttttttgcgtgcttcggtaataaaaccatatataaatcgtaactttgctatttgttgagcgattaaataaatcccaaatcacagataattgataattttgttggtttgatattcaatatttttcgaattttttcaatcttgagagttgagacaccgtacgtctctaaaagcaactgcttcttcttcggcaaccacacctctcctcggataactattcgagtgcactgacttaaattttgaggagtggctaagcatactgctttaatcgtgtcacatgagagcattgtaccaactgcatttcgcaatgaagtgtttttaaggatagtgggagacaaattcctcgcatgaatcggtaatagaggggtgctttgttgatttggtagttaaaaacatattacatagattacaattttagtatacttgttagctaattaaaaaatctcgaatctcacaaatgatctcaccattagtttgattcccaatagctctgttatatctttaaagggagacattgtctccctatcatcggcaattgcttcccaggcaaccacgtgctcctccgattctttggcaacaacccttttagggtgactatgacgttcctttagcgaacacgacttattgtattagatcaccacgctgactctatttcatgatggtttttcctatgcagcggtgggagagaagtttctcacgtgctttgttagtagagaaattttttacttcggtaatagaatcgtatataaaattctaacttttctacttgttatcaactaaaattttccaaatctcaatcaatttaatctcactgctagtttgatattcgatgaatctttgagtgtcttcagcctatagacatcatctatccgccaacaactgatccttctctagcaaccaaaccactcctccggcaactaccctcttatagtgagcacacccacaactcatcgtggatcaccatgtaaactcccttttgcaatggacttttgtcgacgtttgatatcacaactacggtattttgcatactatagggatcgttggtaccagggtatatgcgagattgaagtagaaaaga

SEQ ID NO: 3641 - DNA, 1501 bp, Oryza sativa
ccattaataaactagaggagagtaccaatatatataccctatccaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttaccaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccactggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgcctcgcctggcctggcctggcctggcctggcagggcagggcagggcagcgcgtgcacgacgtacgcgtcgaatggtccgaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatacatgcgaaaatcaatctagggtttgcctcctactctgtactgcgccgtcgctcgtagactactccatcccgctcgccggcgtgcacctgcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaaatttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacagctttgacgttcgtgcacgactccacc

SEQ ID NO: 3642 - DNA, 1501 bp, Oryza sativa
taaatgagttaaaccatcccaaccgatccatcataaataataccacatccctttgacttattgcttgggggaattgtcaagaacactgaacttttaatacacctgccactggaagtatcttagatacatccacagcgtagatgagatttattgtcctttgaccaaaggaaaggttggtttaccaccaattacatccagtgatccaggacatttcacaatgtccatccactgagaaactactataatatgtactacaatatagtagaagcagcatgtacaagccgccataatagcatcagcaagtacaacttgtcaaataaagcacaaggactgaactaagtatttttacagataaagcaatgagatgatgcgtaatatgtcagtaagtctagcatgttaagcaaaaagtctaactgtgacttgtgagttatggacttgagctatggacaattcctcactcttaccatatcaaactaagctacaacaagttaaatagagaactgatgatgactgttactttcaacttcctatgccaatctgattttttcggtactaacaagcatgatgatgtgacagtgatatccttttgtggttctcaatagatgattggcaactatgcaatctgaggtgatctgctagctagtacacatgtgacatgaatcttatttggcaaagctgaaaggatacaatttaactgtcccctggttcaagcactttatctgtttatcaacaaaaaaacatccatgacaagttactaaatctctgattctacatagaactacaatgagatctaaggttagcgctcttccaggatgtcagtcaaaacataccagagatttctcaagatgacaaatgcaaaagtttttcacacaagacatgcaactgatttccatatcataatgcttgagaatcaatttctggagggatcaacagaacctaccagaacttttgcagcaagtgacgatgatggccctctcttcgacagctcattgagcgcaacctctgccgccgcatgctctgccagccgcagagtagaacagaaggcggggctttcgaacgtttctccattgaaattaaccgtggccttaaaccgtggcgcgtgatctggaccctcgcggatgcacgcataggatggcagattgaagcagctcctctgagcaagctcctgaagctggttcttgtacatgcctgcaagctgcacaccaagaaagcaaaaaaatgcactcagaaactacgtcacaattacaggtcggtaattgcaacccgaaaaggtggagaatgatcatatcttgttccctcaatgatacaaaaacagcatataccgatgacgcgaagaggcacatacctcggatataattctatcaagctatgaagatgaagctatcaatgttcagagttgagaactgcttttgctcatactatctcctctgtctctgtctctctctctctctaagttctcttttgccattgctatcctcttcttgctgcaacacagtactac

SEQ ID NO: 3643 - DNA, 1501 bp, Oryza sativa
gcccgccggatgggaaggggaagccggctgggaaggaaggaggaaggggagagaaggggaggagttggagaggagagttagagaggatagatctgaggagaggggtgagattcgatctgtctaagttgtaactgtggaggagagaataatggatagggattatatactacgtgtttaattttagtcccggttagtactaccaaccgagagtaaagattcttgatctttagtctcggttggtagtaccaaccgtacgtgtttaattttagtcccggttggtactaccaaccgtgactaaagtggtgatctttagttcctgttattgacatcaaccgggactaaagattctcggccccctgacatacatctgacagaggatgaaccaggactaaagatcatcttttgtctcggttggtgttaccaaccgggactaaagatcaaaatttttattaccgggactaaaaacaatctttagtcccggttctttttggatccgggactattgtggattttgccggaccgaccaaagatagtttctccaccagtatgcatatattcatatatactactccctccgtcctacaatataagggattttgagttttggcttgcaatgtttgaccactacttgtcttattcaaattttttttacaaatataaaaaacaaaaatttgtgcttaaattactgtgaataatgaagtaagtcacataaaataaataataatttcaaaaaattttgaataagacgagtggtcaaatgttgcaagcaaaaacttaaaatcccttatattatggaacggagcttatattatggacggagggagtactaatctaaatatgaaaactacacattttcctgaaaaaaggttgcggtatcacacacatgcattcatatatactactaatctaaatatgatgccagttaattgcatatatatgctccaaaacaataatttatattgcaagtggtagctaactaggacacagtaattacgccaactaataaagctagtacgtacgaactggaaacgatctggtccacacgcgttcactgcctgcgtacctgtcaacggtgtgaccaccaatctcatctatctatctatacaacaaaagagctactccagctagtaaggacgtccatctcatatctccactgttttctcgatcctatatatacaaactatacatataataattccaatggggatcgatcttttattttatttcatttgtcccccaaagcctaatttctcctcttttaattagtactaaacaaacaaaaactttgacaatttcgagtacatactaggttgcgtttgttacaaccacaaaagaaacaaaagaacccgtttcccgcttgtatgtttcccaaattgctaaactatgtagtttttgcaaaaaaaaagagaaatcgttatataaaagattctttaaaaatcatattgtcagaattacggataaggtataccctctacccttggatatacgacgtatactgata

SEQ ID NO: 3644 - DNA, 553 bp, Oryza sativa
atgtaacgccccgattttcgttcgggattaaaaatcatttaataatgcatttcctagaaattaaataaaaagttaagcaatttatccaagtgaattattgggagaattaaaattttccctttaaaaattattggccgggaatattttgtaatattctttgtgccctaaaatactctccggaattttccgtgaattttcggagctcgagaaatagttttaatagcacaaagatcattgcatcaattaaaataaaacgaaaacaaataaaatcctccttttcctcttcttgggccatcggcccagtccaccccgccgcgcgcgccctcctccttgtgggccggcccaagccgcccctccctctctccccgggacgccgacaggtgggccccacctgtcggacccgtccccttcctccagccggcgccgccgcgcccgcaaccgccgccgcgtccacgcctccaccttctccgggccacgtcagccacgtccgtgtgtgcgccgcgtcccccatgcccactcccctctctctcccgcccgcgccccgcgcccgaga

SEQ ID NO: 3645 - DNA, 1501 bp, Oryza sativa
aaatacaaagaagatcagtttggtctgttggctggtgacatcttgagatttaattcaaaggaacttttctgacatctggtaccgactgaattaacttaaaaagaggtttgtgcaggctagtacgaaaacaaagagtgctgacatatcagtcgcagtagtttcagatccgtaaaatgtggctgaatccacatctgcatgactgaatttcggttccctgacatttaatctcacaaattgtagaagatgtgtgttttcggcatggtttggggttgcttgaaaggctggagaatgtgatgccccaccttaacatggagctgtccttatctcggcaactcgatcagttaataatagtttcactttcaaaaatcacatggttcagatgccactaattaagaagtgaacatgctgctgtgctagagaagctaggctgtgtttagttccttctaaagttagaaatttgggttgaaattagtacgatgtgactgaaaagttatgtgtgtatgacaggttgatgtgatggaaaaagttgaaagtttggatctaaacacaaccctagtagtatcataaaacttttcgcagcattagcatcaggccacaatgcttgacagttgacagtatcaggaattcaggaattcgttcatgtaaaaagtacatcacatcaattgtttcagaaggcatgcagttgacatgatggagaggctgtttatctgctaatgtaatcgacagtaacacgcatgcagtatctgcactaattgttactacacaggagtaagattgcaacacgcattgctgattacgactgaatctgtcagaatcagtcctaagattttgggagcacattgctcagggatcattgcagcaataattatatcgacgacgagttccttgcacgcagcagcctcacgagccttgacgcatcatcgatcagtattagtagtagtgtcagtattggtttgggtcgcaagaattgcagagaggcttgcaagttgcaggttgctttgcagctcgtcgttgcttcgcttttgctactagcatactacagcaggagtactaattaacgaacaaattaatagacagttagctggagatatggcctgaagattaaggtgttaggtatcgccgaaaaaatgtagatcagcaagctgcctctgcctgcttaatttgagatcagcagcattccagcctacgactcgtcaacgccagttcgtgattgctcgttgcgtacttgcgtcacgtaatcaccaattgtgttaaagatttcattttctttgagaggatattgtgttatgaaatttttggatgtttatttgtggggttgcaataccggcgttagcttgtgagtactgaagaattctgtctgtccaaatatcatccgcagcgaccaatcaggcccatctaatatggacgcacagacgccgcaatccttttccaggccatattttccaaggaaaaagtctactttaggtctctcaattatggtgagttacatttacaccgctca

SEQ ID NO: 3646 - DNA, 1501 bp, Oryza sativa
ttgtcttattaaaaaaaattaagtaactattaattttttttccaatcatttgatttattgttatgtatacatatagttttacacatttcacaaaagtttttgaataagacaaacggtcaaacatatttaaaaaagtcaacagcgttaaacatttaaagaatgagggagtaattcacatgctcacagcagcattggtaaaaggtaatggtttggccatccgcatcaaccacccgtgctagtaatcttcacgctaattaactgcacagcaacttctgtttcttctcttattttttttttgtttaaattttctttcagttcttctgtccaacgtccaaaagtccaaacatgccaaactcttcaacgcacatacgtacattcctgcctaagtagctgttaaactgtagccgtatgcctccatgtgtgtcgatgtagggtttaccttaccgccggtaaccgtgtggttaccgtggttaccggccttaccgcgaggtacggtaatacaataccacggtaacctccttaaatttaaataaatttaaaaaataatttaaatttttaataaattttgtacggttttttactgttaccgcgcggcgccggtttaggaaacccttgtcatccacatagatgcacacattagtagtactactagtcttctcgtcgtggatgcttgttccatttgatcactcgttcactcacgtctcacgtttatatcggggacggatagctacacacatcaaactaattcatttgcttctctctcaaacaaaaagaactagtaattcatttcatttgctctcactaattgccccgacactccgaaaacgttgcgacgaacgcccgtacgtcttgaccaaatccaaacgaacaacgatccagcaccaaaacctcatgaataatccaatccaccatttatcttcatgcgtgccattcttgacccaaatttgattacaactcgatgcaattttttctcatgtttcgcgccgcctgtcacgcgttacctgcgttcccataccgccagtataaatacaacttctcgaatcttttcttggagaaaattagtacttccttttcctttttttacaatataagtcattctagcatttctcacattaatattaatgtgagaaatgctagaatgacttatatcgtgaaacggatggagtagtgatcaaatgtaacagtggctgaaagtttttaaccaattaaatcggagtcttgtgaggtctgaaatgtgcgtgattaatcagtcttgtggcggcaactttagtttaacccaagtccaattcggatcgcgtaattgacaagctcgtaatccgagtcggattcgatggctttttttgcagaaggggtataaacagaggagaagctcgacgtcgccatcgatggccgcggtggtgcagacgaagcagctcaacaaacagaccaacccttctccatcgccctactagaagcgtgaagagctcggcctcgccggcgactgcgagcgacatggcggcgg

SEQ ID NO: 3647 - DNA, 1501 bp, Oryza sativa
cttgttttccgttaacacgttttttaaaactgttaaattttttgtgctacggcgattgaaagaatgtcaaccaaagtagaggaaagatcaagatggacgtttctaaatcggtcgataaaattagtaataagaagtctttaaaaagtgcgcattcatcatagaaaacgaggatgtaatagggttgctgatgaacttactcaacttgctaaacggaccgcatattgcgcggtttggcgtgaccatgcttcgtcttgtgtgatgcaggctctgaagtaagattgtaatattattacataatcaataaagcactcatttccctcaaaaaaattgtttgtgttttggcaaaagaaatctatatataaattgtttaaaaaattcaagtaaatctatttttcaagtttataattattaatatttaattaattacgtgctaatgaactttctcattttacgtagctaaaaacctcactccaagttgagagaaagaacgcagcctaatgcacttaaggtctcctgttcgagtctgggtaacaccatttttactgatgttcttttattttgtttttctttgccaaatcttaaattagcaaagtccactaaatttagtttgcatttcttttcatttttttaacagccaaacattttttcctattttttcttgtagcgaagtccactaaatttaatctacatttttttcttttattttttaacagccaaatccactagattttaatatgcttcgtcatggaccacgaaattaaattagtaaagtccactaaatttaatttgtattttttttctttttttttaacagccaaatatgctccatcatggaccactaaatttaatgttcagtcctatgtacagtaccatccattgttttcgttttttaaggctctaatccattgctttctttcttgttcactctgaacgagactggccaaagaaatcaattgagcagtggctagtggtgtactggtggtcattgtcatttgtttttcaccttaacaaaagatgaactacaaaaagcttttctacaaatccacatgtatcactgctctctcgtcccataaaaaactaatttaaaataagaaatgacatttttcagttaataaatctagatacgaacatattcagatgaaatacttgtaaataaaaaggaaaaaaaaggaaggaatttgaaaggaatcatattgcggtgatagaggagagacaaaagtgcacagctaagctgttttagtttagtagtgcagcagttgcagatctcccctcatctccagcttctcctcgtcgccggagctcgagatggccggcggtgacctgcgccagcgccgggcggtggcggcggctgacggggagggggacggcaagatggggtcagggggagaggaggcggaggtgaaggggaaggggcaggggaggaaggaggcgctggggtggctggagtgggggcgggggtggatgggaatcgtgggggagttcctcttccagcgcatcgccg

SEQ ID NO: 3648 - DNA, 1501 bp, Oryza sativa
gagttttgctcagacatttttagtctcagtttaggtataatcacgcgaggatagatccgtcgctcagataccgtcctattagatgtcatcacagcaatttaatttgagatacaatcagttcagcaggcagattaacttgcacgcctcattccaatttaatctaatcatctagctcagctagctcagcgatatcaactcaaacaaatcctaccacctgaacatacactaccacacaagagcaaccttaacaacaagatgataagagaatgagaacgatacaataccatcggggggaaaaatcacacctcggaaaggtgcttaagcgtcggatctgacgaggagcagaggcgggcgggggtggacgcggtggatttgagagcggtgggcggagttgtggtggaaaggaaggagaagggcatggagcaccgtgaaacaacaaacaaatcctagatctggtggggatcagagggtggcggcggcggcgggactagggtttcggccattgccgcagcccggaggaggaaaaaggcgagatgcggagaaggggaaatgcggatggtgacgccgccattttatcgcggcgagatgatatgatggccattatgcaataagacccctctattttttctaaaatacgcgccgttttttccgcaactataagagggaaaaggagaaggatagcaacagtagatggtttcaacatttaaatctaccaaaatcaactaggaaaatgtagcagatttatgaaggccccatgtgagaatctcatccactcaaatcacagcaaatcaaccaaatagaggagaaaaaactgggacagggaagaggatgcccaaccttgcaatgggcgacggacaactatccattgtgctcagctcgacggagagtgacggtggagcagggggcacgaccggcaaaagagagggaggacgaccgaggagagccggagtcggaggagaggggaggggcctcgccgccgccagagccgctagggtaaaccctagttttttcgcgagagggagaagtagcggtgaccccatatatcctccgtgagcgggtgcatcactcgagtcgagccaggccgagcagcgaagtccgtttccgtcgggccttgggcctggctgaggggctattttttgcatcctcgtggacaggctgggaggcccggcccgagcaggcaaccaaagaataagttcattttgggtccctctatttgtaggtcagtctgattttcgtcccttggtcgcaaacaaatttgcatggactggtgcgggccaaccaaccaaacagcctcaaagtgaacccaaaaaccctagcgccgccgccgccgccatggaagaagcgtggccgcctctcgcccccgccccggaagctgcggctcctcccggaggaggaggaggtggaggagcatggggcgcggcggcggtggcgcagcggaaggaggtggccgaggagtcgtcggcgcatgcggtgagccggctggtggcgagctgcgccaaca

SEQ ID NO: 3649 - DNA, 1501 bp, Oryza sativa
aacttaacacttcatctttttctgaaattaaatcatgtcagcaccagcagtaaaagacaaacacatggcatccaaaatgcagagattttgatgtaattttagatcatcatgacgcaaacttggctttcgtttatttgacactttcggagaagtctttgtttttcctacgcgaggaactcgagaagaagtaaagagaactggtgtacctatactgggattctaagaacaactagttcgaggaaaggacaaaaatcttgatgaacagatgatgttagctgtcaaactgcacaaactagtaccgtacttctcttgcaatctatcatcatcatttcactatgaaaactaagacagacaactagccaagtgtcgctgaattaggacaatgccactatgtatcaccaagaggaaaaacaacaccgatttctgtattgtatatgatgagcacatgaagccgtgtaaaatgattgtgattctttcactctgaatttcttctgccagctatgttgttcttaaaatttcataagaaaggagcattgtggtttggcattcaagctcaacatcattgttaatttgtgcttctggggtccttgtttatgtatggcccttgtccatggtgcagttcatcttgttgatccttgcagatgcaaatccttctggatggatgctaactagcctgtcttttcttgtgtccttgggcaattcttcatcctccttggtgttttgtctaggcagatgctttcaatgattggcaattggcattaagagagggtgattaaatcatgtcttgtcattgctaatccaagagcctgtttgtttcatcgcaataacagctcatgtcaatgctctactcatcattggtggagacagtctgacctttatcacgctgattactggataatcatgttttatagtaaacaaattggatggccattatcactctactactaatgcatggccctaatagttttacagggtcatctgaaaatactgcctctgaaacgaattactttgtcagtaaaactctgataactaacaattttggtactaaaccgatggtctaagtaagtaggtaattaacatatatactatcagctgccaattacaataacaatatagtcaccgacttaaaaacaaaaataaaatgtggtcattagtgccagcaagcatccacatcattagaacaaggccaaaactgaaagaataactatcagaatctttttttgtgtaatgaagagaaagaggtgacaatgtgatatcctctgaccaacgcctccctcttgatgatcctcatgcatgtgcatgtattacctactcattcccaccaattaaactaattaacaccaaaatgtgagaaccccctttaaatgacaaggggtcacatggtgctgaaaggactggcacaactctgctactgcaacagctcatattgagacaagaccaacatacaggttgcaggaggaagaacaggaggagatattcagagaaggaaagaagagagcaa

SEQ ID NO: 3650 - DNA, 1501 bp, Oryza sativa
tgtttgcaatccggtggggatgatggcaatttcaaagcttccgaaacctgcaaggcaaaagtaaaaaatttcacattggaaagctggcttgatttgaaagccctataattttttttagtataaaatctctgtttcgaagtcaaacaattctgatcctgagtaggaatcactgatttgctaagctgaaatctgaatttgtttttgcactgaaattttatttggaaattgctcaaaaagaaagtccagtacatgtttagaaaattcctgatttcaggaaacttttaagccgaaaacctgagttggaagttgttcttgggaatttaccaattagtgtttttttgtaattataaatacaaatagtaaggacaacaaaatcctcccgctactttgtgacctaactgttggtttgcatattagaaacacccctcgtgctaaatccagtagtttatgttgtctgttagtttttgaggcaaacttctatatttgtgcaggtggctgtgatgggaacataagagaggctcttatgaacttctaattcatactagtagtatatttatgcttattatacatgctgacttgcaaccttttgctttatcatgctactatctggaatcaatattgttctaagtaacaacattttgcctaatcttaaaacaggaagcatgtcactggttaaccggccgctccctgcactgtatggaatttgcacggcctcggcgaagaccagagcttggtggctctgcagagatggcaatctcccatcaacaagtcgaatttcttgcacagagccatcgaatgggggttctgtcatggagttggaggtaatggaccgcaatgagcagacataccatgagaattcttctgcttctgaggatgaggacgatgatgaggaagaggctgtagagtggagcaaagatgagcttgatgccatctcggcactctttgaccggccgatgcgccagaagccaccaaagccgccaaacccggtgaggcagcgacctctcccgctgccactgcctcacaagacacgactgcccaatgctcctgcaccaaagcagcatatcaggctggcagcaagggctgcactttcttcacgctcttcattcagtgaccaggtgtgcaagaacccggaggtcctcattgggattgcccgggagattgcagcgctgccaccggagtctgacgtgtccattgtgctcgatcggtgggttcggttcctccggaaaggatccttgtcaatgaccattcgggagcttgggcacatggggctcccagagagggcattgcagacactttgctgggctcagaggcagactgtcgtgccactcttccccgacgaccggattctcgcttcgacaattgaggtcttggcacgcttcgaccagctgaagatggaggatgcgctagagcagtgcgtcccttcagcgagccgtgctgttcttgaagccatggtcagtgggttcatcagggcaggtaaagtaggccttgcccgaaaactcct

SEQ ID NO: 3651 - DNA, 1501 bp, Oryza sativa
ccgactgggacaccggcttgcatggcggcggcggggtcgttgcacgtcgcccgtgtggcggcgctgcaggtgttggccggtggagatgccgccggatctggggtcgagctcggattcagccgcacagtactgccatcacgaccggcgatgacgaggggacgccatgtgggtgccttctcatctccttggagctcctccccttcttgaccgcctggtcgtggggagctcctttgcgagacggtgaagacggcggcaaggttgccccaggttgttatcgatagtgatgggcggtggcgggcactctctttgtaggtgacggcatgggaggaaggctagctggtcgccgaagtgcagcggtggtttggtcgtgctcgttccaacgtgtagctgtgggggtcgcgctggcagcaggttaggtcgcttggagtccagccgacggaggggcgtcgttgctgtagaggccacgtgttgacattgcctgggagttggtgaggtagcggcaagaggggcattggcaagtgctaggcgaaagccagcccaattcttgggcggcaacggcgatgtctttgggcgttgcaaccctcttgagggcgttgttgaggtgcctccctccccctcttcaaggatcctctaggtgaaaacctcatcctttcgggatgggcgatggcggcgttttgaatgtcgtgaccttcttgaaggcatcgttttggaggtggctgtgtgttcctctcggtgtggtggtgtgtaggcacgtggcggggtgtgttctcttgtccggttcccctgtcccctgctgcttttgcctttggttgtaaatgtctattttactcctcttaatgcaaaaatacgcttctagcgtattcccgaaaaaaaaatcgatcaatcggattgaattgctctggatctccttctcccccacaacgaacaactaggctactactctgaagaatcagaagagatctagatcgatgggtgcctcccacccctttgggttagggttagagacagatcaacgaagagaaagtagtaaaacttggtatttatttgtcttcgttttggactagaacttcctatcccaagcgaagccaaatgatctttctcgttgcaaatctcaccttagcagagagagggagtggggggagccgcccaaccgctactcctcgagcgaatcggagagtcgccggcggcggacagacgacgggaaggggatggtggaggaagagagagagagaggtggggagggagttggctccggcagcggtcgttctggtggcggcgtgagtgcggcctgcggcggcgtccggggagcacgccgggtgagttagcgaattttttttatttttaattttttttattaaaagttttacaaaaataatttttcattttgaacattgccagacacgtggtcgcctcccgccgtccggcagggcgattttgcaccactccgccatcgtacagggcgcccaaactgacgtggcagacggccgttcgctctcgaggc

SEQ ID NO: 3652 - DNA, 1501 bp, Oryza sativa
tggtgatcggcgggagggtcgccatggcgccggtgagagggttgacgagaacgagatggaggttgggcgcctcgtcgacggtgaccagccacccctgcgacgcgccgaacacgggccgtccatcgagcagggcggccgggagcgggacacggagggacttgccggtggcggggcagtagagcgcggcggcggcggggccgtaggcgtcgcaggagtagagcaaccacggcggccgtgccgtcgtggacggcaggcggagtcgccggaacgtggcgtacgcggcgcgccaggtggagcagacggcgccggagcggacgaggtcgtcggggtcggccaaataccccattacggtgatgacgacgtcgtccggcagcgccgaccagtctgcgacggcggtttcttcctccatggcggcggatctgccggaggcggccgggagccctactggaaacggatgaattggcggattttttttttcttgctctgctttgcgactgcgatttgcgatgataaaacggccgagtcggagatcgaactgttcagcccatcgcagtgtcagagactgaataattatctggcatggttgtgatctttcctttcctttcccaactcatactctccaatttttcttacgaaaaattgttattgaaaagttattaaaaaaattatattaatctatttttaaatattgtattaatcatgtgctaataagtttgcttgttttccgtgggaggaaggttcccaactccattaaacaacggaactgctatattaatttttttaccgtcgattccgctctaagatttgtgttgagatattttacaatcggatctagaccctctttttacaagttagtcccattatcgcatgtttatggtagatttgttcaagttacattccagttacatactagttacattgtagttacactctaattacattgtaattagattgtaactacagtgtaactacactataactacattgttatctctatataaattggatataaagttgcatatattattttaatacatatatacaagttattattattatagtatagttctagtgaaattatatactatagttagatttgaaagttttccccttaaaaaacactcgacagttttttagctagtcccttaaacaaacgttattgtagtcttaatttgctcttttggtaaaatgttcagcccatcgtcgagtccgatgataaatttgattcatattcgtgaaataggataccggatatctccacctctcaactattaaaatcggtgcaatttgactcccacgatagtttcactgacgtggcgcctatgtagtggtgttgacttgatcttcgactcacgtttttcacctctcttttttgatttgacatggaaatatctcccatcccttctttgactctttttccttttttatacgagaaatgatcccaaatgaaaaatgaataggtgtggaagttataattgtaaataaaccacgatcgaatcta

SEQ ID NO: 3653 - DNA, 267 bp, Oryza sativa
cattttcaaaaatatgtgggtgatttgttacaaaagaatgtttcaattcactacaacattagatctataaatagtgaaacattatgaatacactaggtgaaatattttttgtggaacaaaaaatgaaacgaattcccttaatagagggtttctaaaatatatgggtgatttgttgcaaaagaatgtttcaattcactacaaacattagatctatacatagtgaaacatttttttgtgaagacacgtggcaggtgggggcagagacca

SEQ ID NO: 3654 - DNA, 1501 bp, Oryza sativa
ttatagttacgttgataccttgtttgttccctgcaaagaaatgtctcagttttgtgtttgcaacgttatatggttttgggatctgctctggttcattcccagctctatccattgcctcggccggcgctcgttacttttggttatttgttgctacagattcttcgaacttaccacgcgagtggtgggactgtgtagtatgcacatttttttttcaaaacaaatctagtacaatctaattgagcatttgagttgatcgctgttggctgttgtggcctttatgcttgtcattttgatttccgcagtgctatcagcctgttatcgaaccattggctgttgcaaacttgcagtacgtgcactatgctattgattgttgtattttgatacggtaaacaacgcgctagtttttccctcagccaaaaaattttgatactgtttgccaggaaaccggcgaaaaaattgtttggtaggagactgatatatctggcttctgggctccaagaaatatcaaatacactctccgttccaatttaggtgcagctataattttccgtgcacaactttgaccgtctgtctaatttgaaaatttttttttaaaaaaattaaaacataagtttcgtattaagtcctactttatgttttatcatctcataataataaaaatactaaaaaaattttcaaataagacggattatcaaaattgggaacgaaaatttatggttgcacttaaaatggaatggagggatggaatggagggagtatatagatggccatgtggggccgcccggcactgcacggcctgggctgaggcttgtcgggccggcacggcccaaccgacacactgggccgtgccgtgccagcccacgtgccgcactcacgacacaggcagggcccaacacgcctcggaataagtctaatttccctccctcctattgggttgtgacatatatatatagctaaaaaagtctattttacctccctcttctttgggctgtggtatataaatagctaataagtctatttaagatccctattctttggacagttacatttatatgtctatttttagtccctatactttgtgtgccgggcctggcctgccggcccattgtgccgggccggcccgacagcgtgccggcggggaggcccagacacggcccagcgatcgggccgggctggcacgggcccgacccaagtcgggccatgctgtgcttgggccgggccaaaaagtcatgccatgggccgggccttcgggcctcgggccttatggccatctatagagtatatagatacgagttgtgggcggagctagaaaaaaaatatcattgggccactcttcacataccatggtgcaaatgcttaattctaagagtgatttattagttctaagcatattaagtagtgtaattagcaaaaaatcattagtgtcctgagtatttatgtcttgtcaagaagcaaagcaagccataagtagtctagccgaggcgtctagctgggcctacag

SEQ ID NO: 3655 - DNA, 1501 bp, Oryza sativa
cttaaaatatatggttaacatgaactttttattttttcatctaatctaagtatataagaaagaaaaagaaaaggacatagaggggatatgtacgtacatcggacatacggacgtacagatccgggacacggccgagtaacgtgggattttttttagatagattgatttgtttttttcttaaaataaaaatctagtggttaaaaataatgggtccaccagattaaatgaaaaccgatggttggatgtttaagctcctcgtgctgatctaggagcgtttgtaggagcgccacgtggcggcttgagagcttttgtagaaagtttaatggacttttagtatataatagaagatagatagatagatacttctcttagcgtattggtggcgtagtgatggtctgactgcaccagaaaggtggacgttgtttatagtagcatccatgtctggacgctgtttgaatgatcgtccatcctattttggttaatcctcctagagaattactaattatttaatttaaatattacttagtattataaataaaaaattcggcacaggacgcgttgagtgcagcgtacgtggaagccttcccagcctgtagcctgatgcttcttccgtccgggcgccgcgtacgcatatccgcgtgtggtgcgtgcggactcggtggccgcacgcaaacgacgaaacagagatcgcgatcgtgcgttgctagcaaggaaccacgaataaatttgcaatatttagcggtgatatagatgcttaagagaaaggtaaagctggaattaagaatgctaacccctagattcctcttgcttcccagcggaaggcatgcaagagattacgcgagtaggagtacatgcgtggcagaggacgcgtggacgctccgcgatgatgaccctgaggcacccgaggttagtcttcgatttaacctgggttcaagtctgtaatcacaaatgaaatctttaatcccgtcagaacttacccacacgagtaataagcacattgcccgtgcccgctgtgttatgtactagctgtacagtgcaggtggcaagcatgcaccttccttacctcgcatgcacgtacgaccaatttccgtttcatcatcatgtcgggcagtaaaagaaggaggcggccgctctggcaaagagacgagccacgtttattttggttgtattgaccgacacgagccttttgttgactccgtaattgaattcgtcatctgatccgatccgaacgaccggacccgatagaacccggatccctttccgtgggcgcatctcttccttcctcgcgcggctcggcgggcggctagtcgtacgtcgcaagctactcgacacgtaggtggcgccagccgcaccacgcctatatatacgccccgcgggcgctcgtcgtcgcacagagagaaaagctaaaccaaactaccaaggcccaaacgtccaaaccccaaacgcatcgacgcttcacaggtagcttggtttgtgcgtgcgtgcgcgcgcatggcgacga

SEQ ID NO: 3656 - DNA, 1501 bp, Oryza sativa
ccggcggagtagcgcccttgcagcccgtcggggagcgccacgaacctgcggaacttgagcggcgaacccgtcttccgcccaggctggagcgccacgccgcacgccgcacgcgacggcgaccgcggcacgtacaccctgcagtccttgctcgtgaacgccgccacctgcgtccccgtctggatcaggaagtagccgcgcgcgtcgtcgcgccccacaccgacagcgcccacttcccccgcctgcaccgcagcagcgccgccgcatctgcgcacgcacgcagcaaaaagcacacgttatttttcagcggccaaaacgaggccatcgagcgcaggtgggtggtggtggtggtggtggtacgagtactatacttgggaggggcgaggcgtccttggacttgacgtagccggcgtagcggcaggtcttgcaccagacagcgccctcgacgccgatggtgaagttcacgttgggtggcggccgggggagccccatggcagagcctcctccaagctgggtgaggatcacgagcaggacggagaggcagtacagctgaagggatcccgcgaacctagccattgttgtttgtcaaatgatgaagctctatacttatattaaattagtacgtcgcaatgataatggaaaggatgagcaaagatggcgcaatttataggctttgtaggtgggccgatcagctagctaggctagataccgttttgtacggatgatgatgatgatgatgatgatgcgtgtatcgcttatatgggggaaacggagctcatcacgtgcatgtacgtggccttttcggtgttgcaagctacctgcgcgcatccggattccgggtagcgccgcttgcactcgttaaaatggataatgttgatcgaattacttgttttgataggcacagagtacatccacttgttcaaaatgttagcataatctagaggccggcccaggttaatcatgttgtggactggttagtacgacctggtcgatcgattggccgatgcatcaagtggtgtggaacatgatgcattaaccattttcgacaaattaattaccaggcaaatttgcagcctgcaaattaaccatgcatgaacagaccaaacaaaagagttttttttttcttttgacaaaatgagaacagtttgagccccatacaagtaacagattatcgtaacattaagtgttgagtgaacgttcgttcgaaaaaataaaatgttgagtgaaccactgcaattaagcaagctaggagaagccatgcatgctatctatgtcaatgcaataaatctagactagcttctttaaaaaaaatctgggtgctccaaagaggttttctaattaagtcatttcttgaactccgcacggatttgtttgttcagaattcaagctgatgcttaaacatcagagaaccacctagagcacaaaatcggcaggcacggcatctagcaacgcagctacggttcatcatgcacgcatgatgaattcgcttccgcttttgctccag

SEQ ID NO: 3657 - DNA, 980 bp, Oryza sativa
gtaatcactgaatgctaatctatcactagtaaaacccatgctaaataaaaacaacaatccattcaccaaacaaagcaaaaccaacctaaccatctccaaacatctcgcattccataaccaagaacaacacatatctcccttccctggtttattccacatcgaccgccaccggccacgtcagccctcacccgaagaacacggtacacgtggcacctaaccattggtggggtcagcacccagcagaaaacgagagaaaagaaatggtaaaaaaaaaattcaaccgtaactgctgtgctgtgtgtgctctctctctctccatccatcaggcctagagaagaggagagacaagcgcctccttctcctcatctccttcctcctccttcccccttcttcttcttcctcctcctcctctctctctctagccatactctctctctctcttctccactcctctgatcgactccgcttcgatccccgccgacgacccccccccccccgggtacgcgcctcgatccgctgcccccgtctcccgggtcgcacctccccccgcccacacccgatcggatcaagaacagcccctcctccccccatctgatcctgggcactgggcggtgggggcgcgccggggagtttctcctggttcttgattcggtggtgcttcccgattgttactgaatcatttttcccctctctttgttttttcagggtttatttttttttctatctctctctcttccctgattcggtgcacgcacgcgcaggaaggaaccagaggtgagtcgcaaattctccgtatccggggaatttttttgtttgttttcttgtgctatattgagattgcgcggtgtgatttctctgatgaatttgttgttgggtcggggggatttttttttttttgcagcagctatctatcgtgatgtccactctcgcggcgcatccaccgttggggccagcggcggcggcgcaggagaaggcggcga

SEQ ID NO: 3658 - DNA, 1501 bp, Oryza sativa
gggttagaactcgtttggacctatatgacatacatagcaagggacctaaaaatgcattttaggagttcagggacctaatgacacaccaggcccatctactatactcttctataaattcatacagtttaacatcactagttttatgtttctaggaccattatatggttaaaatagtactatctctattctaaaatataatcatttatagttatgaatttagacaaacaactgactaagtttatagttgaaaattattacattttgaaacgagcagtacagtactatgtttgcagtgcaattacctgccctgaaccattggcgttggcgttggcgttggcgttgaccctagctagcctcgcactatcattcaacctagccaagctggtgctgatcctctattgcattctctggtgttctggtgttcgttatttgtacttgctttgtcacattaaagactcgactgctcgcttttcaatgcataaaatataattttttttctatttcaaagaataaggcataatcacatttttacctaaagacaaaaaaataataattattattaccttattgtttgaatcatcctaatacaataaaattagagatcttgagaatgaataggttaaaatttaatagtagacgctagttaattacatgcatgcacgcatgccttatattatgaaacatcttaaaaaaaaattatgccttatattttgaaatggttgaagtacaagtatagcattagtacgtactccatttgtcccaaaatggctaacctaatatcggacgagatattttctagtacaatgaatttagatatgagtatgttcaaattagttgtattaggaaaggctccatctaatactagtttgatttttttttatggagggagtaggtaggtgcagcaagacatactgaaggaataaacctattgattttgtggactaaaggtatatataaaaaaatacataaattagcttatttagagataaaatttaaactctaaaaattagtttattttgggacggaaagattatgtacctagagataaaattgtttgttttactttctatcaagtgaaacaaaacaattcatttctacatttagtttttataatctacctgcttaaacatagtacttcttccatttaaatgtctaagacttgtttttcatcaagatagaggaagaattaacttatccactatgtgacaaaagaaaggaatcatatacatgcatgcaaccaattaatattaaaatggtttattggattccaatcaataatttaatttagcataagcatactacaaaggatgggagttcgattactaatgacggttgtactcatcctattgggagaagcaaagtcgtccataattttagacaaatctaaagaccaaaatcctctataattatggacagagggagtatgtttatctaccgagaccaaggataatttgtctaaatcacatcaaccaagacaccatgtacacattctctcacagtg

SEQ ID NO: 3659 - DNA, 1501 bp, Oryza sativa
gctaaacgttatgttttttataaaaagtttctatacaaaagttacttaaaaaatcaaattaatccatttttgaaaaaaaaatagctaatacttaattgatcatgcaataatgggtgctccgttttacgtgccccctcctcccgaacgcagcacaaggccagttcgtgtgccaaaatttttttaaatatacagatacacatttaaagtattaaacatagactaataacaaaacaaattacagattccacctataaattgcgaggcgaatttattaagcctaattaatccgtcattagcaaatgtttattgtagcatcacattgtcaaatcatggcgtaattaggatcaaaagatccgtctctcaatttacatgcaaactatgcaattagtttctttcgtccacattttaatgctctatacatgtgtttaaacatttggtgtgacggaatttttggaagtttaaaggagctaaacactgcccaaagtagtaacaacaataataatatgttgttaaatgtgtaaatatataggagtatatagttagcgatttaaaagtcaatgcttagaaaaaaacttcaatgaaaaactttgaaatcttgaccttagctgattttagatttggtaaacaatgggaagcattgatgaaaatacgtgtcacgtgatttttccctggtttttttctatttgattttgtaggaggaggataagtattgaaaacatttggctgtggttagttgtcacttccatccaagagaagcttttttccttatcatctgagttactgggtatgataaaatcatcggtttttctcttattccagaccattgctcgcgtttgttgaagttaacaatggtgtcccgttgcgaagattcgtgaggtaattttgaaaagaagcaagaggaaatcatttagtttcttgagttacaatacaagtggaagttcaagcaatgcagcggctatcaacatggcaagctcactaagaatcaacaaaatcatcttaaagagcgattgcctaatactggagaaggactatgataagcaaccatcgtaattctatatttgatggagttatttttaaagatcattcaagttttatgattatcctagagattttaacattgaaaatattgaaggttggtttcaatgtttctaaagtactcctccaaagctaatctttagaaacattgaaacattgaaaccaacattgcatggtttacccaaggtaatcagtatcgagatgctaggtaggatcgttttctgatttgtagtatcatagtattgaaatctaccgtaggatcgggatgctatcagatttggaaagtacattatttttatatgtctactattataaaaactgaagatgtttttgccggtactttggtacgtcatccatgtttgagtcggtttttaaattcactcgcttttggaaatccatatccgtgtttgagttagattttaaggacgttcgcttttggaatatagaaagagagtcgtataagaaa

SEQ ID NO: 3660 - DNA, 1501 bp, Oryza sativa
aatagtttgtaacatgcaccttttatgtagatgacaataaacgagtaagcttggttgctcgattatcatgttctatcaatatgctcgaaggtgatacagggtatgatggcattgaatatataatctactattatctatatattaagctacttgcataaattcttaattcatgtcagtgcatacttttcttttacaggtgctctctttggccatcaggtttattcctatctgagtttattctttcatacccaaaaattttctctaggaagtgttgctttgaggtaaataccgattattttttgtgttttagtttagatacatggaaaatgttatctttatctagcatatatatatttataggaatatgttcagctcaactactctatcttctgctgtaaaatattattactgtaaccagggacagatccaaagtgagccaacctgatcatcccccagcaaatactggttatatcttgcttaggcatgcgttttgcaacacaaatatatagaagtccattgtacatttctctaatctactactacttaaaaagtataagatgtttccttcgtccgttaataaataaaagcgataaaaaagttcgattgtaacgaaaaaagtccagcgcggaaaaaaaaaggcgtggcaaaaaaaaaacctgaccgattcttatctgtactaaaaaagcggacaaaaaagaagctcggcacggcaaaattttcgtccgtttcttttttttttcccctttttcggttttattttctttttgccattttttcaccatttttcgcggttttttcgtccattttccttttattttctttgcgttgtttttctcttctttttttttctttcaccatttttccggtttcaacgaaatccaacgcgctatttttggcggtttttttttttcggcctgaatcctagcgccgccgccatggcgatttgcctctccatgcgtttcctcatccaattgattgcaaaaaccgattccccactactctctcatcattttccccttaatttcccattagttcgtcattttttattccgagttttgcggattgcttcgattttgataaaaattcgaaaaatgagatcgagtggatcaaaatttctcaacaattttggagatcgagaaagattcggccgcatttgacggagaggatcgactccgtcatcgtacgggcacggtactatgcgagctcgaccaaattaccggatttggtgggaggatcggctccgtcatggtacgggcacgaaactgttcgacatgggcctacagctccacttgtgggctgagccaaagagaggtaggccaggcaaaggactgttcaagctaggtctacagctccacttgtgggctgagccgaagagagataggtcgagcagatagaggcaacggactgctctaggactagagctgaaaaggaaggaaagaatgaacgttcggtccaaaaaacaagaaagcatttggttcaaaatcaagggagtataatgtat

SEQ ID NO: 3661 - DNA, 1501 bp, Oryza sativa
aacatttgctaatgacggattaattaggcttaataaattcgcctcgcaatttataggtggaatctgtaatttgttttgttattagtctatgtttaatactttaaatgtgtatctgtatatttaaaaaaattttggcacacgaactggccttgtgctgcgttcgggaggagggggcacgtaaaacggagcacccattattgcatgatcaattaagtattagctatttttttttcaaaaatggattaatttgattttttaagtaacttttgtatagaaactttttataaaaaacataacgtttagcagtttgaaaaacgtgcacgtggaaaacgagctagatgggttgggaagttgagggagatggtcgaggtggcagtgccaagcaagcagccaagttggcaaccgaaaatatcaaaggcttcccgcgaccaccaaccccaccaccacacacatccatcctcacgacgccctccaccgcttcgcgaatcttcctccccaaccacacgaaaaccaaaaaaaactcaccttcaccctcgccgtcgcggcgccccccaaaaaaattcacccctttttccccacgctccggtggctccacgccgccccgcccgccgccgcgaccacccgttccaccggcgaatccgcggatttaatctcccacagctccccgtgagatcacaaagaccgggcgggcgtgggctgtgggctgggatggtgggcgacctctcctccctcctcgccgccgcctcctccgcctcccccgtcgtcctcgcgccatcaaaggtgcgccgcttttcttgctctctgctaccccggttggggctgattgatgattgggggaattcttggttttgtaggagctccatggcgtgcacttgccgatgccgctccaggggaagaggccgccgctgcagccgcaggacgctgccgtccacatcgaggccgccgccgccgccgccgccgccgccttccaggggcaggtgatggtgcccggccacgcgcatgccggcgctcccgccgccttccaggccttcgctgtgcccgacatggccgcgctcatcgacgtccaaggttcgtgttgcctcttcgattcctcttcttccttcgttaagtgcatgcacaagcacaccgttggctaatttgctagagattttgttgttcaattgaatttggaatttgccagtcgcagctatggatccgaattgtgagattaggcatgctttttttcccctaaagttagagacagtaatttgctttgcagaaaggagtagaaacaaaattctttgcttgttcatgcgcgcgccttggcttgtggtttacaaatgagacctgaagccattgctttacacatcggttgctttcttctgtgtgcttgcacatagtacaagattgtgtagtgagctttgcaatggtcttttctagtaggatggtttttcatggtatgttacacataattcaggtcaagattaaaatttcctactctcactaagtggtttgtcccgtt

SEQ ID NO: 3662 - DNA, 1501 bp, Oryza sativa
agcttactcgtttattgtcatctacataaaaggtgcatgttacaaactattataatttggaagaattcaaaattaaaaactcacttgtaggagaaataaaagatatttctttatagatcttctcagtcctatttaaggatgaattattctgcacatgttataaaataagttacttttagtacagcatttcaacagttattaactactacttggctatattacgatgtttaaaagacgtactgattttgacgacatgaactggccaaattcctcataaagtccatcaatcacaatatctgacgataactcagcttctgctataatccttttaagaatagttgtaacataactacagttttgatctccccctgcctgtaatgaaaactcaacattttagattaggagttacaggaaaatattgtgcaacaaccagaaaattataaaaatgtcaagtaaaccaaattgtgactcttttgtattatgcatctttctacaacgcacacatcatggtcgtttttttttctgttgatagttttgcgtgagataacaaaagacatttacattattgccagtacaactctccaaaataaaattttgaacgtgtggcgtgacagaacctcccccagcttttctgcacaatcaaatacacacaaatttaaataaacaccaccataaacttatcaaaaaaaagaagagaaaacaaaatagcgctttgccttgtcaagttacaatcacattcatacaactgagaagaggaagattattattttttttaagaaaaacctttgtatgaaatttcctgacacattcatataaggtggaaactgacaagttctctgaactttcctgggtctaaagatctctctgctcattggagctcaatcactagccaagtctcatcacactactgacgcaaacacagcctcctccactactaaatccaaaccaaatctctgtatcggcaacatttttctgaaggcaaccaaccgcataggcttgcctgagattggggactcgatcgatcgatgcagagcagcatacgaattcgagcgcgtggggggcgcgcgtacctggcgagggagaggacgcaggcggggggctcccgggcgaggaaggcgagcttcaggtggaggagcagctcctgctcggcggcggcgggggccatggatttcagatgccgcgcgtggagatgacgagatgagaggaaaagctgctgatttgcagtctgggccttggctttattgcagttttgggaggggacagactgaggccgtgtacgggcaggctttctaaaccgccggggctgggttactgtgccccgacggtaagcacggttaccgtgtggtaaccgcggtaaccgtgaaaatccatacaaaatcgtgtaaaatttatcaaaaattaattattttttaaatttatttgaatttaaggaggttatcgcggtatttatattaccgtaccccgtggtaagcccagtaaccatggtaaccgtgcggttacc

SEQ ID NO: 3663 - DNA, 1501 bp, Oryza sativa
gtccatatagaaatacaatttagaaatagctgaaattcggaattaaaaaatatggaatcttagaagatgagactagagtccatatagaaatacaatttagaaatagttgaaattcggaattaaaaaataaggaatattagaagatgagattagagtccatatatagaaatacaattaggaaataaataactgaaattcggaattaaaaataaagaatattagaagtagagtatatagtccatatagaaatacaattaggaaataactgaaattcggaattaaaaataaggaatattagaagtagagtatagagtccatatagaaatacaattatgaaataactgaaattcggaattcaaaataaggaatattagaagtagagtatagagtccatatactgaaatttggaattaaaaataaggaatattagaagtagagtatagagtccatatagaaattcaatgaagaaaaaaaaatagaaattcgaaataaaaaaataaggaatattagaagttgagtatagagtccatataggaatttaaaactaactaaaatttggaataaacataataaaatttaataaaattaaaagtagagtttagagtcagtataaaaatacaatttataaataactaaaatttgaaattaagaaaaacatgggaagaagagtttaaagtcactataggaatacaatttagaagtaactgaaattcgaaattaaaaattaaagaatattgaaagatgagtttagagtccagatagaaatacaattagaaataataaaaattcagaaataaaaataaataatattggaagaagagcatagagtctatatagaaatacaatttacagaaaattcggaattaaaaaaaagaaatattaaaacacgagtctagagtccatatagaaatatatataatttacaaataactaaaatttgatattaaaaataattaataactaacacgtatataaaatataatatgaatattacgtattagtagttttgtaaagttattgcaaaatttaaaattatgttgtcattttaatatatttgaataatataatgagaaaacatatatgctattatatgggagaaaacataatgatgctagccgcgcaatctgcgtgggccaccatgctagttaattaagataatgagatcaaacgagctaagctggctcgttatccacccctacatcaaaacctggaaaataaaaggttatattgttagtcattttttttacttcttttgaaaagccatcagttattcgtatgtcttaaacaattttattgaaaacatttgtgacacaaaattgataacttcagagcttgatgaccgtcttgatgcttaattatgattgacaagcacgcaccctgaccctggttaggttaggccaatatattcggaggaaattaaaaaagtaaataactcaatgagaaagcctgacatttcacatatatgcagccttaatgcaaaaggaatatagaatattatatt

SEQ ID NO: 3664 - DNA, 1501 bp, Oryza sativa
caaatgttttcaataaaattgtttaagacatacgaataactgatggcttttcaaaagaagtaaaaaaaatgactaacaatataaccttttattttccaggttttgatgtaggggtggataacgagccagcttagctcgtttgatctcattatcttaattaactagcatggtggcccacgcagattgcgcggctagcatcattatgttttctcccatataatagcatatatgttttctcattatattattcaaatatattaaaatgacaacataattttaaattttgcaataactttacaaaactactaatacgtaatattcatattatattttatatacgtgttagttattaattatttttaatatcaaattttagttatttgtaaattatatatatttctatatggactctagactcgtgttttaatatttcttttttttaattccgaattttctgtaaattgtatttctatatagactctatgctcttcttccaatattatttatttttatttctgaatttttattatttctaattgtatttctatctggactctaaactcatctttcaatattctttaatttttaatttcgaatttcagttacttctaaattgtattcctatagtgactttaaactcttcttcccatgtttttcttaatttcaaattttagttatttataaattgtatttttatactgactctaaactctacttttaattttattaaattttattatgtttattccaaattttagttagttttaaattcctatatggactctatactcaacttctaatattccttatttttttatttcgaatttctatttttttttcttcattgaatttctatatggactctatactctacttctaatattccttatttttaattccaaatttcagtatatggactctatactctacttctaatattccttattttgaattccgaatttcagttatttcataattgtatttctatatggactctatactctacttctaatattccttatttttaattccgaatttcagttatttcctaattgtatttctatatggactatatactctacttctaatattctttatttttaattccgaatttcagttatttatttcctaattgtatttctatatatggactctaatctcatcttctaatattccttattttttaattccgaatttcaactatttctaaattgtatttctatatggactctagtctcatcttctaagattccatattttttaattccgaatttcagctatttctaaattgtatttctatatggactctgtcttttctttttccctaattaatgtgagaatttatagaccatgagagcaaacatggaggcttctttttctattcctttaataatataatagatgagcctgcttggctcgacttgctaatgttaacaagctaaaaggttagcttgctcattaaaattataagtttgagccaattcgagccaagcattttgtc

SEQ ID NO: 3665 - DNA, 306 bp, Oryza sativa
ccctcggggagacagagggaggggtggccacgtcaccctcgggcccgcccccccacccccccgagggggtcaggccacgtgggtgaccgcggctgcccaagcctctagtcacgatacccccggtcccatatcaccgacagtagccgccggcgttacgccagggcgatcacccccctcgagggaagcgctcgggcgtgacgccactccttaggcctggtgacaggcggggccggtctctacaggcgggcagaaacccagcggtcgcaaatcgcgcgcatcggcaagggaaaaaccgaccgacaataa

SEQ ID NO: 3666 - DNA, 1501 bp, Oryza sativa
gtcgatatctctgactccatctgaaatatctatacattttacagacaattgtctgcatccccttcatgagtggcgtgcttgagctgggaaccactgatccggtaagttcattggatcactcagcacgaaaaactatggacctatatatatgtagctagctcaatcgcctagtgatgatcgaccaacataagagtatactagtatgttataacagagtatcacatgcttggtatatgttatagagagaacctattatatgtcctgagtttatcacaggtctacgatttgtcattgattttgtcacgttctataatatgctatcgattttgcttaacttttatgatttaccataaccgtcagtttaaccttcgtttgtattgtatttttttcaaaatatgataaaaattgtaaaatatctgtcggtgacatgggaccgggggtatcgtgactagaggcttgggcagccgcggtcacccacgtggcctgaccccctcgggggggtgggggggcgggcccgagggtgacgtggccacccctccctctgtctccccgaggggtcgggccgctcccgtttcggccccgagggttggggcgccccgaccccctgtggtattggtgccacgtgtgtgggttaggtgggcacaacggcgctcacctaaccgcatttatagcggattggacgagcgcgtcacgccgcatttaatgcggcgcagcgcacgtttatccggtccgtgaccagtcgcggtgtgtgaccggtcacagaccggtcagatcgcgggttaggtggcaacaggcggcctgtcacacgcctcgccccgtcccgtcggaatgatgagagcttcctggctctcgtccctagccggagccggcgtgctaactcctggagttggtatgtcagtcccggtcagattcattccaggcttcagcgcaagtatggcaaggaagtcgccggccattaaatgaagtttgaaatgggcgtcctccgggaaagctgacgagcggggcaggagacgtgcgctctgcttgtcaaaggtcacttccggctgtagactagccctcattgtaaaaagcatgtttcctttcttaggcagctagaggcccatgtggtgacccctgaccagataaaaaggaggcccaggcctaagagagaagggaggaagacggggggctagagcggaaactctgtctggctctccggcactctgtattccttcacacacagatccaccagaacacaggagtagggtgttacgcttctcagcggcccgaacctgtctacgtcgcccgtgtcttgtgcgcttcctttctcgctgacattccttagatcgagggcgaagaatctcacttagcgcccccggccgaaccggcaaagggaggcctgcgcggtctcccggtgaggagccccacgctccgtcatctggcgcgccaggtagggggcgcgcgtgtctttctaagccctcgtcctctttcgtgtgcgccaagcttctcccgctcagcccaa

SEQ ID NO: 3667 - DNA, 1501 bp, Oryza sativa
ggacctgaagatgtggagttcatgtacttatggtttacagaagaagcttctgtcctcgcttgcagacatgatatttacagaggctgcttgcatgagggatgcaaatgcattgcaaatgcttcttgatagctgcagaaggtgctactgggcaatccgggaaccaaattcgatcgataactttgcccttactggaacaaagagatccttgggtgaaattaatgctctgattgatgaactcttggttgttgttgaacttctgttaggatcagcatcttccacagcagcttctgatgatgttcgctgcttgattggatttgttgttgattgcccacagcctaatcaggtaatttggccattgattgctagacaaactcatgctgatgcctctactgtttcctcctgagccattgtttgaatggaaatacccaaccttctacatattttatacgcagatgttcttgaactaaagatcataatggtactactactacctaatatctagtgagcatatacactgaaaactgtaaagttacaatttgatgtatttatttccatacatcatatcataaggataagtgggtattattttaaccgtgagtcacaacaaatttgatggtgcatcagctctttgctcttaaagcttgtctgtggttactccttccagttccataattcttgacgttttggatgaggttgaggtcaaacaattagaaccttgactatcactaacttttaaaatatttaatttgaagacactagaacatgatgcatatattagtttaaaaatattttttaaaagctaaatatttacttattttttgtatatattataatagaaaatcatagccaaagattttggagatcatgttgttgtccaaaacgacaagaattatggaactggagggagtacgtgctatttttctgttgggatatatttatacttgccttgatcatttgaaagacaatacaaatgtgtagcagtctagggccatcttatctatatagctcatctgacaatatagtctaagctgtttcttgtgatcttaacaatgtccttgttaacaggttgcaagggtgttgcacctcatctataggttgattgtgcagcctaacatttctagagccaacatgtttgctcagtcattcatatcttgtggtggtgtggatgcacttctcgttcttttacagagggaagctaaagctggtaacaacagtattttggacaattctgatgcacttttaagtgaaaatgattttttaaggaatgatgattcagacacaaaagctgctagtggtgaagcaaagagccaggatgatcaaattcaatcagttgaacttgaacagcacgaatccatccttcatgaagaacatactgagctgggatctacaagcacaaatgatgtgccttgtgagattttgggatcaagtataggaaggaagttgtccagttctgaaaatcagctgctaaagaatttgggtggcatcaacttctcaattactg

SEQ ID NO: 3668 - DNA, 1501 bp, Oryza sativa
ttttcatggatgtatagaccatacgcttgttttgacaatacattggagaaagaagaacagattatgtttaccttttctatccatgtgagaattaaggattaatacttagatgtaagcatttggctaaccttatgaggagaaaatgactagcctgccaggcgtgcctcttttgttttgttaaagaaacataacatgatgctatactgtaacatagaatctgtgccgatgggtaattgggtgaatacgcctttagtagtagcagtctggctaaggcgccaagcagatgccatcatgctaatgtgtgagataagttatgatttcttatatgtttgagatggtctataattttgtccgatggtgctatcaaacatctggtaacttttttccgtacagttattagtagccgctcatttatttggtcttctgcttatttctagctttcaatacggaggagcatcacctggaagacaatgctgttctccggggtggagatgaccttgatgacgattttattgaagaagaagaaacaagacacaccaaggcaaagaaggctaaacaatctagttcaaaatctaccacagagacaggcgatggtgacaagaataccaacactaaggcaaaagtaaaacaagctccgaaagttgtaaaattctttggttaaactatgtaacctttgtagcttaccagtaatgatacagaagaagatccttccgaacaattttgtctattgggggatcacggttttgtaacgtacaacgggaatttaatatgatctactgttcaatgttttgagaagtgatgttcttgggtgtcaacattgcgtttgtgttgattcaaggagctctgccagtctgttaacgcctcttctctgccagtctctagttgttttgttaccatcatagtcatcaataattcgtttaaataccagttgaagaatctagtgcgcttgacgactcaaataaaccgcgttatagatttctggagcagtatttgctgccccaaagatgaacttctgaagcaattgcgcattctctgaacttctgaagcattcagccgctgcagacaagaagatgagtttgtgactcgccgtgccatgcctgtccgttgtctcgcaatcacggcgatgggtggatgggtggtggagcgcatgttggtctgggtctcgcgcacgtatagtagtgaaggccctgaagggggatcgttggtcaaacgcgcggcccggctcctcctcctaacgtggcggcatggcgccatgcaaagctgcttatctatattttgcctgcttcccccctctttcaggccttggagatcgatctctttgccattcgccatcgccattgcccaccacctcctcctccacgccgatccgtctctcctcgtcaccgccgtgcagagatcgaaacctatcaaccatggtgagtatacgatcgaccaattacatatgccaatacgatcgacgtctaactgctgctgttgctgttgctgcttgatctgggcatgc

SEQ ID NO: 3669 - DNA, 1501 bp, Oryza sativa
ttccgcatagcaacagagcaactcaataaaaaagaacttagaacagagaaatcatacctgatagtgtttttattattgaatgggtgaacaagaatagcaccagtttcctcctgaactcttttagcaacagattctcttgattcaatggagacatcactccagataatatggccaccgtaccgcttaacattgtcaaccttacatgccggtgcatttcttggaatgacaatgtaagcaggtattccgcgtagctttgcagcaagagccactgcagcagcatggttcccactgagaagaaaccatttcaatcagttcagttcactgtgatgcttcttaggattaggatgccaggtaacattgcaataactatgaagctagcactaacctgctatgcgtcacaacgcccttggatgcctcatcatcatcaagcgcaaatatcgaattggaagcgcctcggatcttgaacgcccctctacatcatatattcatatccccacacaagcaattagcagcaggtagaaattagcatggcagatatgccaaacaacacgcgggggggggggggggggcagtgactctcacgccttctggaagcactcgcacttgaagaacagctgcttccccactatggcatcgatcgatgttgatgacagaacgggcgtcttgtgcacgtatggtgcgatgcgagcctgcgcctccctgatggagtggatgtccgcggcatagccatggctttctgcgccatcgccgccacttccacctctgctccccatcaggccctagtaagtactcgtgttagctagcaccacatcaattctcaatattgtccttagctcagtgatatgggcttcaaattcagtgactgaaatactgcgcgcaagatagtaactagtattccatcaaaagaactgcacaaaaaataaaatctatcccattacattgaggggagggcaaacgcaaatggggactacatcagtggagtagtaactgcatcaccaggaaggcaatcaacagagaaaaatatcaagaactatatgattcgagcaggcaaggtgactcaagaaactaaccgaggatttggaggagcaggtgcagaaatcttgcgcggagaggaatccgaagcaaggagaaatcgcctaaccttgagtgacagtccgggcggagatttggaagttttttttttttcctatttgagcgatgaaatccaagaacctaacgagaagaagatggcgttgtggtgattgacgacttgaggggcagccgtgcagcctgcaggccactgtcttgtttgggctaaacttatctaatgggcctccattgttgatatctacgagatcgtgtttccgagcccatttaaagcaatttgcatctgctcagcccatatcgggtattaaccctaccgattctgagcaagaaagtcttcacctgaatctttcgcatttctgcttttacgtttgctccctggaatactagattcccagagcatcgagctgcgacaagt

SEQ ID NO: 3670 - DNA, 1501 bp, Oryza sativa
atctaaattgtaaaatacattaaaaataaaaaaacactcgctaaagattaaaagatcgagaaaaggaaaacgcgccagcaaatggggagagcgcaaaaaaaaaatcgaaaaaacatatagcaacccccataaaatagtacagcatttgttacattttgtaaggttgagttcgtttcaacatctctgttttgacttttccttattttcaattaacattcttaatgaacggttaaacaataggtatatttatatatttttttataatttataatagtttatatttaattaatcatccattaataacttatctcattttacgtaccagtaataatcttcagttagaaaatgaattgaaccctaatcatccgttaataacttatctcgtttttcgttttatataatcgttttacccctactgctataacgacatacattttgtaggataggagtaagtacaataaatgcaagttggcaagtgcagcagtcgagcaacttgcctgccggcgctcgacctacaattggcaagtggtgatcagccagttgggcctttttttcgtggcacccaatttggacaacgacgcagaggcaagggtccgcagcaaggacggcgacgaccatgcagaaaattaaacgcggtgcggaccgtgcggtagattcttcgcgtttgctgcatgcgcgcgagggaggaagaaacaaaccacacggtgagaacggctatgtagtaatctctgggactctgccgactgccggacgatggcatcttcgcgtaacgtacgtaacgaagaaggaggccggtctggtccaagagcctcatcgcacgggagtagtactgtagtatccaatcagcctgatgtgcgatgtgcgacgccctggtcgtcgatccacagttccacacatgaatttgctgcaagtttaactaatgcaccaaaagtgcatatactattagtgaactaaaacatcacatgacaacagtgcattagtcgtagtacaatttaaacagtaagattccctggaaccaaccaacaacttctctgcctcgagaatcgagatacagagcacatgccaaaatggtatacaaaacgatatcatcgcagagccgcaacagggcggtacgtaccgttttggagaggccgcgatacaagcgatcggcccgccgacgccgtcgttagtcgtcactgatgacgagcgcgccacgctcctgcagtctctgacaatgattgagccagcggctggaagcgccgttgttgctgacgagcattctaggaagggcggatgagcgcgagggggcgggaacagatgtgcgtccgtgtcagccctcgaatctctgatgctctggatctgcgcgatatcagcaatgggaattggaagctactgatgtaactttttccccacatatttgtcttcgactgttcgtgcgtgtgtgcctataactctatatataacctgtaaaagtgtataggctacggggcattaaaaatcctagaaatagacaagcataaac

SEQ ID NO: 3671 - DNA, 1501 bp, Oryza sativa
tgccacactcttccaatcaatcaaacggtgcagcctgcagcaagctacttccgtttatccacaactgcaaggtctacaaaataaatgtcgaaatctcccggcagtgtcatatatccggccggtatcacctccctgtccggctatctccatctcatccagccgctaccgtcctaaactcccaaattaaaccagcgagcaacagtcagccaatactacaagatccagccactcagcctctctttcgtggcacccgatttggagaacgacgcagagccaagggtccggcgaccatgcagaaagttaaacgcggcgtggtgactcttcgcctttcgcggttcatgcacgcagggaggaagaaaccacggtgagaatgagaaagttaaacgcggcgtggtgactcttcgcctttgcaccattcatgcgcgcagggagaaagaaaccacggtgagaactgagaacggctactgttgtactccctcagtagcataaaaaaccaaactataatgttagatatgacacattctaacactacgaatatatacatacatatattcatatttgtgatacaagaatatgtcacatctggtataagaatatgctacttaaaaattaagtttgaaaatttaaattttgacttttgcttattgatttttagttctaccgatggggctcttatactccaactcttgccctgtttagattctaatattttttattgggtgaataggcaaagtggtcctccaaatttcatctgaggctcagtttagtccttgatatttcaatctatccatattagtccttcaagttttcattttagttcaaacttatccttaaccaacaactctcttcataaatgatacttatacccctcatcattcacatatataagagagaaattgcatgcttgaattttttttatagataatacatagtatattatgtaaaacgaaaaaaaaatatgtattagcaagtgtatacgatagcaattgcttaagtttcatgtgcacatgttgaaataatgggaagtagatctgtaatgttgtttatttatgttggctttctcttttctagtatatagatgtatataaattgggggcaaaaaggacattttctaatagaaatattgactagaaatagccatatggcatattaagtggatccaaggatgatttcaagccaaaacaaatatttgaagtatctatgtggacaaaataataggtgaaggatcaaattgagccttcgctgaaacttgaggggctaaattaactattcacctatttttcttcaaatttctaactttttcgtcacatcgaactttcctacacacacaaacttttaacttttccgtcacatcgttttaatttctttaaacttttaattttagcgtggaactaaacacagcctcattattgtgtgcctatataaagcctgcaagtctagaggctactgggcactagaattctggaaggtagacaagcataaacaaccatatatcagtgac

SEQ ID NO: 3672 - DNA, 1501 bp, Oryza sativa
ttcctcgtccgtgtcgtcggttgcattctcgggctgttctgagctgcaacctaagttaaggtaaataagtcctctatttattttaaggattgcaatgattcatatttgtcaccgtgggtaccaacactatgtcctgggactggtactgtgatcgcggtttcgtaggaagcggttcgcgccgtttttcctacgacacgctcctgtcaggtgccgttgtacggcggtgccggattgggagtgacaagaacccaatacgagattaatcaaaattcaaaataaaaataaaataaaatccaaaatagaaaaaaaaaaggagagtccaagtataaatacaatttaaaaatatttaaaattcggaattaaaaataagcaatattgaaagaagtatacattaataacccaatacgagattaatcaaaattcgaaataaaataaaataaaatccaaaaaaatacaatttaaaaatagctgaaatttggagttaaaaataaggaatattaaaagaggagtccatataagaacccaatacgagattaattaaaatttagaataaaaataaaaataaaattcgaaattagcaaaacaaataaaagaagagttcaagtaggaatacaatttaaaattagctgaaattcgaaattaaaaataagcaatattgaaataagtatccatataagaacccaatacgagattaattaaaatttagaaaaaaaaataaaataatatccaaaattagaaaaattaaaagagagttcaagtaggaatataattcttaaacaactaaaattgaaaataaaaaataaaaatattaaaagaacacaatacgatattaattaaatttgaaataaaaattctgaaattagaaaaaaaataagatttcaattaggaatacaatttataaataactaaaattgggataaaaataaagactattgaaagaaaataccatctaaaacacatgacgagataaattaagtaatagacctataaaaggagtaaagtggtggaggttgatacgacgtataaaaactgttaataaaacaccaaatagaatcctaatgacgattaaaatgagggatgacaggcagaccatgaagcaaacgagcaaggcagtgccgggacttctagaaagtaaaaaaaaccattgataattatattcgatttttaaaatctaaataacaataaaaaggagaagcagcggacggggtgtataggagtatagttatagagccgccaacggttgacgggacttctagacaaaaaaaaaattccaacgatagttatgttcgatttttagaatcacaatgacaataaagagtagacggcggacgggccatgaaggagcatagtggcatcgttggacgagacttctaaaaatcataaaaaataaaacccaaacaagacaataaactttaaaaactatagggtctaatttttaaaggttcggaacttctaaaagtaaaaaaaacaatgataatcatgttcaattttaaaatctcaa

SEQ ID NO: 3673 - DNA, 1501 bp, Oryza sativa
tggagtaaataattaaatatgatgattatatggaggatatataatgcatgaacattatctttgtttgaaggcatcatggttgacatgccatgatcgagcagcacagcatggaaatatataggtaccttagctaatagcgagcgtagaaatgttttgctatctgcagactgagcattgcgcagccaaacagatgcattgcttgcatagcttttgcctggcagcctgcagacagaatgtaccccagcagatcaataacaacactacagtacagcaatgtatatcttgttattaagatgtcatgagagacatttccaggctggtttacccagcttttgttttctcctattattggagttgctatcaagctagcagatcaaccgacaagtttgatcagtcatgtgtataggcacagatcgatcaacagatcatctcgtatgtgtgtattggcatcaagctagcagatgaaatactcacccttggccgggttggaaggagtaggtcatgcagacgacgtagtaccattctgtgtctgcgagatcttccggcgatagcgcggcaatgggcctcctcgcccggtggtcgcactcgccggacaggagagagtagtaaagctccctcagttgctcgcttctctgcacgacgagctgaccagccgtgaggtctgctgagttggatatcttcctcgtctttaccacgccgttgtagaacccatcattccaagtcaaaactctacaggtaatattttttaggtattatataatttagtatataaatactgggagataatatctaacggaacgtatattatgtaagtaagggaatatcaggtaaataaaatcaaataagtgaaaaaagggtaaaaatcggattaaaagttttctaaattcataaaacaaattacttaaaaattcagtggcaattaatatagttcatgcctacatccgtctctatttttttagatgaatttagaaagctcataggtccagtttttatcggtttttatttatttgatggttttcattggatatttccccatataggtaatagattaagtccttgatgagctggctagtgcacaatggtttactaagcttgatcccaggtatggttatcaccagatcaggttgttaaaccaagatgagcacaaaacaacttttaaaagacgccaaggcctttatgaatttagggtgaagccatttggcctgactaatgcttcaaccactttgcagggcctcatgaatactatctttactaccctaataggaaaatgtgtgcttctatctatttgtggatgacatattcaattacagcgaaaaccttgaggagcacgtgcaacacctaaaggaagtttttgctatcttatagcagtacaaactgtttaacaaggcatataattggtgtcaatgcagtggctatagatccatagaaaatcaaggttgtgcaaaattcgtcagtgccaacaacctcaaacaactaagtggattctaagggttggttgctt

SEQ ID NO: 3674 - DNA, 1501 bp, Oryza sativa
acttctctacggctcgcctgctgcctcccttctttattgtcattgagattttaaaattgaacatgattatcattgttttttttacttttagaagttccgaacctttaaaaattagaccctatagtttttaaagtttattgtcttgtttgggttttattttttatgatttttagaagtctcgtccaacgatgccactatgctccttcatggcccgtccgccgtctactctttattgtcattgtgattctaaaaatcgaacataactatcgttggaattttttttttgtctagaagtcccgtcaaccgttggcggctctataactatactcctatacaccccgtccgctgcttctcctttttattgttatttagattttaaaaatcgaatataattatcaatggttttttttactttctagaagtcccggcactgccttgctcgtttgcttcatggtctgcctgtcatccctcattttaatcgtcattaggattctatttggtgttttattaacagtttttatacgtcgtatcaacctccaccactttactccttttataggtctattacttaatttatctcgtcatgtgttttagatggtattttctttcaatagtctttatttttatcccaattttagttatttataaattgtattcctaattgaaatcttattttttttctaatttcagaatttttatttcaaatttaattaatatcgtattgtgttcttttaatatttttattttttattttcaattttagttgtttaagaattatattcctacttgaactctcttttaatttttctaattttggatattattttatttttttttctaaattttaattaatctcgtattgggttcttatatggatacttatttcaatattgcttatttttaatttcgaatttcagctaattttaaattgtattcctacttgaactcttcttttatttgttttgctaatttcgaattttatttttatttttattctaaattttaattaatctcgtattgggttcttatatggactcctcttttaatattccttatttttaactccaaatttcagctatttttaaattgtatttttttggattttattttattttatttcgaattttgattaatctcgtattgggttattaatgtatacttctttcaatattgcttatttttaattccgaattttaaatatttttaaattgtatttatacttggactctccttttttttttctattttggattttattttatttttattttgaattttgattaatctcgtattgggttcttgtcactcccaatccggcaccgccgtacaacggcacctgacaggagcgtgtcgtaggaaaaacggcgcgaaccgcttcctacgaaaccgcgatcacagtaccagtcccaggacatagtgttggtacccacggtgacaaatatgaatcattgcaatccttaaaataaatagaggacttatttaccttaacttaggttgcagc

SEQ ID NO: 3675 - DNA, 1501 bp, Oryza sativa
  unsure (1)..(1501): unsure at all n locations
cgagcgggccccgcagcgcggcgagctggacacctggaggcgncggccgcgggcgagcatgagcacccgcgcgaggcggtcggccatcgccggctcggacgccgcgacggccgcctcctcggcgtcgaccagcaccgccatccgcttggtgaacccgaagcaggcctcctccccgccatcgccatcgccgccggcgccgccgtggaagaggtcgaagcaggaagggtacttgcggagccagttggcggctcggccgaggaggtcgagcgtcttgaagcgggactggaggaggcggacgggggcggtgcgggacgggaagcggaggaggaggcgcttgatctggttgttcacgatccagcggcggttgcggcggagcgcggcctccagcgccgggtccttcggggaggaccaccgtgccatgcggcggcgctccggcgacggcggcggcggcgggagggaaggggtgtgagagtgtggtgagccgcgtcggagtgttggacggctgagattggcttgcgataatgggctgtaggattgtaaaaatgggccttgcatatttctttaatgggcctgtttgttggcaattggaataggttcactttagattcctcttcttgacgtcgagtttaaatcacgccctgaaccgcaataccagaaatcatgactcccaacttgcatcccgggttaaattaggtcctctagcagcatagatttgatttggtagatgaaagttataaatttgtactagtactaataattatctcaaccgtttaatttggtagatggaagttataaaaaatttagatgcattcatagcatgacatgtcagtgttagtactaagaatttacgtaaccatcgtttctcttattcgcgaaataagcaaaacggtatattcgcaaatgaaaagtaatttgtgaataaaacttttatatatgtgttcttaacgatctaaaagcaaatgctgaaaattaaacttcaatgaaaaaaaccttaaattcaactccaaatttatggttgaaaatttaaattttggctgataagtataaatataagtgaaaagttgagacccttagttagaaaaagttactccatgtttatatatatttttcctatttttttaggttatagttgacttgtagtattaagggggtgttcgggagagtttagtcccttttgatagggattaaagttttggtgggagagagatagtccctctctcccaaacagcccctaaacttgctcttatggaaagaggtagtacgtactgtacgaaccaagtgcaagtttgaagtttcccaacacgatggcaacatcaggcacggcgatgcgaggtggcgctaacgtccaccgtgccgaccggtttggagcctcctccccgcttgcaacgcaggggacgaggagttaggctctgttcgttctgggggacagaggagattgtgtcccgtcttccaagcgcacatttttcaaactattaaacggtgtattttttttaaaataaaa

SEQ ID NO: 3676 - DNA, 1501 bp, Oryza sativa
gtgttttggtggatctgtgtatggaggagctacaaagtgtgagccgacctctccctcgttctaggctctgaatctggaaagaatcaaccaacccctttctctatgggcaaggtcctccttttatacttcaaggggataccacatgcacccctccctttccaaactggacttttcttcttttcataaatggacggagatttgcacggtcgtcctccgaacatcctcctgacgggacggcacatacctacctccacttctgcctgaggcgggcacgtcgtgggaaggtggctgtgtgctgacgacatgagcagtgtcagaccggtcacaaatcggtcattcttgtccaccaagcgtcggctcagcaacgtgcatgtttgcccttcttcacacaacatcttgcttgtaatggttaggatgaagcctggcatatatcgatcggggctaacgtgtcatctctgggatgtaacacgctagctccagccgggaacgagtgcctagaagctctcgtcttgacaggatggggcgaagcatgcgtctgaccgcctgtcgccacctaacccgcgatttgaccggtctgtgactggtcacagaccggataatcgagtgcactgcaccgcacttcgtgcggcgtgacacgcttagccgaggcgcaataaatgcggttaggtgagccctgctgtgctcacctaacccatacacgtggagtagaaaacgcgaggggtcagggcgcctcggccctcgggggcgaggctggagtggtccgacccccccctcggggagaccaagaggtgggcgcacacatcaccctcgggcccgacgtcccccgagggtgccaggccacgtgggcgattgtgtctgcctcaagcctcgagtcatgatactcccagtcccatgtcaccgacagtagcccccggcgttatgccagggcgatcgcccttcttatgggaagcggccgggcgtgacgccactcctaaagcctggtgacaggtgggaccggtctccatggttgggcaaaaacccaacggtctcaaaccatgcacaccggtaatggtaatttggctgtcaataatgggcggtctcttcaagactgccacatcacctgagcggcgcacgaatctgggcgagccgatttgcctcgcctggagatacggtaatgtcgcttcggtcggcgagcgtaattaacgcgcgcacgatacgatctatctcgactgccgcaaccgcatatccatctcacgcgccgcaagcgggcgaatgggattagtggaagcgtgggcgcgagaaacgagggggcgaaataatgggcgcgagaaacgaggagccgggcacagcgttggcaagggtataaaggcactgaggatgagatttgtctccttcctttcgccatcatttcccttgccttcgccgcttgcgtcctaactccttcttccctgcgcccttctttcgccacacgcgctcgctctgaggatctggctgcgctcactgcatgtttgcaatgaggaca

SEQ ID NO: 3677 - DNA, 1501 bp, Oryza sativa
tcaccaacgttacaaagaaaaactagtcttgcaactaggctgaatggttctttattttcctttcagcctaatagactacaaattaaatgttcagtttaaccaaacaacatctcatgacctcctgtgtgtatcctaatcctcaaataagcaaccaagtaattaactcacactgtcacacgggctactccacagtttccaactgcattgcacaacaagcgcattccattgatccaggttagcaagacttcggcacacaaacatcacccctaccgccctcctagaattagattaaaccatagaagcttcttgctacggaaactgttggaagccgttcatctaatgcatataaagcccctccttctatgaactcgtcgtcgacctatccatgaaatctccaccgaaacaagcctatcgtcacaaagcacagcgaactcaaatccatctctaatggcggatccacatttgacactcacggagaaacttcataccaccacaagaactagaaggttctagaagcaaaaccgcgacgcgcccgcagaggcaaattaagccaaccgcagcgagatagaaaggaaaaaggagggtaaggttccagaagcttccactcacctcgatggcttcgcacctccgccggcagctcggtcggtggcgtgggggggcgggggaggtggcgcttaaaatgaggggcaggagaaggatccagaagcggcggcgggttccactggaaggatctagaagtctcgagacggcgcaatataatacgcgagcgaatcggaaggtgggggaggcgaggcgaggcgagtggaattggaatttcgacgagagggagagggagagattagtggggtcgttagctgtgttagtgttaagtatatttattaattgattgattaattaattcggggtgttagggagagctcgtggctgtcaaggtggccacgtcaccttgtggagttggtggattctacaggaagtccataaccgaggaggtccattgacttgacctagttgctcctacttctccaccccataatctccttgtgatctcaatcgatacgctcgttcgatctcatcgaagtagcgagggcaagatcaaatccggagaagtaatcgaggactacggcagcagcgatggacgccgtggaaacgatcatctcaaccgggatcaacatccatgaagcgacccagctgagcaatgaactgtcccgcctccaggccaccttgcccaaggctcgcttcctcatcaatcgcggcgagtggggcaggttcaagaacaaggacatggcgctccttctgtcacagctcaaggacaccacctacgacgccgaggatcttctccgcgagtccgatgatcaggcgctgcggcaaaagatggaggatgctgaccggaactggttcggtaaacgctattcttccattctaaatcttgcaaaaattttgatccgtggtagcaaaacaaaaataaaggaggcccgagagaagctcgacaaggctgtggctg

SEQ ID NO: 3678 - DNA, 1501 bp, Oryza sativa
tattatgccatccaaaatagaataaattatttccaacaactgattccaaaattgtgcgacgtagtatcttactccttttgtgaaaacattaaacaccaaaggtggatcaaactagtagaagatgtgaagatgacatgtatttggctggacaatttttcgttttcaccactaaaaatttcttacatggttgtattacgataaacaaaggttcaagcttttataatttgagaataatattgttttgaatatttgaaaaccttgtttagaaaaataagtggcatcagtctaaaaaatacgagtggctaaaatctaaagataaatagtttcacttattatttatttcagtaaaagaaagtttcccttatataaaaagggatgtgaagtatttgagtttttttttgcgccaaaaagtatagcaccacttcgcaatacttttatatatttaagatgcaatataatttggtaatatgcttgtctaaaatatttgaaaatatttttttttataaaaatccgactggttaaaattttgaagagggatagtttcacctattctccagctaaaagaaatactccctccgtttcaggttacaagacgttttgattttggtcaaatttaaactaatctaagtttgactaattttgtaaaaaaaatagtaatatttttaacccaagacaaatatattatgaaaatttattcaattatagatttaatgaaactatgctagtgttataaatattactaattttttctacaaagttagttaaatttagagtagtttgactttggtcaaagttaaaacatcttccaatctaaaagggattgagtagtatatatatatcacttatatttagaaacggagttaggagtatttctttgagtatttttctaccttttgaggggcatccctatcgcagaagtcaaaccgggcggggcccattcgcgaaaaaaagcccaaacccgcgcccgtaaatataccaaatccacccccctcatcctcgccgccgcgactcccaaacctttcgatcatctcttcgacttcgtcggagtcggagtccgagtccaccgcctcgccggagatggagcacgcctcctcgccgcgcgcccatggcgtggtggtgatcgcggtcgccccggaccacgacgacgacagcggcaagaaggggtggcgtctcgccgccgccgccgcccccgccttcggggacgaggcggggttcggggtggaggaagaggaggaggagggggaggaggaggaggaggaggtgaggtggagggagcggcgggtggcgtcgctgtggcgcgtggccggggcgctgctggtggtcgcggcgctcgcggtggcggggcactactgcctgtaccacgacccggcggcgttctcgcgggaggaggggaggtcgtcgttcttgctgccgctgtacccgaagtccagcgggggcggcgcggcgggggagtcggccggtagcgtcaagccggacggcgccggcgcggaggcgagggaga

SEQ ID NO: 3679 - DNA, 1047 bp, Oryza sativa
tctcactgccgggccgagctcgccgtaccccgccacgtgtgcctcccgccaccgccgctgtggtctcctccgtcttcgtcgcagtggagctcagcccaggtgccgccgcgcctccgcccctcgccaccatctccgcctgccgcgggagagagagagggaacggcgaggagagagagggaactgagggaggggagagagaagggacacgtgggtcccacaatctattttctgtgtcattgacaaatgggtcccacatatattttttaatctaaatgccaccttaacgccacgtcaacgccacgtgtaaaggagacccggtcaataccgccacgttagcgaaaccgccctccaaaaccgctgagggagtcaaattgcaccggtttccatagtttggggggtcaagatatccggttttgtggtttagggtcacagattagatttcaatcacttttgaggggcaccaagtgaacttattcctgcaagctgggatgagccgtgggccgcggcctgtgtctccatatgatggaccatcaaagagttggtttccaagcgttcggccagaaggctagaaagacgtgaacagagacagccaatggcctactgccgagaggcccaaaagttgctaagattggtcgtagtttttgtcggcccatgtaggatagatatgaggtcccttactttttgacgaatccaatttttatccttcaaccaaaaaaccaaatacagcggtcaaaaccggtgtaaactaactccgaaggcggtttggacggtggacggtggtttcagctgaggtggcgctttgactctatctttatctgacgtggcacatgaagcaaaatctaacaatttaacaaataaacaaaatatgtgagcacgcatgtcagtcaaataataagattgaaaaatagtagaacccacgtatcagtggacctacttcctccacctcatccccacttctatgtatcttatcctctcccaagggagtagggtgagcagagcggcgcggcgcggtggcggaaatccgctgccgacgccgatctccacagc

SEQ ID NO: 3680 - DNA, 1501 bp, Oryza sativa
atcttaacatggcaagtaagctatcatgtttaactatcttaactaattacaccggcatccgtgtatacatgtgacgtccaacataaccatctgtgatgtactagcaaagctccaagcttactaattcacccaaattaattgcattttccacccgtaaaaaaaaagaaaaaaaaaacaacaatgggtatgtatatggacatgagttacatatccagatagatagccatggttgcttttatggatgaagagagtagatatcaaagcaaataaattttctcttttgccactcacagactcgcaattgaactctaacgccagtctcaacccaagacactagacgtagtttcataaactccacatcatcaagaaactagtactagacactacttttccaatgcaaacaccactattctatacttaaatttaatgctacttatctcacatgatgtcttggatgttgtgtagaaaccatgtctcatgcaagacagggttttcttctcttttttcatttattcatttgtcacattattttttatcctaagtggcagcttatttaatattgtatacaccatcctagtcattgagttgggaatagtctaaaacatcactgcagttctctccataaatcatctataaatacacacaaattctagtgatcacttatgtcccttggcaatcagtgcttactccgtccgtttcaatatttcatattactagaaaaaaatatccgtgcgttgcaacgggtcaaaactattttaatcgtactattattaggattttttttctatttaaaaagtctatggggttttttattttgatagtatttatatctaatttggaattcttattaggacgcttgccatatcctgtatgttgctttctaatggtctggcaagaattatgaaacaattagttatccgaatctcgtcccaagttagcatgtatttttttaaaagatttcttatgtatttctaaaagtcaatataaacttgaaaaccgactcaactacaaacaacgtaccaatgtatcagctgaaacattttcaatttttataatatcttttgattttttttaaaaagtgtacatgcattcggaagaaacggggtgaagcaataaagaaaaattaggggaggaccccgaactgagccaatagaaaaagaaaaaccaagaaataatttactaagaattatgtgacccaagacagatgaggcccatcagttaaaaagagggacactcagcccgtggtgggaaaaagtacactcaaggtccctcaacttgtcatcgagataaaaaacgtcctcgaaccgcaaaaccagatatacgaggtccctcaactatataaaaccggtcacaataggtccctcggcagttttgaacccgattttatcctacgtggctgctgagtcagcgtgggacccacatatcagcctgctctttcttttccctcttctctcccttcctcttctctctctcactcttctctagctctgggcaggccgac

SEQ ID NO: 3681 - DNA, 1501 bp, Oryza sativa
tgacaacacagaattaacacaagcaaatgagcccaaaattcacagcacaaggaataaagcccaacaagagatccaccaaccaaaatctgggccggttgggccagcccatggtttggccgaactaagtgccgctggatgcaaggttttgggtggacggcaaagattcaactccaatgacggatggagggcatttcctacctttccaaccatcataaccgtcattgggaggctatttaaggagctcaccttcttgactccatcacacacttaagaaagaagatcaaagctctctctcaagtttagttagtgttctagagctagtggagtaggagtagaatagttttcttagtcctcggagtcttgagaagaatttgggtatggctctagtagctttttgttcttttgtaagacttatacgatttatagaatattcttttgtatacaattgcggtactttacttcatttgaatcattcgagtaccgactttacgatatatttatcttgttataattgtgtagctcgcttacctgcgaaatgcattagtgtgtgtataatgatcatgttaatgattggtctaagtggtgacggcgattgtcgggtagtatttagtaatttaagtgtggtgcttaaattattgaatactattatttggggttatatactgcgggacagtagaggtgggccgctgatgatgacagctcagtacgggtattcctccacgttagtatataatccgaagttactttcctagggagggtactcctccgtagttagcctcggttggatggccatgactgattgtcgtaaggaactcgacatggggtattggctatatgattgtatactagaaagtacatactaaagttttatgtataatagaggtatagggatgaattcttttcttattctttctctagttagcttagttttagtatttatgagagtgtttagtgcttctgctttgtgtcactctaccatgaattaaattaactactgctaagactgattattacaagtaacatataaattattagcatagttctctctcataaatcttccatcgggattaaataaatatgatacccttagaatactttcgggcgaaatgctacaatgatatatccgtgcaagaaaatacccgggatcctagtcggctacgattgtattttatctgtaatcccatattccgttaggatatggactgtaccttgtattacggatcccttcccctatataaggagggtccgtatgcctcttggggcacgattcttttttctcccaatcatacaatcaataacacactcggcggaatcatccccggacaggagtagggtattacttctttaataagaaggcttgaacctgtataaaattcattgtctccaaacccatccactttcctagcttgatagccacccccttttattattgccgaaatcttgtttcgatagttggctcgccaggtaggggaggcgtcaagttctcgccgactaagtacga

SEQ ID NO: 3682 - DNA, 1501 bp, Oryza sativa
gcaccagtatcaacccaccaatcaggtgagtgatagacagagagaactgtaggtaaaaatttaccatacctcgatgttcctcagcccgcactaataaccatgtttgcagacttcttgtccttgagctcaggacaatccttggcccaatgcccagacttgccacacataaagcaacctccttttgtctttcccttgcctttcttcttaaaattggttgtagccttgggtttgacgtcgggtttgactttcttgttgttgttgtgggatgcgtgagggtcttcttctgcaccaaattggcgctagaacctccctcgatctttttgccccagttgtcctttgccctcgccttctcctcaacactcaaagagccaataagatcagtaatactgaactcttgcctcttgtgttttagagaagtagcaaagtccgtccaagaaggtggcagtttggcaataatgccacctgccacaaacttgtccggcaactcacagttgttgttctcaagttcctttgccaacatctgaatctcatgagcctgttccactacagaacgatcatcaaccatcttatagtcatagaactgctccatgacatacagctcgctgccggcatcggaaaccccgaacttggcctcaagagcatcccacatgtccttccctgaaggcatgtgcatatacacgtccacaatattgtcggtgagcacactgatcaatgctccatggaacaagcaatccgcagcctcgaacatagcctcctccttaggtgagagaggcggttcactcggtttgccccatgagacaaagaaacaatgcatcgccgtcaaccacaaaagtgtacgtgctttccatcttttataatttgaaccatcaaaagcatgtggttttaggaatgcagcaaagccaactaccgaaaaagacctatcaagtttttggattgttagaaatttggtcataattcggcatattttaatccaaaatattaagacaataaacatgacatttgtaatttgagtagatctagtgacagtgctagatgtgtacaacatgagcatgcttaatatagaataagcaacaacatagataagagaaagcaataatactgcgacagacagttgtaggaaacgaagaacgaacggtaatagtgaaacgttataccccgagaatggccctccgctggagtttgaggcagtattgcctccgttggtgttgacgagaggctccttctccttgtctccattgttggtgttgtcaccggttgtcgacatgttggtgaagatgatgcagagcagtcgcgcttgaagcgccacccaaaaacttgatcgcccgcctacccgtgcaggttctcaagcggacggagtttcggaggcacctgctcgttccgatcacccttgcacgtgggataaacagaaccggggaaacagagagacagcgtaggaacagaaggagagtatcgccaaggaacaatagtaggaggaagacacatactttgagagcctctgcct

SEQ ID NO: 3683 - DNA, 1501 bp, Oryza sativa
aggtaggcatgagtactgacagttgagttaaatcacttctttgatctgcaatgattttttttgtttcttgttctcctttcttattttcggaacaaacaactgccatattactatttcagagatccgatagattatgaaattggaaactcaggagtactaagtgcatccaggatcttaatgttgggcgataacatcattcttttttattttggccaccgcatagtagccgtaagtgacttttacagatccagtaattactagtactgccgtacttgaaagctatgctcgatatatctgtgtattgcttcctttagttatctctgaattattggcatgttcattattttgggcttaatcagttctgctattttctttcaggagttcattgatttttattatttattatgtatatatagacgtatccccgaatccatgatttttgaaaatagccgtatcccggtatccccgtatcgcgtatccgtatccgtatccacgtatccgggtaacataggttagggcgggtttggcgatccacgccgggatcttgtctggttgctcctcaggaacaacaaagactggatccgaatcttttatctgaagatagaaccacctcgcccgccatttgctacgagaagaggggcactagaaggggatgtatcgcaacttcaggccatcccgaagcaggaaatcgacacatccggatatctttttaggttccatccagcgcaactcatagtagaagcggaagaggtcaagaaacgactctaccccaatgtaggcctcacaaagataggagaagatactgaggaaggagatggaattggggttcagatggagcaaggaaaggccgtagaaattcaagacgagaagaaggaagaaaaccgtaaagaatgtaatcctcaaccgcaaccatgcggcccaggacaggttcaggttcaatacctcttgtttctcgctccatggtcccgcggccagggagagcatcgtcgtcctgcagtttcttcagggacgcatttgtggaggtggacttgtcgagatccatccccgccggagatcgccggagatcaaaccgagatgaacaaactagggtttttctataggagcggagaaggcgaggggcgtgtggaagctggaaagtctttgctgcaagcagacttcaaaatggatccctaaaactcccttaaatagacgcactaccgacggtgcgaattccaaggaaaggagagagatagccgccggaaatttctgggtccgttacacgcagcagttttcggacttcaatttaaattcactcatgaccgttgaacttcacacggcgttgtcgattactctttgtctctacggttctcacaccgagatcgaccagtagagaacgacaacgactccgacatcagaagtcgcgatcgctcacatgagttcatttaagcagaagtcgggggctactgtcagggttatggataaggtataccctttacccttagatatacgttgtacactgata

SEQ ID NO: 3684 - DNA, 1501 bp, Oryza sativa
catatacacaaatttaggaaccacatagtataaatggcagcctgcatgcagcttaacagatagacggggagaggggggggttgtcttgagatgaaaagtgtggagaacattggagtcgttgattagttggccacataaggaaattaggggacgtgatcacaatttgagtgctaatcacttgttttaaaagggagtaaccatattatatttgacgatcatagttttagtgataagctttcaaatctagttgtattataatcactactggaaaaacacttcttccagacgggctaaacctattttcacaggcggaccggtccgcctccaaccctacgcttgtaaaaataagtgattttcacaggcagacaactggtccgcttgcgaaaatagtttgcagtgttaaaaaacaaattgggtaccctagcttcccattcccaatccagacccattcccaatccaatccaaccaaatcaaattcacagaggcatcacaaaatcaaattcacagaggcatcacaaatttgaagcatcatagttcacaatcagaggcatcacaaaatcaaattcacagaggcatcacaatgaaaacaaacgaatcacgaattaacattcacaaattaacaaattaacttcggtggaagccgctgaagtctccaccctccttgccggtagccgccaccgccctccatgcaggcggtgccactggatctaggaggagggaggggagccgtcgccgcatccaccctcctcgccagcgccggcgccaccgcaactgtcacgtcctgataaattcatcctgaattaaaaatcattctctaaaaggaataatagaattaattaaaattcgaaaagaaattggcaaacactaaaatacgtactagaaaattcgaatgttgtccggagattttttgttaaattctccatggtctaaaaagagccctaaaattttacttgaattttcagagcaccaaaaatatttattaagcaacaacaacaattaacaaagtttactaaaaagaaaaactaaaaataaatcctccttcctcctttggaccaagtctggcccaaaatcctcccactctctccctcggcccgcggccaaagtcctcccttcctccctctctttctcttcctctccttttctccctccttctcttgggcctccccttccccctcggcccagctccctcctcctccctctccttctgggccgcccctcccctccctccttccctctcggcccagccgcccggcccaaaccaggccgagccgagccagccgcgtgcacgcgcgccgcacgcgcgctgaccgcgcgccccgcatgggtcccacccccaggtcgtcttcctcctcccgcacggcctcctctctctctctctcccggaaacctagcgccattgctcccccaaatcagtctcattcaaaccaggaattccaaaattgattagggggaattaatcctatttccctcctctctctttcccccttaattcccccttgat

SEQ ID NO: 3685 - DNA, 1481 bp, Oryza sativa
cccccggtaagggcattcaccagcggggggggttgatcacttgtttaactccatcctagcaatcagggtaggccccgaagcaatcagctggacgccgaatttggtagcccttaaagatgcatttcgttggattgcttacttttcgtgtgaagcaggtgtagtttaacgctgcccccccccccccccccccctccccccgatttagtggcatacgaaaaatgtgtgattctgtcacacaattaatatagtgttgcagattttctgatccaacaattcagaaccatagctaaaatattgaataatttggaacagtttggtatggttggattgaatggttgaaaatgaccttgaatgttttccttctttttttgtttttgagcttaccccttccttaatcttcatgtttgaatgctatattactttcacatgcgtagcatctgcatttgagttctcatcaatagaatgacctttaattatggtatctagcaactcagtgctttagggtcaagggagagggagagtatttgagtcacatatatataggttttggtccattggctctaatctcatttcgagcagagatagcttcagtttttccagcttgcgatttagtgatgacaagtagcataacaaaatgtgaccaacaatttcctccatgcttcagttctgcaggtttcgatgaatgttttccgcccagtgctgactttctttgttgttgttttttgtcaccagtgatttgatttttgcatgacaatcgttgtcttcttatgtgctggttctgatggaaccattgaagttacaaccaaggttttttggtattgtttgtacaggtcatataatattcaatgctgattgtaccacctcctattagatggcttaatagttttccctttggaaattccacttgaggcatgggtctttcaaagttgttctgtgtaactgaaagcaggttgggtgaaaggagcatctatgataatttacattaatgtgttccctttggtgcaagtcaccagatgctacatgactgagtgattgagtatactgtagtagctatcgcccgttgctggtgtcatattatacgtttctgttataatttacattgatttgtttcctttggtgcacgacaacagctgctacatgactaagtgattgagtagtagctatcactccttgctggtggcgtattatacttttctgctaaatctgaattaactaatcgattaatcaactgtgattctgtgactcagtgaattaactaatcgattgatcaattccaaagttggatggttcatctctgctggtcctttaattgatccatttgcacttgtgcggtacaatgtgtactattaatttggtttcataagttgttaaacatgtagcctggcccaaagcctaccatctcttgggattatgtaacactggcctcaaatgttactactgaccttaatgtttagaacatccctatgcacatgttgatttta

SEQ ID NO: 3686 - DNA, 378 bp, Oryza sativa
agtggatccccccgtcggccatcgcgctcgtgctgctctaccggccgcagggggagggggggggggggggggtgagggtcgggggtaggtgggggcccatggctgctcgacgccctcaggccgggcctgatagagggttttccaaaatatgtaggtgattagttgtgaaagaatgttttggttcactgcaacattatatctatacatagtgaaacattgtgaatacattagttgaaatatttttggtggaacaaaaaatgaaacgaattcccttaataaagggttttcaaaatatgtgagcgatttgttgcaatggagtatgtgatggagacacatggtaggtgggaataaagatcatggtgggacccagaatataca

SEQ ID NO: 3687 - DNA, 1501 bp, Oryza sativa
caatacattggttgtgtacattggctttggatctaatggtcgggttttaatccattttctgaaaaaatcattggtatgtgctgaacagtcagatagacctgataaattaaataatccgtaaattttttaagtgcttactcgcatgtggtataattatagacatcatgcatcctcaacttcaccattgcatcttaggaaaggaagtatataatgggaatcaatgcgcttagttcagaattgcacctccattactaatggacgtggactagtggagtattatatcggaagaagtatcaaatcaggtgtattgccctctgctgaactcaagggcaaacttataagttataattctcctttaactcaaagagacacagctttgtggtcagagtattggaaatggtttgaaaagtttttttttcgcgaacgcaaaaaaaattgtacgtcaatatattaaaggaatagagttttttttacacaacgcaaaaaaatgttttaaaagtggcacgtgtaatcatctgccacgggtgcagaacgactttaagcatgcagacaagagcaaaaaaaagcatgcagacaataccaaagacagcatgaacgaaaccagcttcaattgaacacccaaacatactatagtttccacaatatattctccatcaatccatcatcatttcaccggtattttttatccgtcatcgatcgatcggtcgattgcatcaacacgcacaaaaggcaacacagcagctcgagaatccgggcacgtaagctaattattaacacaacataaagggctccacacgtgttgccaaagttgccacgaaatgatgctcagtttttttttaaaaaaaataaccatgtccgttggtgcgatgcgtacggctgaaaaggtttgcagcagaataaatataccgatcgaccaaatacaatctaagcacatgatattcacccaacacgaacagattaaaaattgacagcacataatttctcagcaactgcccgtcagctcagataacctttagtttactgccggatcagatagccgtgaggacagtgtcagaatccattacgaggcaccatttgatttagattagaaaaacagacttaccaaatactacgttcgtcctaaaaaaaataagggaaaattgtaacatgccattataattttgtaaaatttgagatatgccatcttgacccacatgtcattgactcatgtgggtcctatatgtgattgagataccgatggcatatctcaaactttgaaaaattataatggcatagttctaaattacccaaaaaataaatctaatattggatgtgtaataatttggaaaacgtaacagctccacgccctccgccccccccccccccaacacacacacacggggggcgaaaccctagcagcgccgccgcctttcctctccccctcccccacctcgccgccgccggagctcaccgccggaaagccggcgggcgagccatgatggcggcggcggggcctccttca

SEQ ID NO: 3688 - DNA, 1501 bp, Oryza sativa
actaaccgagactaaagatctatttttagtcacggttggtaataccaaccggaacaaaagattgtggcggagagtacgaggcatctgccatctgagagatcgaggaggaggagacgggcagccttatctcttcacctcttcctccactgaccttatctcttcatcccatctcttcctcttcctcctcctcctctcctctaactcctctccttccctccccaataagccattgttcgtcgtccgctctaacgcggcctgtaactgctctggttacctcccagtatccatcgggggccggcggcctcgcggagggcggcggaggcccgggcagccttgggcggcgcggcggggcggaggcctcgcagcagggggcggcgcagcggcgcggcggtggaccgcggggccttgtggcgggtggcgcgccggcggccggcgcggcagcagtcgacagcctgtgttttaattcaataattttttaagaatttgtgattcggatctgtgtatttgatttgtgtatgatgtccgtgaatatgtgatgtatttatgatgaattttgtagaagttgtgatgtaattttgttttaagattttgtgatctatttgaatatggccgatttggaatttgaggattggggataatttatttgggattttgggatggggatatagtaaaatcaatatattaaaaacataatgaagaaaaaaaaataatagagcaaccggatctagctagctaggctagctctatctttagtcccggttggtaacagatgtatttttactcccggttttttcacccggaactaaagatagtgatctttagtcccggattggtagtcccggtttgaaaaccgggagtaaagcccctttctccaccagtgcttatcacacttgtatgcaaccacgttcgtagactggatcgatgaactttttttttactaaccttttacaaattgcctaaactaaaacttgttccggcaccaaacaagtatgtgtccggattcttccatgccattccactactctaggtgcgcacacatgtctatcaattctcacaaatcaacttggggcctacctatcgtgcgagcgaactaagacaccattatctttgaactttgatagtttgagttatttaagtactatggtaggcaattattttaaccggcttgataaatcgatctttttcatgtcgacctgaagtgagtgaccatgtaaacagagttgtaaataccactgtagcgtagatttttttaaccatgaactagtttatgtagacatatgttatagctttataagtttacaaaaacttgttatgaagaaaaggttgcatgtagcgaatgaaagcagagctatcacattagataacggaatatttatactcgatcgtttgatcatccaccacaacacagattcagattggtacaccggtgccgatctgtcattgatctgagcctcaaggttggatccgaatcatacgatactgtctttacacgcgtcgagcc

SEQ ID NO: 3689 - DNA, 1501 bp, Oryza sativa
tcgcaatttgcaaccattttccactttgcgtgcgaaaaatagcatttaggttgtgtttagttccacactaaaattgaaagtttgaagaaattgaaatgatgtgacggagaagttggaaatttgtgtgtgtagggaagttagatgtgacggaaaagttgtaagtttaaaaaaaaagtttgaatctaaacagggcgttagccgcatttgtgctctatcaatccgatatccagtgcatgtgtattatcatattctaatcgatagactagcgcgaagttttcatacgctaaatcaaaacagtaaacaaactcacgagggagttgagcttctccacagcagcggcggcctcctccgccgttgccatcgtgacgaacgcgaaccccttcttcttcccatccttccccttgatcaccttcacccaaaaaaaaaaaaaagccacgcgtgtctcagaacaccatagcccagaactcaaagctacgcctccataagcatggcaactgggccgtaccggttactcacctcgacgtccttgacggcgccgcactgcgcgaagagcttctcgatctccggcgcggggaaggaccaggggatgttggccacgtacagcttccgccgcttctctcccccctcctcctcctcctcctcaccatcctcgaccgcctgcgcctcgggaggcgaggaggccgcgaccgcggcggccgggaggcggcggatgtcgatgagcgggtgggggcggcgaggggtgcggaggagcggcgcgagccggggaatgcgcggggccgggagcgcgagcgccgccgcggcgtggtggtggtggggggggcttcgcgcgagggagagcgccgccattggttcgctcgcggataacgtgaggcggcgatgtggtggtcgcggcgacgcttatacccagtttcgattcgccacggccgtgtgccatcgtaattcggcccgttgcgtcggcccagtggatagccctatgtttggggcccaatccaagtgaggaaaataatggttagctgcgtgttcgtcgtagaccatatagggatgtgcaagaattgaatcctatcatgtctcatgaatagatgaattcgtagaccaaggaccaaaaaattagttgtccatcttgttgatcctgtcaagatcatcgattgttcacgggttcgactgtttgatgaagattattctttcttctctatggtagtggtgtgagacagtgagaggctaacctgcagtcctgcaaggctgtaattgcaaacatcatatggcacaaaatgtcttgaaatattttcacacatgtcatggccatccactgatactccaaactcacagtcatgctaggatataaagtaccagaacatccagattcagcgcatcttcaaaagtgtaccttgtcaaacaaacagttacactgaaggaataacaagattgctcctgttgcagttctcaaaaaaaaaaaagattgctcctgttgcctgacgaataacaagtaaccatatttctgggt

SEQ ID NO: 3690 - DNA, 1501 bp, Oryza sativa
ttcgtaatggttaaacgtgtccggatactgtagctcacggcactaaaattgtttattacttttacatatagtattatagctaattcattaataaaatagatggctcgaaacttgtaatctcgatagaaactgcatgagattccaattcggtatggtaagtggtcactattcaaatatgctgctgtaggagcagtttctaatgtatgtaagacaccgggtggtgtccatatataatctccactagggttggcaatggggcggattgggctagaatgcccccgcccccgctcgatccccgacttctccccccgcccccggccccgcagaggtggttgggtggaaaacgtcacccacccccgtccccgcaggggacccgacgggtgagcgggcccccgcaatacccgactgggccggtggacggcgagctaacgacggcgacgagggcggtgagctggacgatggcgacgagggcggcaagctggaaggcaaagaggcgagccgccgtgccccgcgccgtggccgccgcccgcggatggctgtcaatgccgccgcacgtgccctgcctgatgccgccccccgtgcctggccatcgacgtcgcagacgccgcgcgcgccttggctgccgtcgccgccgccactgccgccgcgcgccttggccgccgccaccgacgctgttgcccactggtggagtcgtggagatggtggctgcctgggtgggtggggagagattgagaatagggtggggaggggtggggaaattagggtttggatgtatatatatgatagactagatgggccttttgggcttacaacatactatgattaagtctaatatacatcctcggggctccgcgggtcacccgcgggtgaaacatctcccccgtcccctcctcgctcaaatgcggggccccaaccctgactcacccgcggggtctgaaatcgcccctgcccccgccaccgcaggggacccggccccgcaggggaaattgccatccctaatcttatcgatatttacactactacttagacctttgctctcgtaatatacaatatttaagaatgatctaaataatttaatgtcactcatgtatttctctttcaaataactatctcttttcaattaatgctcggattctatgtccatatatatagtatatatctactatagtatatagaagtatttttgttaaataatcaactaaatatatttttaaatttatagctattatacttgactagaaaaaatgcacgtgcgttgcaataggtaaagatgttttttcagtgatacagcagctattaggagttgggcaaattgaaatatagtatcgatatacattataattgaaaaagttactaaatattcttccttggttttgagcgaaaacccattcattctttccttttcagccccaacccagtccactacctccctccactcggtctgcatatcttcgggccagcacacgagtggaaccgcattcccagctcgcacaaccaacta

SEQ ID NO: 3691 - DNA, 1501 bp, Oryza sativa
ccccacccccatcgtcctggctctgcttaatcagctggaccgcaccaaacaagaaaccaccaaacctaagagtcgatccaaacgccaactaatgcattccaaatcggaccaagcgcaagaccaatacttaccatcccaggagaaaacctgacccgcttcggcgccagagtcttggtgacctccggcgacacctccgatggctcctcctcgatgagcggcggtggcggcggaggcggcggcggcgcgggaggctgcgaggggccgtcggccttctggcgcttggcgttctgggaggaggcctgggactggcgctcgaagaagtggagaatgccgaacttggccggctgcgacggctgcgaggccggcggcttcttcgaagctgccccccccgccgcccccgtccgcttccgtggagccatggctgtgttgaggactagggttttcttctttccggtcgctaggcggttcgatacggcggaggcggcggacggcggcggaatgggggatcgggttgggaagggaaggtggtgggaaggcgaggaggagaggagaggagccgagaaggggaaggggaatggccgaaagggaggggaattgggcggggttggaaattggagttcccgcgcggtagagatttcggcggggtagactgcgacgtgggcccgtgacggcccggtgaaaactaggcctgaaaggagaaagcattggtccagaagtgagatttggcccataaaatattgggccccccttacacggttctaaaagcccatgtacgacggcaaagtttctttcgttccctcatggaacttgtgcaaatctcatgaccattttttgcgttcctctgatcaagtggtgtacaagaaagtctcctgcgtacggcgcactcctcctgtgattcttcttcaactcatcaaccatcatccaggttctgattcgataatttgtcacctatttagattagagatctgatgatgattgactaccacgcgcatttgttcccatgtatcacctgatctaaaaattggtggtaaaaatcatcaaatttgccggcccgcccaagtacaaaaatggccaatcgttcaccggcgcacgaggattgacagccacgccaaaaagcgcggcgcgcgaggagtgacagcacgcggacccgacagccctgtcggggcgagagcctcccaactcgcgccacgacgagtcgtcgtcagtcagtcctcccccttcgacttcgaccaccagacgatggatcaacgctcgccaccttctccgagacaccgcgcgtccgtactcccatgtcgattccaggcgaaacaccaaagacgatcgtgtcgctcgtcgatcgccattgcccaagaacacacgcctcatcacctcatcgcctcgtcgtcgggtcctgcgcgagttttctctgccggtggttggggcgatcgatggaagagtaataaagaggatacatccaatcggtatggttcgtcttggtgaaagatggttcaggcaacccagc

SEQ ID NO: 3692 - DNA, 1501 bp, Oryza sativa
ggtgtttatcgtcctttgagcatgccccaccaggtactcccagtactactctcgtgcacgatgtgatgggccccgggggcgcttttaacgtcctgtataaacgcacggtggctcggcggtgtccggcagatcctgatgggttacacctttttttttttgaaactaaatgggttacaccttttgcacgtacaactttatagctgacatctggaaagacatatgacacggaccatacgaacaacatggtgacaaggagcatgtcaatgtcgtccgatttgtgtctaacggctcggatcaaagaacctaccgtacaaaatctctcggctacaaataagtaaatccctcttagtctgtaaaatcttgggtcagctcagtgcaaaatttgatctgttcccaagaaaaatcttgggtcaagtcctttttgacattttttttctcagagacatgttgtctctttcacgtagaagttataatatttggcaaatttttctacttgacattgttaagcaatttttttcccaaaacaaggttgattatatcaattatgataactaacttataaccatgttctcacaataataagagaataagtgactggttattttaatatggttgcatggggtttgtgctaacgggtaacaaccatcaaacatgacaagaatagccgcattgttggaataagtctcctgtcgtttggcataaagtaagaaccaaaagataacttgaaactaaaaacttttatatctatgttctaagtcataagtcaatgctgcaaagtaaattatgataaaatatctctaaaagcaacttttttttaaaaaaatcaaattataaaattcaaatcttaacaacggcttataaatgggaggcttagtatgtcactcaaatattggtaaaaaaggtactccctccgttccaaaatataagaaattttagaggtggacacgattattaaaaaagtaggttgaagtgagtggcggagggttgtgattggatgagtaatggaggtaggtggaaaaagtgaatggtgaagggttgtgattggttgggaagagaatgttggtggaaaagttgttatattttgggacaaattctgagagctaaaagttgttatattttggggcggaggtaatcctccattttaatcctaaggaaggtacgtgatcaaattttaccatcaaagaaaactgtcgttattttaagtcctaatacttctgtggacgtaaatcgtagtggaacattagtagttgtcacgtcctttttcttacttgaattggaagatatcattcttgccgaagaaaaatgagaactgttttccccacgtaacagctatagattagcaagattgttttatcagctacctaatctaaacgaaaatagttaactccataccctgaaaactagggtttctatcctcctggcggcggcgacaaggagtctctcggcgatttacgttatcgactcggtttcttcccagatctcgagtagaattcaacgtgct

SEQ ID NO: 3693 - DNA, 1501 bp, Oryza sativa
atttttttttgttaattattagagggtgttgcacatctctcatgtatacatgtacacatgtcaaacagatgaattaatgaatgaatcgtgtattgtctccatgagcatatacatatgggtatagctacctagataagctaaattaatgttggaatatatttatagtcgtgatcaatataattcgtaaaccaaattaattaggtaaaaagtgtcaactgaaactgctacaaagttatgtatagattttaccaaaggcaagccctcactactaattatattgtgtcatgaaaacagtttattacaaaattaatctattggcagaattttatacaccatgtgtaattattaatttggcaagattttgataagacctttaaaattaaaatacgccctataactataattatcaaaattcaaatcggagtaacaaataccaaaggcagctggctacctgttgggcgtatgtaactctttgtgaccgcagtgtttggagcaaattaaccattgaatttgttaacaaagactacggagaaccaattattgtagaagtagtgcaaaattaatccacctctcgttgtgcatctctcaagagctagccagacctaaccatggccgcagacgatcctatcgtggcatgcgctggtgtgggcccccacgaggggccgcattatggacgccctctaaccttgattagtagccctaaaccacaggtttaaccgcttaaccatggttaattagcaaaaggtcacgatgacacgctagccatcactatcgacatgcatcacatttccgcatcatagttcatcccgctcctcgtctcctctccgaagtctcctcttgtcaccagcacgcttgagctcccgtgaggctgacgcgtgggccctccctcgtgtgcgtgttctgttgggcccacatgtcagtgaggtgatctaggtctcctctgcttagctgtgcaagcatacactagaatttgttctcccttggcacctctccccttattttatgtgttgcacctcctacctctggttggaagaacatctcaagccctcccttttctctcctctttcccctgtgcatgtctctcttcttcttcttcttcttcttcttcttcttcttcttcttcatagcttgcctttctcccttctcctctcctctcccttctccaattcagatcaaacagcaatagctctctcttggtgttctctcctccatgcaagctctcttgtgcttctttttttaatttctctctctgtttgcttctctgtgcatccaaaaattttaaaaacaaggaggagtataaacaactcccccactttaaaaatcattgcttccttttccaacaccgccttttaaccctaaaaacaaaacaccacccctgttccaattcggtttttttcctctcttttttctccactttttttttagattttaaattttttttgctagagctagagaggcgctctgctgctgctacatcagtacatgagctagtggagaagca

SEQ ID NO: 3694 - DNA, 1501 bp, Oryza sativa
tttttttacgggacggagtgagtacgagaacgccatacatggtgggtagctagctagcttagagctgcatcacgtgtaccacccatcacaccgtacccccagcactgtatatgcatcatgctcatagctcatttgctcaactgacggccgcagggttaatttcatgtcgcgcatcgaccaacgcttgctaatgctagctccgtttgatgatttgattaactgaggctaatctatgaccgattaaaacgtgcatataccgacccccatgtggccttcagatccggccgagatcgagctagctatccgcagttctgcacccgccaagagtcaaatcggtggtaattaacagcgtatgtttcagcataattaattaatcaagtaagcgaacactgcaaataaataaataagtaaataaagatatgcgcgtgtacttgagagcgttgagacgatggagagctagatagaatgtcaaatgattgctagcatagctagactaattattattctccgaaagagtttacatatactaattgaccttattgtctatggacagaatcaagcacccatgcatccacacacaccaaagccatacttttcaatgaatcagtaaataaactatgcacgaaacaccacatttgcggccatgtataaactatagcgaggataaatctagcaggatatagctagctagatttgacatgacaaaataaccatttaattaaggcactaaattaaggggttgaaagggtgacaaatcaatcattatcaatcacagggcgctgtgtatatgcacaagcaaactctttgttggtcggttaatattttttctctcgtccttgaaaaatactcctatgcacacgcattttcctttaggtcaacacccctttattgcaagcttccgtcccctcacatttgcgccccatttgccgtctgatgtcgtcacttttatcaggggcccatatgctacttagcataaaatattggccttaataggtgtagtgcttatctttatatggccattaggttaaaggtttccactctggcaagatgccgttgagccctaaaatattagggtgagcaagctaatcgctcattggctcgtgaaaatagtgggtgtgagagagggggtgtctctggctagcttcaacttggcgacatgattaggtgaggcgcctcccagcaaacaaagtctatgccgaattaatctttatttttcttttcgttgccgcgcgccataataaactatactgctctctctctctctctctctctcaagatctctcgtcactttaggatgcttatgcaggtttgattggtgagacgttttgtcgtcgtcttcttagtttcatctccaatttacttcatgaacatttaatttgtagcatgcgtgattcatctcaacttgtgttccacggtttcacattgaatatttaatactccatctgtttcaggttataagatgttttgactttagtcaaagtcaaacttctttaagtttgat

SEQ ID NO: 3695 - DNA, 1501 bp, Oryza sativa
ctatcagattatccgggtattgtatagcttcgggtgggtgaacaccatcaccatgctcctttgtgacatgcccaacaaaaccacaaacaccgcaaaaaatcggcattttctcatacataacgcggaacatccacttctttttatttagagtggtacttaccaccctcgtgagcggcttacgaacatccagcatcacgcgcactcgggccccctcactgcttccccgaaccgaggctgcatctaatttaacaatgctcctagctctacgcgcaagctgagttgcaatgctacccgtcctgatcttctccttcagatcatggatttggatccatgctgggtaggtatagagattaacagattcaatcttagaccagccatcatattctgcgaggagcaccggacatcctcgaaaggtccatggaccttcattcataactcgttcccaatcccccaaacaattgaattggatcgagaacagattgtcttttattgctctgaaatctacttctttcgcgtagttccatgctgagcgcatactcccaaagaaagccccatgactaaacgatcacttcgtatgaactgtggctagggctagccatcttgcatctgcttcaagctcctctagatcttcctccaattccacatcctcctcctcatctgcccttaggtcaagcccctccagcataacttcgatttcctccttttccttcccccgatccgccgcaggcaccttgctgcccgtcgcagcctgtttctccgacgttgaaccttcgctcgccatggctgttgtgttccccttccttatcctgtagtgctataagcaagcacgttgaattctactcgagatctgggaagaaaccgagtcgataacgtaaatcgccgagagactccttgtcgccgccgccaggaggatagaaaccctagttttcagggtatggagttaactattttcgtttagattaggtagctgataaaacaatcttgctaatctatagctgttacgtggggaaaacagttctcatttttcttcggcaagaatgatatcttccaattcaagtaagaaaaaggacgtgacaactactaatgttccactacgatttacgtccacagaagtattaggacttaaaataacgacagttttctttgatggtaaaatttgatcacgtaccttccttaggattaaaatggaggattacctccgccccaaaatataacaacttttagctctcagaatttgtcccaaaatataacaacttttccaccaacattctcttcccaaccaatcacaacccttcaccattcactttttccacctacctccattactcatccaatcacaaccctccgccactcacttcaacctacttttttaataatcgtgtccacctctaaaatttcttatattttggaacggagggagtaccttttttaccaatatttgagtgacatactaagcctcccatttataagccgttgttaagatttgaattttataatttga

SEQ ID NO: 3696 - DNA, 1501 bp, Oryza sativa
tacttgtataatcagttatttgatcaatggttgtctggaagcaagcagttctttgattagtgtaatcggagcaaatgatcttcccaaaggcttctgtttcaaatttcgaattgtgtcctattgatcagcctcccgttccttggctgccatccgcaatccgcaaccaaacgcagtaatgtaaataaatgacgttaccgcctgcaaccaaactaatcatgtaatcggataaattggtatccgttacggctggaggcaataccattagcgtttacgttaccacatccgaaccaaacaccacctaaagagtaaacaaaaatgttctctagaattatccttttaagaggcaaatattggcatgagtacaatattgtcagcgttattggctgacctgatcgctaattcgctgtgtggtcagccgcctggtctactgatctggtgctgcggcatctcgcagcgttcacactgcacaggtggagttctgcatcttccctccgatcgcatgtgccagcaattccatgagagtccatgcggcccaaaacatcctcaagtggttcatagcgtaatcatgcgacacgtagcaggcgtttctaattttaccatttccaaaatttttaaatcacatgtgctaatttttcaccaggttgtaccctgtcggatggtttggaaattctataaatactttatacatctgtattactagaaacacatcaccctatatatttaacacgtatttaaactcgtcatagagcttatactgtactctgaacggtcgacatgcatgccatcaccactgcgatcctttcgctttgcctatccttctcgcccactaccaccgctatgggtgtcaggcctatgacaacgtcatcaacaagtgttacatggatctcctcggcatatagatcacgtgtggtgtaattaaagacacatgaaaagagctaaagtcggacaaaatgataccaatcggaaatgctttaagaaatgaaaggaaaagatacggtaactagcaaatgtgatagatgtatcggcatggattgactgagtattcaactcttcaacggattctactatcatacatatgtctgtacgacaaacaacggatacctcgaccaaacaggatgacaatcgtgataaatgcatcggtgtggatcaagtgagtattcgaggccgtgtttagtttccctctattcccaactttccatcacatcatatcacatcaaaattttttctacacatataaacttttaacttttttttcaaactcctaacttttttcaaactttcaacttttttcaggaactaaacacacccgactctccaacatattctactgtcgtacatgcgcatgaacgatgaataacgaaacatatacgtacagcttttgtcggactcaaaaaattcgtactctcttcgtcaaattaaactaatctagtataagattggaacattatattaaaatatatttattttatatcagcttattttggaatggttgtattaattc

SEQ ID NO: 3697 - DNA, 1501 bp, Oryza sativa
tttcttatctctataatataatttcatccaaagaaaatatgagaatgcggctggatggatggatgacccaatcacggtcaaatgaaacgctcaaccgctcgcaactaattaatacagacagaggaaaaagaacatgcaagtgaacaaacagaagaagaaatagaaccggacagattaacaattcaagatccaccgtcatcctctgccagctcctccccaatctccatttaacaactccaaagatgcatttgccgttttgaaaaattaaacttcttctgtctccacaaaaaaagaagaagaagaagaagaagaagaaaacagaaaggaataagcaagcaagtgtgttctcttcattacgtttctgacaagtagcatcacaccaagtcttaggttaatacttgtgaaactgtcacctcatcatcgcccatcagattgctccagtcgacgcccatcgaattgctccctgcacgcagcaaaacaaaaggaataaaaaaagtctctagttcttcgtcaaaatctcgaataaattgatccatagaacataagctctaggtaagagacgaagtcttgagtaatacagatcacggccaatccatagacttagtattatttattttgcatgcattgcacagtggcactttaatgtgtagccatcgatcgatcgcttactattctgcccgtctgactcttgactagagtattttacatcaatacagatcgttagaaatcataacagataatgtactaatgctgcaagctgtactttttaagcatttcccctacgggattttaatttggaagaattgttgacttggtttgatagtttctcatatcttcgtatcgttattaagaaaacatttttttttcatatatttaacctgctattgagatgaaaaggagacggatggcatcttcatttttctcgtgcatcatgatttacctttttttcattttgctctgagattttcgagcatcaggtattacaattttctagcactaaattgtctgagattcttcatttttctcaaagattttctagcaccaacaattagtctattagaacatatgtttttggttgatattgttagattcatatcaaaaactttttcttatatataatgaaatgtggtgtggtggtgtagatggcgttgttgtttgtagatacatgcttgaccgtttgtcttattcaaaaattgtatgtaaatatatgagatatttttagtgataagaaaactcacaataaaataaataataattacataatttttttaaaaaactagacgaatggtcaaacgtgtacccaaaagttaacggcgtcatctattacaatgtaatatagagctagtatattagtataacaattgttagtcaaagctttatcctaacgaaacaaaatatacctatatttcgacaagggagtatttcattagttatttgaatttgagccattttgcggctgtactttgggttagcttgactttttaattgcatatgatgacat

SEQ ID NO: 3698 - DNA, 1501 bp, Oryza sativa
agagcatagcggcccatgagcgggagacagcgcggaaacggacgatggaataggccggcaggcgcagaacgatttctgtcatcatttcgtccggcagcggctggccggcggacgaccggcgtgctctcttgcccctcttcgacgacatatgctgcatgcctcgactgccatgaatgatcgatgaggcctgaagttagtgcgcgagagatacgctaacttattataacaaaagtcgggggctctgttgaatccgattcgagtgcgtgtgttctattcattatcggacaaggagggattctgtcgaatgatcaaagagaaaaaaaaaaacacgcgtcatatatcctcatatgtaggtaggcatcgagatcaggcgcttcagttttttttttaaaaaaaaatggtgcaacttgacaatatgaaagttaataggtactctatgtttagggattattaaaaaattcatcatcaggccgggctgcgttttgttccttccagttgggaactaatctcccgcatacaaaaaaaaaccggagtaacttattatcacgaaatttattaaatattagttatattttttaaaaaaaatagattaatatgattttttaaaaacaactatcataaaaaaggctttttattaaaaacacatcgtttaacagttttaaaagcttttgcacggaaaacgaggaagacaaattggaaaactcagctgccaaacaggttgaatctggtataggagatgtggattttcatccctctcgaggacatcctctcgttatttgcatgtcatctaaatagtcaaaaaaaaatatgaaaaaaaccgacaacatagattaatatgaaatatattactccacaaacatacaggtttagactttcagctcatctgatttgcatttcaagtccaaaattccttacttgtatttctacttttccatctggataaccgttcagacatggtcacatactcgcattctatttactcatgaattaaacattactggtcaacaactacgagtaatggcaattcacagcattggctagagaaaacgtcagaactcagaacatagatgagaaaccatcgatgaacattcaacaaatcttcggggtgggttacacatgcacaattaacacgctagcattaatcaatctaaacgtgcaacctcccaacgtgcaagcaaaacgatcgggacaattaacagcttggcaacactctataaatacagtttcccgctactacggccttggtgctccaaagtgaagcacaaaacacaacaggtgcagccaaagagagctgcggttttgcgaggccaaccatgaggacggccttgctgctcgcggcgctcgtggccgcgtgcgtcgcgcacggcggcggcgccgatcagtcgaccccggcgcggcggtcgctcacgttcgacagcatcttcccgggcggcccgcacaccgactcgggcatctgctgggagtctctgctgacgctgggccgctgcaagcacgacctgct

SEQ ID NO: 3699 - DNA, 1501 bp, Oryza sativa
atgtgttttttgatgtagcggtcgggttatccattatctgaaaaaaattgtgatagtacatgagatttatcatagattcattgcgagggaaacatggcaggggaaaaggggaatggggttgagaaagggcatgctattttcctttctgtgccaactgataccctctctgtttgtcactgagttaggagtccttcaacttgccagacagatggaacaagaccatctcagaccatattgtacattaagaattgtcatttgttaacttttgacatgtttatacaccaatcctgatatcttcactgcaagtatgatgcagtcaaatattaggagggagagaccaaaaaggcctgatcctccatgcaccatctgcagaggcacaggcaaaatagattgccgcaactgttttggtcgaggtatctcttgtactccatgttctcttctcttgctagtatcatgatcctacaaaccagttctctcatgaccatggaacctgggatttacagggagaaccaatcatgccgatcttgtcatgctcccgaagggcgaatggccacaatggtgaggagctcatagcctcatactcaaaagctgtctgccatacttatgctgctggtactgagaaacatgcttctccggcatgacttccattttccaggtgccgtatatgtggtggtagcgggttagattactgccaccgttgccatggaaccggtgaatttcgagaacccatgggctttcacttcgctaccatccacaggaaatgaacttcacctagacagtgttgtatggttgacagtccgacagatctgtgtagagaaatcataattacttcatgatatacagttcaaagagttgaacactactagtttagttcgtgaaaaactccattttagtttatcgcaatgctcgtgttatggaatccggactgctcgcaatgacggtcatcaactctttgatataaactgtcgggcattgtcccgagctatttctgcaaagctctagttctctgtgcatatggtgcatcatatctaaatagataaattttaccatccttaagaaagtacttgacttctctagttctctgtgcatagtaccatattttataatgtaaaatttgatattttcatatatcaaaattttcagtgtaaaatttagatactttctttaaagtaccgtaaaatttctctattaaaagacacagcgcggtatctgcgcacccacgtctccctaataaccttcccgtccatcctgtctagatttttcacattttggtccttttgaaaaacttattttgcaaatagacccctaaaaaaacttatcccagaaatggtcctttttgaggcgccagagtggctggcgccgtcatccaacgggacggcgccggcctctctggcgccgtcctcctgccaccgtggcacacgcgaaccaacgtggcaggaggagggcgccagtatggctggcgccgcccccaggaggagggcgccagcatggctggcgccgg

SEQ ID NO: 3700 - DNA, 1501 bp, Oryza sativa
gtggcaattcgatccaaaaaaaataaagcctatagggcccacatgtcagttacacaccaattatttaaacatggtgagggccatgtaggccacatgtcagcctcattactccatttatctcactatcctctctctcctctgcatggggtcggagaggagcggccggcgcaaccctagccacagccgccgccgccaccgcgacggaggaagatggggcaaccacggggtcttccatggcgaaactggggaggtcacagcctcacggcatcagatcgaggggagctagggttttgggaggctaagaggaggagaaatgagctagagaggaaagaagccgctctaggttttctagttgggggaggagacgcgatggcatgggtgacgggtggggtggagcggctagccggccggtggagcagggcgggcgacggaacgaggcggcagcagagcagggggggtggagcggccgcggactgtgggcggagcaggccggcggagcgggcggcggaacagggtggcggcggagcagagggacgggcggagtggccgtggaccgcgagcagagcagaggggtggatgggcggagcagagggataggtggagcagcggcggagcagagggacgggcggagcggctgcggaccgcgggcagagcagagggatgggcgggcggagcggcgggacggagcagaggagataatggccgtgcctcctcctcctccggcggtgacgacggcggaggtggcgagctccacctcatcaagaagccgttcctttcccccctccgccaatgaggatgaagtgaggctgagacggagcctgctctaccgctatccccggaggaggcgctcgctcgcaccgttactgaagttcttccacctttctcccttctccccactggtcgcgtcgctgctgtgcacctctccatccgcccgtcgctgtcgagcccctacctgtggtgccctaccaacatcggcctccctgcctctggcctccccacccgtctcgctgacctccctgccttatccctctgcggctctgcacgctctcgccggtggagaagtggagaaaggagatagaggtagagaggattaggtggaggaggtgggacccactgacatgcatgtgaggcccactatttttattgactgacatataggtcccacatattttgttttaatttttaatgttgcttcgtttatttttttcaaatcaaactgccatgtcagcgccatggcaccgccacgcaggacgaggactaagttaaaccagccacgtaggcatcacatcagccaaaactgccatccaaactgccgagggacatcgtttgcaccggttttgtaagttggaggacgtattgtatctggtttttgagttgagggacgaaaatcgaatttggtgccaagttaagagaactctaatgaacttattccatgaattgatgattttttaaactatttataaaaaagttatataaaatattcaaaattttatatttctac

SEQ ID NO: 3701 - DNA, 1501 bp, Oryza sativa
caacatcgaggggcccagagatatctttccataggaggggcaaatcccatcttgattattcatatcccaatacatgtttcatagcatactcgaaaactacttttataactatccaattacgaagtagcgtttagcagtccctaagtaagctactacacatgttgggaaccatgataatctcagtgtctcatgtttggtctatcaaacaacatgttcactaacatgtctccacattgttaatttggtatctatataccatgatccatgagacatgatcatcaattaatacatgtgctgatcatctaatcatatttgttccacatttgatatttgatcaggaatcctttaaaaatagtaacaaacaacataaagagtctcatgaaagaatcacatatttattaaccaataatgagtttatctatttcaaggaacaatgtcggataaatatgtaaacatagtataggatacaatcatctctatgattgcctctagggcatatcactaacaccaccatccttacctccaccaaccgccagcctccccatccacgctgctgcgcctggcagccgccgtcgcgccaagccaccgcgcgccgcgccctgccgcgccaccgaggtcggccgctggccccgccgtgcacacgccgccctcacctctctctctgttgcacatggagaagaacgagagagagagcagaccaggaagagatgagaaagatataagagagaggagaaagattaagaagaggaaataaaggagaatgagacttacatgtaggacccacagtggaacccagtcggttgacccctcactcctcttgacccacaaaccctagtgaaagtctatattggcccccttttactttagtatccttcatttaacaatcagacaaagcccaccgtagccacctcatactaaagcccacataccacatcccctatacaactcaaagcctctcagaaagtctaaaccacctcccttcccgagaatgctccctcctcggtttataaaaccttccaatttcgaaaattcatatctctccaaccgtaactccgattgactccgttcaacttccataacctctctaaaatcgagatctatttaatggcaccattagttgtattgaatgttgttttattttatttcttttaggattgtgcgtggatattctttggttatttattggacgtgtcggatatttatcgatcgcgggtattctagttgtccaactgtcacagacatctcgaagacattaggaacctatagcaaggcaagtccctacgctccattccttgaacatattgatcctacatttacaaatgtgttgttttacaaataaattgcatgctatttataaattgcgtacctacatttgattatagcctgccttgatattgttacccttgtacatattaatgtatgcctttgaatacccaattcatttatttatatacggtcaattattgacaatgcttagcaatgctattgtagacatacgtat

SEQ ID NO: 3702 - DNA, 1501 bp, Oryza sativa
gtcccagacaaagttacaaacccataggcctattataggtgatgcgtcaccttgttcctatgattccggccaaacgagacggaattcaaagatgaggctgaatccgttggaaagcggactccgaaagctttccactaagtactaatggacccaaaacgaaggtcgtatgcacatctggcagtcgtttgaaatcaacattgttgcaggcagttgaattggattccagaacttgtttaatttgttcttgatgtgagcagcggttgtctcaatagcatccatggtcacatcttaagcacgaggggtggatgccctacagctaaccctaatcatatttattcaataactatcattatttagagtgcggttttgcttagattattctgctgttgcagtttcgccgcttagttcggtttgtggaaccccaatttgtgagcttcattgtatatatgcaatatatttatattatttcttcttctctcttgtttttgttctcgattcatttgtaggagatagctttatcggtgaggtcgaccgcgctttggcacagttgataaccaacgaaggggtggggttgtgattgtgagtggttcggtcatcttggttcagtctccacaatggacttatcagtacataatggacgatcgggacttcagtcctcatcacatttcttttgcgattcttttagtgagcgaaattaattttgaccattgttgtaaaagagttgcagcaaatgttacgtatgcaaattgacagaagaactcaaagttaatagatgactttgtttttttttatctgtattctatttgtctatggatgggcattcggtcagactgaaaattttggtcctggtcttcagtcttcctctcagttcagtcattaaaaagtgaggaccgaattttaattgaaaaatatcaggatcggtaaattcggtctcggtccaaaccgagattaaacaaaaagttaaacactacatccgttttttactatatgacgccattgacttttcaaaatacatttaaccattcattatatttattttatcatcaaatgttgttttaagcatgacttcaaattttttatatttgcgcaaaaaaaattgaataagacgaatagttaaacgtttaacaaaaagttagcggtgccatattataaaaaacggaggtagtatatgcaaagaaatcataaaaaaattttaacacaaaaatcacacaaaaagaattcgcaagcacgtcttagtaaagacttttattgggttttatggctaaaaggagtaggatgtgaatattaggttttaattctattaaacttagtggattgttggttgcatttgaattttttttaattagatcttttcggttaaccgagaagactaaccgaattgacgaacaaaatgcccgaccaaatttatcgatcttgtcttttcagtttcggtggtcttggtcttttcgattcgttcatttttcaatccacccttacatttgtcaacgttgtccctttattt

SEQ ID NO: 3703 - DNA, 1501 bp, Oryza sativa
ctctcgcgttcaaacgggcggatttgcccccgcaaatctcgccggcgccattgatggcggccggacctcccgcgcctattccttccccaccggccgctctctcccccttccaaccctatttaaaccctccccgcacctcctccgtccatttccgcctctcgccgaccttcctcctcgccggaatcgagctcgcgccgtcgctttctctccgccgtcgccgccgagctccggtccgccgccgtcgtcgccccagaccacctcccacctcagcgccgcctccttcggcttcgccgcatcctcgccgacctcgtccacccctccgtttcgctcgtcgaccgccggagcgccgccgtccccgtcgacccgagccgcgcagccgccttcctccgctccggctgccttttcgtcctcgccgtcgacctagggtgagccgtggaccgccgcctcgtttccccctttccctcccctctctcggccgccgctccgatgtgcccatggccgccgccggcgaccataggggcgcgggcgcgccgcctcccgccggccgcgccgacgtggccgccttcgggcgcaccgagcggctgccgcgtggggcccggccgtcaaccgcccgcgccctcgggtgcggctgacgcgtgggacccacggcgccggccggtgtgagcctgagtgcacccggtccaccgtggaccgtgaggctgccgcgtgggccccactcccgtggacccggtccgcgcgccccctcccctcggctgacgcaataaacccttttaaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttctttttcgttggtcgtgtagacgctgcagcttcagaagatccgctcttcgttgaagttgaagccgacgtttgggaaagcgagcaaggcaagtcacatcatccttaaacatattgaatcccagtttataaaattatgttgatttaaattattgcattatcgctttatttaaattcccgcgttatcactgttttatctagccatgcctatttacctttgttatgaccttattattgttattgttattatttccttgttcaccctagaataaacaaaaccccaactagtggacactctactcatggtaccactagtatgattttaggtagatgcttcgctggttaattaggcaacattgggtggttttacaactctagactttgggatattcatatcacctggacactatggaatggtttgattattgtggaaattggattcacacctccccctctattcaaaatcctcaaaatagttttaggctgggctcggggtgcatggttttgatagtagcacctcggccatataaggaccggt

SEQ ID NO: 3704 - DNA, 1501 bp, Oryza sativa
ggtgcacctcgccgaagctctccacgtcggcgcgcctgcacctggctgctcgcagcgcgccgccgccccggacccgtgcctccctgcaccgctcgagggacaccctgccggcctgctccaagtccgcggcgcggcaccgcgtgaccgacaccgcccgcgcgccctccgcccgcgctgcgccgcaccggacgaacgacgcggagtcgacgccgtcggcgaccgcgtctccgcacagggtgaagctgacgctgcccccgcccccgccgcgcacgacgacgctgcggacgccgctggcggagaggttccccgcgctggtgatggtgaccgtgccgccgagactggcctggaggctgccctcgtggatggacgtctccacgccgtcgatcacaacgacgaacaggtggtgagctgtgacggtggaggaggaggactccccggccttgggatcgacaagcgccatttccaccgagtgcgacaggctcgcaatttgctttcctccggtagtttgggttggtaagctctagactagtctggaggaggaaaggtcttaatttgctttaaaagccaaaggacaggggcagtttgcaagcgaaataaagtgggtgaagtgctggtgaactaacaaatgcagatcactttctttttttaattgctggactttccacagcagtcgaattttggatgtcggatctacactggtcatcactcatataaataaaaataaggctttgtttagataaaaattttttttggcaaaaacgtcacattaaaagtttgcatacatgtatggggcattaaatatgaaaaaaaaactaattatatagtttgcatgtaaattgcgagacgaatattttgagcctaattacgatatgatttgataatgtgatgttacagtaaatatttgataatgatggattaattaaacttaataaattcgtctcgtagtttataggcggaatctgtaatttgttttgttattactctacgtttaatacttcaaatgtgcgtccgtatacttcaaaaactttacacccaaagaactaaacacaccttaaactttaactatagcaatcctcacaaatacaagatagcatgagaagaaaagagaaaagtagagataaataatattgtttatttcatataggtagtctatatgcatatgggtaccttttattattttttttatatggactagttgcacaatagtactatgatcccgttcgattctccaacaagcatgaagattaagtgcgtacaccaaacgagacaagttattagcacatgattaattaaattttaattattaaaaacttgaaaatggatttatttgatttttatagcaacttatatgtaaaaagctttcatacgaaacacaccgtttagtagtttgaaaagcatgctattaaaaagtgaggaaaagttggtttttttagaacggggcctaggtggctgaatgaaatattatattacttgtggactacatttgcatcacattatggat

SEQ ID NO: 3705 - DNA, 1501 bp, Oryza sativa
agacgggggttcaaccgaaccatgggctggcccaatcggccaaaattttgctccttacttcagtgacgtggtgtcttgggatttttgagattgtttcactggatttgtaagcccatttacctataagtctaactctcgacgatgtttgattgattattcaattattttccattgattctcctacattttatgtagaagtgaaatggatattatttgcttgcagagcaatggcaagcagagtgcaagcaaataatatccaagtacaagtggaaatagattattctaaagcgaatatgcattgcaagcatagctagttctcctttattttagttatattgacggtagaaattggcctataacgactgtcaaaagttatacaacatacccattgcatagacccaaccaaaccacctgaactaaactagtttgtcaagtcaaattattatggtgaggcaaatcacggtgaatctggttgacctcccataaccgagggcacggctatttgaatagttttactctgatcagaggtgtacaactgtactcacaagacacaatctcacaacacgttaccgtgttccgacatgccaccacgacataccggattgtgactatgacaggacccttcgcacacccccctaaccaatcgaatcacaccgtaggtttcgcccccactcctcaacaggcagtgggcagcaccctctcgtgcctaggtaaatccgaaagcagcttagaccatcgcagggcccatccatactccatcacgcccacccttgcccgggtacgtcgactaggtcaaaccacactgcaagtccagccgttgcccacgctaacttgtagtaagtatgggtaattcttccagtgtttcccatgaaccggtactttatcgtcatgagcacgagtgcacgaccatcaagaccatgtgctcacaaccgaccattatcaaatttcagttgacaaattatttaattaaccaaacacgattggccatcgtgagctaccattaaatgtccatcattaagtaatagtgaagcattaaatatcccaatagtgtgctaatgtttctaatcatgactaagcaattatatctaatatctagctgaaccaatatataaggcctaagctagtcaaattataacccataggaaaatataggaaaaagactcacaccacccaataacattcgaaaataaatgcacatttgaaataaatagagaatttaaatataggatcaacatgctcaaaggattgtggttgggatatatgtgacttgccttgcaaacaagcatcttcaattcgtctttaggaacttcccacgaacgagcaatccttcaaaacgactacaaactaaacctagaacacaaaatgaggaagaacactaataaaaccaaataaacagtataattaaaagtagagatgaatttagatgaattatgatacttgaacgacctcattccgagttcatatgaattagttatgaattaatgaagttttaatcaattaa

SEQ ID NO: 3706 - DNA, 1178 bp, Oryza sativa
aattcctgcagcccgaattttttgtttacagcaaagggatcgaaagcgagatttgatcggctgcatgaacaaaaaggattaaagcagtgggcagtcggcagcatgttcctgtgctcgtgtctctcctgcctgaatcctgaaaagctcgacaggtaatgcagcaatggaggaggacatcatcatcaattcatcatcattagaacgaccaaatccaaataaacatggcgcacgtactggccattatcttaacgaaactgcacggagagtggaagtagtgatgggaagagagtgattcactttggctgtgtcacgcagcggaagtttcgatcgatctgtttgggtttccatccgaaagataaaagatggaagccactatttctcgccatcatctgaatgaagcccttctttttttggcgggcctcatctgaatgaagctggtcggaaggagcaagatttgcagatccacgtatgtgcaaatcgcaccacgaatcctaatactccgacatgattttgcttgtgtcgtcacaccacaaactctatttttgagcttagtttgttaacatcacttgatcgctctcgcttgcgatctgtgaatctagtgcgtgcatactgtgcagttgaaaagtttgccgtcaagtgagcgtagctcaaatccaactcagatcgaagttataaagttgacacatatgctcgcttttacggttaattattctttcaacagtagacaatatagccgttgatagtaatgcactcgcaacaacttcatgaaactcaagatatgttaatccagatttctaaatgtgctaatagagataaaatgtgtgttcatatggagatatatcagttcagtttttttggaggtgtttataggagtacggcgcgtttaaaagtgtggtatgcatcgtgttgtgagtgtttgtgtgtttctttaaaaaaaaattgccatttgtcaattattgtggattttctgcaacttgttgtccaaagaaaaagaaaatagtttcggtcaacaactcaacatccatctgggggtatgaccgaccgagcgcggtggccgttgattggctcgtcgcctcctcccttctcggtctgacggtctgaccagtgccgggtaggaagcgtaattttgaggagagactccgacccgcgccgccgccgccgcagccaagccatggagg

SEQ ID NO: 3707 - DNA, 1501 bp, Oryza sativa
cgtccgtgtcgggctgcggcagcgtagcggtgcgccgtggcaaggtgaacgtgatcgaacagccgccggtttgtcaagagaagccgatgtaccacctcgtccacgctgagccagtctacgcgatccctttggaaatatcgagcgagattaaattgcagtagaccgggcagtgccagcgggctaaaggtctgatatgctgatgatatatatgcgtgtcggtgtgataagtatacgtaatatactattgtaatataatgtgtggtttgtacggagtatatatgcacaaggattatacttttaaataaagggacaacgttgacaaatgtaagggtggattgaaaaatgaacgaatcgaaaagaccaagaccaccgaaactgaaaagacaagatcgataaatttggtcgggcattttgttcgtcaattcggttagtcttctcggttaaccgaaaagatctaattaaaaaaaattcaaatgcaaccaacaatccactaagtttaatagaattaaaacctaatattcacatcctactccttttagccataaaacccaataaaagtctttactaagacgtgcttgcgaattctttttgtgtgatttttgtgttaaaatttttttatgatttctttgcatatactacctccgttttttataatatggcaccgctaactttttgttaaacgtttaactattcgtcttattcaattttttttgcgcaaatataaaaaatttgaagtcatgcttaaaacaacatttgatgataaaataaatataatgaatggttaaatgtattttgaaaagtcaatggcgtcatatagtaaaaaacggatgtagtgtttaactttttgtttaatctcggtttggaccgagaccgaatttaccgatcctgatatttttcaattaaaattcggtcctcactttttaatgactgaactgagaggaagactgaagaccaggaccaaaattttcagtctgaccgaatgcccatccatagacaaatagaatacagataaaaaaaaacaaagtcatctattaactttgagttcttctgtcaatttgcatacgtaacatttgctgcaactcttttacaacaatggtcaaaattaatttcgctcactaaaagaatcgcaaaagaaatgtgatgaggactgaagtcccgatcgtccattatgtactgataagtccattgtggagactgaaccaagatgaccgaaccactcacaatcacaaccccaccccttcgttggttatcaactgtgccaaagcgcggtcgacctcaccgataaagctatctcctacaaatgaatcgagaacaaaaacaagagagaagaagaaataatataaatatattgcatatatacaatgaagctcacaaattggggttccacaaaccgaactaagcggcgaaactgcaacagcagaataatctaagcaaaaccgcactctaaataatgatagttattgaataaatatgattagggttagctgtagggcatccaccc

SEQ ID NO: 3708 - DNA, 1501 bp, Oryza sativa
atcctccgccaaatccgattcgattttgatgcatgtcctaccaaatttggtcatcaacagcagagctttcttccagagtaattcggatcattaccactcctcgaaccattccatgttgccacgtcgggtcttttaactgaaatgcatcaatccacaatactagtacctgctctacaatctcagtggttaatgatgcatgtcagtatgatgttactaagctatgcgactcttttgtgcggatccttattatccgccgctcttctaatgattagatttcgaaagaatttagatttcttttcgaaaaagaagaaaaatgttttgcttaaaacatttttctttaatgagattgaatatttctatgcaaaaagaagtgctttaaaaagcaccttttttcctttatttccaaattattacaaatatcaattaattgagcgtttggattcttggagttatcgtgtcattagtctagggtttacccttttaaccataggtattctttgtggagcagtatgggctaatgaggcgtggggatcctactggaattgggatcctaaagaaacttgggcatttattacttggaccatatacatatacatatacatatacatacatatatatgtataatgtatataaattccagaaccctttgcgatcacttacctgagcgacaagacaattacaccgactaacaaattcttcaagcatcccaacgggaatcttattgaaggatttgagattgtccaggatgtgcccatcattcatgacgacaaagaggcaatcttgaaatcatgtctttgaaatccatgaaattgatgttctaatcaggcatcccatcgagaaacttcttatcaacaccctcgattaggcagcctcaaattctctttaggagggaatgagttttcaatcccattcaagcaatcaaggttcgccttgactgactccattcctgaagatgaatatgcggaggaagtaacggttgttctaccatctgagtcccctgaaccatgtcttgagaatgatgtcccagacttctgttgatgcgaaaaacacacactggcctgagaaatttgctttactctagtgcaggttcaaagatttgctttcgggtttaggtcgtgccagttggtttgatcctgcaaccaacaagaaacaaagaatccaaagttaaatctataaacgatagccgatcggctggattgccgatgacgtatcgtttaacactggaccaatgtaacatggatcagatcagcagtgaaatatataataatgaaagaattagatctactcgatcggctgtagatatcaataatatataatcaatgcttcgaaaatatatttaaactaagtgattgggatagatcggacagcatgccgagacagtataaatcacttatgtctaaaactacttcagagcaaagattatatatattcatagcatagccgataggataaatctaatatgtatcggctagtactctgataccactttgtactaagatat

SEQ ID NO: 3709 - DNA, 1501 bp, Oryza sativa
ataccgcgggccagttgatctccaggtgggactcggagatatcggacccctcgcgatatggaaaagacccagtattatccgagtagaacttcttccgtctatagataccatatctaccacgtgacatatttccttaatgtatacggaaactatccgtatacgcgtgggtacaccgtgtcagtatacaacgaacatccaaggatagagggtataccttatccgtaaccctgacagtagcccccgacttctgcttaaatgaactcatgttatcgatcacgacttctgatgtcggaattgttgtcgctctcatctggtcgatctcggtgtgaaaaccgtagagacaaaagccatcgacaacaccgcgtgaagttcaacggtcatgagtgaatttaaattgaagtctgaaaactaccgcgcgcaacggacccagaattttccggcggcaaactctctcctttccttggaatacgcgccgtcggtagtgcgcttatttgaagggattttgggaattcatttaaagtccgtttgccagaaaacactcttgccttctagcgcccttcgtcttctccgctctctgcaaagaaaaccctagcttccttctttcctcttgttctccggcgatcctctggcggcgatggatcttgagaagtctacctcaaccaccgggtccttgaagaagctgcaagacgacggtgccctccctggtcgcaggaccatgcagagggaggcatgaggttaagaacctaaacccatcttgggccgcatggttgtagtcgaggattacatttcttgcggttttctttcttcgcctttcaagtttcttcttcttggcctgaatttctatggcctttctttgccccacttgaaccccaactctatcggctttctgagtgccttctctcacctttgcgaggcctacattggggtagagccctttcttgacctcttctgtttttactatgagctgcttgatggaatctagcagggtatctggatgtgttggattctgacttcgggatagcttgaagtcgcgttacatccccttccagtgcccctcttctcgcagcaagtggtggacgagatggttctaccttcaaatagagaactcggatcccgtccttgttgtccctgaaggtcagccagaaaaaatcccggagtaggccgccaaacccgccctaactcccgtcctttatcgccctcatccatcatctccgagaacgggggttgtcggggtacgaagtcgctgccgacttcataggtaggtggattcaaccgctgtaggcccacaaaggggggattattcagagcaggctcaatggacaatggggatggaatagctgttggatggttaggacatcctatctttagagataaagaagggcgcgaactttttgtacgccgtatgcctacttttttttgaaacatttccggttgttttggtagatgaagagggaattgtgagagcggacgttccttttatgggagaagttgatcgttgaaa

SEQ ID NO: 3710 - DNA, 1501 bp, Oryza sativa
tacggcgctggccagctagatcagggagggcagcatctttggtcccacctttttttttttactacgttgccatgtaggtgctacgtcaaataaagacttggtcaacgtctcacgtaggataaaaccaccgttcaaacagctcgaggagacaaattgatcctgtttttatagttgagggagcctctatagggtgttgctaatgtgagcgatcacccgcactcccctccccctatacgcaatacgctccttcctcttctcccccttcctcctccccttcttctctttctactacagtacatcacatttttttaaaagaaaaacaaaagttagaaaatttatgtatagaaatactatatataaaaaatttaaatttaaattcaaatttgaatcgggtatgtaaacttttgacttataaactttggatctataaactataggtgtataaactttatatgtatagaaatactatatatagaaaatatttgaattcaaattcaaatttgaaacgggtatataaacttttgacttataaactttaggtctataaactttaggtgtataaacattagatgtatagaaactagccgggtggcccgcgcaattgcgcacctagcacccaaacaaaatcatacatttttcagtataattttccttaaaatttattaaatagctatctcgttgtcttaagactttgaaagaccaaaccttatcatttgcgtatttctaattatatagtttttaaaagtcacaccagctgctaccccttacttctgtcatattcttctttatttgcttgctcgatctaccactagttctattcattctccttgaaacctttaaaaattggacttgtagtttttagagtttattgtcttgttgggtttcgtttttataatttctagaagtcccgtcaaacgctgccattatacccctatacggaccgtacactgtcttttctctttattgccattgtgattttataaatcgaacataattatcgttcgggtttaattttttactttctagaagtcccgccaaactgtcagcgactttgccattgtactcctttatggctcgcccgctgtctctcttctttattgtcattgagattttaaaatcgaacatgattattattgtattttttttttactttttagtagttcccaacctttaacaattggatcttgtagttttgtagtttttagagtttattgtcttgttaggttccattttttataatttttacaagtcccgtcaaacgatgccacaatacttctctacggtccatccgccgcctactctttattgtcattgggattctaaaaatcaaatataactatcgttgaaattcattttttattttctataagtcccgctaaccgtccacggctctacaactatactcctatacaccccgcccactgcttctcctttttattgccactgagattttaaaaattgaatatgattatcaatgaggtttatttttttactttctaga

SEQ ID NO: 3711 - DNA, 1501 bp, Oryza sativa
gaaacaaaatgcgtcaaaggtaaccatgcccgtgacggatacgcaaatcgcggcccgtcagaggtgacccacctgtgacgggcctttactttcgggcccgtcacaggtggatcacctgtgacggcttctatctaccaaagaccatcacctctgacggcctttctttacatgcccatcagagatgggtcacctgtgatgggtcctaactggccctaggctagcagagaccaacacctctgacggtcctctagttatttgtccgtcagaggtgacggccggccacccgtcaaaggcgactggagtcaccagtgaccactgatcactgaccaagcctaaacccgtcaaaggtgagggttgggcccgtcacatgtgaccttatctagtgtagtgtgaaaagctcgttgcactttatgaaggtaaacgatactatggccgtcactggtagcttgcgaacacctactagcacactgttgaactgtgatattatgtttgagacttgctaaatgctagtcctgaattaattattgttagttgttagcttgctattgtggagtaaattgcgagccatagctttacatgcatgttcggcattgccatgttaaattattgttggttgatcatggctagccatggagacttaattagtggtgtagggcgaatccacccaatttcccacgcacgcacattcataacgaacgacgttgtgattggaggcacacttttttccttttgggctagcccccgagtaactaccatcaggcaccagggtaacatacaaaaggagagaaggccccgtgcatggacatggcgatatctcgcaccgtaagtaccctactctcccaaaccttaactcttatcgcccaatcattagggtgctggaagggaccctaaggaccgattcaaggccttgcaggagatgcttgaaagaaaccgatctgcaaattgatcaccggtgacctctcatggtcagccgatgcccgctgatctatcaccaagaaccacctcgatcgtcgtcaacctagtggcctcgattttcctattaaatggattatactccgtaatataacaagtcaaccatgaatattttttttcacaaaaaaaaactagttctaactgaagttgattaatgaaacaatgaaatgtatgcaagttaaagttacttctaactgagtactacatccatcccaattctcaaaatataagaatctaaaactaaaaccagacaagacatatacttcatccattccaaaatataaggcacagtggtaaactctattagataacatgagatgtatgcaagcatgcaattaattatgacatcttctctaattaattatgacatcttctctatacttttttaaatcctacactctcatgttatctaatagagaagatgtcataattaattgcatgcttgcatgcatgtcttagagcaagttcaatagtatactccaattcatctatagccaatctaatagctcattcatacaatagttatata

SEQ ID NO: 3712 - DNA, 1501 bp, Oryza sativa
tcatcatcatcgggcacagtgtaaggagatttaaccttattccacacattattcccttgcgactggaggtaggcctccattcgtgccttccaaatgacaaaattgtgtccatcgaaaacaaatggtttcgcagagtatttttcctccatagcggcattcgttgccacggttaggttacaacgaacttaaccgggctctgataccaattgaaagaccaagaacggctatagagtggggggtgaatatagcaattcaaaacttgtccccaaaaatactcatcaagccggatttctcaaaattcttactagaaccgcggctattagagaagccggatctagaaaagaagagagatggaattctcgaatctagaagtgaggtgaggagaagatagcaaaactcgtcatcgcgaaattcaaatcgcaagcggaatttaaattgcggaatttaaaaggcgaagacaaaacgaaatgcttcaaatcattttattcatcggtgttgcaaaataaccgctcaactaggagcaaacatacacctttagaggaacattaacacaaactttaaaatctctcggacaaacacactccaaactaatcctaatacaaaagcctctcgggcaaacacactccaaactcacaccgaaactctctcaccgagcatctcaaaaggattacaaaagaagcaaccttcacccttgcatccacctctccatttatagcctaagacctcgtaagacattgtcacaaatgtctttagggcgaaaccctaactcagatgcaatctgggccttaggttgttccttacatcctaaggaagtagcctggattgaagccacgtcgcttgccacatcgggatcctcttttcacaaagagtctgcaccaaattcctcccatgtgcgtgcccgcgtgctcctcaacgtgggccccgtgatctgtgagaaggctcctctgagccaatcagcatgcaccgatcgggagatcgatccgcgtcgtctccgtcttgccgaatcgaaacttgccacgttgcccagccgtgccatgcgcgtcctgtctccttttcctcagcgcgcgcgcatgcccgcgccctgtccggagccgccacgcgtctcgccgagccgctccgcgcgcgctcgcgaaaaccgcgtgggtcccacccccgtgcgcaccgaattccttgccgccgcgtgtccactgcgcgcgcatgcctcgcgcgatttcccgcgcttgcccatgcatggtgtcgatgccatgggccgtcgtcttgtcttgggcctgctcggcctggcctccctgccagctgatccatccatcatcttgagccacgaagaagggctggattggcttggcctccctgccaaccaatcacaacacacatgcacccatgggctagcaagctcctcatgcacacatgcatgtcttgagcccgtgcatggcattcggccatgtgcacgcatgcataaccgaagcaccactgcccatgcttgcatatgcacataccagtgcat

SEQ ID NO: 3713 - DNA, 1501 bp, Oryza sativa
tttccttttttggcaccgtattactttcctattttagtaaatttatgcacctaaagtttatagacctcaagtttacatatctaaagtttagagaccaaaagtttataagtcaaaagtttatatatccgattcaaatttgaatttaaattcaaatattttttatatatagtatctatctatctattatattattaaaacagctttgaaaggagtcaccacgttcgccgtgagggctagaaattcccaaattaatcggagaaaaagaaaaggagagtccaagtagaaatacaatttaaaaatagctgaaattcagaattaaaaataagcaatattgaaagaagagtccatataagaacccaatacgagattaatcaaaatttggaataaaaataaaataaaatccaaaattagaaaagaataggagagtccatgtaagaatacaattaaaaaataactgaaattcgaaattaaagataaggaatattgagagaagagtccatataagaacccaagacgagattaataatattcagaataaaaataaaaataaaatccaaaattagcaaaaaaaaaagaagagttcaagtagaaataatatttaaaataaaccgaaattcggaattaaaaataagcaatattgaaaaaagaatacatataagaacccaatacgagattaattaaaattcaaaattaaaaataaaataatatctaaaattagaaaaattaaaagagagttcaagtagcaatatattttgaaacaactgaaattcaaaaataaaaatattataagaacactatacggtattaattaaaatttgaaaaaaaatctaaaattagaaaaagaaaaaaatatttcaattaggaatagaatttataaataactaaaattggtgataaaaaaaataaagactactgaaaaaaaagaccatctgaaacacatgacaagataaattaagtaacatgcttagaaaggagtagagtggtgacgattgatacgacatataaaaattgttaataaaacaccaaatagaatcctaatgacgattaaaaggagcgacgacaggcaagccgtgaagcaaatgggcaagacagttgccgggacttctagaaagtaaaaaaataaacctcattgataatcatattcaatttttaaaatctcagtggcaataaaaaggagaagcagtgggcggggtgtataggagtatagttgtagagccgtggacggttagcgggacttatagaaaataaaaaatgaatttcaacgatagttatatttgatttttagaatcccaatgacaataaagagtaggcggcggatggaccgtagagaagtattgtggcatcgtttgacgggacttgtaaaaattataaaaaatggaacctaacaagacaataaactctaaaaactacaaaactacaagatccaattgttaaaggttgggaactactaaaaagtaaaaaaaaaatacaataataatcatgttcgattttaaaatctcaa

SEQ ID NO: 3714 - DNA, 1501 bp, Oryza sativa
agtactaataatttggatatttgtactcaggccttgtttagttctcaattttttttcccaaatacgtcacatcaaatctttagttacatgcatgaagcattaaatatagataaaataaaaaactaattcaacagtttgcatgaaaatcacgagacgaatcttttgagtctaattagtccatgattagccataaagtgctacagtaacccacatgtgttaatgatggattaattaagcttaataaattcatctcacgtttcttggcgagttatgaaattagttttgtcattcctgtccaaaaacacattccgacatctggtcaaacaccctatgtgacacccaaaaattttcttttcgcgaactaaacaaggcctcagtctacattcatagtataggatgtgtcagcatcggttaggacatctacaatcagggacactctactgagggtactctctgggaaactcccttcgcaatggaggacaccctagatgggctccccatgaggcaactggatgaaagtactcaagcccacaatgggtgtctcaaccaaaaaacccacagtgtgtgttttcctatactacccctctcttctccctatctctctttccctctcctcttttttctccgcctctttcccctcctcttcttttttcttcgccgggtttcactccctccgctcggcgccgtcgtcgtcctccccctccctctccctctctatctcgcgagcaccagtgccacctccctcctcgcccttcccagccgccgccgccgccactttctcctctctctcctgccgctgctcgcctctctctccgtgcggaggagtccaagatagaggtggagaaggtcgcgacggacgctcgccgctgcccgtctctgcccggtggccgacggcagcgaccaccaccacgaagttgtccgcgtgctcctcggtggcgagcacgggcgcctcaagcagtggcgatggcggcggcggtgcggtgcggttgcttctccgccagatccggttgtcgtcgccatcgcctctctctcctctctctcttgacgccgcctcccttctcgcagctctggtgacgcctcctgtctctcttgtcggcgtctctctctcgcgccgccgcctcgggttcctccccaccgccgtcgccctcctcctagcaacgagatcgagggtagaatgggaaatcgcaggtgcggtagtcgtgtccacgagcgccccaagcccccaacgtgtcgcctgcctacgactccccacgaaaaaccggcgagacgtgtagagagccgcgccccctagcacccccagcagagggacgcgctccatcacgggggaacagggcggacggaaaagcgaacggccgtcgctagtggcaagacctggggttacccattgctgatggccttagcgagcctcctatcacttacaggtgggcccggcggcttgcctcgatttccccgacaggccggctcgtcctcgtctccaaagtctccccaaactcgaaaaaaa

SEQ ID NO: 3715 - DNA, 1501 bp, Oryza sativa
accatacattaaaaaaaaaagtgaggaatcggcatacatcgaagcaaaggggggagacggcgtgaggggcctataaccttccgtctcgaggtcgctgccgggggcgacggggccgcgatcgctcgaagccgaggatttcctcgccgcgggtctcaccacgtcacgccttggcttggcggtcgtcgtggcggcggcgagcggtgccaatggccgctcggtgctcctcggcttcttcggcggcggcgcgtccaccttgccgtgcgagccctcgtgcttgcgcacctgccgccccattcgcgctctagggttttgtggcggggggaaaggccgaggaggactggaggaggacactactccatttttgtgttcttttaacttttttttcgagtttggggagactttggagacgaggacgagccggcctgtcggggaaatcgaggcaagccgccgggcccacctgtaagtgataggaggctcgctaaggccatcagcaatgggtaaccccaggtcttgccactagcgacggccgttcgcttttccgtccgccctgttcccccgtgatggagcgcgtccctctgctgggggtgctagggggcgcggctctctacacgtctcgccggtttttcgtggggagtcgtaggcaggcgacacgttgggggcttggggcgctcgtggacacgactaccgcacctgcgatttcccattctaccctcgatctcgttgctaggaggagggcgacggcggtggggaggaacccgaggcggcggcgcgagagagagacgccgacaagagagacaggaggcgtcaccagagctgcgagaagggaggcggcgtcaagagagagaggagagagaggcgatggcgacgacaaccggatctggcggagaagcaaccgcaccgcaccgccgccgccatcgccactgcttgaggcgcccgtgctcgccaccgaggagcacgcggacaacttcgtggtggtggtcgctgccgtcggccaccgggcagagacgggcagcggcgagcgtccgtcgcgaccttctccacctctatcttggactcctccgcacggagagagaggcgagcagcggcaggagagagaggagaaagtggcggcggcggcggctgggaagggcgaggagggaggtggcactggtgctcgcgagatagagagggagagggagggggaggacgacgacggcgccgagcggagggagtgaaacccggcgaagaaaaaagaagaggaggggaaagaggcggagaaaaaagaggagagggaaagagagatagggagaagagaggggtagtataggaaaacacacactgtgggttttttggttgagacacccattgtgggcttgagtactttcatccagttgcctcatggggagcccatctagggtgtcctccattgcgaagggagtttcccagagagtaccctcagtagagtgtccctgattgtagatgtcctaaccgatgctgacacatcctatactatgaatgtaga

SEQ ID NO: 3716 - DNA, 1501 bp, Oryza sativa
agagagagagagaggagaagaagcgaagcgagaggtggaatggcggtggcgtcgtggcttggaggcgacgggtggtataaataccagcgagggtaggggcaggagggagggtgacgtgtcctgtggggaagccggcgcgcatgatctcgtgagagggggaactatagttttaaaaacgtgcaaacgccttgacccatcgggggcgatgagctggtctttgtattttgttttttttttactgcaaaattccatattgcttcatgcgttggacgaccaaacggtctctgcttctctggtccaatcctaaaaaaaaacccccaacaaattcgttagaataatggagagagaaacaaacaaacaaagctttagttcctccttcccgttttcatactataaattgttttgatttttattagctaaattttgttaagtttgattaaatttgtcaaaattaagaacatctaaaatactaaattagttccattaaatctaacaatgaatacattttgataatatgtttatttttatattgtaagtattaaaatattttttataagcttgaccaaatttaaagaaatttgattaactcaaaatgatatataatataaaatggatggagtaattagcatatgtttttaacttgggtttattcacggcatctgttggaaaatgcgttagaaactacgtgcgtactcctccagttgcgctagctggttcaaataatgagattctctgatactgatgtgtgtgtagacttttttttcttttttgacaaaaaatttctatgtggtatacagtggcattgttcatcgttgaaaatgtatatatatagtacaattttctgtttgacttggatcattgaataaacgggttttgttaggtctcaaaagaaacgctgagtcaacactataagaacggcgtttagggttgtcctacaattgattttgggagtggctttcaaacatgtatcataaattaaccatgacttaaataacctggtcctccaaaaacaaattcaaccagagatcgatatgccataatatatttttaatttaaacatttctggcaaaagtttagaaacaaacaatctgatgtcacagttaaattcttattacggcacgatactatcaagatatgatagaggagcatgttgaccccgtttcttaaaagtggtaggttgcacatatgtatatgagcacatgtgtttttactatgtggttcaaaaacaaaacttgtacaaacaaataagttaccggcaatttcaaagttttgtctaaatagttgaggaaaagatttcttagctaaattagtacaccttcgtctgaaaataacaacttttaaaacttaaaatttatttcaaacttaacaacaagtggtacttgacaaaaaaatatgacttttaccactaaactattcgtagtatcccaacttcaacttattcagacctatatcttaaccatgcatcccaataacacaaccaagtctttttacttttcttctt

SEQ ID NO: 3717 - DNA, 1501 bp, Oryza sativa
atctttcagttttaatctatatacctgataaaaaacttgtaagccttccagttctattattattattatccggatcttatctgtaagcctttcagttttatgctccgttcgtattttcgttgttttcttccgtcgcggttttattatttttcatttttttttctcatacggtttttttccgccaccgttttttcgttgcggtttttttctcgcacgcggtaagggcttctggcttttcggttttcttttcgtcaccgtcttttcccttcgctatacctatctctagctccaccaccacatcgatatatctcttcatgcgttttctcctccaattgattgcaaaaatcgatttcacactcatccctcatcatttccccatgatttgccccttaaattcggctttaattggccggatttaatctccatttaaccgtcgtcgatgatggcaggccagcaagctaacttggccatttttatcccaagttttgctcactccaattttggaaaaaaaggaaagagaagatcgagtggataaaaaccctaaaccaattttagaagatcgacaaagattcggacggatttgatggggagaatcaattatggtattgtacgagcacgacaccatcttctggaggttgaagacgtgcgacctagacctacggctccagctgtaggttggaccaaagagaggcaggccgagcggagggaggtagcagactgggctagggctgaaaaagaagaaagggattggctttcggcccaaaactaagaaaggagtataacgtatgctgatttaaaaacatcttatctgttgcaacacacatgcatttttctagtataaccctaagtaatattgattacataaaacatactccataaattttgacacatgacacattgacgagagagtactatatccacctatggtatttatagagtatgggggtagttggtgtcaccaagattgaagtaaaagagatgaaagacaaggatttttatacatggtcatgaccttaactaacaagtaatagccctgctcttcttggttgaagccggtgttgcctttatctatcaacatcacgcgagtataatatttgggatgacctaatctagtcactgttggcctagccgcatggagctctcacatgtggttgacaactagtgtaatcttatttctcgagtactatgaacttggtgaggtttgaagttgttttgtatttgtttagatctgtattggcttgtgttctgtcttggcctcccacttcttctagtgggacttgtatttatatcttcgggtgtgcctttttctaagtaaaactaagtaggcaagtattatacgatccaaatagtcctggtagtatcgagtagactctttttcctctttctttatctggaatacttttcgtatattaggattgattcagtataaaacttggtatatggtgggtcccaccgagtttaacacaaaaatatatattatatatgccttatctataacact

SEQ ID NO: 3718 - DNA, 1501 bp, Oryza sativa
acgcaggcagtgggtgatgacgtcatcatgtgagccatggcagtagcaatgcaatcgtgtacgtgcacagcacaaaaattaatttagcgtgagtgatcccatgtttatatatgctctcgaaattaaacctgtaatttggttggattattttgttttttgctacaggaatatacatggccctgcaaagtatgcgtgatcccaggatacatgggagatgcatccttgaaatcgtgaacttgcagaaggtgtggatggatcatatcagtaactgcatctgttaggtttggtatgtgtgtgccatatgcttgtgtaccctccttcaaagaaaactatctacggccacaggtttttgtaaaaatatgtcaaatataattatattataaatcaagtgtaattaattacatatatgtaatttagagagttacatacgtaattttggaacttacacatataatttaggaacttatattctagatacactataattaataattacatatataatttagggacttagtacaatataaatacatactgactactccctccatcccaaaatgataatcatactccctccgtccctaaatatttaacaccgttgactttttaaacatgtttgaccgttcgttttattcaaaaaatttaagtaattattaattcttttcctatcattgtattcattgttaaatatacttttatgtatacatatagttttacatatttcacaaaagtttttgaataagataaacaatcaaacatgtttaaaaaagtcaacggcgtcaaatatttagagacggagggaatatatgtttatgcatcaagactaaggataatttaaatcacatcaatcaagacaccatgcacacattctcctgcaatacatgcatcaattaaaacatcatgtcaattacaccctagcatgcacatattctcttatgcggcattaattgtattttaatgaaatccgtgttcatgtggttatatgataatcaatttgagaaattttggattccattatatgatgatcaatttggaaaggatggagtattttttttcatgaaaaatatggcaacacatttatatcaaatccgaagaaaaaaccagcttctgagaatgaatccgataagcacttgtttagatttattctttcctttgatgcgccaaatcgctactcaatgtttcagttcacctcccactctcaacagataatggcagcattatctgtaggcattcttgaaatgagaagctgctgttggtctctgactcccctcaaggcctgaaaaaagagtataaagaatcagactgacttagttatggatgatcctatgagcaatcagcaacaagttccaacctttttcattttcattgttcgtttattttggtaattacataggatctagttgtacaactcatatacaacgaaacatgtaaccatagattaatgaaagaatagcatatccatatacactgtagtcatttacaaccgttgatcaaatttagt

SEQ ID NO: 3719 - DNA, 1501 bp, Oryza sativa
acatttgacatgaccattcttgccctgcttggagtgcagcacaactgcacaaggcaaatactactggggctctattggagtatagacttctactcctacttgagttaaatctaccacattattcttttctctgtggttctgatcacagatcaaatttaacattgttcgctactactaatgtatcagaatcctgttgagctcatggattcagtacgatttcaagtctgggtattaatttgattgtagataaaattcatcacaagaatacaagataatgcaggactctggaagggtggatcgttgagggaaaaaaaaggctgagaataaagtatgagggcgttcacagcgcaagtacgtggtgtttagccccacatcaagaaaccgaatattcgatgtcatatcgctaatatgtggagccaaaacaagacactcgttcttcgccttgctcgagggcttgcgagttgcaacacagggaggaacgcgcgcagccgcgttgtgaagggcggagccttacgcagcatggctttgcacatgcgtcggcgagtgaccccctccccccggctcaccgacgtggaacctgtattttagacccgtatctctagcctatgtggcactgtgaggctcctcaaactaatgtgactgtactgtgaacatcgtctagttaaatatatacaaacatatatatttttttcagaaacttttgggtattcacgtgatacccaagaaccctctggatctgcccaagcagcttgccaaggagctgatttgattgattttgccaacgtaatcttcatcgctacctaggaaaaaccgacttcttcgctggaaagaagcagcagctttgctcaacaaatggcaccaaactcaagaaaagtttcattctgaagacaatttttgaccgacgaaaatgcagcaagcaaagcataattaagcatcctctagtcatcagtcaaacgtatgctaccatgctgtcaggaaacttcggagttttgtaagtaaaccaacaactttggatcataacaggaagatggagtatgaaagagtactaaacagatgaagcatatcctcttcagtgatacttttcttgtgtctgaaacaacttggaattagacgaatggcccacaaattcccttttttttacttgatttgctagtcttactcgatcataataaatatagcaacatcaactacaaccggtcaatcgaggtttttgggcactgatcataataaacataatgtcaatcgagtaacatttagtttaaaataaaatactgctaacatttactagtacctggacaaggtatgcagaaagcaagcctgaaatctgaaatctgtactcctactggcctaccttatttaccacactgcttcccaagttctctgttcatgagggccctactatttattctccaggatctgggcccaccagccaggatagcatcaaaacaccctgtccatgatccaaattcatgcttctttgtactagcaaaacaccaatgtc

SEQ ID NO: 3720 - DNA, 1501 bp, Oryza sativa
cactaatccgttcgacaataagaccagcagtaggataagaaatccagacctccaaacgaaaattgctatacatatacgacctaactgttcgacttatatattactaaatttgatcaacggttgtaaatgactacagtgtatatggatatgctattctttcattaatctatggttacatgtttcgttgtatatgagttgtacaactagatcctatgtaattaccaaaataaacgaacaatgaaaatgaaaaaggttggaacttgttgctgattgctcataggatcatccataactaagtcagtctgattctttatactcttttttcaggccttgaggggagtcagagaccaacagcagcttctcatttcaagaatgcctacagataatgctgccattatctgttgagagtgggaggtgaactgaaacattgagtagcgatttggcgcatcaaaggaaagaataaatctaaacaagtgcttatcggattcattctcagaagctggttttttcttcggatttgatataaatgtgttgccatatttttcatgaaaaaaaatactccatcctttccaaattgatcatcatataatggaatccaaaatttctcaaattgattatcatataaccacatgaacacggatttcattaaaatacaattaatgccgcataagagaatatgtgcatgctagggtgtaattgacatgatgttttaattgatgcatgtattgcaggagaatgtgtgcatggtgtcttgattgatgtgatttaaattatccttagtcttgatgcataaacatatattccctccgtctctaaatatttgacgccgttgacttttttaaacatgtttgattgtttatcttattcaaaaacttttgtgaaatatgtaaaactatatgtatacataaaagtatatttaacaatgaatacaatgataggaaaagaattaataattacttaaattttttgaataaaacgaacggtcaaacatgtttaaaaagtcaacggtgttaaatatttagggacggagggagtatgattatcattttgggatggagggagtagtcagtatgtatttatattgtactaagtccctaaattatatatgtaattattaattatagtgtatctagaatataagttcctaaattatatgtgtaagttccaaaattacgtatgtaactctctaaattacatatatgtaattaattacacttgatttataatataattatatttgacatatttttacaaaaacctgtggccgtagatagttttctttgaaggagggtacacaagcatatggcacacacataccaaacctaacagatgcagttactgatatgatccatccacaccttctgcaagttcacgatttcaaggatgcatctcccatgtatcctgggatcacgcatactttgcagggccatgtatattcctgtagcaaaaaacaaaataatccaaccaaattacaggtttaatttcgagagcatatataaac

SEQ ID NO: 3721 - DNA, 1501 bp, Oryza sativa
ccttgacaatagatgcaatggtgacatcttcatttgtagcctccttgtccaaaaccatctttatcttccaaagttcatgaaaatagcaagttgaagttgggtacaacgtaccagatactgcaacagtagcttcatagaaaactttcaacaaagcacaaagcttctcagccattgtccattgataatcgaagggttgatgcaaataatttatgtcatgccgatccaaggcttcaaaggccattctgtgtcatgcatgtggttcgactttttgtgctcctagatggttgaagggaggcggcgctgcgggcgttgcaggaggaatgtgcgagcgtgctgctagctggccatggcggtcaatttgttggactaatcagcatagcacacaccaaatccgagaagaggaggagcagcactgcgtaaaaaaaatactccatctgcgaagaagagctagcacctaacgcagataggagcatctcgcaagcgatcgagacttcgagagcatggagccacagctgccgaccgtgatatcgatggagtgggatagcaccaccgagccggccaaatcgtcgccgccgtcacagaggtacggctacctggagaggatccgtaacttgtccgtcgtctcggccgaggccggccggtggtggtggccatgctcgtcgtcgtcgacggcgagatccagctactacagcagcagcatgtcaagcagcgtgtccggtactggctctcagaatcaacggtacgtctcttactcttcgccgaggatggtaagactcgacgtccatggtcctcgagacattgcgaggcagatggtgcacgatgcatgggttcatggtgaacttgatcagagacttcgaccgggagcccgaccatgcgctggagaggtggttctccgagctcgacgtcggttgggtactccggtcggcggcggagaaggagctagccgccaagctcggcttggatgatcttgtgcagcggtggacgcgaggatatgccgtgatggtcgaagcactcgtagctacgcagcaaaatatgaaatttcaggatcataccaatatggagctagaagacgacctccgacctctccaagtcactcggttcgtggaggcgaccgtatccaagatgcttgcctttgctgatgccctcgccgctgataacacttggcggccaattgacaagctctcgcggtcgcggctcatgtgcctgtgcacctcgatcaacgagtgcggcatacgaatcttgtcagaaataatagtatttgagtttgattgcatattcagcaaaatgaatggtgctttctcagccatatacaggatggccaaggatgctgaagccatcacttgaaagaccaagaacgactatagagggggggggggtgaatatagcaattcaaaacttgtccccaaaaatactcatcaagccggatttctcaaaattcttactagaactgtggctattagagaagccggatctagaaaagaagagagatggaattcccgaa

SEQ ID NO: 3722 - DNA, 1501 bp, Oryza sativa
aagcacaaagcttctcagccattgtccattgataatcgaagggttgatgcaaataatttatgtcatgccgatccaaggcttcaaaggccattctgtgtcatgcatgtggttcgactttttgtgctcctagatggttgaagggaggcggcgctgcgggcgttgcaggaggaatgtgcgagcgtgctgctagctggccatggcggtcaatttgttggactaatcagcatagcacacaccaaatccgagaagaggaggagcagcactgcgtaaaaaaaatactccatctgcgaagaagagctagcacctaacgcagataggagcatctcgcaagcgatcgagacttcgagagcatggagccacagctgccgaccgtgatatcgatggagtgggatagcaccaccgagccggccaaatcgtcgccgccgtcacagaggtacggctacctggagaggatccgtaacttgtccgtcgtctcggccgaggccggccggtggtggtggccatgctcgtcgtcgtcgacggcgagatccagctactacagcagcagcatgtcaagcagcgtgtccggtactggctctcagaatcaacggtacgtctcttactcttcgccgaggatggtaagactcgacgtccatggtcctcgagacattgcgaggcagatggtgcacgatgcatgggttcatggtgaacttgatcagagacttcgaccgggagcccgaccatgcgctggagaggtggttctccgagctcgacgtcggttgggtactccggtcggcggcggagaaggagctagccgccaagctcggcttggatgatcttgtgcagcggtggacgcgaggatatgccgtgatggtcgaagcactcgtagctacgcagcaaaatatgaaatttcaggatcataccaatatggagctagaagacgacctccgacctctccaagtcactcggttcgtggaggcgaccgtatccaagatgcttgcctttgctgatgccctcgccgctgataacacttggcggccaattgacaagctctcgcggtcgcggctcatgtgcctgtgcacctcgatcaacgagtgcggcatacgaatcttgtcagaaataatagtatttgagtttgattgcatattcagcaaaatgaatggtgctttctcagccatatacaggatggccaaggatgctgaagccatcacttgaaagaccaagaacgactatagagggggggggggtgaatatagcaattcaaaacttgtccccaaaaatactcatcaagccggatttctcaaaattcttactagaactgtggctattagagaagccggatctagaaaagaagagagatggaattcccgaaactagaagtgaggtgaggagaagatagcaaaacttgtcatcgcaaaattcaaatcgcaagcgaaatttaaattgcggaatttaaaaggcgaagacaaaacgaaatgcttcaaatcatttcattcatcagtgttgcaaaataacagctcaa

SEQ ID NO: 3723 - DNA, 1501 bp, Oryza sativa
acacgcgggacccgcgggtcagaggcacaggagagagggagagggggcggctggcaagcgggacccaccgggcagcgtcacaaggggggggggaaagcggcgaggcgcccggtcggtccggctcggcttcaaaccggccgaccggttatggcgagggcggtgccgcgcacgcacggtcgccggcgacggcaaccggaggcgcgggaagcgacggcggatgacggcggcgcaaaggcggcggcacacagccgaagcggcggctcggcccggcacggcgctaggagggagaggaaggggaaaagagggggaggggcgcctcaccgcgagttggccggcgtggggggggaagacgacggcgaacggcgacggcgagcgaccggggaacggcgacgataggcggacgagctccgagacctcctagggaacaagatgggaggtattagagggagaggggtggttaacagcgagcggattcgccggtcgaaggcggcggccatggggtactcaccgacgcgcgaggagaagcaagctccggcggcgggattgaccggggaaacggcggacggggtggcgcacaagctggcgaacccggcggcgtcgtcggcgcggtgcggcgacggctctagcggtggcggagtgcggccggagcgtggcggcgagcggcggaaggcgggatgagaggcgcgggagcgatggagagctcgggagggctcggccgagaaaggaaaaagagagaggaaggtgcgggcgtgcttaaataggagggggggcggcgagtcgtggccgggaacggcgcaatttccccggagtagtggaggaggtggaggaggagagagagagtgggggaaatttcaaatcccccgccgtttgcgggcgcgcgagctggcgggaggtgcggggaaagtgggcggcgacgtgggcgtgcggtacgggcggagtgggcgcgggagcagcgggatacgcggcggcgtgggcggtggtttcgacggcggttggcgcgggcgtgggcggccggaggttagggaaagggctgacaggtgggccccacctgtcagcgcccgagagggagagggaggccgggtgaacttcgggagtgggagggaggagcgggccggcgcgggaggaaatgggccggcggcccaagaaaaggaaaaaggagggaaaagaaaagataaaaggaaaaaggattttcccagggatttaatattgcactttgcttattttaattggttaaaattatttccaatgctctgaaaattccactaaaaatcctgttagcatattttgacatgtagaatccaagaaaaattccacatgccgattccgattattatttgcatttattaatttagggtttctctcttgcctctaaagaaataatttcttccaaccatttattaattgaatttttgctagggaaaagaacttctgggcgcgacaaacctaccccccttaaacggaatctcgaccccgagattcggaagagctggcgaagaggtgc

SEQ ID NO: 3724 - DNA, 1501 bp, Oryza sativa
ggggagccgttggagagtcccgaccatctccgaaaggcgctgagcgaggcccccctggttggcggcgtacttcacagtccgcccgccccagaggcctgcctgccggccggcgtgatctagacgggagacggcgtcccgaagcatgccgggccctacgtcgcctgccaaacggagggcctcgacctccccggcggacgagtctagcgcgccctgcagatcggcaatggtgtgttcggcagctgcgaggcgggcggctaagtcgctttcgcccgtgcccgcaccgccgctgcgcgccctcgcgtccagctcctttgcctgcgcctcgagttcagcggcccgctggttcagtgcggccttctcggcgcgggcaccttccaaattgcggcgcgcttgttcctctagcacagcctcacggagggacgcgctctccgccagccgttgcgccgtggcctcggcctcctcaagagctcgctcccgatcggtgagcgcgtcctcgcggaggcggagtgcgcactcctcctcggcgcaggcggcctcgtgcgccgccagcgttacctcccggatggcaacggcgggctcgcggtccgccaggtccctctccacgacgccggcgcgctcttccagcgccatggcacgagcctccagggcctcttcgcgccggcgagacgccgcctcggtctccggcgtccgccgttcttgggcagcggcagcgtcaaggaccccccgggcggagtcgagctttttccctagctccgcctcccagctcccgtattgaaggcggagggtgtcctgcgcctcgttcatcacggtggtggcgatgagggcagccccccgctccttctccacctccttggcgatctcccccagcaccttccgacgggcttcgagctttgagacgtgccggcggtgtgccttgcggcccacctccaccatggcctccaccgagcgtcgcccctcttcgacacgcgcccatgcggcgtcaagctccgcccgctctgcttgcagggtctccacctgggcacttaacccgtccaacaccgtggtgtttgcgacggccaaggcctgcagaaggggttctgcgctcagtggagcaacggaaggcgtggggaagagccgcctcggtgaggatgccgcgcggctcggcccgccgatgaacgtgccggactcagggatgtcccccagacctggcttgtcctgagcgtcgcccgagggaatgggcccaagcgatgcgcccgcggcctcgtcgcgagctgcctcggaagtcgtcgccgcctcggcctggcgaagtctggcctcctcccgagcggcttcttcagcttggcgagctcggacggccacctgggcggcctcctcggcttcccgtaggcgatccgcggcttctcgccggtcagattcccgcctccgagcctctgtggtcgccgggtcctcggcctcagactggccggacttggaatggcaggagggacgcgacgagatctcgctgaaacagaagaaagaccag

SEQ ID NO: 3725 - DNA, 1501 bp, Oryza sativa
aacggccctgtccctgtcaccagcaccctcctcgtccccatgtcgtacaacctctgcccatggacacgagcaagaacagcatactcacaaacaagaataccccgtgaaccgatgaacgacatgaagtaatgtgtgcatgctcgctggtgatgtccgggatgttgaggccattggagaagcgaccggcggcggctggacctcgtcggccagcgagctgcgtgcgggggacctcgccggccgacgccgtgcgcgaggagcagctcgtcgatgacggccgaacgccccaatgtgccaatcgggaggacgtcggtagctggcggttctcgacggcggccggatgcgtatgctgggaagacatcgactgctgatggcgggcagatgtgtgcgcatggaggacctcggcggccggaggcgctcgacggtagcaagatacacgcgcaagtcattgccggtcggcggcgagcgctgggaggacctcgccggctggtggctcgcgcgggaaggaccgacgagcgagctgctccctgcccgatggacgaacgacggcacggcacggaccgactgacggatgcgacgtcggatggagggagtgtcacggagtgaaacaattcgcgtctctggtggcatattctgaaggtgttacgaattgagtggcaaaagctgaaagtgctacgaatcagatagcatatatactgaaaattctcgagatcaacggaagtgagtgataggggtctttttttctagggttaatttttttttgaccgaaaaacagtgggggagagagatggcaacgggtgcatatccatcgggttcctttgccccatacccacacgcatgatatcaaaatatttccacttaaatacccacacccgtcgcgggtacaaaatcgtccccatacccacacccatgcggataacgggtatccaacgggcacccatacccatataattgacttgtagtatttatagttttgtactctaattagctatattagagttgtaaaccattaatattttctctagcaacaatgctattaatattagtgttcaaaggcgagtaaaaaattatacaactacattacataatcaagaaatcaactaataattttatataactagtctagaacaatgcttaaggtgtgaaaagagttttatgctatgatttagtagtcgttgagacctatatggctctgttttaggctcaatcaacaggtttttttttacccacgggttggtgggtacgggtgggtaaagaacatacctatatccatgtatctaatgggtaagagttttcacccgttagtagatccatgggtataagagttagaacacgattagctcctaatggagtaaaaacccgtcgggtctcgggttatgggtccccattgccatctctagggagaccccacgtttttctagggttaattggatctatgccattacaaatatgcatatttagataaatgtcattacaattcgtcaattcgtaactatgccattgt

SEQ ID NO: 3726 - DNA, 1501 bp, Oryza sativa
accgcccacagcacggacaccgccgcctccgcgccgcccatcccgccgcacttcatcatcctcgccgccgtcccggagcagcgactccaccagcctcgccgcgtcgacgcgggcctcgagcccgctcccgctccgcatcacgcgcgccagcgacgccgccaccgacggggcggcgccccccgcggcgagcgcggcgacgacgcgcctcctgttctcctcctcgatgcagtccgacgtggcgagcaccgcgagcacccggacggccgcctcgacggcctccacgccgccatcatcatcatcgcccttccccctcctccggagcaccgacgccacggtctccgccgcgccaccgcccaccggccctcgcgagcgcgttcttgtcgaattcgtcgacgtcgtcgtcagacaggaacgccgcgagcttacgcagcgccgggcacgggtcgaccccgggcgccgcgacccggcggaggagctccgccgccgcagcagccggggtggggccaacagccgatggcgccggggacggcgcggccgtggatgcccagagcgcgatgaaaccacgatggcgtcgctgtcggccgcgcccctcgcgaacgcgcccccgtggaacggcacgatcaccggcagcctcctcccggaacacgccgtcggcaggttgcacggcgcggcgggagagcccctgcgccaccgtcgctgcggtcgtgtggctgcggaggcggagggttcgcggcggcggggcatcgtatcgtagcgatgagacaaatcgtaagcgattagaagattcaaacaaccaatcaatttcaaaatcgtctgcagcagcgaagagccgaagaccacacgtatgggctgcggccctttcgcttgccgagtttcgaggcccatacgatgaagccactgagctagtaagctctccttttagtcccacctcgcctactgaacaaacattgcaccatcttatatattgaggccgggaacgccaatgagtgaaacaccctctcctgagccgagcgagcacttgagattctgtatgtgtattttgagcgacagctggttctttcgcatatatcctaggcccgattgaacttgttatcctttgactttattgaaaatttttttttttatcgtttggactggaatttaatttcgtgcacaaatgaacatttattgtttaggctaccccataccaacattatagtttggactggaatttaatttcacgcataaatgaacctctattgtttaggctacagttctattcaggactctcattcagaatgtgttctttgttgcatatggaccagctaaaacttgatataaatttattttagttgtacgattagtgtataatgtaaatgggctcatataccatacaggtcatggttgcgtgaatgctcgactccactagctagtagagattgaaaattttaatattaatacgctaactcggtgtagctatcacctacaaaatacataattcacacatttatgtgtgtataga

SEQ ID NO: 3727 - DNA, 1501 bp, Oryza sativa
gtggtgctgtcgtgctgctgctgctcagttccagcttccttgcttcccccttccagctccgagcacgctttccttgtgaaatctcgcggctgtggcgagcagatttattaccagacacttgcatgcgcgcctggtcttttgttatcgttgtgtgcagcctacatgggcaacctactctggagctctttgctgcatcgaatcttacctctcccaacgatggctcgcagtgtaggtatgcatccacaaggcttctcaaaactagcccagtcatcctaccaagtgcactcagtttgggttaaaaaaaatcactgcttccagaactgttaacagtgtgtttactgaaagttctctgcatgttttccatgtttagtaaattaattaattgtgcgctatcaatttttctcgtttctagtgctctggaaatcttgtcgaaatatactccccttcccataaaaaataaatctagtacaggatgtgctacatactagtactgtgaatctgatggccccattatttcgcttatccgtggaataagccaaatgacatatttacaaatgaaaagctacagcctcgtcgagcttgctctatgcagcctcatcgcgtcggagaccgaggagatgtgtgttagtggctgcatcattgagcttgagctctacggcctcctcgcgttggaggccgaggagagacacgccagcggtcatcgaggttggagaggctgggaggagccatgcgcaatgaccgtctacttgaactcgagctctgcagcatcctcgcgtcatccacgaggcgtgcacactactaggaaaacgttttttccgtgctgttgactctgattttcgcgtgcgggtgcatatgtcgcccgcacggaaaaatccggaaattttttttcaaaaatccggtggcggtgccgctcccggccgccgcctcctcgtcgtcgtcgtggtggtggtcggccgaggatgccgctcccgcactcgtcatcgtcggcggcggcctccgcgccgccggcctgagggaaggaagaggaggggaggggagctggatcctgcggggggaaggtggccggccgctggatctgtgctcccgctggcctccgggctcccttccggccgcaccgccgccaatgcccctcccctccgctggatttggggagggaaggaaggggaggggcggggaggggagcaggatctcgcaggtgagagggtggccggccgccggatcggtgcggggacggccgccactgctggatccgtgcgggggttggccgccacccgccggatcccgctcgccatcgttgcgctgccactgccgacgagttccgtcgcggccgccgcgcgtcgtcgttgccgccgccgtcatcgcgcgccgtcgggactcggggaggagaggacaggagatgacgaggaaaatgaggagaggagaaaaagaggagatgagggaagaaaaagagatagagaggagagatgagaggagagagaagggaaattttaaagtggatagg

SEQ ID NO: 3728 - DNA, 1501 bp, Oryza sativa
attttttaaaatatagtgggacccactcgccataccttatcttcccctcttcttcttccttttcctctctctcgggttcagagtgtgcacggcgagcggcggcgcgcgggggcggatggtcggtcggcacgcggaggccagcgatggatagtgggcggcggcgtgctggggcggacgggcggttggcgcgcgtgggctagcggcggaatgcggagagggcacggcggaatgcggggagggcacggcgggcaacgggcggcgccgaggaggccaggagggtgttggaggcgacgggctacggcgacgagtcctcggctcaggcgggcgctgccgaggtcatccttcctgccggaggcagcggagagagaggtgcagagcctcttctctggttccgatgtggagtcggcgggatccacggcctccccccgtctctctctctctctctctcggctcaggcaggcggctggcgatgaatcctcctcggggagggcgcagcgagcggcgctcgtggcgcagagggcacggtgggtggcgccaaggagggcattggaggcggtgcgctacagcgacgagtaattcgctgcccatccacgtcgtccccatcgaccgtagtcgctgtcaaccggagccacacagccgcaccacacagcccaccgctgctcgccgccgctaaagatgccacctgattcttctgctgctcctggtgttccccgcttcgctgctgctcctgtaaaactccccgtcacaccggcaagcagcacacatctgtacatcctgtacatgcatgtacactgttcgtcgattcaatttctctcagaattcttccgtgacattgccacgggtagatcgcgtcattgccgcgagcagtgtgccagcgtccaccatgctgatgccaccctcgtccggtgggtggtgcgtgatggcgatgcccgagcgagctagccgagcagcgtcgccatgtgcaccgccgctcgctacccagctccgccctccgcctccgcatctcgcactgtggcggcgggtcttcgttgtgggaggagaggagcagcaggagacgcgcgagacgagggcggcgagaccggatgcgggccatgcggcctccacttccatcgacgtgccggagggcggcggggcagcagggggaagacgaagcagattgagcgccacttcaccgccttccgctcctgccacgacgccctccgcctccaccctcgccaagtcgccgtcgccctctgccatggccagaccaggccgctgcttgtcgccgccgccatggatgaggctgctgctgtggcgcatggggcagatggaagggtcgacgaggatggacggccacgcgtttcaggtctgcaatttttccccttcccttctttgcttctctcgttgacgtggtggaggcggcgcacggtccgtcgtcctggtcgtcggcatcgtggccgtccaaccacgtccgccagcgaacgcagagcaagctcgggtgaccggcgatggaggcggcgag

SEQ ID NO: 3729 - DNA, 1501 bp, Oryza sativa
actccggtgaagccaccaccatcaaagaagttgaagggtgcatctactgctgaagctcatggaaagactggtcttgatgatgataacgaggacaagatggatgaagacgctaagaccccttccaaggcatctggaagtggaaggggaaggggaagggggagagggaggggaggaagaggagcaggagcagcccatggaaagacaattggtcttgatgacgacggtgaggaggataagatggatgaagatgccaagaccccttccaaagcagctggaaggggaaggggaggagcctctgggggaagagggagaggagggggtgggagaggcttcatgaactttggtgaaaggaaggatcctcctcacaaaggggagaaggtagcttattccttcttgttataatttgccagaaaactcaatcctaaacttgttattcgtgttctgtaggaagtcccggagggtgcccctgactgtttaactggtttgacatttgtcataagtggcactcttgacaggtgctttctattgtcttcatttcttcatattttaatttgttttatgttcatgtaaatggtggatggtcggtgcaccattaatatcctcaaatttcctgattgaaacaatgccgcgaataagctatcataagtttatatacacttgcagtcttgaacgtgaggaggcaactgatctaatcaagcgttatggaggccgtgtgaccggctctattagcaaaaagacggtatgaaataatagtatgatacttgcattggtaatgttttttagcctatagtttgcttacatcgcttatttgacagaattacctattggctgatgaagacgttggtggagtgaaatcaaataaagcgaaagaactggggtatcatttgctcttttcactcaagaaaactatattttcttaattgtcatttctaacacatgactgtacttgtttgcagcgtcccattcctaactgaagatggtttatttgatatgattcggaaatcaaagcctgcaaaggctactgtggcaaaacatcaaagcgacaaaaattcagaaaagcagcaaaaatcaccaatgaagagttctccagttaaagttgaaagaagaggtaactgaaagcgtaaaaatgcttcttagttgtatagcgcatgcacaatcctgcttagcataacctaactattagatacttgtattctcaaagttgcatgaatttgagacatgattctagtgttcattgtgtcttttacccattgtagatgctagctttatccagcgattgttgtatccattgctgacatcatctgatgactaagttttatttgatttatttgtttgatattaacatttcgcaggttgtttatgcttacatatatcttgattttccaattttcagatggtaatcaaattaccacaggcaaaaatatttcaccaaagagtaataaaggaagtgcctccattgacaaccaaaaggtcaacattgttgaccgtggttctttgcaat

SEQ ID NO: 3730 - DNA, 1501 bp, Oryza sativa
cagatcttggttctgaagtaagaagagaagttaatgctggaattgcatccgtatcaaggatgatggagcgtctggaaactagaggtagtaatggtagaacaagtgatggcccagcaatatccacttctgaagttattcccagtacagaatcaagcaatgagagagttacagaaaacaatccaactactgcagcgacaagtagtggcaacacttctgcgtcttctgccccttgtgttacaacaaccggttcaaattagcatgttataggttccgaaagaaggcctgcacattcccattcttctccatcaaaggtactacattttcaactgaaagataattattgcgatatatgtagttttagtatgcattgcttctagacggaaggataatttatgcactcaaccgtggctgtcttaccttgtaatttagtcatttagttctagttaggttaagggttagttattggttgactctcacatttgagaaaatgccatttatgtagaaacgggaatttcattttttttttacatccaagcaagagacgctgccaacaattatgtttagttaaacaaatatggatatgggttacgtccatttattagctccaaatgattatcttagttcaactgtctgtttgctcacaactgattcatgttacacggattacaggattgccattgccaggcatgggcaggtgaccaaaagcaacgtcatgttgtcatcctcagcattgcataaatcacctccagaaaatcggaatgacaaatttgatgtattggtttgataaaagggctcagcccgaggtattaccttaggatgccgatttgttctgcttcatctatgtaaaaagggaaaaaaatcagggacaagtttttaccggtataaataatggatttggtgacataatagcaatcataatcgtgataaatatgattgatacagcaaaattttcctactgtgcgagaaagccaaactcatcgctttctacctcctgttaaacaggatgtttgaacagtcgctctgttcgttaaattgttttcataaaagatttgctctcagcaacccacaaattttaaaaaaatcatgtaaattcgcacgaaatctagctgctgctcttttttctttttcttttttttttttgccgttgtgtgcaaacctcaccgttctgtagttttaagtgctgacctgccagatttgccctgcgctcacgtttctgaaagtagttatctttgagccttgtcaaatttttatggagaacctggctaatttgaaacaagcttcatggttttcaacttttttttccctaaatgctactgcacttaatattttcaaggtcggattaggcaaacttatatcacgttctatcaagttgaaaagttaagtccacaagaccacaacagaatatatttgctggcagcaaaaactggaacttgaaggggaggtagctagctcagcaacatatggcatcgttaaatgccgtattgtgaaatatatttgtcaa

SEQ ID NO: 3731 - DNA, 892 bp, Oryza sativa
tcttttcaactgcgattcctaaagaagaaattgatgtacatgttcgatctaacaaggaagttaaaaggcttggggttatttcatcttatgacacttcattctcctgtaaattggactttgaagaccagtttactctatcacatacttcacaagaagaggatgtggtattctatggatacacacttcgtcacgtacaatatcctttcttttacctttattatcataatatttgtagttacagatttattcatgaaggcttaggctacaattcaacatagctatggtctgtggaaactcagtgcgattgacccaccatgggtttgagagagcaagaggagggggcaggggtgttagatgtattacatagctagctgtgtatttacagggcgctttctgcacttgtaaacagttccattgtatacctgttggtccattgcaattccaagtccatttgtgcttaacggtaccacgtcaatgaatgctaggctggcacaatattattatttgtttacattgatataatcacactctgtttacttaacttctatatgatgatggaacttcgtttgaatatagaggtacgcaaccttcttttaatatttcatctgctctcttgctctctgtactaaattttctactctgtagagctgcctatctcatgtcccagtcttctttgcacagtcaaaatatcaggtttacctctgttcatctttttaacgtaggacaatgttcagtttagatttgcagaactttgatgtttgctttaatttgttgttatacagatgatccagagtatcgtgcgtctaaggcactcactgcaaagagagaaccagagatgacgattgtgccatatgtgccagatacagttacctactgtggcgattctcggtga

SEQ ID NO: 3732 - DNA, 1501 bp, Oryza sativa
atcccagaagagatatctcacagagctgctgagtgccgatcacttaaatacggaagatggaaagagatattgaagcagtgtggctaaaacctgatgagaacagagagggcaatgcagattgcagaagagagctgttatagattctcctccctttcttgccaccaactgcctttgtcacaatggacattgacattctctattgcaaaacgtctgaaaaacctgaaaaaaaattaaaacagtatgaaagcactttttgaggcaaaatctacccacaaagatttttgtattcaaatctaaatgtttcaacgatgatgcaatgtgaaaaagggcaagtagtgttacaaaattgcaaggggattcaagttgaaagctcttccaggctgtgtattcttttcctttcatccccttgacaataataatttgattttattgcagcaaaggagccacttggtgctttactttcttttcctgtttaccacctaagaagcctggaagcactggagcagagttctctttttttcaggaatatgcaacaaaaaaaatatatttatattggcattaaggttgggtaaaacaaggttcagagaaaatgatacattagatcaccagagtgcagacagcagaccgaaggaaaaaatagagtcaaacaggtgctggccggtgctgggcatgcaaccgcacgcaggaatctactgggcatttcgtcaaacagctcatctgcgccccaaccatttgttgcaaagtccaagtttcagagcttagagaaaacatcgaaaggaactcatcccattcgcatcagtcgcgttgcacataatcaagtcagaaaagaaaaaaaatatgatggttgattacctacgcaagaaagagagatgcttctcctagcgaaaccaaagacggcgacaacgacccacaagcaaagataagcagggcctaggtcgaactgagcctggatcaggatcacatcgcataactccagtataaacaaagagcaaattctctgattcatctcgcacgtaacgtaacgtaacgaatggggcgctcggggagagcgatgcgcgaatggcgttcgatgaaatgcccctccaagttcaacaggcgcgtccaggccaatcgattttgttttactttctgaattgggccctgtcgcgaagactgcgacctgaattgggccgtaagcccgtaacctaagctctacgccgaaggaaagcccaaactctaaaaactcctccacccccgcgcggcgggaaaccgctcctccccactccgttcccgcgcacattttttcggcatcccacccgtcgatttttccggcatccaacgtcgtacatccctccacgtcatcgatccgcgccgcgtgccttccaccaatcagggcgcacgtcccctcctctacaaaaccatcttcccccgtctcctttccccacgccgcaatctcgcgaatcccaccgcttccctttcctctcctctcctctccccgggaagaagacagcagcggcatcca

SEQ ID NO: 3733 - DNA, 1263 bp, Oryza sativa
cggcccattcaaaagaaaagagaaaggaaaagaaggaaaaggaaaaagaattttccagggattaaatattgcttatgctccattttaattggttaaatttatttctagggctctgaaaattccactaaaaatcttgttagcgaatttcgacatgtagaactcaagaaaaatccacatgccagtttcgattattatttgcattaatttattagggttttctcttgatttgcaccggcattttcttagggtcatttataaattcaattttaggcttgggaggagaacttcagggtgtgacacccagtatctctctcccccttcatccttttccatccgccgtccctccccccccccctctgtccgccacccctcctagtccctctctttccaccgccgcccctcctcctcctctctccagctgcatcctctcctcctcgacactttctcaccacttccgagctgtctctctctctataaccgtgctggatgttaggggccaccagattcaggctccttgaggtcggggctcaccggatccagccgccgggcagcgacgcagctaatgtttcagctttttatttttcacgatttttattttttttcggatttttgtttttgcgtgcggtcaacataagcacccgcatactaaaatccgattttcgcgcgcggtgcgtcacccgcacggtaaaattggatttttcgcaacccttccgggcagacaggccagagatccacacgcaaaaactacttttgatccatctggaacaattgttttttactagtgagtggccttattttggtaccgattgagaaaccggtacctataagggattctcaattggtacatatggagtgttatgtagtagcagtgattagtatgtgttaaaaattttcttactgatatcattttcactttcaccccaaggctagcactacgcagtaccactgtgccggttgaccaagttctacgaccaggtcaagtcgacaacgacacagcgcccactaattatctctgtccattctacagataatgatcgtggtgtgtctaccttcaccgttccctgcccaccaaggcaaaaaattctccaatccaataaattctccacagacaaagacagtgatgacaccacatgcagatttgcaactagctaggccatcatctctgcactctctaaagctttgtctgatgacggatcatcattcaattcgtagctccgatccatcgtcttcttcccggcgacgacccagccatgaacaacacaa

SEQ ID NO: 3734 - DNA, 1501 bp, Oryza sativa
gccgacgcaagggacaaggcggcgacctcccagccgaggatgacgacgctgccgacgccgccaccaggagccagctccagccgacgatttgcccacagatcttcggatctcgcacctccactgccaccaaccatcaccacctccgaccactccggcacccatggagctagccggcaaaagcaccaactagagacaaaccctaacaataggaagaacctgacgacctaataacagacctaaccacacaatactagtaaggggaggtggccggacccctataaccctcgccggcggcaagccgccggaatcgaggaggaagaggggccggagagcaggagaaacggggagggctactgtagaaaggggaaaggggaaagaagactcgagaacgaaggggtattcattgcctccttctgtggccattccagtcaccaagatagaccggagtttttctgttctcatgatagacctaagtcttaaccaggggtggattcacaatgggggcagaggggtcttgagaccccactaccgccccgggacagtggagacccccctaagccccactaattttttttccatagatccataggatatagggactggaggtttgatttatgctgatgtagtttattcagcccccactactatatttttctagatccacccctggtcttaacggtcactcgcctgatctgatgactatggattaccagacaagtttgcgaggaaaatttgtgaagtgatggacgggtaattgtcgtaatcggcaggggtgtagggcaggaacaactggtgaactgattaatcatggattcatgggttggtatatatttattcaaaaaaaaaaggtgacatacattgaacgcaatgttgtcagtatcccgatccatatcatagtatcttaggatactatacaatcctaccaacccggaatgataccgatcacatcttgtatcctaatttccatagtatctcgattgtactattcattattacacgatcctacgaaatcttgggtaatatcctaattctacgatcctacaaaatattatttaaaataagatggtttgaaaataatgtaaataaatatgctcaagtttatataaaaatcagttaaatatatcaaaactaatgtggtttctcttaataaatgtctctatttgtatgatatatattattactatatttttttatatataatgactatatgtaattaatacatatattaattgaattttaaaaaaaattatagtatcccgatcctacgatacgatattactttgatcaaaacggataacctttattgaacggcgctgatagtgggtatgatatagattgatagactttgttgttgactgacttgggtcgacgaccattgacgaaggcagtccaatgaaacaaactcacatatagagaacagtcatgatgaataaacaactgatccaagtgcactagaaagttaagtttcaagatccagcaataacagaattaaggcaaggct

SEQ ID NO: 3735 - DNA, 1501 bp, Oryza sativa
accgtgcttaccgccgaggcgcggtaaccccggccccggcggtttgggaaaccccgccatatagtacgtactagctggagtagtagtacaaactaaatatgaacatcgatcgatctgtacgttcaatgcatatatcaggcatatactgctgcctatccattatgtaaaaaaaaggtatatatacactgctgcctgtctcatgcatacatgaggtgcataaattatttaatcgaaacagctctggtacatgcatggttcggtgagctaaggtacatatatataaggccaaggtttatcgataattaagttgctagtacagtaaatggaagtactataccaacaacatatactcgccttaattaataaataaagaacactgctactattactagctaccagctcaattaacctgaacaagtacactgcaattactccattgcagcaattaattgtggatcttcaattggatcctcataatgattacctcgattggtataactaaccaaattaaggacgatatcggatttagctgctcttgatcgagctactactactccagcttgcttgtgatgctgccgtatcaatagcttttagttactcctgattttgtacgtgttgtgtgtgctgatgtgtgtatcagtggaaggaaggagttgtgagcaacagctggacctggaaactactaccatccatcattccatctaaccaccctttgctagcttgtacgtatatgtagtaaccacactaatgttactggttgctttggatcagctcattaatctcaagctagcaatatactccctccatctacttttgatagtcatattttatcttggcacacagactaacgataagtgattctacttatcatccatttaaacatgctactagtcattcctcgtgaacaagcgattcattaatatttacatttctcgatgcccatgtagccaatcttgtgtggaggaatagagaatcacgcattaaattcgagaaagacactaagatgataggttgttggattgaaatatgcctatcaaaaatagatttttcagatttggaaatatgactatcaaaagtagatggagggagtactttgtcaagtggtcctgtagaaaatgctctgtacactatttaaaataataattttcagcaacaatctctttattcaccttcgccacccgcgcgggggtgtggggggcgcgctctcgagacggcgaaaggattaaaatcctttgcagtcaaatgcacggtgcatttgtcactaatctatgggcccacatatcagtaacaaagtcacgtgatttcgattgcagatgatccttatccgcagtggtgacgccccgaggaggtgatgccgctgcccctgccgaagcacaccactatcatcatcgatgcgcacctgctccgttggtcttctcgcgcgtcgctggacccaccgtcgtcgtcgtcgcagtccaccaaccttctcgcacgccttcgtcggcctacatattgagagaga

SEQ ID NO: 3736 - DNA, 1501 bp, Oryza sativa
gcagatcccagaacagatatctcacagagctgcagatcacttaaatacggaagatggaaagagatattgaagcagtgtggctaaagcctgatgagaacggagagggcaatgcagattgcagaggagagctgttatagattctcctccctttcttgccaccaactgcctttgtcccaacagacattgacattctctattgcaaaacgtctgaaaaacctgaaaaaaaaattaaaatagtatgaaagtactttttgaggcagaatctgcccataaagatttttgtattcaaatctaaatgtttcaacgatgatgcaatgtgaaaaagggcaagtagtgttacaaaattgcaaggcgattcaagttgaaagctcttccaggctgtgtattcttttcctttcatccccttgacaataataatttgattttattgcagcaaaggagccacttggtgctttactttcttttcctgtttaccacctaagaagcctggaagcactggagcagagttctctttttttcaggaatatgcaacaaaaaaaatatatttatattggcattaaggttgggtaaaacaaggttcagagaaaatgatacattagatcaccagagtgcagacagcagaccgaaggaaaaaatagagtcaaacaggtgctggccggtgctgggcatgcaaccgcacgcaggaatctactgggcatttcgtcaaacagctcatctgcgccccaaccatttgttgcaaagtccaagtttcagagcttagagaaaacatcgaaaggaactcatcccattcgcatcagtcgcgttgcacataatcaagtcagaaaagaaaaaaaatatgatggttgattacctacgcaagaaagagagatgcttctcctagcgaaaccaaagacggcgacaacgacccacaagcaaagataagcagggcctaggtcgaactgagcctggatcaggatcacatcgcataactccagtataaacaaagagcaaattctctgattcatctcgcacgtaacgtaacgtaacgaatggggcgctcggggagagcgatgcgcgaatggcgttcgatgaaatgcccctccaagttcaacaggcgcgtccaggccaatcgattttgttttactttctgaattgggccctgtcgcgaagactgcgacctgaattgggccgtaagcccgtaacctaagctctacgccgaaggaaagcccaaactctaaaaactcctccaccaccgcgcggcgggaaacccgctcctccccactccgttcccgcgcacattttttcggcatcccacccgtcgattttttccggcatccaacgtcgtacatccctccacgtcatcgatccgcgccgcgtgccttccaccaatcagggcgcacgtcccctcctctacaaaaccatcttcccccgtctcctttccccacgccgcaatctcgcgaatcccaccgcttccctttcctctcctctcctctccccgggaagaagacagcagcggcatcca

SEQ ID NO: 3737 - DNA, 1501 bp, Oryza sativa
tacacgcaagcaacaaccagtgaaacagtgccacctgccctatccaaaccactcaaattatcagtatcgtttcgagatcatataaagtaatctttaattcggtagagaatttgagaaaagaaaacgggagaaccaatttcgattctgtaactgcggtaattgccatcgacttagcgccattcgaaaaggggaaattctgggattacgaaacaggcccaaatttctctaactgatacgtggaaaacaaatcaaaatcgtatattcttcaacactgaaaactcccaacagaacaacagtctcgaaaaaaaccattgattcagaaaaaacaaatccaaacaaaaaaaaacaccttcctcactccaaaccgaaattaatcgcaaagaacccaaaaaggtggccaagaaatgctcaataatcaacagaaacaggccaggacaccaccagcacgaatcaacccaaccctcccggaaatcaatgaaagaacgagacgatgaggggggggggggggggggggcaggaaccggaatgcggagaggaaggggcaggatataaccttctgcagcttgcgctcgatctccagggagagcgcctcgaggtggtcggcggctcgggcccgcatctttcgccgtcgccgtcgccggcggggggcgctcgccgtggacgctgggtcgagtagcgtcgcttcgcttctccaacgattcgtctcgtcgttgttctctttgctcctctcccctcttctgactcgtggtagggcggtccaatcagagccgtacacgtggcgggccggcgacgctggcgagtaaccgcgagttcagcggtggtggcaggataggcatcaccgtgattttgatattgcaaatggatgagaagagatgattctgattctggtcgcatttgatcggcttttccaacgaaataattttgccaaatatttttttttggactgttttgtgtaggccgtgtttagtttctctttattcccaactttttatcatatcatatcacattaaaaatttacatatacttgtaaatttttaactttttttccaaactctcaactttctttaaactttcaactttttttagaaactaaacaaacctgtaaagtttgtcaaatttttgtgttccaaacatgtgtctgattatcaggttgtactccacaatagtctgtctgtctgcgtgtttcagacatgcactgtaagcattttttttcttaatattaacagtgaattgattgtgtgattctttgctttcaatagaagcagggctgcaaagccttttctctaaaaaaaaatttgattgtgtgaaatgattgccgatttcttcttatcccacgctattgcgtgccgtctgctgtgctccaccattttcgccgcgtagctgacgtgtaccaacctttatcttggctcgaggacagcacgacagctgcatgcagcgacacgtggaaaaagcctactccacgggatcttctgcaccagctcggatcggtcactcttcactc

SEQ ID NO: 3738 - DNA, 1501 bp, Oryza sativa
taaaattcacataggcaaatgtgacttcttgcattgtctataaaaccaaatttacattgtttagtgtaccataataaaatttgccaaaattgtatttagcaagagcttctatataggatagtaacttttaaaatttaaaatttggcatcggctcatgacgaaacgattgatcaactgtgctatctttcagaccaatttttatacagccgtgttacgtgtacccttgtggtttcattaacatcgaatcacttaacgcaacccaaagtgaaaaaggataacgaagaagaacaattcatacgaggagtacgtatacgtgggtgaagtactagcaagtagccgatcaagcgatggcgatgggagtcatgcgagtcacactgtgctttgtttggttgggagatggacgcgccgcgtttcgctttgcgcagccacactcgtgtacatgccgccctccactgaagctggagccatctcaacttctcaacaactagtgctctcctcttcttctgcaagtaatccaacaattcatcttactttggttttgcattacgtttttacccttggctgatctagctgggaacttaatttatggccaaattttctcaaattttgtttctccttggttggttttgcttcacctagatcataaacttccacgcaaaaaaccgcagagctatatatcttgatctcaattcattaagtgtatattttactagtaaaggctctctgaaacgctggaatggttttcattttcttggtaatcaggagtaaattcccatgattcaaaagagacgtaatattactttatttcttttcttattataagataaccccatccaacccaaaattattaatgttgtgttgtagcgaaagaagagaaagtgtttatacgtcgttggatttaaaaggactgaacttgtgtgaaaataatttccaatttctttccatacgtttctaacctagaccaccactccaaagaaattctgagttttatttatagataatttgggagaagccatttcctttatggtacctaaaaagaaaactttatataccaaacaaaaaaatcatttgtaaaaaaaatactccctacatcccaaaatatagcaatttttagtgggatgggacgtatcttaggactacgaatctgaacaagaacaagagagagtacgtagtaggatacgtctcatccaagcacaaattgctatattttgggacggatggagtacgtactaacacgacattttaaaaaattcctaaatgaaaaaaaagtgaaaaagaaaaggagaaaatggcattatcgtaaataacccgtcaataccgagggcataatcgtcccatcaaaaccctcccctctcgagaataaacgaccttcccctcgaccaccctcccacctcgtcgtcttccgcgccgccctctccctcctccaccgcctccgcctccgccttctctcgtgccgccgatctccatcgccggcgtgcggtgcaccgagatccacccgaga

SEQ ID NO: 3739 - DNA, 1501 bp, Oryza sativa
ttaattaccataaagtatagggttcatattaggaaacggtaagacattgccgcgtactccaggctagtggaagacattgattggcttattcgaattacttattactgcctccgtcccataaaaattaaatttctagagaattaaggacatattaataggatagactaatgactacaataaccctatttaatgaacacagtacatgcacacattccatatataaacttgattaaaaggaatgtcacgacaatgggttagagatgagatggaaggaaagaagattacagtttactgggtcccacattagtagaaatacaatttttatgggacaaaggtttaaagctagaaattcaatttttatgggacggaggtagtaacaaatagaaaaaatatttatgagtataaaacttgttcttagcaagtcaaaaacaaatattataaaataaacataaacagtgatgaaaagacaaaaaaaatcaaattcaaatcaacttctaaaatttaaattttggcttataagtataagggccaaccaataacacctcagaaaaaagaactagcaatgaagtggcatttcaacccaaccgctccttaattagctccgtcctcatagtaagagttgtaccaaatgaacccttaattagtccaaatgcactaatatgggtatattctagatactacagatactagcgtatctatttcttacccacgcttaccattacacgagttacaaatgatggatcatttgatgtttaaattgggctatttcaaaatattatacataggagttgtgtgaacgatactattgtaatactacgggtggcgtacacaatgatatggtaccacactatatctcatcaactaagaaatactactattgtacaaacatatgggttgtttataggttaaccttacaacctcgtcttttcgcttaagtttatacttatcagacaaaatttgaatttttaaccttaaaaatagagttgatttgggggtttttttcatcaaagtttattttgcaacatttgattttagatcgctaagaacacaaaatataaaagtgtattcacaaattattttttgtttgcaaatatgatgtttggcttatttcccgaataagcgaagcgatgcgatcattagttataaagttgtttattatctaaccttttggaggccgtattggtacccgcgatgaattaacaccctgatgagtcatctttaatactgttaatttattaggcattaaattcatggtagtgttctgttataaaattttaatcatctatgcttagttttaaaattgtatacatatatattggcctaaaaaatatcataatatcattgaacttattctaacataaaaattattggttgagtgatgggtttagtcctaggggtattattatacttgcttcaaaaaaatctccttgaaatagccaaaaatgataaataataggtgcgttgtccactaaaattcacataggcaaatgtgacttcttgc

SEQ ID NO: 3740 - DNA, 1501 bp, Oryza sativa
gaatttggatagaatgcgtctgttttgtttgtagttagtggcttagtgcacactgttgaatttgatagtatttgcaatacagtgttatatgctgctaaactaaggctgtgttcgtttgtgtgagatagggtgagaaaacacctcgttttccgcgcgcacgcttcctaaactactaaacgatgcgttttttgcaaaaattttctataggaaagttgctttaaaaaatcatataaatccatttttgaaatttaaaatagtttatactcaattaatcatgcgctaatggctcatctcgttttgcgtatcttcccaatcttctcaatctcctatctctcaaactcaccctaagtgaaaatggatttccttgtgaagattgtagaaacttcactaattgccaggattggtctaatttgttccaaggtttatggcattttttgtatttctttactcctttaaacgtttctggtggcgccgccaccaccaaatgacatttgggctccacataactagttgcagaaaaaaatgtgagagtttgcgtgctcagtgatgtcctgaagagtatgtgtaacacaaagatgcataacagaagactagttatgatcacgccgttgccaaaggttatcatcaagttccttgtatgttgtccactatgacttattttggtgtatccctactttttaatctctagatataaaactatggccaatatattgatagaacacagctgtaactaaatgttgcgtttctgactgcaggatacatatggaaattgagtttgttggtgatcacagttacaggtctggtaagatagttattgagtttaacgattgaacaaggtgtctggaaataccaccaggtgcttcaatctttgagcaagatttttctgcgctctccattgttttgtgttgtgtttgtttgcagtctgaaccatgaaagaggaaggagaaagaatgtgagaggaaatgttcttggatttttctctagcagagagatttatcttgtacgacaataaatgtttgctgaattcttagtgtcatctcaaaattcgatttgtctaaacaggaaaaactgacctattaatcaaaatatatagagtttaccctgtttttaattattattttcttcttatttacatgctgtttatggttacagactccatggcaaaaagcccaaaacctgaacccaaagaaagaacagcccaccaccacagcgctccaaaaacggggcccactgcacatttttctttgcaacgtcagcgatccgcacggaaacgcatcgcagccgtctaaccgaaaaggcaccggacgtcacacattcatccacgtcatcgatccgcgggacaagcctctccaccaatcagcgcccacttttacccactataaactcaccgcacccgtgtcctccttccacaccgcaatctcgcaacacatcagcacacaccgctccaaagcaaaacccacggacccgcttcccctccccgagaagaagagagaagcatcca

SEQ ID NO: 3741 - DNA, 1501 bp, Oryza sativa
cggtcatgttgccgagctcgggtggtatcccaccggagtagctgttgaagtagccgatgtagagctccctgaggctcgtcaggttgcctagctccggtggtatcttcccggagagctcgttgccggagacggcgaggtactggagcctcccccaccggccgtactcgggcgggatcccgccggagaaaaagttgccgccgaggtggaggtggcggagctgcgccatggacaccacctcgagcgggagcgcgccggtgaggttgttgttgtagaggtcgagcacccggagcgcgcggagccgcgacagctgcggcgggaaggtgccattgaggccgttgttggagaggttgaggtgggtgaggaacggcgcgaggcgggacagcgccgccggaatgggccccgacagcgcgttcgcggcgaggtcgaggcgcgccaggtgctgcagccccgacagcgcggcgccgggcaagccgccggtgaggttgcgcccggacacgtcgagccccaccaccgcaccccgcgcgttgcacgccacgcccgaccacgcgcacgggctcgaggtggtgttcgtcgtccacgacgcgagcgcgcccgtcgggtcgtcgagcgccgccttcaccgcgaggagcgcgtcggcttcgccaccggccgccgccgtcgccgccgccgccacggcggcgaggaggacgacggcgaggtggtggtagtggaggcgcattgcgcggcgcggcgtggcgtggcgcggcgagtggagacaagagagtgtgaggagagtgaggaggcaaaggtgagagctttttggcaatggagtcgtctcctctcctctcctgctggctgctactgctataaaaaaaacacatgtgattattttattttatttttatttttatttttgctaggaaaaagaaacatgtgatgttttgttggattttatgcttgaatttttactctctttatttatggacgttttttcctcttttcttgcataaagtttgtgttcttgttttttctttttggtttttggctggggatggatggtgtgttgctgttgtgaatttgtactggtgtctggtgtctttgagtgtgaaattgggtgttgttaactttttaggatgggacagacaagtgtagatttgtagttcaagtgttatttatcaaaagttgcttttctgaggtgacactttttttttcctttttgttgcttggctaaatatttggctgccaagtttcaaaaaggctaggtagcatttgtcaatagtaaccttgatttaaggtggtgtttggattcagggacttaactttagtctctatatttagacactaatttagagtattaaatataaactacttacaaaactaattacataaatgaaagctaattcgcgagacaaactttttaaacctaattaatctataattagagaatgtttactgtagcatcatataggctaatcatggattaattaggctcaatagattcgtctcgcgaattagtccaaga

SEQ ID NO: 3742 - DNA, 1501 bp, Oryza sativa
cgggggtgccggatccgaagcttcgctctgcgccgtcgccgtcgccgtcgcccgcccatcgcacgccgcgtcgtcgtcctcgcgcagagccgtcgcgtcatcgccggaggaaaggcctcgccaccgccctcacggctggccgcacggaactccggcggcgcgctccggcggcggcgaggggtgggagagaaagggagggggtggcgagggctagggttcgccctccgtgccgctcgcgagagagggcgacgtggaggtcagaaaatttagttccgtaagagtggtgatttacagctaagtgatgtaaaggaaattcgatccataattgagggacaagaagtgaactttttccaagctctgaacatatggattgcatttcgaggaacattcggcctgtttggttggaggaagtttttaggaggaattagaagttcagagggataggctattaactattttgtttggttgggagacataaaaattttagtggaatggagatagagaattgacgaagaaactctctccttttcaatacctgggtaggaggtggtaattgggagggattcctcctttactttgcctaaacaaatctcagccatccgttttcattaatgacttaatctccaactaaactccctatcaatttccattacctctaccaaacaagatattgggattaaaaatcaaattcccctcttaatctcaccatcaattccctcgtgtaaactcccaatccccttcctcgaatgccaaacaagtcgatttggattgtatttcgaggatggaaaaagtacatcaaatgcccctcattttgtcatcggattacaaaatcatcctccaaccacaaaaccagatactccgtatttgccatccctcatcttataaaaccgaatcactttgagtcctcgggggttttgactctggttttacccaacgcgacatctgactcagcatgggacccacacggatcctacccatcagcctcttctttccctcccctctccacctctctccttccctctccacgggcggcggcgggggagcagctggccacgggcggcggccggcaggggagcagctaggctcgggcggcggggtgaggagcactagcaacagcctctgatggcgtggcgacgcgacgacggcggtgacacgggagcaccggagcagcgtcccgacgaagccctcctcccgacgctgcctcctcccctccccttcccttattcttatccaaaactgcatcgataaatggcggatggtgttgcccagctgggccacgatgctggtgacctcgaaggagaagaagttgcgcgcgtatcctgtgaagagggattcgaggtccgacttgatgtcggtgagcacctcgtacatgccgagcatgcggtagagcttctccgtcgccagggtggacatggccacgcaaagccgatgagcaggatgaatcctctggcgatgtcggcgaagcactcgtggccgagctcgttttgttcatgtggatgtg

SEQ ID NO: 3743 - DNA, 1501 bp, Oryza sativa
cacagaaaggagaagaaagggaaaaaagagaagaaaaaaataatgtcgcgttatgtccgtgtggcatgccacatcaacgcctcgtaggatcataaaggggttgtggcgatttgggacctagatgacacactatgacaagttccggtacttggatttgtattttgagagtttcggggcctagatcctatgcactttactctctctcttttttattttgccccctaattttgttggtctagctgtttctacagtggaaggctatgttatcctcatgtatatattaacattctatttgttatctccttgaagagatcaaggtttggaggggtggttgttacttgttacttgttagggcttaggaattcaattcatgtgctgaaaggttttgaaatttatatactgggtgaggttgaaggagcaattgtttttaaccagtttttggatacataatctcgtagaagtaatgttgaagaaatttatgagtcaacaaatggtgaggagcaggaattcatatatattctgaaagttccctaaactcttatctactcaaactgctgctgattctgcctaaaattccaagaaaaatttgtaatatttataggtgcaaaatgcttcttactagcgctcatgagctcgtaagctcccaaccatgtgaaaactaaaggaataaatccactttgactccctcaaatataggtcaaatcaaatccgtatcccttaaccgtaataccagatatcttgacccccctcccactattaaatccagtgcaaaatgactctctcggtggttttgaggatagtttccactaatgtggctcgttcacctagtccaaccagctgagtcagcatgtgggggcccataagtcacccactctgccaccgtcgagagacatggggccatacaactccctcgagctccttagccaccattgcgctactgtcgaccgctgccttctcctcaatctcccactgcccgagcgccgcgctacccactgttggtgtcgccaaagccgaaatatatagggtgagggagagaaaggggtggagaaggaaatagtgggagatgacatgtgggccttcgactggttggactaggtcaacgagccacgttggtgaaaatcaccctcaaaatcaccaagagagtcattttgcatattaaacttgtaactaggtgtaatcggtgtcatgcatgcagcaaaccgacagggacatattaaacttggacccctattcgggtctccgcggggagcggggacaaggaaaggaccatctccgcccccgcgaaaattgacgggggcatgtcttctcctatttatgtccccgtgaaaaaccaattgtaaccatccttgcttcctaataggtgaattcaccacgagaaaacggtgaacatctctaggcatgccccgccacacccagtgaacaacactcgacatgaggaagatgccgcgcgccaaacattggtgaacagaaagactaacggagaactgtgttttgtcggttt

SEQ ID NO: 3744 - DNA, 1501 bp, Oryza sativa
gttgcacgtaccggtcagtgtgcaggcatatggcgcatagcgatgtgggatctgtgtgatgcattgcctgtgtggaaccaacttataaggcatatttggatgtgtgcgcatgtttactaccaccttgctagtttagcatgagtgaaaccaacttataaggcatattccctccaaccatgaggcatattccctccaaccatgagtggaactaacttataaggcatatttctccaaccatgagtggaaccaactaaggcatatttagatgtgtgcgcatgtttactaccaccttgatagtttagcatgagtggaaccaacttataaggcatgttccctccaaccatgagtggaaccaacttataaggcatattccctgcctccctccaaccatgagtgggaccaacttataaggcatattccctccaaccgtgcctccaacccgttacaaatggtaccagagacgacccttgcggttgcgcgtacgggtcagtgtgcaggcatatggcgcatagcgatgtaggatctgtgttgatgcattacctgtgtggaaccaacttataaggcatattccctcggttgcgtgtacgggtcagtgtgcaggcatatggcgcatagcaatgtaggatctatgttgatgcattgcctatgtggaaccaacttataaggcatattccctctaatcatatcaacttataaggcatattccagccatatcatattccctccaatcatatcaacttatatggccgttacaaatggtaccagagacgacccttgcgattgcgggtcagtgtacaggcatatgacgcatagcgatgtaggatctgtgttgatgcattgcctgtgtggaaccaacttataaggcatattccctccaatcatatcaacttataaggcatattccaaccatatcatattccctccaatcatatcaacttatatggcgcatagcgatgtaggatctgtgttgatgcattgcctgtgtggaaccaaccatatcaacttagctgtgtgcatttgccatgtgagctgtgtgcgcatgtttactatgtttagctgtgcgcatgtttactatgtttagttgtgtgcgcatgtttatgttaacagtgaaatttggtaagccccaaagtcaccatcagcttggagtcaatgtcggcttcaaagttctagaatcagccgatgagagtcaagtcgccacgatgtcgtgttctcgatggagtcggatcaaagagttcgagttcaagaaggatgcggcatggcagtttatctattaattaggaatagtttgttagtttccttttgtctttaggaaagtgtgtttagtgtccgataaggactttatgttttccttttatctttaggatagtttctttcttgtccagcaaggacttgtattaacccatgggtataaatatgtgcacccggggtctatgtaatctatcaatctatcgatcaataacactctcggtgcatcgccaccctcttccctgaggtttttact

SEQ ID NO: 3745 - DNA, 1501 bp, Oryza sativa
ttctccgccttgggcgccatggatgccgccctcttcttctcggggagaggagaggaaagggaagcggtgggatttgcgagattgcggcgtggggaaaggaggagacggggggagatgattttgtagaggaggggatgtgcaacctgattggtggaaagcacgcggcgcggatcgatgacgtggagggatgtacgacgttggatgccggggtcgacgggttggtgggatgccgaaaaatgtgagcgggaacgggaggagttaaggcggtttccggcgcgcgtcggtgggcgaatttttagagtttgagctttccttcggcgtacgcctacagcccagtccagcccaatttagttgtcaggcttcttggcgggctgtctttgtttatgggctaattgggcctatttctttgctctgaaagccactccacgacttgttaggctacgtattcggtaatctgcccacgtcaacatcccagtgagacgacaacgacgtcgtcgtcttcaagcaggcagctagcctaaacccatctccatctgcaagtaggcttatgtaacagtgcgttgatcatgcaagccttccgtcgatcgcctagccgcctaaatcgccgtgttctgaaagtcaattctctccgactcaacgaaaatactaacaacatgcacctggccgcgttgaccgttcgaaatgtatatattccctcgttcacgaaatacttttcattgtggattttttttaatacgcaaggggcgtatttttttcattaagagaaataaaagttatttataaggataaaaggaaaacaagcagggaccgataaaggacattatgaaaaactagaggaatatctcgtgctaaatttggctaccacgacctcgtaaagacgaaacagcggggatcccttaataagccgacttccaaagcatggtctccttcgccattgctttcgccacttcggtccaagacctttgttgatttagaacggtcttgttgatttagcactgttttagcttgatttagcactgttttagctttgacagtagtagttttattaactaaatgttaatgctaagatgagcaaaagcagctcgtggtaaactggtaatgatgatttttttaaaaatatttgtaattttttagggaaaaaaaaacaagtgaccaaagcaatattagtagtatgaatgatgtatcaggacaagtactattccgtccataaataatggatgtaagatatgcatctagatatggttgtccagatacatatcctgaacggaaggtatttagaacaaacaaacaaagggagtactatattataaagtcaaacgaagtgttccagaaatggaaaaaaggaattaaaagaatgcaatcaacaaactgtcatcatctccaaatttgcttcaaagaccatctatactctccatataatacggacagccattggtactaagatatagcactaccactctcacaaaccaatcaagaaacacaatacgtcccatgacgatca

SEQ ID NO: 3746 - DNA, 1501 bp, Oryza sativa; identical to SEQ ID NO: 3740

SEQ ID NO: 3747 - DNA, 1501 bp, Oryza sativa
ccaagcactgttgaataattattgtttttatgcttgtgtgtttaacatctgaatcattttcttcttcttgcagccagattgttggatcagctattctagggggaattgagatcaatcccagccctttatttattgatccaatggtccaaattgtgagctacagtaaaattagagctgtacattttcttcttcatgcagctagattgttggatcagctattctagggggaattgagatctagtgcagttacacaatcccaaccctttatttattgatccaatggtttaaattgtgagatacagtaaaattagagctgcacattttttcattaaaaaacgctacactaatttgctacagtactaaagaggcatctaggccatccgttttaaatccaatgatactcttgtgactgcttaacttgacagtggccactgcactggaaccgaatccgtctaggggtcggtcaagaacacaagctacaacaaacttgtgcagatccattgaatccctgaaaatgtcattcgggtgaacatctcaagcaataatatacctaagctgtaagtatcacccaccttcgtgactacagaaccttccccgtactctgcaacatttgtagccaaaattagtatttaaccctaccctcaacatgtaaaaaatgaagcaccctcagtctgataggaaggggagagattaagggaataattgcccggacacctctcggtttgaccgccgcccattgtctggtctgaccggccactcagtgctgcactgttcactgacagaaaatattaattactatattttcaataaacactcgcatttaataattgctcatcacaaaaattgaccatcacatgattctagaggtgtgactccatctaatttgggaaaaaaagaaatagaggttcatgcgactggttcaattgctttatgctgtgataatgctattgacaaacaacaggtgttataccattttagcgattcaccgtggaaggccggacggttgatgaggtcatacgctaagacattaacatgtttgtatagactttagagcaaaaagaaatagtagtagctcgattagcccagaaacaagtaaacaggccactctcgtgggcctcgaatcgggaatagcccagtttccaagcctgcgacttttactgggccatgagctaaactctacgaaagaaagcccaactgcccaaccatgaaaactcgtaatccccgcgcgcgcgacggaaaccgcctactcctcccgttcccgcgtacactttccgcgccgaaacgcatctcagccgtccataggaaaacaacaccaatcgtgcgccacatgctcctccacgtcatcgatccgcggcgcaccccctccgccaatcagcgcccacctctcccctcctttaataccatcgccgccgcctccccttcaactccacaactcgcaaccgaattcccccaaattttcgtctcccctttcccttccccgagaagaagagagcggcatcca

SEQ ID NO: 3748 - DNA, 1501 bp, Oryza sativa
tacacgcaagcaacaaccagtgaaacagtgccacctgccctatccaaaccactcaaattatcagtatcgtttcgagatcatataaagtaatctttaattcggtagagaatttgagaaaagaaaacgggagaaccaatttcgattctgtaactgcggtaattgccatcgacttagcgccattcgaaaaggggaaattctgggattacgaaacaggcccaaatttctctaactgatacgtggaaaacaaatcaaaatcgtatattcttcaacactgaaaactcccaacagaacaacagtctcgaaaaaaaccattgattcagaaaaaacaaatccaaacaaaaaaaaacaccttcctcactccaaaccgaaattaatcgcaaagaacccaaaaaggtggccaagaaatgctcaataatcaacagaaacaggccaggacaccaccagcacgaatcaacccaaccctcccggaaatcaatgaaagaacgagacgatgaggggggggggggggggggggcaggaaccggaatgcggaaaggaaggggcaggatataaccttttgcagcttgcgctcgatctccagggagagcgcctcgaggtggtcggcggctcgggcccgcatctctcgccgtcgccgtcgccggcggggggcgctcgccgtggacgctgggtcgagtagcgtcgcttcgcttctccaacgattcgtctcgtcgttgttctctttgctcctctcccctcttctgactcgtggtagggcggtccaatcagagccgtacacgtggcgggccggcgacgctggcgagtaaccgcgagttcagcggtggtggcaggataggcatcaccgtgattttgatattgcaaatggatgagaagagatgattctgattctggtcgcatttgatcggcttttccaacgaaataattttgccaaatatttttttttggactgttttgtgtaggccgtgtttagtttctctttattcccaactttttatcatatcatatcacattaaaaatttacatatacttgtaaatttttaactttttttccaaactctcaactttctttaaactttcaactttttttagaaactaaacaaacctgtaaagtttgtcaaatttttgtgttccaaacatgtgtctgattatcaggttgtactccacaatagtctgtctgtctgcgtgtttcagacatgcactgtaagcattttttttcttaatattaacagtgaattgattgtgtgattctttgctttcaatagaagcagggctgcaaagccttttctctaaaaaaaaatttgattgtgtgaaatgattgccgatttcttcttatcccacgctattgcgtgccgtctgctgtgctccaccattttcgccgcgtagctgacgtgtaccaacctttatcttggctcgaggacagcacgacagctgcatgcagcgacacgtggaaaaagcctactccacgggatcttctgcaccagctcggatcggtcactcttcactc

SEQ ID NO: 3749 - DNA, 1501 bp, Oryza sativa
gaggggcggacatggccgggaaaccccctcgatttggccggtgacgtgggggagagagagagagtgggggggattcaaatcgaatcccgcccatttgcgggcgcgcgtgcgggcgggaatggcggggagggcggcgacgtggggacgcggagtgggggcgcggcgtggagcggagaaggcggcggcgcggacggtttcggcggcggttgccgtcgtggggcgggcggctggaggaaggggacgacacctgtcagcgtcccggagagaggggaaagggaaacgggccggcccaaaggaaggaggctgaacgcgggagggagtgggccgacggcccaatagagaaaaaagaaggaaaagaaaaagaaaaagaagaaaggatttttcctgggatttaaaattgcactttggtgatttttaattggttaaaattatttccaaggctctgaaaattccactaaaaatcttattaatgcattggagcatggggaactcaagaaaaattccaccacgctatttccgattattaattgcatttattaactagggatttagctctaggttaattaagataatttcttcgggcaatttatttaaccaatttttaaagcaagaaaaggggggaaacttcagggtgtgacatagggttcagcccatgagctctgataccagtgatagataaatttggggaatttgctgtgtactattgacttagggtcaaggaccacatataatgtatacaagagatgaaaagacacatataccctttaacaataactactcaagagctatggaatctgatttcttatcgaagctacggctcaggttgctaccatttcctgaataaagaagtaaaggttactactagaatggaaatgctaaaatacacggattatcttttcccttggtaaaaaagaatgacttgctaatggtgtgttgtaccaaacataagcttttttttttcccatctgaaggaaaaatatgtactcccggccggagaaaaaaaattgtactactctatatcaatgccgaaaaatgatgtttagatgttcggcttttcaaggatgaagaagaagtgtcaccatttgatttacattgatgtgcagtaactgtcagtgaaaggagccaattgcgtctgatcattcttgatttcttcctactcttatccatggacccatccgattgctcaaatgtgtaaagccttttttttttttttttttttttttttttttgcagattgttaagccatagttggctgttgaatgagaatggccttccaatgtatagacagggtttaccttttcgtttttaaagtgaaaattgttcctcgctagtttactgaaaaccgatccaaaattggtaaaaatcaatgactttcggtcaacacggtacggctgatgtcgatagcagataagggcagtgaagcatatcttttgtttgaaaaactgttggagcattgtgccccctatgctctcataagtaatactaataaagtatttcctcc

SEQ ID NO: 3750 - DNA, 1501 bp, Oryza sativa
aggagggggggaggaggaagaagacggcggcggcgtcgcctcttgtgtcgccggtggggagggcgacgcgagagaatatcgcgaagttttaaagcaaagatgtctcgcactatgttatactgtcctgtagttctgatgccttcgattcccacactgtatgtgcttgtgtccttgcacgacatatagatgttgctcttttctggtagcgagagcctgcactttcttgtccatctctgagcattcatatgctcacatatgtcggttgttgcgtccaatatatattctgattggcattgaataggcatgttatcttacaagtaagagtactttgatagtccttgagatcgtatcaggatcagttaccatattttctaatgtaaaatttggtaagatactatatatctcaaggtaccaaaacatttagtttagtatagagtttagtacgtatcactggtgctttctgatggacaatgaaactcttatatgaaacattgaatggatatgatacccgaaaaagataggccaggacagttttgataagtttgtattgtattcgatatgttttgattggttgggatatccatggtcaatacgtattctatgttatagtctaatctctttgatcaacaatgcaataaacaaacccattttgtcaaggtccaaactccatagtacagactaatatttatgactactgctgatatttttgtttctttgaatttcttcagaattacagtttcagatttcaagcatctgtcattttgattgaactcagaacagagtttgagcacgtgccggttcttctacagcatatatacacagggtttatccctcatcgattcgttttgtaacaatagaagttaggaatctcctgaactccaagcaggccgtatggtgattctcaaatccaagatctaggtgcgaatttggtatatgagatgaagtgcagacgacactactacaaaattcgtttttctgtacgagggggtcggtaggttccatgcgggccgcttgtggcggcgcctgcaaaaaccgcccccccaggggcgggtcgattagccgcatgcgatgatcggccatatatgctcctccaggcccgagcttgaccatttgaaaacgaagctttctctctcctaaagcaagcaccaattagggggggaggttttcaactcgaaatttttgcttgaactctatacgaaaggtgaagaactctctatcctccttcatttggctccatttttgttatatttcgttggtggaaagtggagtttttttaatattttgacaaggtttgttctaactattttttgcaaaatctagcttcaaaatatttgttttgatgggcaaattttgcatgtaatcacttgtacatactagttacatgtattgttgtaattttttttgggagacaaatgcatttaaacttttgtatgaaatacctgcggtctatttttttatctgtaacttttttgcctttatataattagatggatcggtcgtc

SEQ ID NO: 3751 - DNA, 444 bp, Oryza sativa
gttggtgttacagtatagtcctagagactatttggcgcgcggtgattttacctatatgaggtattttttggtgattgatgtttttatgctacaagaggaaattcgtctcaaggtggagattgttaaatatgtgatccgtattttggacccacaatatattcggattagtttcctagtaggagtcctatgaggtgtctttctattatcccctatatatataccctggttagtcgtacaggaaggggtgacgttcccattgtgattcccctaagtttgtaatcatctcctctacagtgatcattgccggtcggcgcccgtggttttttcccgcatatgttttccacgtaaaaattcgtgtctctgttgtgcatctattttcataacacatggctagcatctgactcgggttgatttctttcttatttgatataggaatggaagcca

SEQ ID NO: 3752 - DNA, 1501 bp, Oryza sativa
accagttaagaagtccgcctgcaaaaataaaggtattttcgcaggtcgaccgcttaagtggtattttcgcaggtggataacgatttcccccacggttgttattttcgcgggcggtcatttagctccaagaggactactcgcctggaaaaaagtacaatcgtctggaaaaatggattttctagtacgggcatatgcgttatatttgtgctcgtgacattttgcattatatatttccaacagagagttacgaaaggtgatccacaagattagtagagcttagtttctgggctggtcgatcgggcagctgtatgagctgctggcgcgtctcattgtcgaatgagattgatgcttgtaaaaagtgttcggccaccgcgaaatactcttactcgtccagacatactccctccgcctaaacaaacgaatcttatgatgtattctagtacaataaatttaaacagatgtatatctagctagatttgtagtattagaatatctcacatccagttctaggttagtttttatgggatatatatacaatcatgccattggctctgtgactgtttatagcataggtgcaggctagtttctaaatttactctatggttggtacgatgtcaacatattttttggtgaataattttctaaagcatcactgctgcctccaggttccccgtcttgtagcgcgctcttggttcagttcctatgggagagggctagagatgaaggctgtacgtgcccgagaggatagaatgagctgatataatgttggcatggaaaacgaggagatctattagaatattagaatatgactaagtattaacttaaaaaataaatcttatttgatttattaattaagaaactcttatacagaaaaatttttccatacagctcaccatttcacgccggccttgtccaccactgccactgtcaccggatggaaaggaggaggggggaggggagggtcaagaggagaaggaggggtggcggatggagaggaggacttagagaaggagagaggagaggagctcccgattcggtggcttcagcgatggcggtgctgcactctaaaatagccgtcatattgatcgagcccccccccccccccccgccccctaaagctagctggccccgcaagcttgagaggaaggcgacatagtggataagaggatggagagggggtgaggacgagagaaggggggattggacaaggacactaggataggaatgaggaggcttgatctcgaatttatactgagtggtcggctcagttttgtatgggtgttggttctttaaaaaatcggcatctataatatattataggtatcagttttaattaaccggtacctataatatgttataggtgacggttttttttaaaaaaaaggtacataggtgttggttttatattttttttctcattacacggaggtgggaagaggttcataggtgtcgaatttacctatgaaccgatatctatgaggggttttgtagcagtttaacc

SEQ ID NO: 3753 - DNA, 1501 bp, Oryza sativa
aagatacatatgacctaccctctaatcagtaggtttacttactgcaagaaccatgtgattattctctgatcagttggtgctactgtcaatatatgactgaggtcgatcaagaagcaaaaaacggcattttatcaactgtagccagtgaatggtcagcatgtataaaactagattcagtaatattatcatctttgtcaaatatttcattttaagtactgtggcacatctttgactgcaaactgcaaaggttttggcatccatccatgcatgcatgttttgtcagtcctgtgaaaaaggatcaggccatcacaaatggatcatcgatctctgaatcaatccagagccaagcattcttgcaaggaagcttaccatattttttcccctatcagcatctttctcaatcatatacagtttataaactgattttaagccacaataaaaaccatttccacagtattatagtaccttgaagactgtttttttttcattcagtacgatgtttggcataccattgtccacaaaaaagataaattaagacgatcaggtctgaaacactatgattaattgtaataacaggtagagaggccggcacgttgctaggcaggttcaatgtacttgaatgatcgatcatgtaaagattcatatctgaataaccatacataccaatttgaccacatttctttttgactgaaatttgaccacatttttaatgctccttttttcatactagttacatgcccataagttataacgggtcagatctatataactgaaatagactgagagcccatacattaatgcatgggctaaacccataattgaaaagtgacaaaagaacgtgctggcgtgttgagatgaggagataactaaaaggaggatgacttcgcttataaagtagtagagatacatacatatactaaaattcaattcagcctctacattaagtacgtatttttttttggcttcagataaaggtagcgacggcaagacctgcagccagcaaggtcttggtcagtgggcatatctaggatttttatatgggtgatccaacttatataattttttaaatactttaaatatataaatagatcaaatgtgcatcataatatatattagaaacaagttctttttcttttttttttcaaaagtttcttttcacatatgtgtatatatgcattggctagaatattttgggtggtcccgggaccaccctagatccacctagttcttggtgccggagtcttcacgacgagatgtgcctttcagtctgcttcacttgtgtgaacaacccagtgcttttccggcaggctagatctcccaagtttggagctgatttgaggattgctgcatttccagctgaagaacagtaaacgactaaaagtgtcatcgtcgtgtgtttgtccatggaccatgcatggttcaagaaaaatgaagcttggatggtaagtaaaaactacgtggaatttgatggaagatgtaggaacatatttgccagactttt

SEQ ID NO: 3754 - DNA, 1501 bp, Oryza sativa
agtgatgagtcagtccattattgttgggtttttaaataaaccagcactgatattctaggtttttttaggacacgcgtgagttgggggtgggctcgaaacccttatcggtgcttggtttagtctaatcgacacaaataggggtggttatgatggctattctgtagtacactagtacataaatgcccttatgtgcctgttggaaactggttgtaggtgccgctgaatgatcgattaatcctatatatacatgcgatggtgaaaattgcagtgtagccaaatgattaatcctatatgtacatgcaggatgaagaaacacgtggatgaatacaaaactcataatttcaacattgggcagaagaacaattgtgagttgatgaagttaaaatatcgatcatgtaataaataattttagtctaaaaaatcatgacacattgatcaaatccatcaattgggctagggttgaaaagtatggaaggaatgggcttttggcccaaaaccaaggaatagttataattaactttttcaattatagtgtatagcaattttaatgttttaatttgttgctaaactcctaatagttgtaccattgaagaaatgcttttacccgttgcaacactcgtgtattttttctaagttaactttaaatgagtactatcacaaactctgaagttgttaccaggttcaaaattccggaataatactttcaaaaagtcatgaatttaggcccgccctatatgaaactatttcgccgaaattttcaggaatgttttttttttgtgaatttagccaaagtagtttttcaaatttaacaaaacttgttcaaaattcaaattattctgaaatttccacaattagtgaaatttcggttcaagcagagtctccagatatagaaagctccaaacagaaaaatctgaacctagcttggtcgttatcagcttataaccgccagtaatggtagctagtagtagcagctactcaaagaagcattgccgacgtgatgaagaccgtacgtgcgcgatccggtgatctctcacctcttcggcggcggcggagcgcactgtattgccgccgccggcgaccactccgtcgtctacgacttcgagctcgtcgtgtaggaggttggcgtcgagctcctcgccaatgcgctcgcagaggttgtgcagcacgcagcagacggccagcatgttggctagctccggcagcttcacctcggcacgccgcaggcactgccaccgcgccctgagccgccggaacgcgcccaccgccgccgcgcgcgcgtcggccacgtgcgcattgagcctgtcctgcgcccacgtctggttgggctgcgtgtacggcaccagcatccagctcgtcagcgggtagctcgcgccgccgacgagccacagcggctgttgccacccgagcttgtcgtggccgagcagaagcccagcctcgcaccgggcgtacagcgccgacttcgcgaggacggcggcgtcggagagcgagccggggtggccga

SEQ ID NO: 3755 - DNA, 1501 bp, Oryza sativa
gcagggagtaaagttttagcgtgtcacatcggatattatataaggtgtagcatagggtgttcgggtattagtaaaaaaactaattacagcatccgtcagtaagccgtgaaacaaatttattaagcataattaatccatcattagtaaatgtttactgtagcaccatattgtcaaattatggagcaattaggattaaaagattcgtctcgcaaattagtcgcaatctgtgcaactagttattttttaagcatatatttaatgctttatacaggtgttcaaatgttcgatgatgaaaaaatttatggtgtaatctaaacaggccgtagtactcaaaatgcaggcacgtaaaagccagctgcgaaggacccggtgcagtttatttaaagtttcaaatatacttatatctttaattgtttatgatggatagaaacactatataaaggatagatgtccacaacacgtgtataattatctctataaacacacatttaatttttatgagtagatatgattagataagcatattttaaaattgacgaaattatcacgggttatcaacattgataagtactacatccataagaaaaatacgccatcaaatctaacttaggctgcgttcgtttggagaacaaagggagtttgtttgtttcgtttttcgcgcgcacgcttcctaaactacttaacggtgcgttttttgcaaaaattttctatataaaagttgctttaaaaaatcatattaattcatttttaaagtttaaaatagttaatactcaattaatcatgtgctaatggctcacctcgttttacgtatcttcccacttttctcaatcccctatctttcaaacacagccttataatcggatgggttagttccacacttccactaaatgaaaacctaaaccagctacactctttttattgtttttctaccaatgctgctactacacatacaattttatttcacttttataataagcaataaaaaatagaaaagggaaatggtggggtcgcaccgttccaggtacggagccacaggcaaacgggtaagcccgaaaaccaggtgcaaaaccaatcacccccaccattgcaccatccaccggtacccacccgtgcacttgcccgcccatcgcaaaaacaacagacgcacatacccccgccgccggttcgccgctcgccggcgacggccgccacgacgacgactcgtcttccgtcacctacctccgctttcccactattcaatcccctcccgtttcccaccaccttcccccctttcgctccatgggaaaaccacccgtcctacgaattaaatgccaccacccgcgcgactcctccgacccgacgtttcctccctttcacacgcgggcccccaccttctctctataaataccccgtctcctctcctcctcgccgcatcccatccacgcaaatatttcttcctataacaggacaagagcagatcgatcgtttcctttttatttctgaggagaagaggatcgatcgt

SEQ ID NO: 3756 - DNA, 1501 bp, Oryza sativa
gtattcatatattttttcctatattttacaattacatttttggtacctaatttttgtgaatgggctaacaatctcggcctctgaaataagattggaccgaatcatggctgcacaattgatcatgatcagttttgttggactgggccgacacggagatgcaggtggccggcccacagacctgattccgatgtacacaagtcggcgaagaggaaacaactgattagttaatgcatcatctcaattgcaatttgattactgctagtcctacgtataatagagagcaaaaacgcgaagaaaagttggagccgaattcgatcaaagcaaatggtgtacttggctttcttattatcttttcatcgttaatttctttcgctgctgacctctgtgcttctttcactgctacgacaccgatttttccgggcgggctatccaattttcgcgtgcgggtgggcggcccgcacgcacccagtcgtctggaaaaatcgcgattttcgcgtgcgggtggcgcacccgcaagcgaaaaccaatctttgcgtacgggcgctcgcacggagaaaaaaaaagaaaaaagaaaccctaaccctaaccctagtccgccgctgcctagccgaggcccgccgtcgtcgccctcgtggtcgccggctacgaatccgccgctcgctcccgtcgccggcgcaaatgaaccatctcagaagaacacatctcacatctcacaagaacacacatcaacacatctcatatcaacaagaacacatctcacatgaacaaatcacaaataacaaagagaggagggagagatagatccggttgccggtcgccgacgtatgccgctgctccgccggtcctccccctcccctccaccggatctgcaagggagaggagagccgcgcttcgccggccggatccgccgccccctcccccggatctacaaggggaagaaggagagggggcgggcgccgccggatccgtcgccgtcccctttgcctgccgccacgcctctcgcccgccaccacccctttcgccctccgccgcacgcggccggatccgcccccccccccaagccttccctccgccgtatctgcacggggagggaggggagggggcgcacgccgccgctgccgctgtgcatcgccgccgccggatccgccgccgcccccttcgctcgccgccgcgcacagccggatccgccgccgcctcccccggttctgcaaggggaaggaggggatggggcgggtgccgccggatccgccgccctcttcgcccgccgtcatgcactaagggagagagggaggggcgcgctgtgcactgagggagagagagagagaggagaggagaggagagtgggagggaggagtggagtgggagagatcgagggagagcaggcagagggaggtgggcggccaggttaaatgcggtggaccacgcgggtgtgcggttggcttaacccgcccgcacgggataatgtgttatcccgtgcgggcgacatcctggagcctgtcca

SEQ ID NO: 3757 - DNA, 1501 bp, Oryza sativa
aataatttgtttaaacttagcaaaagattgattagttttagcgaaaacatgttcaaatttcaataagaattgtgaagtttctaaaaatcacggagtttctatgttatcataatagctttttattccaaaatgtaaagcccgtagttgatacacctaatttctactattgatccaatatcattttaaaatcaaaacaagtcacccaaatccacgacaaattacacatattgaacagctcgtcgacaccatgactctcgagacaatgttgcatccctggtctccctctcaccaacggcaagggggaaggggttccatctctttttctaaccaagcataagtttttaggattttctgaaataacgtgtttagtgctatgaatctattagatatgtagagcttgtttttcttctatgaatctttgtcgatgtctactttattagtgacatctttgatcaagatctagaaggactaatcagctaggttattgataatccaataaatggcgtcgactttatagttcgaattgttgacttatttagtgatgtcagttgctaatctatcaaaggaatgaaaatgatgacaggtacttatccatatccgtatggacatgcgggaattagttagcattgtggctgcggtcatttgtaataccatctctctactcttccgttttccttaattttctttttagttttatatatttttcatctaagatggttgtaatatcttcaaagaacaggttatcataggtttattgttgtaacgaaggattaaacaattgctcaaataaacaaatcctatgcagacagtgtggggctaacacaagcgagcaaagccttgtctggtccggtcaggcttcgaattcggcgaaatttgctcttttcttgtcccatctccccaagcactgagatactctcctcctcctatatatattattatgcgagtaagatatgcatgatggtggcattagctagacaagcagagagcatcactagtgatatctgaggtgtagttggggctcgagacctgagccgccgaattgaattgaaacgagccagcatgcatatgcagcccctgcattttgccgaccggtcaaacgctttccatgtgctgccctagctgggatcgaagcaatgccattgccacccccaactgctccatcatccattcacaatacaggccaaccaattaaatactccatctatcctatattattagggattttagataaatgtgatacattctactccctccatcccaaaatataaggcataaccactcatacacaaagaccagaaaaaacatttaattgactttttggttggatcaccttgatacatacaagcaatgtgattgggagatttgatgatataagatttaaaacaaatcaattttataggaccaagagatgctaattaatgtatgtatgcatgcatgcatgccttatactatgggacgatagaaaagtggttgtgccatatattttgggatagagggagta

SEQ ID NO: 3758 - DNA, 1501 bp, Oryza sativa
ccattaaaatattctgtagggatgagaaaagtaactgaaaattttgaaaatttaatttagacgcctaacactactaaaaataaatccaatcaacttggaacaagttcaatggaacaaaacccatcaattccattattactcgaaataaatacaacaagcttgcgatcaacagtacattgatcatcaactaatgaccaactgcatgccacacaagcgttattacaaacagttcatggccttaagcaaagtacgatgaaacacacgccaattacaacgtacggattcatggatagacagctagttaattactacctccgtcccaaaataagtgcagccgtggatatccgtgcccaacgtttgatcatccgtcttatttaaaaaatttgtgaaaaatttgaaaatatttagtcacacataaaatactattcatgttttatcatctaatagcaataaaatatactaataaaaaaattacaaataaaacaaacggtcaaacgttgaacgtgaatagtgtaaaactgcacttattttgagacggaggaagtagctagccagccagcaatggcgtctcctccggccggtgagcaatgcaagcttgttgacgtagtacacatcggattggaaagcttgaaggtgcgggctcccgccgccgggccgaggaggtcgctccactggtcaccgatgttaccgacaatggcatagccatcgctcaccagcttatgccgctcaccgctcttgaacgcctcgatggagagaccccccgtcggctgaagcaccagcttctcccacccggagtagccctgttgggaaaggttgcggatggtgacggccctctggttctcggtgcggactgtcaggaacaccggtttaatgccgagctcgagcagccgtcggtaaagtcgtagcgtccctgctagcgccggtgcggtcccctgctccacgtattggaggaagctcctattgtcgtacggctgggctctgtaaaatggataatatatataccggccgtttcaaaaatgtgtaagcatgtagtattagcaaaaaatatattacacatgttcaacttttttgttttatgcaaaatattttaagcaactaaaattgtgcctattttactacataatgtctaaaaaaacttttatatttttttactaccggaaagagtattttagtcatcactacctcttatgatgaacgggcatcaaacaattgcaagaggtattcattcattactagaaatatgagcgcggcgccacgccgcgcacgttaatatcgacgtggttagaaccacacataatcaatgttaatttgacaacgtggagtggaatattatatacatgtaaatttggtttaacatcagtttattatatgggcccccttttttaagaattgttagtttttttgccatctaaaagtggataaaaaatggtataattttggaaaacaagcggtaacacgcaagaacagcagagattggtttgaaaactataatttagtcgta

SEQ ID NO: 3759 - DNA, 1501 bp, Oryza sativa
acaaaaatggaaaccaattgtgcttttatagtaaccatacaaacttgacacaaaaatgacataagaagaatcaactcatccttcacgaaaacaaaaaaggcaaccagttatgctattgcactaaccatagacagcttcacacagaaaaatgcaacccatgctgcttttatactaacgaacagattactccagatagcttctttcagaaatgggcataggcagaatcagctcaactacagtctcaggtccaaacaaaactagaatatttacaaatttgaagcaaagacacaccatctgtaatcaagaacacggtactactatatttctctgcatagtaagatcaagtaaccttcaagaacattctttgaaaagaaaaaaaaaagttactaccttcaagaacatcataccattctagattttgcttactggctgacagggataacacaatagcattaacactaatcttactaattttcctgaagcggcattccaaatttcattaacaacaaaatgaaaacaggccacatatatgacataaacgagacgcgatttatcatggcaagaaggcatccatccaatcaacagtaaaggacctaacacggggaatggggatcattcagcggccgaaccccacaaaataatttattctattttattttattttgcggggagaaagaacacgagctgctattctatatttctattcgattcgaaacgtgagggattcaggcgggcaaaagggaagggaaaggaaggaggtcgtccggccgcgtggcaccctccagaacctgctcacctgccgccgttcgcgcgaggagggtaaggccaggccgccgcggccgcacaggggagaaggctagggcgcggggaggccgtccacgcgctcgtcggcggaacgcgcgaggtgggcggcgcctcgcattctcgccaccacgccgtcgcacagcttgtggaagagagaaagagaggaatttgaagagagaaagagaggaatttatatttctgagcaattttgcgctgagcttagtttctaaaagagcaggggtgctttactaaattttcttcgaaaattcttgcaaacaagattttaaccgtttggtttaaaaaaacgtaagacgtaggatcattttaaccataattttttttgtaaaattaataaatatatagatgtatttactagtaggttgttaccgaacattggtaatgcccacacctcttcctttagctatatccattaaaaaacaaattgaagtatctataatatctactaccccgtttcaggttataagactttctagcatttctcatattaatatagatgttaatgaatctagtcacacatatatgtctagattcattaacatatatataaatgttggtaatgttagaaagtcttataatattaaacggaggaagtacaaatcacccctacagtatgtttagataatagaaaaatgagagataggattggaattgaaaaatgaatgagatgagacttggg

SEQ ID NO: 3760 - DNA, 1501 bp, Oryza sativa
tgcacaagagtggttgtcagctgtatttgacccaagggatgtaagcaatagaagattgttacactgtactagtaagtaaaaagtaagcttatgcactacaagaccacgctggggtatgaaatgtaatccgaaaaataatgattgtccatgggagtttaatgggctcaaagttcaaaatgtgaccactaaaccagcccaaaaagagagcatcgatctgttactcatcagataaagtctaattcgagttcctcaaatttatgttggatctgcttcgcgttcctcgacagaaaactagctataacgagttctcctaccgttcggaccgatgcaaaatgactcttcaatggtttgtaagacgattttgactaatgtgactcttattggcaccttgatattacaaccagtgaaaatcaaataaaatatgcattgggccccactggtaagagacattcatgctctttgtggggctgccatggagcacaaagcgtccgttgagcgtcaaactcccgtcgctgcacgatggcagtgaaggaagaagagattggtaaggaccagcacagataatgagtgagtttgagccattaccaagtaacacaaccttatctttcttcgccttgagactacgaatagataaatagtgatgatatttatctgaataggcatatttgcaatggcaaagatcaaattaacttttttttcaaagattagaataatttgtggaagcaaagaggtgcccgggttttttaaaaaaggatgatacctacaaacgattcaacttacaagtaacttagtgatatgtgaaaacgagaaatagacaaatagatacttcctccatttcataatataagtcattctagcatttctcatattcatattgatattaatgaatctaaatgtatttcctacatttatattgatgttaatgaatctaatataaatgtgagaaatgctagaatgacttacattatgaaacggagggagtactttgatactttagtgaaagagaaacaaacatttcaaataactgtaagatctttccaaaagtaccagcaaactgacctcttgctaatctgctactataagctgtcgtcacttggcacattgcactttaaaagatcatacaaagctattcactattagctgcaatcaagtgatagagagagatggatggtataccctcctctatgaatcaaccaaaagcgccactgcccatccggccccaccaaaccccagcatagtagtcagtccccaccaacccctccccgaatctcaaggcaaatcggacggcctatctcccaccgcaccaccgccccgcttcgattcccattagcgacggaagcggaaaccgagcaaccaccaccaaaccccaaccccccctcgccgtctccggcgatctccgccgccgccgccgccaatccgaaacctcgtcgagtaccccccacctaccctccgggcgctgggtcctctgatgcttcccaccccatggccacccacattcccc

SEQ ID NO: 3761 - DNA, 1501 bp, Oryza sativa
ttgtttactgatcttcctatgcgaattaagaaggttgagagaacaatcgatgaagcaaatatgtcgtacgttcgagcagatggtgttgccaaggttattaagtcatagttatttcgtaacctttagttctcattgtattccaaatgtacgtgcatgaatttaggtcccccttatgttgtaatcattagcaaatgtacgtgcatgaatttaggtcccccttatgttgtaatcattagcatgtaacatttgattacgagttttgagtaattttcatgagttttcttagtgccaaaaacatttggaatgtataattgtggcgaaatattgggaaaaaaatatatatggacagtttacttatagaggaaaaaaaatatgagtttttttggtaaaaagatctttctatgcggctggcttaacagcccgcatggaaagatctttttcgcatgcggccggcttatgtcgaccgcatggaaagatctttttcgcatgcggccggcttatgtcgaccgcatggaaagaactttttcgcatgcggccggcttatgtcgaccgcatggaaagatctttttcgcatgcggccggcttaacagcccgcatggaaagatctttttcgcatgcggccggcttatgtcgaccgcatggaaagatatttttccatgcggtcccttaagccgcccgcatgcgatgatctgcgcctatatatagggagcgcggggagccaaaattttctaagtcccagctcccgcgaaaccctagccgccaggctgccaaaatttcccaagtcgccgtcgccgtcgtccccgccaccgccggctcctccccaaagtcgccccgccccacgccgtcgccgccgccgccgtcaggacctctcccccctcgcctttgccgtcgccgccgccaggacctctcccccctcgccgtcgccgtcgccgccgccaggtcgccgtcgccaccgcacggaactctcccccctcgccgttgccatcgccgccgccaggtcgtccccgccgccaagtcgtccccgctaccgccggctcctccccgaagtcgccccgcccctcgccgtcgccgacgccactgccaggaccgttgccctcgccgtcgccgtcgccgtcgccgccgccaggtcgccgtcgccgccgcacggacctctcccccctcgccgttgccatcgccgccgccaggtcgtcgccgccgccaggtcgtccccgccgtcgctcggtaacatttactttttagaaatgtgaaatgtgcaattgtggattgtggattgtttaattgtgcatcgtggattgtgatatgtgcaattgtggattgtttaattttgagaaggtttaattgtggattgttaaatggagatttatgtttaaattgggacttatgtttaaattgggacttatgttaaattgggatttatgtataattgggacttttgttaaattggcacctatgttaaattgtgatttatgtataattgtgatttttgttaaactgagattta

SEQ ID NO: 3762 - DNA, 1501 bp, Oryza sativa
ttccattggccaaaggtgggtcccaccatctctcccatcccttcttccggctccccgcccccccccctctctcttgctctctctctctctcgccatgtactggcccccacccgcaagcagtgatgacaccgacggtggcggatcaattggtggtgacggcactgatggtggagcaaggagttgtagcagtggtggcggagcaagcaacgacgatgatagggcagggatggatcggagggcctgctgacctttagcggcggtgtcgacgaggtcagaccggtcactggtgatgaatacgttctggctgcgctttcggcttcatcacagtctctctcatgactcatcatttggagtctcgccatccaccacaactgcactgttgttgctcgtcgcggtctccaccgtctctgtccttgcacggcctccaacgcctctttccccacacggattcgactggcggccggcaaagaagaagagagaggaagagaagagatagaggagagggtgaaggagagaaagaagaaggggaaagaagtagggaggctgacatgtgagacccactatcagattagagaattgtaatagagaggctattgaaatgaaaggtaaatttgactatctttttattttttggcaaatcggtcaaatgaacatttggaaagtgagatttggaaaggatgttatcggagatgctctttctaggaagtgtacaaatgaagtgatgaatcgtggtacggtctcgtggatgcatccactaatgtttaaattttgatgtcacaaatattacacatacactatattagtgattcgtcgttgatatcggtctcttcgatcagcttgtgttggttaagagggtgtatgatcagttcacgcatgtatgtatgcatctagcttgtatcaataacaagctttataataagtattgcaatttactcttttggaagacgtacacgcactactacaaaaatcgtttttctgtacgagggggtcggtaggttccatgcgggccgcttgtggtggcgcctgcaaaaaccgcccccccggggcgggttgattagccgcatgcgatgatcggccatatatgctcctccaggcccgagcttgaccatttgaaaacgaagctttctctctcctaaagcaagcaccaattagggggggaggttttcaactcgaaatttttacttgaactctatacgaaaggtgaagaactctctatcttgcttcatttggctccatttttgttatatttcgttggtggaaagtggagtttttttaatattttgacaaggtttgttccaactattttttgcaaaatctagcttcaaaatatatgttttgatgggcaaattttgcatgtaatcaattgtacatactagttacatgtattgttgtattttttttgggagacaaatgcatttaaacttttgtatgaaatacctgcggtctatttttttatctgtaacttttttgcctttatataattagatggatcggtcgtcat

SEQ ID NO: 3763 - DNA, 1501 bp, Oryza sativa
ttgaattgtagaaataacttctttgtctataaataatgtaatttcataaaatatatattagcaatataatactgttaaaatatttatttattacatctatacagttgcttcttcgggaacaaaccttgttctaggtgctactgttctacaaacctctgctgtgcagtgtcacaaatattcttaaatatctcttgctgtctaggatataaaccacagaaaccaaatgaaatacagagctcagcaacttgtagcattggtactcgagttattgttcaacagtttcatgaaagaaaagtactctgtccttttgttatgctttattcacaggagggcattatcaatgtagaataaaggttttgcatgttataagaaaaatccttttttcctctatatatacaccccccctcttgtgcatggctcattgtgtctcagctctctccacctgcttgaactgatctctaaagcttagccatatatggagtattcaaatttgcgtcgccaaatcatctttatgaagaaaaatcttttcgatcaggtttcatgccttcacttttgttcctttgagaaatgagatcgtaattaattagtgtattgcactagacactagttgatgttttattgcttctcagttcctgagctgcaatattagatgagatagttaactaggagagagagttagtttcttcagtttttgtcttacatgtaagtatataacaaagtttgattgcacccttggacatcccctgagggcacactgaacccctggagaaaagcattatcaatcaatggtcagatatgtggtcatgtggagcttatatcattcatgcactctgtttcaattgtgaatttcatttgcaacagcataactcagttttgtagtgtagtctactagtctgggatgatgcaataatgctcacttagcagttggcacccatcttatcttatctaaaagttatacaactttcttttacatcacatatgcatgcattatgataatgagtttaagcagatcgtcaaggatgtaatatgccatagacaatagcaaaccactttcttaatttcctttgtactattccattgagaatatacaaaaagtcaggtctttcaacctttagagagtaatcatagagtagcatcaatttgatgatacattagtatctcctaggcaaatactagatttcctttatacttaactagggtgaagcctactccctccatcccataaaaaaccaacctagtaccggatgcgacacatcctagtactacgaatctagacatatatacgtccagattcatagtactagaaaatatcacatccggttctagattcgttttttatgggacgaagggagtaagtcacttgctggaacctgactttttttttaatctttgactaattatatagatttacccttgtaaattagtacacttatttgtattatatggactgcacaaaagttttttttttggttgtgtatttcatgcttctttcttttgccta

SEQ ID NO: 3764 - DNA, 1501 bp, Oryza sativa
ttcaaaagttacaccaacggctatcttaggattgtctacatcagttacatgagccactgactcacaaccctcctcatcgtcaacggctaaatcgtcttgatcttcgtcagaaccagggtcatagtctgcgtcaactgcctcatcatctgaaaccaagtcgttgtatttctctttctcatcatctacaccaacatactcaacctcatcactctcaccccaatcatcaaccttttccttaggcttcgtaggtttgctaggtttgctacgtttagatgcaatgacttggctctcttgagtggctaatacaatgtcagtacaagcaacttgtccatctcctgcaacagtactagccggcccatcaatgctgccttgatccatacaaggctcggtcctatttcgtgggtcatcactcacattaacaagcaaagggagcctcctcatctcccagtacatatcaaatgcatcaagcaatgaactatccgaagctatctctgcatacctctcaacatttttgtcccaataggttacagttatctcctgaagataactatgttttacctccccatcaagatcattaataaggtcaatccaacaaattgtatccttgtctattacccacttaatatcacgagagacatgataatccggtctaccgttctcatcaaactcaacgtatggaccaactcgaacatcaactctgcaagctgcgctagcgtccatcctacgcgacaaaaacgcagcaataaaatcaccaaatttcaatcactttaaattgcaacaaaaactctacaactcgcaacacatatcactgcaaacaattccactcataatgcgaggcaaaaaggaatcaagcttacccttgaggaacccaagacatgtccaatgccttcaatggaacctcactgctcgtcagccgcagggacgatttcttcccagcacacttcttccttggcgacatcttcctagctgccgctcggccgcctaccaatatgacagctccatcggcctccgccggcgccgccaccgccggccccgccaccaccgccgccgccgtcgctgccgccgccgccgtcgcctacggttaggtttgggaatggggaatcgggctgtggagggaggggggatggaaacagcgccggctaggtctggttcgaccagacccagtcaggcttagaggtagcggcgcgcaggggtagattggtcatttagaaaattttctgaccacttttgcctcggaaattataaaatattgcctccggtgtctcacagccaatttcacaactttcgtagtgtccgtgggcaaagccaagattttgcggtgtcccacagccaattacacgattttggagtgtcctgtagcaaattttgcctaattatttataccaatcggaaccaaagattaaaaaaaagcagctgcacacgcctcctcggcaaccgcgcgcctactcgttcttatcccttcttattctttttcacaaacgccttatcccttcgtcctctc

SEQ ID NO: 3765 - DNA, 1501 bp, Oryza sativa
cgacgttgttgcaggtgccatcgttgacattgcagatgaccatgcctcgccacagatcaacgaaggccactacctgttcatcgtgcagagtaatcaccttctccgtgtaatggaaaacggtgtctttgtcctgcggattgcgcagctggtcgagacgaagggtctcctggctccattcgccatcgatggagtcgtagaggcagagcttgaagtggccacgttgtccaggtaacccataccatagctcctgatcaagactgcagacatagaagccggtggagtcgtcgtcgtggtcgtcaccggcaccggcacggcggcgggagaggatggcaatgctgccgagctcactaaggtaatgacagcgatggaaggggcggtcggggtgccggacaagcgtgagcgaagggcggcggcggcggctgtcaccaccgccgccggcgtggtagaccaggtggtagacttgatcgctgtggactcggaggaagacgaggtcggcgttgacgcaggcgacgacgggttccttggcgaagacgagggcggggtcggcgttgggggaccaggcgcagacgtaggagacgagcggcggcggcgcggcgcagatggtgatctggagcttgcggccgctggtgagagaggtggtggcggtggtggcgttctggcggtcggcgatgtaggcgcggacgtcgaggacgatccatgggtgagcgtcgggagggtggccgtgggtgggtggacgctcggtgagatgcttggttttagtccaacggtaggggaagacggtagccatggccggcgatctgcacacaagtttattcgttttagatagaaaaactatctatgtgtgaagatgaatagaaggtatgatactagagtcaggtttccgattatgaaagagaaaaaaaaataaagatgtagccaaactaaatcctatttggaccctaagtcggagcccgtacgtctagttcatgcggtttgtgaatcctatctatcttctgagaatgaaattgtttagccagacattactacagtatgtcagtatatctgtctatctagctgttatcaatacatgcatgcatgcgtataggttttgcatgatgcaaaaatcataggaggactcctattttcatcaatcaaataatgtgtgagattaaaattgcttcaacacattagaacgcacatgcattttctctaatattttcaacacaaaaaactattaatatatatttaatgctagatttagttaaactaatttggtgctataaatattgctaaatttttctataaatttgatcaaacttctagtaagtttgacttaagaaatcaaagcgacttataattaaaaaacggagggacgtttcatattataagtcgttttgattttatagagaaatatagtaatattttcaacacaaagcaaacatataatcaaaatattttcgatgttatatttaatgaaactaatttaatttatatattcatagttttataatgtcttatctga

SEQ ID NO: 3766 - DNA, 1501 bp, Oryza sativa
ggctccggcgacggcgagggcgaggcgacgccggaatcatcggtggcgttggaggcggaggcggaggcggagacggggaggaagacgtggccgaggtcggaggaagtgtcggggtcgaagagcgcgaggaggggcgggagcggggcggagaaggggagcaggagggtggcgttgcggaaggtggagttgagcgggtggggcgagaaggcgcggcccgcggcgaggtcggcgagggagtccccccgcgccgcccagaagcgcgcggagggggaggccgcgaggaggtcgaagcgggtgaggcgcagcgcgcaggagtcgtcgtcggcgaggcggaccgtgccgcggagctggtgctgcagcatggtgaagtccgcggcgaagggcgcggtgtggttggcgtgcgggcacacggcggccgacgacgacgccaccagggccccgatcgcgaccgcgagtacggcgaggcggagggcggcggcggccatggccgcggccgcgggggagggatcgagatctggagaggaggcggcaacgcgtggagtggagggatctggaagcggagggggttgggttggttggatgagttgagttgagttgggctcgctcgcttgctcgcggctgcggctgcggcggagtggggcgaggcgaggcgagcgggcggggtggaggtggggtggccgagatccactttgggtggtggactgatggaggccgtgcgccgcgtgggaatgtgcgatgcttcgtagggaaggtcggaaggaggcagtcgcaaaccacttgaactgttaagagaagaagaccattttatgttctctcgagaaactttgaccattttatgtcctatcaacaaaagtttggtctatctcaaaaaaaaaacaaagttttggtcaatttatttgtttgtttgtttattgttgaaactgaatatcgatatcactttttacagaatgtagaaaaacaaaaaaaaaacgaaagtgataaattcagtgagcacaaaaatcgacagtagattaccttgagctagtatgtgtaaaaaccaggaagattttaatttctatatcatcttcagtcggttattgattttgactctgaggctgccactcaatttctcttatccaagttttagaagatgactattgtaaagcaaatggggtagtattaattggaagcattagctaccgtggtacacatagtatggtaactccgaaagtattggttttgttcaacatagcaatagacgtagatcattcttttgcgagagatgttctgtggctttgcacatgtcatcgtgctatgttttgtgacactagaatgtgcgatgttagaccctggtttaaactagtgctcctatatgatattgcctgtgggatgattatttgaagggcaatgcatgtgcgatgatttgatggttaatttgtaaaccttatttgtagaatagaaacggattaatccactgaataaattctagtgctcctcttgagaaaatttgaactcatgtgta

SEQ ID NO: 3767 - DNA, 1501 bp, Oryza sativa
tatttaccaatgataaatgataactcaaatatttattcatattcttatactgcctttctttccaactgaacatttagaacccaaacatgtacatgatgtacattttgcgtgaaggttaacaagcagccatatatatagctccaactgcgaggatataacaaaatcttttcacccaaagaagttaacactgcatttattttttacatgtatatttatttataacatgtaaaaactaggtcctagagacacttgtaacttgttgcacatgtatgttcatttacatgtgaatgagtttattcagcgccgtgttttctaccgaattttgtctgaatttggcatttgtacaccgtgacaagctttatagtgggacaaaggtcgctagctggcaagggcaggattcgatggattttttgttctccaatcgatgaaagattttaaaggcattctttgcttgtccaggagataaagatagaattatgccgtgttcactacattgctgatttcaacccaacaaaacttgataatttggtgttatcaaaatttaatagtttaacaaactacacaagccttaccgttatcaacctatcataattttgtaacttcgaaagttttcgctcacagaaattctgagaatgattgacgtcggtcgcccggcgcgggggagccggatcgggcgctcccccctcgcacccctccccccacgtgtgggcccgcccacttctttctcatttttccacaaaagatgtttcattcagtgtatttataatgtttcactatttatagatctaatgttgcagtgaattaaaatactttttttaaaaaaagaaacccacatattttggaaattctccattaaaggaatttggtttattttttgttccaccaaaaatgtttcacccagtgtattaacaatgtttcactatgtatagatctaatgttgcagtgaacaaaacattccattgcaacaaaaaaaacctacatattttggaaaccccctattaagggaatttagtttatttttttttccaccgaaaaatgttgcacctagtgtactcataatgtttcacttatgtatagatctaatgttacagtgaactgaaacattctttcgctatttactgaaacattatttttatatagggtgaaataacacccgatttaaatgagtgaaacattttcgatctacttagtgaaacaattctgatatatttgttggaacatcatgcaacatttaaaaataattcaataataagctaaaaaaattcatcggaatatattcatgtgtggtcttattttgaagatttaattgcaacgaatttaatggtgcaatcggatcatgatttggataagtaatttaagagaaatcagtttaaagtagtttttgcacgtaaatcgggcgctgatgtcagcgcccgatttttctcaaattcgatcgggcaaccgatcggtaggagtgccccaaaaattccaccgaaatttaaggctacgttcgttccccagg

SEQ ID NO: 3768 - DNA, 1501 bp, Oryza sativa
tgtgcacggcgctcggtgccgctgcggtcgtcgtctcccttcgtcgtgctcctgtcgtctgctgcgccccagcttgcgctgcccctgttgcagcctctgcctctgttggcagcagccatggttggttagatgacgacaatctcctccaagtcaatgtctttgggatttttgtgattgggtgtttgcttcggctagattcttgtggttccaagttgcaggtcacctccttcttagccatcgtcgtcctcacagcaagacataagtcaattggcaacctctcaaatgccccattgttgatggttggctggtctatggtttggccctctcttttgtttcctagcagcagaaaccgcgtatagtttgtcattcgggttgagctcggaacccctgtgcaattttcattatcagggttgttgttagagttcctcagattcaatgacgaatcccgtggggatgcttcgctgaatccggtgatgctcgcaccaaaatctatggctcaacaattatcctcgatcttgtgccgttcccgtgaaggcaaccaaaggggatcaacggtttgtcaagcggtgtgcaattcaactgaggcccaaggtagcagtcgtcgcggttttaagacgtcgtggctctacaatcgtcacggcatcaacgcagctccctatcggcttgctcctttttctgctattttgttacatctggaaggcttccatagtttggttaatcctctttctttagggttgtctctaatgctttcagctactatcctttgttgtgtactggggtttatcccctaatatctgttcttacttaataaagttgtttgtgtttaaaaaaaaaatccaccgtcacgcctcgatctccctgttgattgttgtaagagaaaaactaattattaattaactagagtaaaatttagagaaatgcaaatttaataactaaattatcaatatttactacaacattaattggtcacctagttcattgctgcaaggattaaggatgaaattattatgtaggtaaagttgaatctagaaaaaaaaaaggtatgtaaagctccaacaagttgataatttggtcgctaaattaatttgtacgtacatgtctaaaattcactcaatggagtattaatctctatctcttctcgatctatatctatttgtacatgtgctaatctgctgccaatgaaccgcaaccttaattaattaagctttaatctcgttgtctctagcgcgatctcacgctgctaatttgtcctgctccctctccccgttctgcatttatttacttgcatgatgcatgtcattcagatataattattattcgatccaagttcattttttatgattcaagtttcgtataggtttcttttcgacgtcattttttaatgatagatgctcatgatatattaattgctcttgctataagtggttaattacatactaatggagtataattaagttcaacaaaatcaattgaagtaatttgattcttttttaaagagatt

SEQ ID NO: 3769 - DNA, 1501 bp, Oryza sativa
tgttggtggcgcatggccgagccgcgggaccacggtggtgccgcgcttaagtgaccgggagtgggtcgcgcattgtcgcggcacgggtaaaccgcggtaccacatagcaacggtcccatgccatccccaagtcgtggccagggaatattttcgataatattttaaaatcatgtatataaatgcaaaatcttcaaaataatatatattctttttttatgtgtgtgtgaaagggaagggagctgcccagctgatggatttcatataagacggccagaggacatgcacagtctcaatgaacagacaaacaacagcaatggaggcaactttcagctagcctagttgcatggaagtggatgactggatgaggaacctggtgcagctggaggataaggatgttgtagttgaggtagccatcgctgccggagcatgcgcgtcagtgcatgttgccctcagcccccaggtcgaatccctttagctcgctaaggggagctagcaaatccaaatcatctgttggaattaatgaatgggccttagcccactcgaagattaattctttggaaaatcacaaaagcccacctcatgggatggcatgcatatggagtttagtaccactttgcttattctaggagagggggacctccttaaaagggaggatgccctcctagtcgcttgaagcatgtgtggtggagagaagaggggaaacatgcgcgcgctcgctcgcctggcctggccgggcaggcggcgcgcgtgcacgacgtacgcgtcgaatggtccgaaaaattggctcctcacccttgcgcagatacagcctccttttgcagttttgttttgttgcaaattcggattcgtttttgttttggaaacgttccgaaagatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacatacgcaaaatcaatctagggtttgcttcctactctgtactgcgccgtcgctcgtagactactccatcccgctcgccggcgtgcaccggcgatcgggagagcaggtctccggaacctctgccttcgacgttctgcaccgggagaaggcggcaataaggtttttgggaagcgcttcgcgcgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattacatgtctataatctcaacaatccaaaaaccttattataggcactgtgattttacta

SEQ ID NO: 3770 - DNA, 1501 bp, Oryza sativa
gggtgaggagccaatttttcggaccattcgacgcgtacgtcgtgcacgcgcgccgcctgcccggccaggccaggcgagcgagcgcgcgcatgtttcccctcttctctccaccacacatgcttcaagcgactaggagggcatcctcccttttaaggaggtccccctctcctagaataagcaaagtggtactaaactccatatgcatgccatcccatgaggtgggcttttgtgattttccaaagaattaatcttcgagtgggctaaggcccattcattaattccaacagatgatttggatttgctagctccccttagcgagctaaagggattcgacctgggggctgagggcaacatgcactgacgcgcatgctccggcagcgatggctacctcaactacaacatccttatcctccagctgcaccaggttcctcatccagtcatccacttccatgcaactaggctagctgaaagttgcctccattgctgttgtttgtctgttcattgagactgtgcatgtcctctggccgtcttatatgaaatccatcagctgggcagctcccttccctttcacacacacataaaaaaagaatatatattattttgaagattttgcatttatatacatgattttaaaatattatcgaaaatattccctggccacgacttggggatggcatgggaccgttgctatgtggtaccgcggtttacccgtgccgcgacaatgcgcgacccactcccggtcacttaagcgcggcaccaccgtggtcccgcggctcggccatgcgccaccaacaagagccgaccgtgttccgaaatttatgtaatttggatccatttgaatctttcatatctcaattcaaattttaaaacttccatatcgaaattcaaaacattcagctgaatttttttacaaaattaactcacaattcgaattttgagttgaaagtttttaaatcttgagttaaaattctcaaatttgagttgaaagtttacaattcttgacttgaaagtcttcaaatctaagttgatagttttcacatatgagttgaaagttttcaacgagggaaggggaaagagattggataaagtgtgcgctacttttcttgtcatcatgtatgcactaaataggatgggcgagcaaatcgtgaataggaggtggggctaggaggagaggttgtggttgccgtcgtcgttgtcactccggtgtgaccggcaactacctctctctggtttgtatctagtgatgtaccaatgtgagggagggggaaattcaatggtgtattgtaaatgtagaaaacctggcgtcgggtaagttcataaaacttaccgagtggatgctgggtataccaaaggtaaggttataccagagttcacaatcttctttgttttcttgtcggtctgaccgccaagaaaaaaacttttcctcatggctagcagccaagaaaattagatttcccttactctctagacttggtggttcgccaacaaaatatatcgcctt

SEQ ID NO: 3771 - DNA, 1501 bp, Oryza sativa
ctagagtccatacaagtatacaatttagaattaattaaaattcggaattaaaaataggaaaactaaaagtagaagttagagttcatatagaaatgcaatttaaaattaactaaaattaaatattttttaaaaaagcaagattaggagaagagtatagagtctatataggaatatataggaatacagtttataaataacttaaatttaaaaaaaaacaacatatcaaaaaatgaatttagagtccatatataaatacaattagaaataacatactgagaattagaaaagtagaaatattggaggaggagtctacggtccagacacaggaatttagaaattactaaaagttagaaataaaaaataagaaaattaaaagtagagtttagagtccatataaaaatataatttagaattaaaaaaatcaaaattaaaactaaaacatattgggagaagagtctagcatccatataagaatactatttataaataactgaaattcgaaattaacaaataaggaatattgggaaaaaaattctagcgaccatataggaatacaatttagaaattactgaaattaaaaaaataaatattagaaaaagaagtctagagtcaatataggaatacaatttaccaataattgaaattcaaaattaaaaattaagaaatattgaaagaagagtttagagtccatatagaaatacaatttataaataactaaaattcagaattaataaaaatgaatattgaaagagtagtttagaatccatataggaatataatttatgaacaaaggaaattcgaaatttaaaaaaaaataagggatattaaaagatgattcttgagtccatatagaaatataatttataaataactatcacatatatacaatacaataaaaatatcacacatttgttagttcaaccaagaatttaaaattatgttgtcattttaatatattttaataataaaatgtgaaaatatttaagctattatatgagaaaaaaaatctaatgaggcaagccgcgggccaccatgctagctaacttattaaaggaatagaaaaaagagactccacgttcgctctcacggcctagaaattctcatattaatcggagaaaaaaaaacagagtccatatagaaatacaatttagaaataattgaaattcagaatcgaaaaataaggaatattggaggaggagactagagtcatatagaaatacaatttataaataactgaaattcggaattaaaaaataaagaatattagaagaagagtatagagtccatatagaaatacaattaggaaataatagaaattcagaattaaaataaagagtattagaagaagagtatagagtccatatagaaatataattaagaaataatagaaattcggaattaaaaataaggaatattagaagtagagtatagagtccacataggaatttaaaactaactaaaaatcagaataaacataataaaattaaaagtagagtttaga

SEQ ID NO: 3772 - DNA, 1031 bp, Oryza sativa
tcatccgacatcatatgagaattttacaattagtacaaaactacgtcttatgtgttgtagaaaattttacatttaggcccttctctccctctattagggtgggcgggaggagtatatttttgccaaactttaaaatggtaatttattttttaaatatttttaaaaataaatataaatataaaaaaaaattccttcttgctacaccaagagataactcgtaccactaccaagccaaattgtatatactaatgtccattcgtttcgattttggtctttctgctagttctagaaaaaccatagcaatccttccgtcaacctaaaagaatggaaaactcactctctctatctatatatatctttattcaagtatcgatcttattttcccataattaaagagttctccatagagcatattaaatatatagaaaagagagaaaccacaaataaaacatgaattatcaacgacgacagctagtgacactactatacaaatgatttttgtgaatgagacccctttaaattgcaagtggaccataattaaccgtgtcatgtacggctccttaaaatgcatgtatgcaaaaatcaattttcgcaagcggacctcttaacttactcacataaaaaaatgagcatattttcacatgtggatcttttaaaggaccgcatgagaaaatatattttggtgggcaggcctcttaaggggatccgctagaattctaacttgccttcttttccctctcaacactacaattttttccaagtcccttattatctcccctcctctccaacctcctctccctcattcacacctcctctctctctctctctcatttctcattcctcccctctctcattccaaagcggcggcgacgactcggtagtgggtagcggctggtggctcggtagcgggcgacgcccgggctcggtggtgtcatcgcccactcggatttggcgacggtggctgtcccccacctagcctcgcacggatccagcggcggtggaaggagcggggccccacgcgaactcggtga

SEQ ID NO: 3773 - DNA, 452 bp, Oryza sativa
tgggctctcgtgccccacaagcacacctcctcgctctctctctctatttctatctctctctatctctttctctctctctctccaccatgaccacgagctccggcaacccctccccttcgaccggaggaaacgcagcaccccggcgctgccacccttggtgttgcagccacctcctgttccccaggctccccttcgtcgagcccaaaacaagctagaaaaccgttctcgccagtgaccagtggtgatgccatcgccttcctcctccggcaacctttcccgactcaccgaagcattgtcccgctgcatcgtcgtcgccgtcaattacgcctcgtcgatctcttccttgagcatgcctccatatcaagttattgtgtgtattcaattcctatgagcaattcagattacctttttttttatcttgttcttacttgtttatttgatttgcttgcagt

SEQ ID NO: 3774 - DNA, 1501 bp, Oryza sativa
tggttctacagagcatatgaaccacagaaaatggttctatagtggccctttacagactagattagggacacagaaaatgcatgtcaccatacaagaatagttctgagcattacattgatattctgaaatgatgtgtccacgcagacaatgcatttccccgcaaaaaaaaaaagagcagataatgcatttcagctagtggtactgtgtgcgcagttatgcagttttgacactataataacaggaattggttgaaaaccaatatatgcctcttgttgtaaggaggttggaaacataataacaggaattggttgaaaaccaatatatgcctcttgttgtaaggaggttggaaaccacagcttgtgcattaaaaattgcattgcacttgtccacaaggtcaacaccctgaacttctatatgttcctcttgccttgttaatctgattcatctctcagcttggtctaactctgtctttggatcagaaagagcagttgagaagagatggctggactactagcatctggaatcataaagtggacaacaaacaagctttcttccttggtttctcctcaaatcgtttcatcatcatctgacgagcaaagtgcttcgttcagagatctaagagatctgcagaggacgatggcaaggattcagcggaccctcgatgcgatggatgaacacaatataagagatgaagccgagagacttcgcctgtgggagctgcagcagcttgcatatgatgcccaggatgctgtcgatgaatacaggtatgagttgcttcgacggaggatggaggaccaaagcaatcaaaggcagagcagcagaagtcgcaagcgcaagcgcaaaggtgacaagaaggtaatattatccccttatcctagctataaccaatgctacatttggtttatcagaaaaaatagtctgtgtttcttctttgatgaaataaagcttccaaattgcagaggcctcctctcaaagtttcttgtataaaaagataagctcccaagcaatttgtttctctcaataatacatgagcaatctgcatatcatgcataagcaaccattgacatagccatataaaagtattgggatagtagaggagcaaaaaggggtccataaaggagcatgtacatatgtgtgttttatttaactcttgttagtacacagtatactacatgcctttggattataataatattagtgcatgtacaggaacctgaaccatcccctatcaaagttcctgttccagatgatttggcagcaagggtgaggaaaattttagaaaaattcaatgagatcacaaaggcatgggatgatctccaactcaatgagagtgacgcaccaataagagaggaggcctatgacatcaagatatctacaaccccgcatgtaggtgattttgacatagttggtagagaagaagacaaggaaaacatcatcgaaatattaatttccgatgaagctgctcaagcaaatatgtctgttgtttctattgttggcatgg

SEQ ID NO: 3775 - DNA, 1501 bp, Oryza sativa
aaaaaaatagttgctttatactcgtcttttttggattgccatttacaaccctgttaaaatcaactcagattacactaactagtcgattgctataaaatgtattagttgctatggtatggtctcctatcctgcacgattttttaccaacaatctcagtttgtaaatttagttattaaatgttcagttttgctatacacctgatatatgcaacaagataacataacggtgctctgtggcaatgaaacatttacacattaaacattgcacatggaatactacgataaggaagaatgtggaatggtgtttataagcgggagaactggactccatgcaatgtttcttgtctgattggtgatttagtgatgccatttcctgtcataaactgctgacttctaatatctttaatataagtctgttccttaattatgaatttgtaacttttcgatacttcaatgattcaggaaacatcgttatagaatatattgccaatcgtatagcatccctttgtgataaaaaatatttgcaattttcccttatatgtgagtcagtttctaccatctcatagatttgtatatataaatcttgcatcaccatatcgaaattgagtaggtttcattttaattgctcttctgtaatatgtgcttcaaatacaaccccttttctttttaagtcaaatcaatctatgaattatgaatgtgctatgtgctatgctactgcctaatgtacattaaaatttttgccaactatgcgtaactaatgtagttgcattgtattaatggaagattatgccttggtcttgttatctgtttataagtacatgattaacatgttaatatggcctggttgtcatgattgaactaatattgctataggctgctcatgtgctttctattgcttgttacttcatacagggtactggaagcatatcatgtttctgtctagaactctagatctagcaaactgcattcactatcataattacttacctgtaagcaataaaataaaaatatatcaaacgtattcctatatcaaggaaaatgtccattttagaacccccccaagcttttgcagagactggatcagccttaaattttaaaattgaacactattcaactctaaagtatcgtcactttcaatcttgcatcagatttaacgtggccctgacatgcctttgtggcataaggctgaaaattcttttgaattttaaaatttagtaaatgaatttaaaaatttgcttacgcaattatcacttcttccatagtataaacaaaatttcgacttcaccgttcctatacacttttttgtggtgcgtagatttcatagactgcagtgcattagtgccagacaccgtttagcacggaccattccatggcccatcctctgtgatgggccatgttattattactctatcctgccaaaattcccaaaatttgatgttgggataactgacgtcacatttgatgatggagtatatcttttgagatgaatagaatttgatctt

SEQ ID NO: 3776 - DNA, 1501 bp, Oryza sativa
gtttttttaataagacggacggtcaaacgttggacacggaaaccagggtttgtctttttttgggacggagggagtatctgtattaaagtctactggttgccaggtttctccaagtttcatgactctcttgcagtcttggtatgtgaggtaagaaaactccttgtctcttgatctgccattgcatgtgccgtcaagcgatttcttaagtattgtgtgctttccccgcaaaaaaaaaagtattgtgtgctttggaactcatggcaacgtgttcctacggtttgttcggtaaaaccgaacaaccaaactgaagtaactcggtttatttggcttggttttgtattcttttataaacaactcggttgccataactagaaaaccgaatatcttttaaactgatgaaaccaagccgagctaataaaccgaacgcccacccctactggttgccatgcttcttcccatcgctcgccacctttatccaccggcaaatgcacgcgccaccatctcgtgtagggccatcgtgagggagagagattgtagagagaaggggtgagggagggaaagaagagttggccactgacatctggggcccatgtgggtcctgtgctaattaagatgggttgaccgtagtcaactcgtcatgtcagctaaaaccaataactctattgcctaaggatctcgtgtacacctatattgcaagttgagagatgcgttatactttgtattatggtttcaaggacgcaatttaaactcgtcgttaagatgatggacctaaagtgaacttatttctttatgtgaagtgttgggtgtaattgggttgtaagttttgcgtctagtgtttttggcccaattaaagccaaacacggccaagactactttcgatatcgaagccgactgatacctattctgtcttgacaatactagcgtcgaccttcaggaggccgagaagaatggggattagagaggatagataagagaagatgggagaatcaccgacaggtgagcctcactttagtttttaatttctctaattattgggctatccattggactccatgtggccaaaaccattctaaaaccactgagagagtatagttttgcatagtttaatagttggaggagtaaatatacccagttttatagttgaggaataacaatcggatctgatctttaaggagggagtataaatagcctttttcgaatcttgattacttgaatctgaatggaccaattaatcattaccagcgggctgacccacgcccatcccagattcccaggcccatataagtgtgacttttagcccaacaggagaaatgaatttcgggcttctgcgcctaaaaacgagagaaaaagaaaaacatatgctcacttttctggcttactgctgtgcagcgtcacccgcttatcatccacacaaacatttcccgacttcactctctcaccggcggcggaggcgcaccaccaaagtccccacgcgcctcaaactccccaacaagagaatgcc

SEQ ID NO: 3777 - DNA, 1501 bp, Oryza sativa
tcatttttttatgtgagtaagttaagaggtccgcttgcgaaaattgatttttgcatacatgcattttaaggagccgtacatgacacggttaattatggtccacttgcaatttaaaggggtctcattcacaaaaatcatttgtatagtagtgtcactagctgtcgtcgttgataattcatgttttatttgtggtttctctcttttctatatatttaatatgctctatggagaactctttaattatgggaaaataagatcgatacttgaataaagatatatatagatagagagagtgagttttccattcttttaggttgacggaaggattgctatggtttttctagaactagcagaaagaccaaaatcgaaacgaatggacattagtatatacaatttggcttggtagtggtacgagttatctcttggtgtagcaagaaggaatttttttttatatttatatttatttttaaaaatatttaaaaaataaattaccattttaaagtttggcaaaaatatactcctcccgcccaccctaatagagggagagaagggcctaaatgtaaaattttctacaacacataagacgtagttttgtactaattgtaaaattctcatatgatgtcggatgaagttaaaagtttatataaaaattgtagagctcgacgatatttataactttgtagttgacaactttttcattaaaataatttatgggtcataatatttatatttatatttgtatttagccccctctcgtgggttttcactaatctgaaaattaatattgattatttcatgctttaatagttttaaatgaatgaatggctaagtacaaaattatagatctcgtcgagctctacatctttgctatagagcttgtctccatcggaggttgtttaaaatgtagatatgagaatttgtaaaaataaatctaagacattataaggaatatttggacccataagttattttaatgaaaaattaatcaactacaaagttgtagatcttgtcgagctatataattttcatgtaaactttaacttcatccgacatcatacgagaattttacaatcatacaaatacttcatgctatgtgttgcagaaaattttacatttagagggtgagaaggatttaaatgcaaatatttttgaaccccgtgctgctacatcacataaatcgctctctattagagggcgggaggaggatatttttgcaaatatttgaaacggtaatttatttttgtaaatcttttaaaaataaatataaatataaaaaagttctagcaagaagcagctgtatgggtggtgtgggtcaattgggttgggctgcaaggaggaggggttgggttggaaggggtctataatagttgaattggatacatctgatttacgcatttttacatatatcttattgaattgaattcctttttgatgaaaaaataaagagcaaccatgcttctacagtagttgtgactaggggtgaaaatggtacggaaatgga

SEQ ID NO: 3778 - DNA, 1501 bp, Oryza sativa
gttgagggagtacaaatagacttattcccctagcttttcccggtcgccagcccaccgggaggaaagccttgacgaacgaactgtctcgtgttcccatgatcccatccaccacacgacttttacgcactcaaaatccgcgtagctttggtcacgtctttattgcgtgccaattatttcgtacactagtcgcggaaacaccacaagtccacaagacacgcgtcataggtggcactggcacagatacaccacctctaagagcaagtttaatagtatagcccattactaactccaatttatctatagtcaatctaatagctaatttatacaatagttgcttactatactattaatatatggtcccacatgtcatacacacactgtgtcttggagtccgtgctgcagctggctacagatctgtagcccgctgctcttctctcttatcttttatctcattaaaatatgcttatagctggctaatagtctgctattgtacctgctctaagagcaaggtcaatagtatagccagtagttggctctaattacatccatgtcattttacagttaataatagagccaacctatacaatagaatggctatactatgctaattacagtttcataatccgggaattaattaagcatgcacatacttgcgtatgatcaagagtgaactctgtctatgtaggtagttgtgttgtcgcctgaaaataagtaccagtgccgcgccatggcatgaatctggcgcatgggatcaaaaggggtggtgatgaggcccacaatatgtgtttttaatccgtgagatcgactgcacgcgagctttccgcatgggaacttgtgctatcgccgggctgcagatatgtcgctcgctttattctctctccttcgtttttctcttctccatgtaagaatagcatgacgtggaaatttttgcagcctgctgtgtcagcttattgtactgctctaatcgtcacgcgtctaggtaatcaacgataattctactagtatactgtttataaagaacctgtgaagattacattacattaattaaccatataaaaattccgcaaaactcttgcgccctagacccattctcgtgtggggacagttgacagtgggagcgggctgccctgtgcgacgcgcgatgcggcatcacatgctgacacgccccccgttccagatcgcagtcgcatcaaaaggtttcaaaccgtctcgcggtctcgccaaacgcgaaaagggcactctcaaaaaaaaaggagaaaaaaaagtagtctcggcatatccccagttccccacgctttcttcctcctcttcgtttgagcccctgaaacacggccacctcccttccctgcgcgccgagagcggaaaaccctagctccgaatctccgatctcccatccgcttcgacgcggaggtcgatcgcaagcagcttggtgagcaggggctatgacgagtggcctctgagtgtgcgagcgagcgtgtggttagatctgagggcctcgtga

SEQ ID NO: 3779 - DNA, 1501 bp, Oryza sativa
atatttatcaaataaatcttaatttataatgaaatatttatcaaataaatcttaattttataatgaatcttaaaatgtgtgcgtgccttgttcagtgggacggagagggtacttacatgcatgcaaccaataagtattaaaatgacttcttatgttttagttaacaatttaattcggtacatataaactataaatatacctatcttatttaaaaaactaaaaaattaaatataccttagattagatttttggatgaatgatgtattttagaacaagggaatggtatttgtttgcactttcgtcggttgcaaacttctttgagactgtcttcctagcgtaaaaaggaaatgccattttcaccctctcaattcctcccgtaaatgttatgcaacgtatttttattacaccattttccatatattgttcatgttccgtatcttctttaaacaaaaacttatgcctgctctttggttcatgctctttggcacgcccttttccaaaggtgtatgattaatttttgggcgtgcaaacattagctcagggaacattattcttgccttcttggtttctggtagcaaaagcatttcaatgtcagcaattttttttaagaaaaaattctgtcctcctttagaaacaggtggacgtgttctactactacctgacaaatgacaacaaggatctgcatgggcagctaatcaagcataaattgctccgacaaagatgcctaattgtttcttagtgggaagcacagataagaatgctaaatgctcaacttgctgatatctagtactgttgtttcgcattcctggtcagtgttctccttccatggctaacatcataggataatcagtgggttaggttcatgtaattatgcaatcacctaatgataggcaatacatgactttgaccaaaaagggtggctttgcttagttgtcccgattagaagaagtgtagttgtggtgtgttttctaggcaaagtattgatgtttacaaatggcaatgaactgtgtacatcagataaacaggaacagatatgagagctaatcaatgaattcagctacaactactagcctactacgtaaattacggacaatggaatttagtttagagatgatcccaatgttaaccgagtactttttttaatgatcaagcaacataggagtaataaactactctagccacatttcagattgaatccaaccagaaggcacaaaaatgcagtaataagcttatcatggataaggtggccaagaaccatctgctacgagctagtggtaatttataatcaaaatccatgccgtctgaattcgaaatttaaagggagtagcaaattcaggagtgtaaggccggcattcgttcaaaaaaaaaaaaagaagtgtaaggccggccggcaccaactacctccatagtccactaattcctgcaaacgcataggtcccaagttgggagctcaacgcatttctggatggtgatcttccaactaccactacatactactttc

SEQ ID NO: 3780 - DNA, 1501 bp, Oryza sativa
cttgattttatatacagtgatacactgactaatacaatcctatgcatatttcgcatttgttaaaaatcgatatcatatactgtaaaacgatcagctttgagatgatagaaaatttcatccattagttatagacggtaatcttaccctcaaagaaaggaggtatccatacctccaatctataacaaccaaacagctacatatgtatcccctcaaccagatcaaactaagccaggatgggagagatgagccaggctagatggatacgagcaaacaaacacacccgtattgttcttttggatcgtgccaaaagctacagaagatatttttttttagataatggaaagaacatggcctctacatctatttcggatgtacacagccaaaaccttcagaagttagatagaatctggtacttctatatgcaaattctttgataggcacatcatgtatccgctggacaactgaagatgagtggagtaagtacttgagtatgcaagtacttgagaagccaaacactcataccaaattacctattgagattaacttcagtagtattctcgttttatttttcttgtgggtatagcattcccagttcttacttggactgtatcatcagtttcagtagttcttctatgtactgaagatgggtaatatctggtatctgtatatgcaaatactttgatagactaggtacttgtttgcaatacaaagctgaatatgagtacaatttcgtactttctctgagaggtgtagaatacatcactagactatgcactctttgatataccaatttgctgtctgtgtacatagctgttgtctcttatgtgtacatgagaagtagagaactttggatagttctcttcaaaatatgttatgcgttttggcaaatgcttgaatcatctactgaccatatcttcagatggcaatccatggatggtcataacaaacatttcacagttttttgacacagttttcgttttccatcactaactagaagtgtgaatctgtgatcaagtgtagtttttttttttttgaaatgaaggcaagaaatttgcctcatatactgatagaaaagaagtgaaaaggtgcacaagtatttacaaagagtagaacaagtacccaaccaaagcaagagtagatgcaagcccacagctaaaagcccaagtccaaaggagaaatcacgaattccagcccaagttttgagcccggtcttcacaaatccgatgacgccacgtcatctatccggccttctcacgtctaaccaatcacttctctccatttacgaaccacacggatcgaacccctcctccccgccacgtcaccgatccgtcctcccaagccgtacccaatcatacccgtccatttccgatccatcgcgcgaaacccccacctcccacggatcgctccattttcacctccgcgcccaaacgcctcctcccaccgctataaataccccgcccatctcctccgcatctcacaagcaaaatccccaaatcctcca

SEQ ID NO: 3781 - DNA, 1501 bp, Oryza sativa
cttattcccctagcttttcccggtcgccagcccaccgggaggaaagccttgacgaacgaactgtctcgtgttcccatgatcccatccaccacacgacttttacgcactcaaaatccgcgtagctttggtcacgtctttattgcgtgccaattatttcgtacactagtcgcggaaacaccacaagtccacaagacacgcgtcataggtggcactggcacagatacaccacctctaagagcaagtttaatagtatagcccattactaactccaatttatctatagtcaatctaatagctaatttatacaatagttgcttactatactattaatatatggtcccacatgtcatacacacactgtgtcttggagtccgtgctgcagctggctacagatctgtagcccgctgctcttctctcttatcttttatctcattaaaatatgcttatagctggctaatagtctgctattgtacctgctctaagagcaaggtcaatagtatagccagtagttggctctaattacatccatgtcattttacagttaataatagagccaacctatacaatagaatggctatactatgctaattacagtttcataatccgggaattaattaagcatgcacatacttgcgtatgatcaagagtgaactctgtctatgtaggtagttgtgttgtcgcctgaaaataagtaccagtgccgcgccatggcatgaatctggcgcatgggatcaaaaggggtggtgatgaggcccacaatatgtgtttttaatccgtgagatcgactgcacgcgagctttccgcatgggaacttgtgctatcgccgggctgcagatatgtcgctcgctttattctctctccttcgtttttctcttctccatgtaagaatagcatgacgtggaaatttttgcagcctgctgtgtcagcttattgtactgctctaatcgtcacgcgtctaggtaatcaacgataattctactagtatactgtttataaagaacctgtgaagattacattacattaattaaccatataaaaattccgcaaaactcttgcgccctagacccattctcgtgtggggacagttgacagtgggagcgggctgccctgtgcgacgcgcgatgcggcatcacatgctgacacgccccccgttccagatcgcagtcgcatcaaaaggtttcaaaccgtctcgcggtctcgccaaacgcgaaaagggcactctcaaaaaaaaaggagaaaaaaaagtagtctcggcatatccccagttccccacgctttcttcctcctcttcgtttgagcccctgaaacacggccacctcccttccctgcgcgccgagagcggaaaaccctagctccgaatctccgatctcccatccgcttcgacgcggaggtcgatcgcaagcagcttggtgagcaggggctatgacgagtggcctctgagtgtgcgagcgagcgtgtggttagatctgagggcctcgtgatggcgagggcggcggcgaac

SEQ ID NO: 3782 - DNA, 1501 bp, Oryza sativa
ttctaaaggaggacagaattttttcttaaaaaaaattgctgacattgaaatgcttttgctaccagaaaccaagaaggcaagaataatgttccctgagctaatgtttgcacgcccaaaaattaatcatacacctttggaaaagggcgtgccaaagagcatgaaccaaagagcaggcataagtttttgtttaaagaagatacggaacatgaacaatatatggaaaatggtgtaataaaaatacgttgcataacatttacgggaggaattgagagggtgaaaatggcatttcctttttacgctaggaagacagtctcaaagaagtttgcaaccgacgaaagtgcaaacaaataccattcccttgttctaaaatacatcattcatccaaaaatctaatctaaggtatatttaattttttagttttttaaataagataggtatatttatagtttatatgtaccgaattaaattgttaactaaaacataagaagtcattttaatacttattggttgcatgcatgtaagtaccctctccgtcccactgaacaaggcacgcacacattttaagattcattataaaattaagatttatttgataaatatttcattataaattaagatttatttgataaatatttcattggattgatatttgaatttactttcatataattgtgattttgttactataaacatcgtagtatttaagaatttcaaagttaaaagttagttttaaaaattgttacaactttgactgcacctcaagcttagtcagtggaacgaaaggagtagtttcttgatttgtcatatggtagatgagtttttttttcttggtcttgatgataaaagaaatatatcttaaacttttaaatggagagagtatatttatttctgaagactttgatagagaataaaaaacaaagataaaagaactatattactctttattaattgtcccgattgatgatagtcggatggaggttgtctagatacgaaacaatccttttaaaataaaatttaaatactagaaatagttatatttaagtgatcaaagggtggtaacttatatcacagggggaaacttgagaaatcaaaaatagaaggaatattagagatatacaaacaatatgtctctaacttaagcattgagttatactccatttatctcagtataaatatggcctaaagataagatatacgaacaacggagtattctcgtagttctgaaatatgtgcacggatagagttgtaaacgaaaaacccgagcattgtattgcaacaagagcctggacgctgaagcatgtgcctgcctactggctagggctgcacgttgatgtgagcccctagggttctccggtcacgtctcatcactatatgacacaaatattttcgtcctacccaagttttctttcacatattaatggactaataattaattagcacgtcactcagattcagagattcagattgccctccacacgtgcatctcctgtcacagtgtcac

SEQ ID NO: 3783 - DNA, 1501 bp, Oryza sativa
ttgaaaaaagcatcatgataagttgataaccggcatcatcatagtatatatatagctaaaatgaaaagggggaaaattggtagtggtgaaaaggaaccgtcattttcagttctgaggcaaagaaataaacccaccttgttaaataggatagagcattaaaacaagaagaatggactcatattgcggttaaggaaataaaccaataaatcaaatatcaaagtaaatgacatgttaaattaagttcctaaatagagtgaacagttcaaaaagtttacactgatagtctgttacatttctaatttcagaattttcttgtgtttaataactgtcagaaactcagaattcattaattttttttaaaaaaaaaactacaatccactgaattgaattttaaacaatacttatgttcaagtactagaatttagaatttctgtatgagaagccatcagcagggctttcacatgtgttttggccatgatttcgtgatcctagaagcacaaattgaacttaatcaacaaacacattgattttagatgtactcagaagattctactaaaaccttatataagaagatatacagccccaagcgattactataaacaactcctacttgcatgcttattatggtaatgttcaatctctgctattatccaaacacataagttaagagggcttatatttgcccacattacccttagcacttccggttttctttccagactaacataagaaaaaaagttcaacttaacacaagaacgatgaaacaattgtggtaggctggcagcctgcagctaagtctgcaatataactccgcaagtccgtaactaccctgtgaacaagcagatttcttcaaaatgcatgcaacttacgttataaacccaggttttctgaatattatatttacgctttcaaacataaagagtgacttcgcctcaagttatatgtagagttataaagtttaaaaggctagattatgaaccagtccacaatgttcttttgtttttccatataccagtcatgttctcggttaaaattatatgtgatgtgtaatgatgtttatatcctacattatggatacttcatagctttctcatgactgctaacatacattcaaactataatagattaaacaactgatattttcctatcatacccttgcatggcaatacaagtctccccctttaagatccagttgtgcaagtacaagtttatgcatcaaaataacaattaaacatttaaactgtctaaaatgatcatagttagcttatgtacacacattttttctctctctcaaagataagtcactttcatggaaatttccatagccaggagaatttatcttatgcaaggaccacccacaactcttagcgcactgattggtacttctttattatgttgatacattacagtgaggcctgacgctgactaaacactacacgaaaaactgtggctatacagacatggaactaaattgtaattgataacaatggcagctctcgtt

SEQ ID NO: 3784 - DNA, 1501 bp, Oryza sativa
gcggaggagatgggcggggtatttatagcggtgggaggaggcgtttgggcgcggaggtgaaaatggagcgatccgtgggaggtgggggtttcgcgcgatggatcggaaatggacgggtatgattgggtacggcttgggaggacggatcggtgacgtggcggggaggaggggttcgatccgtgtggttcgtaaatggagagaagtgattggttagacgtgagaaggccggatagatgacgtggcgtcatcggatttgtgaagaccgggctcaaaacttgggctggaattcgtgatttctcctttggacttgggcttttagctgtgggcttgcatctactcttgctttggttgggtacttgttctactctttgtaaatacttgtgcaccttttcacttcttttctatcagtatatgaggcaaatttcttgccttcatttcaaaaaaaaaaaaactacacttgatcacagattcacacttctagttagtgatggaaaacgaaaactgtgtcaaaaaactgtgaaatgtttgttatgaccatccatggattgccatctgaagatatggtcagtagatgattcaagcatttgccaaaacgcataacatattttgaagagaactatccaaagttctctacttctcatgtacacataagagacaacagctatgtacacagacagcaaattggtatatcaaagagtgcatagtctagtgatgtattctacacctctcagagaaagtacgaaattgtactcatattcagctttgtattgcaaacaagtacctagtctatcaaagtatttgcatatacagataccagatattacccatcttcagtacatagaagaactactgaaactgatgatacagtccaagtaagaactgggaatgctatacccacaagaaaaataaaacgagaatactactgaagttaatctcaataggtaatttggtatgagtgtttggcttctcaagtacttgcatactcaagtacttactccactcatcttcagttgtccagcggatacatgatgtgcctatcaaagaatttgcatatagaagtaccagattctatctaacttctgaaggttttggctgtgtacatccgaaatagatgtagaggccatgttctttccattatctaaaaaaaaatatcttctgtagcttttggcacgatccaaaagaacaatacgggtgtgtttgtttgctcgtatccatctagcctggctcatctctcccatcctggcttagtttgatctggttgaggggatacatatgtagctgtttggttgttatagattggaggtatggatacctcctttctttgagggtaagattaccgtctataactaatggatgaaattttctatcatctcaaagctgatcgttttacagtatatgatatcgatttttaacaaatgcgaaatatgcataggattgtattagtcagtgtatcactgtatataaaatcaagtcattggatttcttacactgacgaataaaa

SEQ ID NO: 3785 - DNA, 1501 bp, Oryza sativa
accggatttcctacccgcatcctctagacaataccgatgtgaacaattaaaggtacgggtttaagaatcagtacctttgatggttataggaataaaaaaaaaagaggctcgcatcggctcaaatcgagttgatgcttcgggtactcaatgcttcaggccaagaacaacagggacaaaagctgaataaaaattctcacagatccaataagaagaaaccaaataacaaattctcacaaaaaccactgccgccaccgccgctgtttattggaggccaaggcattaccgctcaccaccactgtcaaatccagaatacatagtgaggggattttttttttgggagggatggatggggaaggagaggagggatacctacctgctagtcattgctcacagggaggcagggtcaaagggagggccactgctcgccgtagtcggaccgccatcaccatcgctgttggagggggggggcacatccaacgacccctgagttggaggtgacgccatcgatgcatcgacgcccgagaaacaaagagggcgagggggagtgggagtcgttatcacaccaaccaaaccattgccgccgtcatctttgctcgagcccccatcattgccttggattgaggagaaaacaacaacctggggaaggggaagggggatgctgccacatgctgaggaggatgggaggagaaagcggcagggcgagagcaaagagataaagggtatggcagggcgagagtgaagggatggcgtgggcgagagagaaaggggtggaacgagcgaagggataaggatgatctatgttgactttgctaaaaaaatatctcccatttttggctcgattcttacaatgcctttttttaattaactaacatctataatatattgaaggcggcacctataaaattggtgtcggtttttcttagaaccggcatctatagttgttcaaaggaactagttgtatattatttttaacccatgtagataggaaaaaggtttatatatgtcagttttaacagttttaacattttcggtatatatagtgctaggtcgtctttagattcaatttttttcttcaaactttcaactttttcgatcacatcaaatgtttggacacatgcatgaagcattaaatgtgaaaaaataaaccaattgcacagattgcatgtaaatcgcgagacgaatcttttgagcctaattataccatgatttgacaatgtggtgctacagtaaatatttgctaatgacggattaattaggcttaataaatttgtctcgcagtttacaggcggaatctgtaatttgttttgttattagtctacgtttaatactttaaatgtgtgtccgtatattttaaaaaaatggcacacgaactaaacacagccctagtccttttatgatgttatgtagtagtgcagatatttttttttccagaagatgtttttggtacggtatatggagtcatttatgtatgacttgaatatgaatttagtgaggtagaaat

SEQ ID NO: 3786 - DNA, 1501 bp, Oryza sativa
ctcgatctgcacaccgccggtgtcctcggctatgcggcggagggcgaggactacagcggaggccgccgagccgccgagttcggcggctaggtcagcgagagcagtccgctcggcctcgctggcggatgagctctccgcctgcaggcggcgggcgagcgcggcggcgtcgatctcggcgaaggggacgagctccaggaggcacacggcgaccatggtgcgcacggcgtcgaggccgccgggggcagcggcgacggaggcaggggaggatccgggcgaggtcttgcggcgggtggagcgcgccgggtcagggagggcgcggcggtggtggggcttgagggcggcggggctcttaccgtggccgccgtcggggttcggggtggggacgaaggggcggtcgttgaaggcggcgatgatgcggagcgagcggtcgagggaggggacgaggtcggggacgaggcgctggagcgatgcgacgaggcccatctgcgtctcccggcggaagccgatggcctcctccaggctccggcactgctcccgcatggcggcgaggtcgtcgccgccggcgtccgcctgcgcctccattgctgttgcggctgcggcggagaggtcacgggggtttgggggtcttgcaactctagatcgagcttgacacgacgcgatacggccttgtttgtgcagctacgtggcgcttgcacggcccggcctgttataaagtcgagcccatttgagaaaggggacgcggtggcgggcccaatagctggccgaaagcagacaagttaacctgccacctcagcgaaaaccactcttacaataatctatgaagtcaaattacaccacagcctcatctttttcttttgcttatgcttatcagccaaaatttaaattttcaactctcaatttggagttgatttttgggttttttttcatcgaagtttatttttcagtctttacttttagatcgctaaaaacacgtgtataaaaattttattcacaaactgtttttcgtttgcaaatactatgttctcttattccacgacggagccagtttcaaatatctttgcgattaaggaattcaaataaactggacttatattttgagggagtcctactggacttattccgcctagccccttgcgtgcacagttgtgtggaggccgagaggaggcggagggaggccgcgctggcagaccacttacttgaaggccgacacccacggcccacctcaccggcccacaccctcttttctcaatcggaagtcggaaccgtggcgtcgcgttgtggttccttttcctactgggtttcgagtccgcatctcgcacggctccgccctcccccttttcttcggcgacacggcgaaggcgcagactgcagatcggagaccactcccctctcttaaacccccggcacacggcggcggcaaccaaaaccgatcgtccagaaacccagaaggcacgcagcggcagcagcagcccacggcaaccctagatcagccagccatgtc

SEQ ID NO: 3787 - DNA, 1501 bp, Oryza sativa
ttcctctctctccgaatctccttaaaaaagcaagaggccgaaagttaatagattctcatgaggaataatttggcatcaaactttttcggttgaacttatctagacccaaccaatgaataagtattcactttgtatttggcagtcattttgatttttcacaataatccagaaattttcatcctattctcaactgaaaaaaaaagaacggcaagcctggtaaaaatggattttcgctcatgcgtattaactgtatcaccgtttatcagtatatatgagtttgcgtaccatgtaggggttgttttgttctctaccttaccaaatcattggtaataccaaattcttgacatgttttggtactaccaatttttttggtaggatagaaatttattatacatgtttggattactaccaatatgatgtcaaatattgatgatataaagaagaaggttctagattagtgacaaattgatcattggcattatcaataatttggcttcaatccaaatccatactattactattcaagataccaataaattggtaggacacattttggtatcaatccaaaatcgctcgtacttcctgcattgcataaaaaaataaatctaatatgagatggagtacaatttttttatgaagggagtactacctctatttcaaaatgttattaactttaacacaatatcttattctaaaatgttgctatttctctatctaacattttctctcaaccaatcacaatcattttctatttaattttttatctatttttttctccaaccaattataatatttttccaatcattttacctgttttttaaataccgtttccatataaaaaatgctaacattgtgtgacggagtaatatgagcgtcatcccagttcacagatgcagctgctgctcccgaaccgtaataaaggtccaggcctttactatttctctcccaccttttgctccccaccaccacctacctttccccttttaattctcctcgcctcctccccggattccgtacaccggcgcgccgctgaattcttaaccctagcccttgcctccgcctctcctccatggccgccgcccccgcgtccccgttcgcgtagccctccatgggatccgcccgcgccgccgacgacgaagggaggagaccgaccgggggagaagaatgaggtgctgcgccagccgcgtggcgtccgccgggtgccgggccatgggagttgcgggtggggtgaaggcgacgtcgctccgcagcagccgccgccgccgcgagctgccgtcgccggccccgttctccgagcccttcaccgaacgcccggcgatcctatataattaactggccgccccgcgccgtctctcctccgctgcatcggtcgccggctctagctgctgaccgccgtgcgtagcgggcgcccgcgccgctccacgcgctgtcccggcgatctcgcctggctcatctcgctctgcttcctctctgcttcctgattcgttcgtgcgcgtggggt

SEQ ID NO: 3788 - DNA, 1501 bp, Oryza sativa
taacccaatacgagattaatcaaaattcaaaataaaaataaaataaaatccaagattagaaaaggaaaggagagtccaagtaggaatacaatctaaaaatggctgaaattcggaattaaaaataagcaatattgaaagaagtttccatataagaacccaacacgagattaatcaaaattcgaaataaaaaaaataaaatccaaaattagaaaaggaaaggagagtccaagtagcaatacaatttaaaaatagctgaaattcgaaattaaaaataagcaatattgaagaagtttccatataagaacccaatacgagattaatcaaaattcgaaataaaaataaaataaaatataaaattagaaaaggaaaggagagttcaagtagatatacaatttaaaaataactgaaattcagaattaaaaataagcaatattgaaataagtttccatataagaacccaatacgagattaatcaaaatttgaaataaaaataaaataaaatccaaaattagaaaaggaaagaagagtccaagtaggaatacaaattaaaaatatctgaaattagaaattaaaaataaagaatattagcaaaagaaaataaaaaaagagttcaagtgggaatacaatttaaaattagctgaaattcggaattaaaattaagcaatattaaaagaaaaatccatataagaacccaatacgagattaattaaaatttcgaataaaaaataaaataatatccaaaattagaaaaattaaaagagagttcaagtatgaatacaatttttaaacaactgaaattgaaaataaaaaataaaaacattaaaagaacacaatacggtattaactaatttttttaaaaaataaattctgaaattagaaaaagaaaaataagattttaattaggaatacaatttataaataactaaaatttgtgataaaaataaagactattgaaagaaaagaccatctaaaacacatgacgagataaattaagtaacatgcctataaaggagtagagtggtggcggttgatacgacatataaaaattgttaataaaacaccaaatagaatcctaatgacgattaaaaggagggacatcaggcaggccgtgaagcaaacaagtaaggcagttgctgggacttctagaaagtaaaaaaaaaataaaccccattgataatcatattcaatttttaaaatctcaatgacaataaaaaggagaagcagcgggcggggtgtataagagtgtagctgcagagccgccgacggttgacgggacttctagaaaataaaaaaatgaattccaatgatagttatgttcgatttttagaatcacaatgacaataaagagtaggcgaacaggctgtagagggcatagtggcatcgtttgataggacttctaaaaattataaaaaataaaactacaagtccaatttttaaaggttcggaacttccaaaaattaaaaaaacccaatgataatcatgttcgattttaaaatctcaa

SEQ ID NO: 3789 - DNA, 1501 bp, Oryza sativa
agctatgtcatgtttttggagtgtccttcagcaatgagcataaaaacaacttttctaattaattttcacaaacaatatatagttttaggaggaccgcatataaaaaggatatatttacaggagtcaccctaggagcaccacatgtataaaagcaaataatctattaaaatcgaaggagggtgggccacttctagccgcaagccccttcgcatctctctccgctcctcactctcctctcccgcaccaaactcgatctcctctcctcctaggcgccaccctcgtcatctcttcctttacacacatcccacgttgatgtcgccgcataggcttaacaaggagttcaaagccataagatctgattcaccttggcctttccactggtggcgcgcccaaatcaattttcgtagacggcggtggatcgagccatatgtgaaaatcaactatttttataggtttttaagttataggcgaaccctccaacagcatgtatatatgaaaaaaaaaatctattctagccgtatgtacaaactggttttgtagtagtgattcatgttgaaatgcttattactgagaaaagttagcacatgttgatgggtcaagcagttatatgacttaaaggatgatttcgacgcaatgcagaacacttgaagaatgggcctcggtgaagggcaagagagacaaattttttactatgctcatgcatgtacgaactagtagaacagaacagcatactcagaacatggataatctgcgcaggaaaccataattaatgccatctacagtacgcaggtgcgcgattaagttaaacgcgattgtatgtccgcatcaacgaaaacaaccgcaatgaggccaaagcagggagaatctcagcgtataggctggggccccagccccccaactcagcagatgaggcatgcagccatattcctctgcctggctctcactctcactcgatcacctcccggtaaaatccaaacggcgcggcataattctgccgcataaaaccaagcgaccaaattcccctcctctcaccgtgtcacacgggaacagaacttactactcggcctctgcagctatatagctctcgatcgattctgttctaagctctagtaatctagcctattgcatgccgttcccaaggttagcgaatgtttttagactaagccgtgatctatcatctgatagtatcaggctatcagccatgaattaatatatatatataaatactactatatggatgcatatatatgtctgatgtgacctatagctttgacgcaatttcctcacctaatgcttgtgatatctatgggttgttgtcacgacactcgttataggttagtgatatctaaaactaattttgattacgtttctggagtttactttttgtttatagttaggacatcgaagggtcctgtttaaaaaggtcctccttgacgtacggattagagtatgggtcattgtttgagtatatgcaataatacgtacacaccatttttcccgg

SEQ ID NO: 3790 - DNA, 1501 bp, Oryza sativa
tggcggatagcttcggcgcgaatctctgaagcatcggcttacccgcgacagctgcgccggacaggactccgccgaggatgccggcgacgatcatcgaccttgggccggacgcgatgcggtagagcgccccggcgctggcccccgcggcgacggtgttgacccagtcgtcggcgccgtcgcgctggtcgcggacgaagctctcggtcccggcgaagagcatcgcgacgatgccgaaccggttgccgaaggcgcggccgacggagccgctctggttgagggcgcggttgatgcgcagcttggcggactccccgcgctcggcctcggcggcggcgcggcggaggcccacgagcgcgccggacgtggcgccggcgaggtagctgacgccggtgtagaacgtgaggttctcgccccaggtgcgggtctgccggaacttgtcctcctcgaagaggcactccggcgaggtgggcaggtcgtagagcgcgcggtacgaggtggggaaggcgaggccctcggggcgatccggcgagtagaagcggcgcccttccgtgggctcctgctgggcgtcaacggcgcgggacatggctggctgatctagggttgccgtgggctgctgctgccgctgcgtgccttctgggtttctggacgatcggttttggttgccgccgccgtgtgccgggggtttaagagaggggagtggtctccgatctgcagtctgcgccttcgccgtgtcgccgaagaaaagggggagggcggagccgtgcgagatgcggactcgaaacccagtaggaaaaggaaccacaacgcgacgccacggttccgacttccgattgagaaaagagggtgtgggccggtgaggtgggccgtgggtgtcggccttcaagtaagtggtctgccagcgcggcctccctccgcctcctctcggcctccacacaactgtgcacgcaaggggctaggcggaataagtccagtaggactccctcaaaatataagtccagtttatttgaattccttaatcgcaaagatatttgaaactggctccgtcgtggaataagagaacatagtatttgcaaacgaaaaacagtttgtgaataaaatttttatacacgtgtttttagcgatctaaaagtaaagactgaaaaataaacttcgatgaaaaaaaacccaaaaatcaactccaaattgagagttgaaaatttaaattttggctgataagcataagcaaaagaaaaagatgaggctgtggtgtaatttgacttcatagattattgtaagagtggttttcgctgaggtggcaggttaacttgtctgctttcggccagctattgggcccgccaccgcgtcccctttctcaaatgggctcgactttataacaggccgggccgtgcaagcgccacgtagctgcacaaacaaggccgtatcgcgtcgtgtcaagctcgatctagagttgcaagacccccaaacccccgtgacctctccgccgcagccgcaacagcaatggagg

SEQ ID NO: 3791 - DNA, 1501 bp, Oryza sativa
gagcgacgtcgccttcaccccacccgcaactcccatggcccggcacccggcggacgccacgcggctggcgcagcacctcattcttctcccccggtcggtctcctcccttcgtcgtcggcggcgcgggcggatcccatggagggctacgcgaacggggacgcgggggcggcggccatggaggagaggcggaggcaagggctagggttaagaattcagcggcgcgccggtgtacggaatccggggaggaggcgaggagaattaaaaggggaaaggtaggtggtggtggggagcaaaaggtgggagagaaatagtaaaggcctggacctttattacggttcgggagcagcagctgcatctgtgaactgggatgacgctcatattactccgtcacacaatgttagcattttttatatggaaacggtatttaaaaaacaggtaaaatgattggaaaaatattataattggttggagaaaaaaatagataaaaaattaaatagaaaatgattgtgattggttgagagaaaatgttagatagagaaatagcaacattttagaataagatattgtgttaaagttaataacattttgaaatagaggtagtactcccttcataaaaaaattgtactccatctcatattagatttatttttttatgcaatgcaggaagtacgagcgattttggattgataccaaaatgtgtcctaccaatttattggtatcttgaatagtaatagtatggatttggattgaagccaaattattgataatgccaatgatcaatttgtcactaatctagaaccttcttctttatatcatcaatatttgacatcatattggtagtaatccaaacatgtataataaatttctatcctaccaaaaaaattggtagtaccaaaacatgtcaagaatttggtattaccaatgatttggtaaggtagagaacaaaacaacccctacatggtacgcaaactcatatatactgataaacggtgatacagttaatacgcatgagcgaaaatccatttttaccaggcttgccgttctttttttttcagttgagaataggatgaaaatttctggattattgtgaaaaatcaaaatgactgccaaatacaaagtgaatacttattcattggttgggtctagataagttcaaccgaaaaagtttgatgccaaattattcctcatgagaatctattaactttcggcctcttgcttttttaaggagattcggagagagaggaaggatgcttacagcctagattaggcattctatacattctttttttttagaccatattatctacgtgtacaacatgttacttgtcatataaacgtgaaaatacatacaagaatgcttgtgctaggcgtcgaaaccatcaagaaaaattaggcaggagcaaaacatccacccgcccacaagccaatcccttttctgtctctttttcccatttccttctccttccccttttacctctccttgagctagtggtggttgtcg

SEQ ID NO: 3792 - DNA, 1113 bp, Oryza sativa
ctcctcaacaacaattctcatcctcctttatatttcttctcttttctcccatccgagtaaacacaacactttcattttgttgtaggaatataataaccttgcatcaatgtactaatagtctagtatcttcagctactaataagtaaggtcctgttgggtgtttttttttgggggtggggggggtgtttaaaattctgtgagtagctgatttcagtttactttttagactatgtaactatatattcttataatttgagtgagtgagaatacacgctgtttgggagctaaagattctaatatgaaactactaccatggctaaactctcctaactaggcgtaagaaagtatctgtgtatttgttaaaagacatcctcgatggatagtgacaacaaacagtggccaagtagacaagcactcgttgacgaagcaagctctacacactgctaccttttctcacatactccacccgtattcctcaattcttgcggacgatcaagcgtgcgtttagttcacattaaaattaaaagtttggttaaaattaaaatgatgtgatgaaaaagttaaaagtttatgtgtataggaaaattttgatgtgatgaaaaagttagaagtttaaagaattatttagaactaaacacggtacaaccatacgttggatagaccatttgaacgccgtacacaccgagcacgcatactcgtagcgaacacttccccgctacctctcccggctaaaagacaagcgaaggaattggaaggaacgtccccgtcctgcctgccgtcccggcagcgtgtgttggtggccacgaagggacgaccggacgagcctgccgatcgagctgacgcgcgacgccactactccaccaataaacaaaatctccatccacacctgacccaagacgggaggacccgcatcagccacgcctttcgcgcgcgctagccccctgtttcctccgtttcctcctccgctttgctttgctactatgggaaagtaatttcacttaaataattatcaaaaaaaaattgaaacaatttggtaagatagattaatataaagtatatcactccacaaacatataagttaaaatttaacttctactagttgtaaaataataa

SEQ ID NO: 3793 - DNA, 1501 bp, Oryza sativa
tgtttaaatggatgataagtagaattacttatccttggtctgtgtgccaagatgaaatatgactatcaaaagtagatggagggagtattaatttatggtcccacctatcatacacatattgtgtcttgtagtccgtggtgcagttggctacagatctgtagaccgatgctcttctctctcatcttttatctcattaaaatatatttatagctggctaatagtctgctattgtacctgctcttagagagcatgagagtgtacgatttaaaaaagtaataatttattggagaagtggttatagttaattgttgtcacgcccggaaattcactagtaattttcgaactaatttgtgcataaaatcctcgtccagaaatcagccgaggtacacaaactgacaatttaatatacaaatccatcataataataacgttacatacttacaaaagaaaagaaaaacaacagcggaataacggtctagcgatggcttcagctccactcccacaggcagctcaactggggtataagccaaacgtctgctccttctggatcctttctcttcaactgaggttgattgattattgcaaggatgagcatatgacatactcaacaagccacacagcaaatatgcaagtgcacaagaataccaaaggatggcataatataggctcatttgcaaaagcagcatttagcaaacatttaagagaagtaaaacagtagagtaattaatcatcaattttaatcaacactgaacagcaccccaatgctgcacaggcccaaccatcctaaacaaccatacccggctgtacagatctaactccaaaccaggagctaaacaaattattaccagttattgcatcaataattatttgtgagaggtgtgagactaatcacgaaaaacattgctcaacccgcccataaccgcgggcacggctattcgaatagttttactctggccaaaggtgtaccactgtacccacaagacacgattccacacatgttgccatgccccgaagtaccaccacggcactgcaaagggggaaatcgtgacaatacccttcgcacaacacaactcaccacagtgcaccattcctggatcataatcacccccttataaacaaggcatggactccccagcgaccccacggacttctcgccgcttctcagtttggcaccccgtaatgaaccatgctatacaaaaggtaaagtcgttgcccacgctggcttgtggttggcacggtaaatgtttcacaacaatagctcgcgaactggtccttaattgtcatgagcacgaccttcaaaaccatatactcacaacccaccattgacaagttttaattatcaattaattatcataacacgataaccatgagctacatttaaatctaaccataatttaaatctaaccataagaaatgatgtaatatgattcaccccattaatgagctaatgtttctaagcatggctaagcaattatatatatatagcatttagctgaaccaa

SEQ ID NO: 3794 - DNA, 1501 bp, Oryza sativa
  unsure (1)..(1501): unsure at all n locations
tgaactcgctaacaccattctagtagaacccgtttccatggccccttctagcttgggatgatcacagcgtggtattgcctgctgcgtgtgcttcacttccccgaatggcgaatacccgatcgatatatcatccacccactcacaactcgcgacaccgaaatggaaaacgggaaagcgttggttgatgatctcgcttctgccccgtggccacatgcgaacataaccagttaaccgccaattaaagcttccgatcgattcacatccttatatatttagtacaactttacaagttaagcatttgagcacagcgcattatttgcagacgccttaccttaacttgcattcggcaacttccatctctttgcaatggtgctttggccaagcaagccggccagttatatatggcaggttggagcagtcacgtctgcgtttccgtttttccttctacattagtgtgcttacgtttaatccatggacagcccggtcttgtattcttgtgcaaatgcactgcctaattggccagaccatgcatgcactagtaatactgaccttaattaacttcaaagatttagtagctagctagatgaccatcctggcatatgagtatgtgcagcaacacgttgtgctggcagccgtttcatttcatttcacatgtgcctatatcactatccccttgaagcccagaaatccattgcgtgccaactcaaatcctaggcagtctcatcctcccatgaagaagcaagctgcagctgcacgatgcaacgccctttttgttgacagatttgagagtgagttcctgttaatccttgaataattcgttttttctgctccaattcccctcccggcccatgtatgatgttttttttacttcatttttttttgtgcctgcagagataatgatgtatcccctggttgcgtcgttggaatacattttttgtttcgggggctggactgcatcatgcgtggtgttcttccacttgatcgtgtcattttacggcacagaaatgacggaaaacctggtaattaacnacatgtgctcctccaagttgtattttgcactgttcgttttagtctgaatctgatgtgtttgtaatatatgctcgtgtagtgttcttgcgatgggatgacggccgaggaggccgccgccatgccggcgtcgaggcgtgcatgctgttgagctgcgcggcgcagatgcccgcggcggcggcggccatggcactgccgacggcgacggcgacgtgggggcggcggtcacggcgcgcgcgcgccgtccgccgcgcgtcggcgtcggtggcactggcggtggccggcctcaccctgtggctgtggtgcgtctacctccggttcctgccggggctccggtgcttccgctgttcggggtgctcaagaaggttgccgtccccccaaaagccctgggattcgccacgccggtgttcgccttcgtcgcgctgggctcgcacgccgtcgtccgcggagacgaagccgagtgggacgagtgacg

SEQ ID NO: 3795 - DNA, 1501 bp, Oryza sativa
tgtttaatgttagagatacaggtggtgatgtgtaattttgtctataactattaatgttagggatacgtctagtttgtattttgtttgatagcatctttaaccgtacattcatgagatgcaggtaaattaaatgtttgagttatatcttgtttgtatttttaagatatgtagatttttagtgttggagatacaattgttatatatttaaattcattcatgactagagatacgattaaccagatatattcatccatagagattagtgggtatatttggttgatcacatctgcagccatcaaagaatttaaagatataacagttatatcaccaacattaaaagcctacatcttcttaagcatatctttaaagatacacaatccagcaaaaaaaaatacaaacaagacgtatctccaacatttaatttacctacatcttttaaacgtatcgttaaagatatcctctgacaaaattacataccagacgtgtatctccaacattaatagttgcacacgaaatccaaaaatatacacatcacccccctcccctacatctccaacattaatagatgaatttccctcacatctcccatgtgtgcatgcatctttttttgttgtttgctggttgtatggttttttggtattaggctaaaactgtggttaaatcagtggtataaaaaggggtagagggagggtggcctccatcagtcaccacaacccccccccccccctctctctctctctctcctctcctccatatttttctttctcatctcatcacacttggagtttgccaatagaatacaaaaacagcaggtgaggagagaggagagaaaaaaaaacagagctttctctctctccctccctctctctctctcttcttccaatctgcggcgcgaggcggaggtggtggtggtggtggtgggcgccgccggcgagatgggcccgtaggcgccggtgtgggcggcatcctgtcctcgccgaccacccgcccccgccggtgcggcctcgccggcaagaagtctttgtttttcttttctttttttttttcatctttgaaggtgcgtcgccgactacctccttgtgcttcaatctcggttcgaatcgaatggaagattttgtttttcgtgagaaatttcggggcttgagatgaacacatgggcgctcgagccaccccggtgcttgtggggagcagacagatttttctttcttttttttttgggttgttgttgttgggtctatttgatgcagggattaggttgtgtagatcttgtttctgaaacgcttgcagtttttttttgcggtttttttttctgtattggttctgatcgttttgtgtgctgtcgttgcagattggatccttaatttaggggcgaaaagaggggagtttgcaagaggaatcatccctattgggttgtttcttgctgctgggtaagatccaatccagcctctaggttaggtttgtttgctgttggtgaggagattgaagggttggctggtcatgt

SEQ ID NO: 3796 - DNA, 400 bp, Oryza sativa
ggggtctgaatctcatgaaaatgaagataaagatgaagattaagtgttttacgtaaaacgaggtggtaataacatgtgattaatttagtatcttcacaagaaaatcatgtacataattaatgacaactacttaagagtctaagagcaagtttaatagtatagccaaccattagctccaactcacctatagttaatttaatagtcaattcatataatggttacctataaacatatactacgctattaatatctggtctcacctatcatacacacatcgcgtcttatagtccgtgctgtaactgacaacaaatctgtagttcgctactcttgtctatcatcttttatcttctcgacatgtatttatagttggtatatattccgctattgtatccgctctagg

SEQ ID NO: 3797 - DNA, 1501 bp, Oryza sativa
agcctcgccgcctcaatcactggtctcgtcctttcatcaccactcgcagtattcgtcaagcaaaccaacagcagcagccctgctttcgtcgtcttcaagcagcaaatcattaagaagcagcagccattgagctagttgcagacttgcagcagcatgtgtcagcagcagcaagtcatcttgatccatttcatcctcaagcagctgaggaaactcctctgctttcttctacattctcaccaaatctaagtggatctgttgcatttaggcttcagtttgagcctctgcttgttgtcctggaactccattttgtgcactatcatcaacatcctttgtttcctatcctatattttgctagtatcagattgccatgctataagcttgattgctcatcatcattttgtgcactgctagctccttgatttatacctaatatcagttggcacaagttctaaaacctcccgcatcatgcttctatcatgtgctgcaacacatcaacagcataaaccagtggattacttgggatatttctaattgaaattggcttcttgattagtagatgatcttcaacctttagttcgaaatggttctcttccattgatatgccatgatttggatgaagcatctagggtctcagtctcacagtcctacccacaaagagtagtgttgatttgttagcctctaatcgtattccatcaacagatctacttatttcttctacatttgctatgtttgcttgctgctgccatcaacaattctactaatctccttaggcctattgatatactatgttgtcatatttcctttacaatccttttgagtccatccaagtccaatacacaacgattcgttgaagcgtgctaatctatcttcatcactagttccccactggagctggtttatcacaccacatcatctgcattgtcaactccccatcggagttatcatctccaacttcaccagctccatatcggagttggacatcgttatcagtcaaggaccgaagaacaatttgtaaaggtccattatcatcaccatcaacatctctagatctacaaaggtctgaagaacagtttgtgaaggaccttcatcctcttcatcatcatatccacatctccgaatcagtgattggccgaagaacggttcgtgaaggctttaaggtaccaaaggagctgaagaacagtttgtgaaggctccaagatcctcttcattgaggaagggatggatttccatcttcatcatcattctagagttgcacgattcgacaacatcttcaagcatggactgtggatttattctagtgtgtcattaatctatatttagtttcaaatgcaatgttacatatacattgcatttgagtaggggtgttaagaatatatatgtattagtgtgtatgtgttaaggggtatttctgtcttttcacgttgtagtcatctcatattagccctaagggccaactcaatgaataaatagttaaatccccaattcactcactgattttgac

SEQ ID NO: 3798 - DNA, 1501 bp, Oryza sativa
gtttaatgttagagatacaggtggtgatgtgtaattttgtctataactattaatgttagggatacgtctagtttgtattttgtttgatagcatctttaaccgtacattcatgagatgcaggtaaattaaatgtttgagttatatcttgtttgtatttttaagatatgtagatttttagtgttggagatacaattgttatatatttaaattcattcatgactagagatacgattaaccagatatattcatccatagagattagtgggtatatttggttgatcacatctgcagccatcaaagaatttaaagatataacagttatatcaccaacattaaaagcctacatcttcttaagcatatctttaaagatacacaatccagcaaaaaaaaaaatacaaacaagacgtatctccaacatttaatttacctacatcttttaaacgtatcgttaaagatatcctctgacaaaattacataccagacgtgtatctccaacattaatagttgcacacgaaatccaaaaatatacacatcacccccctcccctacatctccaacattaatagatgaatttccctcacatctcccatgtgtgcatgcatctttttttgttgtttgctggttgtatggttttttggtattaggctaaaactgtggttaaatcagtggtataaaaaggggtagagggagggtggcctccatcagtcaccacaaccccccccccccctctctctctctctctcctctcctccatatttttctttctcatctcatcacacttggagtttgccaatagaatacaaaaacagcaggtgaggagagaggagagaaaaaaaaacagagctttctctctctccctccctctctctctctcttcttccaatctgcggcgcgaggcggaggtggtggtggtggtggtgggccccgccggcgagatgggcccgtaggcgccggtgtgggcggcatcctgtcctcgccgaccacccgcccccgccggtgcggcctcgccggcaagaagtctttgtttttcttttctttttttttttcatctttgaaggtgcgtcgccgactacctccttgtgcttcaatctcggttcgaatcgaatggaagattttgtttttcgtgagaaatttcggggcttgagatgaacacatgggcgctcgagccaccccggtgcttgtggggagcagacagatttttctttcttttttttttgggttgttgttgttgggtctatttgatgcagggattaggttgtgtagatcttgtttctgaaacgcttgcagtttttttttgcggtttttttttctgtattggttctgatcgttttgtgtgctgtcgttgcagattggatccttaatttaggggcgaaaagaggggagtttgcaagaggaatcatccctattgggttgtttcttgctgctgggtaagatccaatccagcctctaggttaggtttgtttgctgttggtgaggagattgaagggttggctggtcatgt

SEQ ID NO: 3799 - DNA, 1501 bp, Oryza sativa
tgacaaggcaggcgcatggcctgctgtaatgctattatactccatatatcactagcaactggtgtacatacatcagaaaggaagtaatcctagcagtagcatcataggaggaccaaatgctgtaactaaagcaggaaatgatacatgaccttgtacataatgcaggcagtttctgatggaggcatgctttattttgtatcaagtagcaataccaattcatgttcttccagctttcacccatacggaggaaccacacattgtaaaaagttactgcagctgggcaattatatcatggtgtaaaacctatactgattggttatactgaagataaaggaagcagatcaaaatgctctgtttttgtctatcctaagaatcacatgaatgaactacaggaagccctatttatgctgttggagaagttttcaatgatgaactaccgtgcagctacatattgtcatatacaaccgaaaatcagaaacacagaaaaccctgtgaattaacgattactcctgttacatggcaaggaagattggcacaacaaagattttccttttttccctgaaaaaggagctaaaatttgtaccctttcatggcaaggtgtagctatacatcgcaataagagcacggcaaatgcaaatgcccaaatatcccaaaacatatttggagtgctaacaggtcaggtgaatacaagccaataaactgggattgaatttccaacgggaaaaaatagttcaggtccaaggatgatctcctgttagatcctctactcagatggctacttgggaattgaacactaactgcagtctatatcatctcttgattgcttattaacattttaaaaaagcatgttcattgatttagggtgtgttttctcaagataacatccagcaatagctaaacaaatgagaaaccaagacagctgcacaaagtaggttagattcagttggagcggagaacatgttaacacaaaatggttacaagtaaccctgaagaacagaactgctaaaatctaatgaataagaacataacctccttagaatgtgtttcgtcaagatagtacggaacactgtacaaaattccgaaagttgaagagaggatcagaggatcacatggatgcttcatgaactgtatttgcatctatggttcaggttagcaaagagccaaagacagaggcatctactgacaagcatcctagagggtttgaggcataaatgcaacaacttaagcctctgagtgtgacgtagatttgctgctcccatactccattggtccatacctgcacatcagtatccaaatacaggattcagtcaagcttgcataaatctgtggtctggaatggttctcggacataaatcacatcaagcagcaaattcaagtgtcattgagcataaggtaaaccaactataaatacaaccaacactaagctgaatagtgaattatctcagtagaaggttcatcatgattccaatctgattaatataagacttgaaactagatcttt

SEQ ID NO: 3800 - DNA, 333 bp, Oryza sativa
cggcgcggcgggcgagcggggcgcgggcgagcggctcgcgagcgggcggcgcgcgggtgggcggcgcgtgcggcacgggagggggcggggctagggggaccatgtcgagcacctagaggctaatgaacagtgtagtttcctatttttcccgatttttggcccatttattatttaaatttgattctataattcccaaattttgcataaatgaagtatactcaatatttgtgccatcttaactaatgaatttatcctagattaatattactcatattttatttttatataatttatttgagttttaattagggttaattcttattccatcgcatt

SEQ ID NO: 3801 - DNA, 1501 bp, Oryza sativa
aaatattttaataaataaaataaaaaaacccaagcccccaatccgaccggactggcttgcgtgggctgtatttgtataacgggcctaatggcctttccttgacgagacttcagaaggcccagacctaagctctttctgggctgtcttgggcccgattgtgaggaatatatcgagtagcagaacgtattggacgatttgttttcgatgttattcacctcccgcgtttgcattaccattcctacacgagaaatggattagattgagcagtttagtggctattattttgtttcgttgcagtcattaatagaaaaaaattcttctccaatattaataagaaaaaaaaacgttctccttcactatattcgctcaaagcaaggtgcctaagtttcatgaaactgtttgtcagtataggatgctacaatgtgcgaagtaagagagggtattctcagccgtccgatttatagcgaacgaacgagatcgagcgctacagggcacatcaacagtacctctgtacattacgctttacattaacaacttgcaaatcgctattctgcactgcagcacaaagcacaatataggagccggatccctacacatcggcaatatttaggactttctcttactctttcctttagcaccttctcaaaaacccacattgcaaatgctcttaggaagcttgcaatactgacggccggccggcatgtgcaaaatctttcgagatgctgttcatcctcaaaaatccttcgatgctgttcatcctcaaaaaaaccaggtacgaaagcaggcagctagggtggcgagctccttgtcatgtacgtgatgtggttcacaaaagctaacgagagatcaatgcagtttttatagtgactgtaagctattgcagtcacttagaaatgaacaatccagacaacagtgtgttgcctttgttttcgtagtgatatttacactaatcttcaggtatatatatatatggacagacctattgtgttattcatcgatcctttgtctaaaggacatgtttttggcatctgctgctgcctgaataaagagaaaaatgtgaggatagtgacatttttcaccacattactagtaagacgcctgacgccactgtcggtggcacgacatgttggtggaagctgaaatgttgaggcaattggtttcaaaacctaaaatggttgacattaattggtttgccccattgcaaccgcatcgcctggcttgccccaactcttgacatggcaactggccaccagcccacacttttgtcagttttgttcaatgctatgagatttagtatacgcaaatggtcaaattgacgaccggaatgtatgaatatccaaaatgtaccagatattcttataatgaaatattatatattgatgagtgatcattgtgactttctggcaataaaatgaatgatactgcttggttaaaaaataacatcattttgtcattctggtaagaatacaattggtataagcaattaaaacatcttattttc

SEQ ID NO: 3802 - DNA, 321 bp, Oryza sativa
gattgggggtagttcagtggcatttctgtgtaaataagttaaaaaattaaagggtagtgggtcttttggggtggagtggagctgtggagcagcaaaaacccagctccacccccgtagttcattttgtaggagtagctctgctaactccgctcccaaaaatagaggatctagactgtttggcacagctcgactctaggtaagtttgttgggagctggagctgtgccaaacggggccttacttgccgtaattactctagtgggcattgcagtataactatcatcgatgcaacatctaaactctttcgtacttgtatttttggc

SEQ ID NO: 3803 - DNA, 1501 bp, Oryza sativa
cggtgaaaaatctagaataacatcgtctaatcctaatcttggtgaaatcttgttcctgccttctcacctttttatatttaagggtttactcgcttccttacagttccgaaccatttcaaattttggtaataccaaaatttggtgagacaatgaactataaacatgtcactgccaacataatcctgttaatttttggtaattatgaaacttctactctcaaaactacttttggccaatgctcccacccttttgtctaatgctcaaacatatatttttgtggggaggattaattcctccatagagttgccttagttgaatatatattgcctcattaattggtcattgatgaggtggcatttaggcagatgaaaacaaaaaagggaaaggatgaaaaccccaatttccagccaatgaatgctcttgctggacgccccacttaattatgaggagtgacgaaacactgcaagctgatctttgtttcctgattgatccatatccaatggcgctggagtcgattccgcttgtgtatccatccatttgactcccaaacaaaaaatagatagatcaactccacttgtgtatccatccatttggcttccaaacaaaagatagatcggtgtagacgtgactaagctcgacaatgatgacacgattgttgcgggatcaaagctttcgtgttgctttgtgataagctcggcaatgacaacctacgtttgggctctgtttattaccggtcatttggagggatgcatggtgtgtgcggaggtgggtgtgccgcgtttgttcagacagccatgagattgaccatactttgctttgtcgagttgtttatttttttttcttgtaacccatcggaattttactgttttggtttgtctactatataaaaacctctttcctctcataaaaaccatccaccctcaaaaattcatttctaaaaaaaagattgtaaaaaaaaaagaaaaccaaacagcctactagatccaaatctcccactaaaccgaataaaaaaaacagttacactgctagttaaaaaaagaagaagaaagataaacaacggatctcccaaggtcttcaacgtaaaaccgccaaaccgggccccacaacaacgtcacaattccacatcccaccgtcactgacaccccggccccacccccagtcaaccacccctcccttccctcccccaaacaccacggaagacgaaacaaaccaaaaccaaaaccaaaccaaccaaccaacttgaaacctcccatctccgatccccacgtcgccatctccccctccctcctcctcctcctccgcctccttccccgccataaaacccaacccccaccaccactccatcgccaccaccaccaccgcgccaacccttcgccgccgccgccgacgaggacgacgacgacgatcgaaatggcctcctccaccaccgcctcctcccagctcgccctcgccctcggcatccccggcctcggcggcctcctcatccccaccgacgccgccg

SEQ ID NO: 3804 - DNA, 1501 bp, Oryza sativa
ccctggtcaattaaggaccgagccatgaagttaagcatgaaacgacccccgtacaaccgcacttctcgtatgggtatagacctagcggagtagatagctgagcggaggcagtatccatgcatagtggtttcttgatgtgtgaggcaggggctctacggtgggggcagccattggtaggaccgcgaggcgggtgtctacagtggtgtcgccatcggtaggactgccatgtgagaatctaaaacataattataacttaatgcatgtgtgagtcttcccttcccgggtgcgccagaactcctctcactgctagaaaccgtgtacgcctagagtgcatgaggatgaaaagttcatggagcgggtactgccaatgcgaggttatcaaaaagctttgccgtgacgcgtctcatgtgttgggacgaggctcatgtgttgggcagtcgcggagtgcgggtaaagtgtacatccactgcagtgtgagtaaaccaaatctattcgaatagccgtgctcgcggttattgagcaccgggacgtgtattacacttggctagactctaaattcttaacttgtgtgggaagggatattgcatgatgaattttatgctgttggagccacttcctgagaggcgggaaggtggacgtcctcagaaaaccatgacgaatcaatggtgggaagctatccttgggatcacaatggatggtggacagaaccgtcgttgtttaaatacaaactctggtactaaaatttgatcagtcaatgctaggtcttaggcttgtgaaaagaattacaaaacttgctttgcgcaaaagaactatggccatcctttgaactccccctttcatatgcattgttgctgtggtggcttgctgagtacggttggtactcatccttgcaaatataaaatttatcagaagcgggagatgaagccttggaggatccctatgcctactatcaggagggagatgaagacgatggcgtccagtaggtcttagtacggtcgttgcccgtggcaatggcatgccgctgcctgaattccgctgccttatctatttctgcttttggatgtattccggacctctcggtccgatgatttaagactatgcctgcgggcctatgatgtaataattcgtatttaatactcgtgtatgtgcacttgatattccagctatgaattcgtgtgtaccaaactacttgatccagggaaatggtactgtttacacgattgattcctgttataaaaacgggggtccacagagctggtatcagagccatacgactgtaggaaaagaccaaaaggcgccccaccccttttctaagttggccaagggagatattcccatttagtaatactttcaaaaataaaaacgctatgtttacaaaactcggtacaattttcatcttactcttaactattttatttacaaaacaagttttactctcaactgactttgggtttttcttaaaattagatggcagattcggattcacccgctacctgggagt

SEQ ID NO: 3805 - DNA, 1501 bp, Oryza sativa
aacaattgagctgtaacacacaagttttagcctttggtgcacgatgataacctgagcatattgatcattagtcctctttgtatctaatcttgtaatttttaagccaagttgctttcaacgattaataattagtacaagttggtatatacttaatgtggcctgtcaagtcacaataatttttcagtctaaacctgactatgtttgtgtacttagctaccttaagtaatgtgtaaatgcaggtacacgcatctgcatcggaataggtttcgctttcgcacgagttactacttttttttccactttgtaccagcctctttttgggttttggaaatttttgctttatgacttgtagtgccttgaggagatatcatgcaaaaatatttgaaaacgctttcgaaatattatgcaacgacatttcaaaaggtatatatattcggcaacttggaaaactgttgaatgcccaattgtttagaattgcatagataatttggcaaaattgttaacccttaaggtgaaattgttggaatatgtgggtttatatgttagcctcaacctatctaaattcttcatatgagatcaatcccactgataacatatcacaatgaccatgcatctaactactaagagattgaattattacattcatcccccccttaaatggcaataataatgctcacaacaacatgctatagatgccctacaatgtttagaaccatcccgcgatattttttttttaaaaaaagtgcctcgtatatattgatagagtaggaaatcctgtgatacatgactatatatgttatatacgcactatgatcccaaaaacacacatggccgtgcaatgaaagattatgttctaatatcaaccataacactttaacttcacaatcagcattagcctatatatagcccttccatttggagtccatgcgggcatatattagcaattaattgcacttaattttgttcttgctttggataaaatggttaagctgaaagtcctattgttaaaaccacttattatttctttctcacttgaaaaggactaatatatatatatatatatatatatatatatatatatatatatatatatatatatatatatatatatatatactacagttaaaatgcatagtttatatgccaacccagcctatctaagttatgatttggttcatggcaccagctggggacagagcaggtctcatccatacgtttgggtggtaggatgaaacatagatggtgcgtggccactgtttggagaacttgagaaatattccccttagattttgtactgagaaatatgcctagtgaaggtacaagaagaaggattgataagggtatcaagtgacaaattagctttgatgagtgataattagcatgctttagggttaattagtgcatgttagagtaatgtttgcatgcataagtgataatcatataattagtatcaatgagggagattaactgatgagtaactaggtctcgatcttttgatagg

SEQ ID NO: 3806 - DNA, 379 bp, Oryza sativa
tgccgcccagcccccagccctcattcctccccctcaaatccagcgaaaaaaaaagaagaaaggggaggagaagagaagaaggggcgaagccctgccagattcagacgccgatttcaggtaatattcatagatcctatatgtgactattgagttaaatagtgtgtatttttttaaaactttgtttgaataaatgcattatatttttagggttttagttgtactaatctagaagtgtgtattatagatatcggtaactacgtagatctgctagtttggaatcaatactttaccgttgcattggcaaacacaagaagatattacgttgtagatgtttattgcatgaaagagtaatgtgatctagttatttcgttgacagata

SEQ ID NO: 3807 - DNA, 1353 bp, Oryza sativa
cccttacatccacaagacccatggatacccctggagcacccccttcaattttttcaccatgaatgataaactaaaggtccctaaatagctgaggttgaagaaactgtgtaataaagcccccaatttttttttccttgatccgcccctgcatatgagaacacaattaatgtatcacgctaactttccaaaaacaatgttcttctgatggatcgttatgacatgtcacaatcttttaagttacgcttcctttgcaatcaatgatcatcataggactaaaaaccaataagattagttggtcacctatgtttttggcttggtagagacgacctaaatatattgccaagatagtacattattactagtgcacatgtactcatcggacatgtcgatgatagaaatgcacgagtcctctttgatcattttcttgttctcctctcttgtacaatcttgtttgcatgccctcaatggtgatgaattgtacgtagttttgctgtggcggttgcacactcatcttcaatcttggccggtaattaatgtagcgaacgtgtactgtttgatctgtctatataggctggcggatcaatcaagaccttgttgtgaagtttacttggtctaaaaccaaggagagatatgttcaccggttttggccattgttgtcccttgccacgatgatcgtctttaatttcatggtggttgtgggaaaaaaaagtttaagcacacgatccatctaattaactggataatgttccaacccaaatcgatcgatgataatgtagctagctagtccaggatctcaaggagtctctctcatagatactccctccgttttacaatgtaagtcattctagtatttcccacattcatattgatattaatgaatctagatagatatatatgtctagattcattaacatcaatatgaatgtgggaaatgttagaatgacttacattgtgaaacggagggagtatatatagatcacatgcattctgaaacctaactagctaagtagctactccctccgtcctataatattaaaacctatgactggatgagacgtttcatagtgcaatgagattcattgtactatatgaaacatcccgtccagtcctaggttataatattatggaacggagagagtagctactactacatccatttttaaatatatgacgtcgttgacttttggataaacgtttaaatatttgtcttattcaactttttgtgtgaatataaaaaaaattaagtcatacttaaaaatacattagacaataaatcaagtcgcaataaaaaaataattacataaatattttgagtaaaatgaatggtcaaatgtatcttaaaagttaatggat

SEQ ID NO: 3808 - DNA, 1501 bp, Oryza sativa
ttggaacaacgtaagctagcataaataaatgaaagaatttatctacagaaaattgagcctaaacgttgagaactaaaagcaattaactttaacagatggtacaacaggggtcctacaaaagagaaaaagccagcctaaaaagtaaataagaacattgagattttatctcgcaggcaatgcatccatagcactagaaagtctacaagaacaacagagcaataatcaaatgcccagaaaactaatgagttataataacgaactaaaagcaacaggtaaacatgggcaatttggcccatgaaactaacccctattactccataactcaatgcaacttcgtttcaatgctttgaatgcccacgcggtgtaaactacaaacaaaacgcaacaattggagaggaaaatcttaaaatacctacctcagtagtagtaccattcatgccgcacacgagcacatgagctttacttagcctgttccaagcagcacagattcagtagtcaaaaacagatgaaagacatcaaaagttttggttccgaagctaacaaatacgatggaatggaagaataatttgggggtgaaagttacgagaaattcaaggaaagcaccaaacaagctcaaaaaaaaagatttaggaaaattcaatagcagacacaagatacgaaaacagcggatatctctgtcttcacttcaaaaatacaaacacttcgggctcaagtttttcttttaaagaaacaaacaacagccattcgttctaacataaaccatgaaatcccccaaaagaatgattttcttttcttccttttctgcaagaaacaacctgcgattaaaagagaagaaaaagaagaagcatcaactcaacaaaatttcctccacataagcgaagagcgaaagaaaacccgggacttttaggggaagagagagagagagagagagagagagagagagagagagagagagagaggcggagccggggatacctcttctgggcgtcaacgccccagacgcggatctggcggtcgtagagcgccgtctcctgcgccgtcagctcctcctccgcgccgccgccgccgcccatcgccgccaccgcccggatccctagcctgggacgccgcgaatccgatcagcagccgaaggagaagggggaggagcagcagcaaagcgagggtttttggcgttcttggctttcgctgctgctagtagatgatggctttcacttcattctatttctttttctctttttatttgtttttttttctgttcggctgcgatttgggctttgggccttgggccttgggccttggatgaacggcccagcaggtagtttcggccctgaggtgatgatgggctatatgggctgatgggccaggccctatggttgatggtttgcgtcactaattaacagcttgtttggttaggggaatataatagagggaatgagagtttggagtgtggagattgttagggcatcactaatgtatatggcaaaatgatccatatgaatgg

SEQ ID NO: 3809 - DNA, 1501 bp, Oryza sativa
ggatctctagctaaggtgaaagaaaggcttccatggctcaatgcaccttcttggagaagaaccccttgatgccgaagagcccgccgccgccgccgccgccggcggaggcgcgggcgactccggcgtcggcgcggcggcagctcacctggtggcggtacccgatgcaggagttgatgctcaggttgatgccgcgtatcccgccgccgccggtggcggaggtggtgtggggtttcttggcgccgccggttggcttgtccttgtggtgcggcggcctcctgtccgcggcggcgtgcttcgccgccggcgatggcgggcgcctgatctgccagaccgggctagaccggcccaccggcacgccgccgcctgcgcggccggggctggcggcccagcggcgaggaggaggaggaagggacgacgccaccgccgccgcctcgccgcgggagttgctgcgggagcacggggcgctactggccttccgcggcggcgggcggggcttcgacgaccccacgccgcccccgccggcggagcggctccgggagaacggccagatgttaatgttcagctccgatccgcctccgcctcccgccggtctccgccgcctcgtcggctgatccttctccttctcctccgccgccggctgctgctgcttcttggcgaatatatccgtccaccttttcgacccaccaccaccaccacccgacgccgccaccgcagcagtgggcggcgccctggacgcgacggccgcaccaggctgcacctcctcctcctcctcgtcctcatcatcatcatcatccgcgacggcgagggacatggagaggtcggcgtcgcggcgggggtaggggaggggttggagggggaggaggacgccgccggagaagagctcgtcggcgcaggagggggatgcggcggggtcggcgtcgaggggccagaagcggaactccggggaggcgctgctgctccgccgcctctgcgctgctgcggccatctcggatcggcgtggagactgcttcttggagatggaggagagatggttgggggggaatggcgaggctttgtatggcgtggcgtgcggggagggagggacacatggggaggtgggacccgcgcacgccctcccatttttctgatgcagttatgagaggtgggggtgtgggacccaccgggaagtggctctgtgggtggggtagagggaggggaagcgtgagggcattttggggaactttattaaggactcgttcgattttcatgcatgcttaggaagaaatatttccacttcatgtaaaaatgaagaagtttattaacatataattaattaattaagtgttagttatgaaaatatatttatttattttttcttaaacaacttctatatggatttttttaaaaaaaattacacagtttaacagtttgggaaggtgaagttgaagttgggctagtactactttaaaagaaagttgaaataaagttacacaaaaggaacaaaatagcaaatagtgctctt

SEQ ID NO: 3810 - DNA, 239 bp, Oryza sativa
cactacttcactcattcactcgcaagtcgcaaccctttttatttctctttgagctacattgctatggattatacacgctccgtggcttttttgtttccgtccgataccagcatcattgtaatcattttcagtcgcgagaaaaaaaacctgaatttatctctaaataatccaatactattcgacaatacgtaagacaaacagtacggtccgtttctaaatatcactcggattggtcgatg

SEQ ID NO: 3811 - DNA, 1501 bp, Oryza sativa
  unsure (1)..(1501): unsure at all n locations
acagtcagaacatcaaaccaaatagaatgaatataaaagaagaatatatggaaatttgtaagaacaggaatgattattggtacgcatcaccatcgttttgccatgctcctgtgacatactaaaccctaaaaaaagtgtttgtgctctagaataacataagaccaaggcagttgtgatttgttaatgttttataaagaaatcatattagttatttagtgggcaaccaagatttatatcaaacctttgaattacaccatcatatgggtattgtttagcaatgatacatataaatcactataagtatactatgtgagcacacatcaaaccctagagcagggtaaggatgagaagttcaatgtaactcctaggagtagtataaaagaattagaacttagaagagaacggtgcaaacaagaataagaatctcatgatgctaagtttcttcttagtatctcactttttccttttcaaagaagtaagagcaactcaggtgtattgaacaaggtaacaaatcaagtataatcaccctttgtagcgcactcatgatcaacttttttgggtttgggggcnanccaaggggggnnaaaatagacgaaaattgtaaatttttgatgtggcagtctagcatcctttagaatttcaacttcaaattcaatgtttcagaagaggcaaacataaatagtgaaacgcctgcccaaggataaaacttgataggaggtaataatcacggacaaaaatttgcataagcctttagtcccaagcaagctggggtagctaaagatcaaacccaaggcaaaacgcatgaaccaaaagggaacaaataatgtactactcccaccgtcccataatataagggatttcgagtttttgctttcactgtttgaccactcgtcttattcaaaaaattttggaattattattttttttatgacttactttattatccaaagtactttaagcacaatttttccttttttatatttgcacaaaatttttgaataagacgagtggtcaaacaatacaaacaaaatctcaaaatcccttatattatgggacggagagagtaataaagtaggataacacaacatatgagctgagaatggctaacatcaacaaataggattattcagtcatttatcggtttggactcaaaaagcagcattacctgggaataatagttaaatttatcaacccatctaatcgaacgtgcatgtggttacttcattgcgtgctatgaatgctgttcctggtatatattgcgttgacacttagatatacagatatacaggtcttaaaaaaaagcacataggaaccaactgacctggtgcgtctaagccgcctcaactaaatgtgttccatactcctgaagcatctcatagagtaacaggaaaactttcgaccggtcttacgacttgagcagttttcatctgattggctcgtttctctgatgccaagggatctagcctctttctgagcccacctctctctttgtcattgcagt

SEQ ID NO: 3812 - DNA, 1501 bp, Oryza sativa
cagaaaacctatagaattatatagagattcaaaccttatccttctcctgcgagagcagcacgagcaggtccctctccctcctgtcccgccggcgcgcgtagagcagcgctcccaccacaacggccgcgcccgccgccgaccacacggcgggcctcaccgcggggcacccgcacgtcccgtgcaccatcagcccctcccgcacggccccgaccccggccgcccacgctcgcctcgccgccgcgcggcacctcccccacccccacagccactccccatcaccaaattcatcatcatcatcatcatcatcctcctcgccgtcgtcttcctccccttccttcgccgcagcctcctccgcctccccctcgacgccgagcccctcgtggaggcgcggggggaagacgtcgcagtcgtcgaggccgccgtcgtccacggcggcagcgcccacggcgacgacggtggcggtgggcgtcacgagctcccaggcgtcggtgacggcggggccaggcggggaggaagacggcatcgagccgagggatgacgaggagagcgagagggtcagcgtcttgggcttgaggaggaggtgcgggttaggggaggggaggagcagcgggtggagcgccgagtacggcgatgccggcgcggagaacggcggggactgcggcgccgacggcggcggcggcagcgctggcctttgtccatggctgcggttgccgcggctcaccggcggattccgcttcgatttgcagatggtttgtttggatctggatgatctttcatgtggcgctcgagatcgatgacgactgctgctggttttcactccacctgtactgaatggtccgagttgaaaggacagcgatgtgtttaatcccaattcaattgaaatctctagcatgcattcaaatcttatacatatttcacacgaattgcagattattaagaaagaatttgataattttttgaataagacgagtgatcaaacgttgtaagaaaaacttaaaatcccttatattatgggacggagggagtattaatttggaatttcagattaatttggtttgtgtttacatttagtcgcgactaaaatcttttttttaagcgtgttttctcgatatcgatattttgagtctgtttgacacagctctagctccaccccttctggagtttccacctccacagctcaaccaaaactggatggaagtggagctgggtagaggaagtggaccctggatgaactggatggaagtggaccctggggtaccaaacaagccctttatttcaacaaatctactagtagtacaactttcaggttaaagtttgaatctaatttagttgaggtgggccatcaattttgcttataatcaaaatttaaacttgatttggttggggtgcgccaggcccgggcggtagtgcaacgcctgggcgacacgcgagggccccagtggcaagccactgtggtggaccctcccccacaaaaaataaatttaatatcgaagtgaacaca

SEQ ID NO: 3813 - DNA, 1501 bp, Oryza sativa
atacatatataattgtgagaaaattgtatgagatattttctaagttatgtagtagtagatgaaagttccttttttttaaaaaaaatgtatttttaaaatcatgaagcaaataattcgtggtaaaaaataggacaaagtacgaaaagaacatggccatcttgagttttcttctttgacttctctatttcttacattctaaaattccaatttagagtgacaacttaagacatacaaatactgaagttgtctactgtacgtgtgagttcttacgtcaactacagtaaatacatacaacatgtacagtacccattatatgtttattattttaaaaatgaaaactaacatttttttatgtttaataaactcatatcgttgtcttgatttttcttctctctatcttgctgtgcacgagtgcctgttttattattattaactgacgaacggattctttctcatccaccgtacgaaaaaggaaaaactacgggaaaggcaccgtggccgtcggatcgggatcgtgcggcgatgagggtggcgtagcgtggagccggtcgctgcagggcgcccaaccgacagcccgggcccactgccgggagcgacccgcgcgaaatgctcggccactatttccttgtttattccgttttgggaaaacacacaacactaaattaatttcccccctttttgcacttaactcctacctttcctatcttttcatctctaactgcatttttccactaacttcagtttatttgatttttatgaaagtttggtgatttgaaaaccatcttttatgcactggttagattacttgttgtaaactatttgtaaaaattattttctgaaatatttttatttttataattaaatacatattcctaaaaaataacgtaatgattaataatctacgtctctctattccgtattttatattataactcgcattgatttttttattagttaaatttctttagatttaattaagtatataaaaaaaagtttgcaacagttagcaacaccaacaataccaaattagttccagtaaatttaacattgaacgtattttaataacatcttttttttgttttaacaatattactagcattgattttttttattagttaaatttctttagatttaatcaagtatgtaaaaaagtttgcaacagttggcaacaccagcaatacaaaattagttgcactaaatttaacattgaacgtattttaataatatgtttgttttgtgttaacaatattactatatttttctacaatctcgatcaaactgtttttttatataaaaatgattaggaaaataccaaaacaaccaatcaaacggggaaagtaaaatgtaatttgacatgaggtcaggtgctaatgtgtaaaatggcagtcccgggtcactgaccgttttgaccaccggtgacctcccagctataaccaacccaacctcttcccttctcccattttgctttgctttctttgctttcctctcctctctcgccgcc

SEQ ID NO: 3814 - DNA, 1501 bp, Oryza sativa
cctccatcacgtcactgcgtatattatacgtagatcaatacgtagatatatacgtagaggtagatatatacgtagagtgtatgtgcatggaatgcatgggagagtatatatgtatatataccagaagaggaggtagtcgtcgccggacttgggccagaggcggcggagctcggagcggagggaggaaggggagaaggtgtagccctcggaccacatgagcttggagaagaaggaggagatgggcggcgagccgtagccgcagggctcgccggggccgcggacggcgcgcatcttctccgacgccggcagggagaacacgcgggcgacgcgctcctcgacgcgcgacagcagcgccgccggcacgccgtgcccgaccagaaggaacgcgccccactgctccgccgcccgcgccacccgcgccgccgcgtcgcccgccccgacgtccaccaccggcaccgcgtcctcgccgccgccgccgccgccgtccaccaccgggtggtcgtccagccccggccacgcgtgcgtctccggcacccgcctcgccgcccggaagtcgaagcagagcgggttcttcaagtgcgacggcgtcggcatcgcgacgacgacgacgatgaccagagagcaacacactcgcgcgctcgctcgtctcgtctggcagaaagccagtaacaataacaacactaattttttctctctatataaattttttctatgactttacaatagtggaatgagtagtaaagtgagacgagtgtaagaactggacaagtacaagggagaggtatatatagggagagaagttttggagcgtagtggaagaaaaaaaaagagagaattaattggtgaataaatcagtgatgaagaattgaaatggatcattaattaatagatttggagaggaaaaaatgtggtgattgggacagagggtttggagtgatgtggagcacacaaggccaccagcttagctacacaacacaaatctagctagtatgctcatcaccaccccctggctggctagtggcactgccacccaattaataacacacatattcatacaaattaagttatgttatagtaaagtaaaatcacaatgtgaaataagcaccagagtaatttttaattatcacattacataaaacagattaggtaattaaacataggaatttcacaggaacagtagcgtcctccgttgccgtggtgtttttttttaattcgtctgtctgctttagaaccaaacattctcacatgcagccacttctaattaattatgattaccgtataattctcatacacgtcgaatttcattcgatattttactttcagtagcaagatcttcatgctagttcccatatacagtactacatccgtttcaggttataagacgtcttgactttagtcaaaatcaaactgctttaagtttgactaattttatagaaaaagtagtaatatttttaactcaagacaaatttattatgaaaatatatttaattaactaatttag

SEQ ID NO: 3815 - DNA, 1501 bp, Oryza sativa
taaaaaaaatatggttgtaatcatttcttaatatttagcataataatcaacattattttgcaaagaaaaggtaaaacctagaccattgcattattattgttactaaaataaaagaaatatagtgcagaaaaaatcatgatgaggattagacatatattcaggaactagagtggactcgaatccttatatacaaatttttatatactaccgcattattatttgtttatatttaaataagaaataagaatggttccagggcggcgccgtacgtagcctaaagagagaaaagggagaaattggtggagagcgcgtgggaagcggcgggcggcggcggggctgcacggatcccacccaatggcgacgcgccctctgctccatcgatcccgacaacgcatccagaaggcgccggcgacacctcgccgccgatcgtccgccgcccctagtcgccgccatctctcgatcatccccctgtcccttcccttccacgcacggccggccattccatcgccgcctacctccagacccaatgcatcctctctctctctctctctctctctctctctctctgtctctgtgttaattttgtaatgtattagcaaccattcatggatggatggatgatgatgatcatggcctctgtcctctgtttttactcgtggctgcagactagtgctgtcttttctcttgtttgctgttctagaatctgtgtgctgttttctaaacaatttactgtttatatttgttttgttttgtttatttttgtagttgtaatataaggttagtcttcttagtaaatatattgaaaaaagaagaagtagataacacggtttgaatcttggtaattgtactgtgctcgacaaattaggacgtaatcctatcgtttcagattataaaatgatttgactttagtcaaagtcatgttgtttcaagtttgactaattttatagacaaatataataatatttataatactaaattagttaattaaatatattttcataataaatttgtcttgagttaaaaatattactactttttctataaaattagtcaaacttaaagcagtttgattttgactaaagtcaagacgtcttataacctgaaacggatgtagtactgtatatgggaactagcatgaagatcttgctactgaaagtaaaatatcgaatgaaattcgacgtgtatgagaattatacggtaatcataattaattagaagtggctgcatgtgagaatgtttggttctaaagcagacagacgaattaaaaaaaaacaccacggcaacggaggacgctactgttcctgtgaaattcctatgtttaattacctaatctgttttatgtaatgtgataattaaaaattactctggtgcttatttcacattgtgattttactttactataacataacttaatttgtatgaatatgtgtgttattaattgggtggcagtgccactagccagccagggggtggtgatgagcatactagctagatttgtgtt

SEQ ID NO: 3816 - DNA, 1501 bp, Oryza sativa
gggactttgatggcagtactgcaactctgcattgaattgcatttcaattgtgcagcatgcagggacaagtgcagtgctgcctccacctgctttcttctgcaatcatttactcccgtataagcactctctctttcaatgcattattggtcatctggcaatgagatgtgtgtacacatcctctcaaagtctccaacacaaaattagcatcagatttcttgaactgtcagtctctgatagctcctccagttggcatttgttgttggcaatcacacattctgagtccctgatgctgatgctgatcttgtgatcattgttgcttattgcttttcttatcaacccctgctgaatagtactactttctccattccaaaaatataaggatttttaggacttaaatttataccacaatataaacatccatgtacttattcctatgattcccatcatttcaatgaatccaaagccaatcacaaacttgaaaagggaatacaagaatttagattcaaaaaaaataaaatctgaactactgaagtgagtaaaaagaaatctttagacctaacattggaaaggagtatttgctaagcaacctagaaatctttatatttcggagtagatggattacttctaacctgcttttctggtgcatcgtatcaagctatttatatgctgctgatactatgtttctttcagcctgaagattgctgtcattttctctcatgtactctctctcactcaatcacgtttgcaaagaaaaaaaagagaggcatttgatgcaccgctagtgcacatcattttcatggatctctttacataaaaagaggaggaaaaggaggaaacatatttgcttttttcagagaacggcgttttaatgtgagccaatcacatgtcgctgctgtgatgatggatcgatcactgtacgatgaaaaggacacaggttggaggagaaaagagatgagaagtatgtggacagcaaaaaaaacacaacatgcagtgactgaaaaactattccaagatccgaagcgcgtgttctttttagcttattcataaaattatttaaacggattgttctactctattgcttaaatcactcgttgtaatgtaagctattagtaaagcttatttcttaaaatatttaatttattcctataatcaaatcaataatccacgaaaacaactctaaatttacaatcactggtttggcagcaattggagttttacaggaactggaggtgatagtgcttgaagaactaaaatcatggttgtatgcaatgtctgattttggctatacattcactttggatgtaaatgccggtttaatataaaccattatataaaaaaaatgcaatgtctgattctgcacgagcacatttcttcagaaattgaagtgctaacaagttcaagaaacatatttttttcagtttttgagcttcgagaagtgatccgaaccgaagaaataaataaaaaagctgaaataaaagcacatcatgaacacttattgttg

SEQ ID NO: 3817 - DNA, 1501 bp, Oryza sativa
aattccagtggtggattggtccaacctctgtcatgttgcaaatgaagtttgggatggttggcagcgccctgctcccgacatgcacgtatgcgtccactgtcagatcctcgtacctcacttcgatcttggggaactctatctgcactctgcaaccaacaaaaataaaaaaaaatggagagcagcacagatgcttcagatcagcccatgagcaagtttaccaacactacaagcatacaaacaaaattctacaccaaaatccaaaccaaccagaggagacgagcgatttacagatcctacaagccgtagctgaaattgtttcgtaaaattacagcaaatttttttgtaaaatcactgcgttccaaatgtagccttccccgcatgatctaggcatttcatcagaacgatagctttagagtaggatctgaactagcaagcgaacaaaacgcaagactggcatgtggggcccatgtgtcagccgctcccggccgcaaagcttccctgcgtttttggaaaccgagtacttcgcccacagaagaacgcggcgagcaaagcgcttctagaagcttcccccggtgtgcgtgcgtaccagttgggccccacatgtcagtgtcgagtgttgcgcttctagaagcttccacgcgagcagagaggcagggggagagagagagagagcagtgtggtactgacgcgtcgaagcgggagcggatgcggcggaagaagtcctcaacgtcgccggagtcggcgaggaggcgatcgacgagggcggtgcggtcgccgggggagaggcccgcgacgtcgacctcgcagagcgcgtcgtcgccctggacccggtcctcccccggcgcgggcgacctgagcaggcccctcctcgcgcgcgccaccgtcggcagccgctgcagcgccgcccaccgcagcgcctcctgctcgtcctcctcctccctccacgaccccgacctcgcgaacgccgcctccgccgcccacatctccgcctcctcctcctccccgcagcagcaggtggtggtggtggtggttgcagcggaggagcggaggtggtgggggatttatggaggttgtactgtgaagctggccatggccgcagtggcaattgaggctggctggatccatccatccaccgactccccctcgcattaatggcgcgagacgagacgagacgagctcgccttctctctcctcgcgtcgcctctgctcttggtttgatttgatttgatttttgtgccctaattctgtggggaattagaaatttagaattaagcgtaggtggaggatggagggagacgacgccttttgagtttagaccgttcggtttggctcttctgggccacctttgctgctacctcgacatgggcccctcctctcctgcctccacgtggcccaatcgttgtgcttccttctatctcacagaaaaaaagtttagtaaatttcgcaaaactatcgttactcttaatgtgatgtatcataaaactatatatttaatactaaa

SEQ ID NO: 3818 - DNA, 1501 bp, Oryza sativa
tctcggcgagcaacaacaacaggaagccggcacggtagagttaccgcgtgggtgaaactgaaaggtgcaaatacggggggcccacctgtaagcggggatgtgctgctgctccggtggggtaagagcaagttcaatagtacagccaactactatcttcaattcaactatagccagtctaatagctcatttatacaatagttacatactacactattaatacatagtcccatctatcatacacacactgtgtcttggagtccgtgctacagctggctatatatttgtagcttgttgcccttctctctattcatttatctctttaaaatatgtttgcagctggcttatagcctgctattgtacctgctctaaaagggggtgcgtgcatacgtggaggggtgcgtgggcccctcccctagtatggtgggccgggcgtgatggcgttggcgtgatatccatcactctctcctcacctcacggctcggcgcctccccggctcagcggctctcggttgaatccaccatgcgcgccgggcgccgcgaccacaccactcgcacacggcctagcaaatcacggcgcgacgcagcgcaaccacgcgaaaacgtgaggcggcgggcgggccgcccgcccgctccgcaccgcgcgcggcgcacgagcgattcgcgtcgcggggacgaggagatgcagtacattactatacgtggcttggcagtcgcggtcgacgtggcgcccgataaaaaaagccggtgccggcgctgccgccggcgcaaggctaggggaaggggcctcacaatattgtctgtcgatcgctctttccccgcactccgcgctgctttgctcccgctggcatggcgcgagtgccgccgccttcgctgggatttcagaaaagaaaacaaacacacttgtcgccacaaaagctgccgcgtgtctgtcctcctcccgtcacgccggttttacagttttacaatgtatactccctccgccccataatactccctccttctctaaatgtttgaggccgttgacttttctaaatatgtttgactattcgttttattcaaaaaattttgtgaaatatgtaaaactatatgtatatctaaaagtatatttaataatgaatcaaatgatagaaaagaattaataattacttaaattttttgaataagacgaatggtcaaacatgtttaaaaaagtcaacggcgtcaaacatttagggatggagggagtataagggattttgactttttttcttgcactttttgaccattcgtcttattcaaaaaattttggaattattatttattttatttatgacttactttattatccaaagtactttaaacataacttttcgttttttatatttgcacacatttttttaataagacgagtagtcaaacagtgcaagtaaaaagtcaaaatctcttatattataggacggagagagtataatagtaggctataaataggctaaatgttgagatggaggagagagaagaagaag

SEQ ID NO: 3819 - DNA, 1501 bp, Oryza sativa
cttgaaaggtggaagtgcttcttacaagaattaaggtttaaacaaataaccgcaccttgtccaacaaaagtgagagagaaggttccgcttccaatctccttcgaaagttttaatcaacattcgaaacaattacatggtccttgatctcaacaaattaattaacaagcgatcacaatatttgcaccatttgagaacgttcaaattaataagcgataacgtcttttttttttcaaactaatgctgaatttggtgaaaatttgtagcttttgcaccattccttaagcctgtggccaccattttttaagcaacaaagatcattggcacgtccagttaccatcttcttaaacgactactgtacaaaagagttaattttagagctattaaaggtcatataatttctatgtaaccgtatcgttcagcaaaaggttatcctgaaatacgagattacggatataagcttgtgtttggctcaaagggatgggaactaatccctcacacacacaaaacggaacaactcattagcacataattaataaagtattagttttttaaaataaattaatattatttttaaaaacaactttcatgtattttttaaaaaaacacgcgtatttaacagtttaggatcaagcatgcgtgtgtaaaacgatatagtacacttgggaagatgcacccggccaagaacacagccaagtcataagaaagatcgatctagatcatggatatcaatatatcatatctgattatcagatatcagtttgtcaaaaaaaaatgtaacatcagaaaatattatcatgatttgtacgtttgctaccacctaatataaagctgttctctagtaagtcataagaaggaacgttctagatcatagatattatatcccattatcagaaatcagtttgtcaaaaaaatagtgtaacgtaaaatattgtcatgattggcacgctcgctagccgaatatggaacagctccacgcgtaaaaaaaaaaagaataagtggaaaatcatatagaacgtgcagtggggagatgctaattgtataacactcgaataatttaacgggcatgcaggacacatccaacatatcaacatcgagtgagtcttgcagtaggattacattccgatcttccaagattgtttaaatgaaataaagttataaagtactaatacacgtggggcaaattgatactattatatatatagtcatccaactccaacagacgataggtcgaagatgaagtgaaacgtaatttaacttgttagatatcttatggtgaaacctattatctaggttaaagttttatatttgatatgggtgctcgtatttatagataattattttttaagtatatgttgataatacacgtagtgactttcgtttatcttaagatatatcggtccaatctactcacaaggaataaagtgtacgtgtgtctatttatagggatgtataaggacacctatgtgttgtgtttcactcgcaataaagaaaagaaaatagg

SEQ ID NO: 3820 - DNA, 1501 bp, Oryza sativa
  unsure (1)..(1501): unsure at all n locations
ttatatccgcagacattgagcaaatttaaaaaaaaaacgtatatatacataactttttcatacggaatcagatggagacaaactttatatcaacattgtagagctcgatgagatctacaactttcttattgattattttattatttgaggtcatttaaggagtctaaatattcattataatataccatattaatttttacaagatctcagaactgcaattcaaacaacaacatctgatggagatgtgttccatatcaaagttgtagaactcaacgggatctaccactttgtagtttataacagttgtatttgaaagcatttaaagtataaaacaaacattacaagtttcgaagatgtgaagtaaaataaataacatctccaatttatacaatggtaagtaagttatacatctagtaaaaggtcttgagaatagaaaatgataatcatatttgcatatggatctctaagagcaatagccatgaaaatcgattttcacatagggttgtgggatcgtctataaaattgacgatataaatgttggagatgttgaactaaaataataagcgatatcttttccttaatcaagaaactcaatttgaggggttttttatatactggtaaatattcgctatcgtattcgttccgtctcgtattcgctccgtatctgtattcgataatattcgatttcatttccgtatccgagttttcgattccgatttcaattcaaaaaaaataaaaacaaatatgataattccatccgttttcgatccgatttcattcctaatttcaaccaaacacgacctgagttcaggtccgtggtccgtctctcgccgtctcgcggtctcgctcggtttccccctccgaattccgaatttccgatccccacggtggcgtctccctatatctttcgtcaaccaatcaaaaggaaactcgaagcgtatcggcttcatcgccaatcgatgatgcgacgatgctgatctgatcatctgaacccaacaaaatttctccttcaaaacctgcaagctcaccttcttctcccccagctctctcctccgatcatttgcccaaccaccacccagcccgccagccgtgcgagcgcagctttcctatttaagccgcgcctcgctggctcgctgccgctgcccctgcctcttccccgaatgctggtctctcgtcgccccgtcccctggaatctctccctttctaccttggtccgggaccgcggctcctgaaatctctctctgtccctagaaatttctgcgcgcgtcttccgttcttctccccggtttggttggttcccgagcctgtgacctcgggggcggccgaaaggttggattttgtagagcaggctttacttgcatctgggcaaagattggattttttttgtggagcgattttgaggtcgttgttttttggtgattgtttgccgaagtttggattttgggaggagtttggggnngnggggggggggttcggtcagatttggtgggagcggagggca

SEQ ID NO: 3821 - DNA, 1501 bp, Oryza sativa
tgcgtcctttatcctttggcctattttcttttctttattgcgagtgaaacacaacacataggtgtccttatacatccctataaatagacacacgtacactttattccttgtgagtagattggaccgatatatcttaagataaacgaaagtcactacgtgtattatcaacatatacttaaaaaataattatctataaatacgagcacccatatcaaatataaaactttaacctagataataggtttcaccataagatatctaacaagttaaattacgtttcacttcatcttcgacctatcgtctgttggagttggatgactatatatataatagtatcaatttgccccacgtgtattagtactttataactttatttcatttaaacaatcttggaagatcggaatgtaatcctactgcaagactcactcgatgttgatatgttggatgtgtcctgcatgcccgttaaattattcgagtgttatacaattagcatctccccactgcacgttctatatgattttccacttattctttttttttttacgcgtggagctgttccatattcggctagcgagcgtgccaatcatgacaatattttacgttacactatttttttgacaaactgatttctgataatgggatataatatctatgatctagaacgttccttcttatgacttactagagaacagctttatattaggtggtagcaaacgtacaaatcatgataatattttctgatgttacatttttttttgacaaactgatatctgataatcagatatgatatattgatatccatgatctagatcgatctttcttatgacttggctgtgttcttggccgggtgcatcttcccaagtgtactatatcgttttacacacgcatgcttgatcctaaactgttaaatacgcgtgtttttttaaaaaatacatgaaagttgtttttaaaaataatattaatttattttaaaaaactaatactttattaattatgtgctaatgagttgttccgttttgtgtgtgtgagggattagttcccatccctttgagccaaacacaagcttatatccgtaatctcgtatttcaggataaccttttgctgaacgatacggttacatagaaattatatgacctttaatagctctaaaattaactcttttgtacagtagtcgtttaagaagatggtaactggacgtgccaatgatctttgttgcttaaaaaatggtggccacaggcttaaggaatggtgcaaaagctacaaattttcaccaaattcagcattagtttgaaaaaaaaaagacgttatcgcttattaatttgaacgttctcaaatggtgcaaatattgtgatcgcttgttaattaatttgttgagatcaaggaccatgtaattgtttcgaatgttgattaaaactttcgaaggagattggaagcggaaccttctctctcacttttgttggacaaggtgcggttatttgtttaaaccttaattcttgtaaga

SEQ ID NO: 3822 - DNA, 1501 bp, Oryza sativa
cagttgcttagctctgcttcaatattgcaaggtggtggatggagtgaggggaggtaggcttgcagagcgagcaatccaagagcctgcacaagtagattgttaccttggaacttaaaccagtatgaagcagaaactacttgttcggtggctgtgagcaaagatagaaacttatatccagatattaagttttaaactagtgaaagtatctataagttaattgtctgaagaaaatcaatgctaatttaaccacaagcaaacaagaagatgccgatgtacttttttacatagaggtcctttaatatctttatcaagtaggcttcggatcaaggttatgccacagacccacagtaggtgatgaccaaaccatagttaaaaattcaacagaatatattcctttcaaaaaaaaaaaaaagttcaacagaatatgatctggtgttttggcttaattcacacctaactaattctgaaggagatataaaattgttttccttagcaacttgtaagaatcttgttttgtatgtatcccaagttcccagctactttgagcttgggaaaacgatttagcaacctaagcttttgaagtttcaggcaacctgcagctttttcgatatcggtgtgattacagctgagaataatgttagaagaaaaaacagaggcaacatgtgaaataattttcatgggtttctttcaacatctgatgtaactatatgatgctattagtttacattcattagctgtgattaaaataactgcgacgagtactgtgttttttttccccttctcttggcaggctgtcactagtaaagataaaaagaaagtgaaatcaagaaatttcaatggatgatacccagaatatatagaccgttgaatagaccatgaggcaaattaccagaaactccaacggaccaaagagtagtatggttctagagcgagtgatgtacgagtctgagaggaaagctcctaataaagcaaatccagatgtggcaccaatgaagttagtaactgtggttgcagagcttgaaactcccatatgcatggttccatggagatatgtaaccaaattcagcatgtttggaatattttccatgtttgttaccactgacagaactacaagagagaacaagcataaaaaaacacttcgatttcaataggaaaacctactgttagtgagtaattacacaaataacgcaagaagccaggaacaatatattaatcaatggactcagtagagcaacttacagaacataaaccatgcagctctgactcctccatgtacctttctgtctatcgggtttcccctccagtccacaaagcctccaaccaccatcagctacagatgaattagcgtcttcttgcacttgattactacttcttcattgcatacttccattccatcataggaggtatatatagacatatggtatactttttttttcctcgcaaagtggccccagctaaataaagaaagatgacaagtgaaagatcattggctattctatgc

SEQ ID NO: 3823 - DNA, 1501 bp, Oryza sativa
tgctccgccgccgccgacgcggccgctacctccgacacggagttggggtgcacccgcttgggcctggtctgcggcggcgcgtcggtggcggcggtcgggggcggccgcggagcggcgctcggaacctcggagggagcggacgaagcgggagccgtgaaggcggtggctggatcgaaggaagggttgcgcgactggacgagacggcggaaggaggacgacgaggcagtgccggaggccgcggtgagagcagagccggcggcgatgcgcgcggcgaggccgtgcggatcggagagcgcggcggcgcggagcgtaggcggaggcggcggggcgggcgcgggcgcggaggcagcgggcggcgtgggcttgagcttgggtttggtgggggcggcgggcctagtacggtgcttgggcggaggaggaggaggaggaggaggcggcgccgggcgaggaggcgagcggcggcgtggcggggaggcggagacgtcggagaggagggatccctcggagtccgagtcggcggcgtggggcggggagtacatctccggaggcggcgggcgcggctgcggaggcagagattgtggcgccggcgcggggccgacgagggaggagagagacggaagggggagtaggggaattggagggaaatttgagaagatagcaatatttttggcgcgctaagctgcggcggttgagcactgaagatcggcctcgctttgctctagatctctaagctttcaaaaaaaaaataatggaagcaataaaaaataatttacaaataatatttttaaaatcgtgtcttaataatttaaaagtaaaaaaacaaatacgatgaaaaaatctcaaaattaactctaatttattaagtttcaaaagttaaattttggttgtagctaataaaccaacaaacaaacaatggagctgtgaatagacaatagcccaacacatgttcaacatatctatctttggaaaaaaataagtttaaggtaaaatttaaataattgattgatgtgagaaaataggtagagaaattaagtgagagatggttatgacttatagatgagagacttaggtggtgtttcttttcttctgaaaatgaagatgaagattaagttttttacacaaaacgaggtggtattaacgtatgatcgattgagttttaattgttataaatttggaaaacatattatctgatattttagagcaactttcatatagaagcacgaaacgcacggcttaacagtttgaaatgtgtgccacaaaaatctttatttttatccaagttttgttggagaaaagaacagggccttagtgaaagaatcaaatggaagatggttaagatgaaagggtgggtggaaggttatatttagaataaaatttatatgataaaaaagtgttttagtacatataagaagtacgaatgtaacatctatttccatagcatagcgaggagacatgttattcccttattcacaaaaggtgataccaagagaagtttcacgtg

SEQ ID NO: 3824 - DNA, 1501 bp, Oryza sativa
gttgggttgggctgcgccgcgctgcgacggggagggggaggggttggtttttggtggaaaaaaaagagggagatgagaatgagattgggaagaagtgaccgagccacagtggtggtggtggtggtgactactgtccccgtggtcgtcagtgacagtgcgcgcggagtggtgcggtttttttggcctggttccttccctctcggtcgattttcgggctccacgacacgtgtgcttttgtaactgtggtgtacggtgttaaggagtttaaggagtgttttcaatgtaggactaccgtcttttaaagagagttttaggagttgcgtagcttacatatcgtcgtggattcgtctcctgtagtccggttgttgtgccattgaattgagttcgggggctgggtgaaaatctgtctctagccgtttataaatgtcattaatgtaagatatatcttcatcatgaatttgtgatggttcataagatattgtttgggttgtgtcttgtgagaggaaaaaagatgattgatgcaacaaaaataattttacagtacagattttacacttctattttagcagtttaaatccaagtgtgtaaaaataaaatatgttctaaaattaagtttgaaaattataactatagctgtggcacgtaagcctaagcttaagagcctatttaaataggaggaattttctgaaaaatttagagaaatggaactatttcatgtggaaaatctataaaatatatgctatccaaatagaagccgttgtgagagtgaatcaactcattggattggatggtcattttgtgtgctcatctatggattaccacggtttaagttttgtgagctctaaccacatggcatactgcacggtttcaacttgctctatcactagtacaattgaggactaatttttctctacttgattttttcttgtcccatatttgagggacatataggagtgcaccgtcacctcaattcttaggaatcattggttgtgtgctctacgtgagatagcaataattgaaatacgctcgttgcaggtgccaattaagcataaccctcgatccaaatgcagattgccatagagacattcgtttatcgataacaccaactgatattcgtttgaattaatttctgattgccgtcattctcgaaagagacgacataggaggaagagggtccatatatattattattctcaattggtttcatttattatttttcaaaaacttaatttcttatttatgtgatcctttacatagtaaactgaggatgtaaataatttgtttaagtaaatgcagccactgagctccacgcccttgcacaaccgagctaaaatccttaaaaaatcttgcaaaaaaaaaaaaaaccttcacaaaccaaactttgccaacctatagagtagtataaaccatgtttttggttacagcgactaacccctcttaacagcgtgatttatttgtgggcaagccagatactatgcaataatgcaaatgcaatagctta

SEQ ID NO: 3825 - DNA, 1501 bp, Oryza sativa
agcgtgcgacggcgacatgcgcccagcgacttggaccggtcacggccgttgttgccgagcaccacaccactcgcgtcgtccaaagcctccaaatctgcaatccaccccttccccgcaaaacttccaacctccgatctggcgcggagactatccgcgtgtacagatcgcaacgagagctgctgctgcttcgcgctgccagcttaccacatcgtgccagcccgaggccaagccgccaaaggcatatcgtgccgaggggtgttcaacgtcgttggtccgaacatccgccggggggaaaaacagctaaaccgccggaaaaatgaggcgataattacacggcacgcgactggtcgccgtggaaacgaagccgaggggttggagggggggaaaaacgagataatccacggccgcgttcaccgtttgtactcgcacagtcgcacggataattgaggaaaaatctccgttgtcccctcgtccttgactatcattatcattcagagacaaggccccgatcatcatcccagcatcagccgatctgcagatgccaaccgttgtccattgagcccacatccagcaaatcgatgctgtaactccgaagcacacagcaacacacagaccaaacttttgcgaaatgtaaccgcggtaaatgagcgctgtcaattgatccagagactgacagtgagtaagtcgaactggattgggagggagttgggtaattaggctaagacatgttcgcttgattggtggaagcaacattgggagtagtagaaaagatttatatggtgcagccgcgtttttttttttgtcttgatctcaccgcattttctctgtgcagcatatgctcatgcaaatctggacaaagcagccactagcagtatagtacaataactgcaggcaccagctaagcacatgattcgaacagggttgcaaaaggtacggcccgttttttcacctctcgatttatacttatctatgtagagtcacttcacgcatcatcttgttaactgtgaagaaaatcttaacaggaagtagtctaaaggtaacattcgctaccgcaggtaagtcaaatttacgattgttcaatgatggtgacaattattgtggaacggcatgtgcaaagggaattgataattgttctttgccaccaagagctgactttgaaatcaaagaaagcatacaatacatcaagtaagacaactagataacactcaagataccggtacacaaccaaattagaaaacaatggctaaaagcgaggctgaaggtgacattttccaatcgtgatgcttcaaatgtatggtcagaatatagagcagtgaccacaggtagatggtccaaggttgacaagtataacacccagtttatagctatacagattttgacatcaaaactgaaaaattatgaactgataagggcgcacttaatagtaactatgataaatcatgtttatacagcattgtttaagtggatgtgaataaggtacatggtatcatcaagaaaattc

SEQ ID NO: 3826 - DNA, 1501 bp, Oryza sativa
ccatccttcgaatcgacacagagaactcacgagacgagagaggaggggagggagaagcaaggaaggagcagagaggagagggtgggcggggcagcaatggcggagagggacgtagcacgccgccggctcgcgtcctcgcgccccatctgcgttccgtggagggagctcctacacggctgcctcccgtggctgtggttgcggaaggagaccggctgcgcggcctgcatcatctgccgcgaggggatgaagggccgcgaggaggccgtcaccatgtcctgctgcgggaagacgtgccaccaacgctgcttcgaggcttggagagcggagacaacaacgagatttcaagtctgcccgtgcccgggctgctacgacctggaccccctgtcgccgccgccgccgccgccgatgtgatcttcgggtttagggttcttaggattctaacgctttcttctccactctgatgcgtcatgtgattgtgtctggcctggatgtctggttcttcaatagtttcctctgctggtagttttcttgtcgccgctactcgccacatgattattggggcgcttcttaggatttatgttagagttcttaggatttctgatttctgttagagttccttctgaattctgattcttttcggccagaattgttgcccttgttgcttcccatgtaacaaactgaagtctgaatatttggatatggaatatgaagatctgaagattttgggagatgtcaattcttcaatttgtcaatgaaagaaggcataagccaagaagtggtcctgaattagtactgactaagcgatatgctattttgcgatgataactgcatactgaactattgatcttgacaagtacaatgttgtttgttatgtatactgcaggaattctctaagtcttttttttttatcatacagcttagctgaaatcgcctgctaaatattcagtgtacagagaatcgtattaatgtccggcatactattgtgggtctaattctgcaatgttatctgaactacctgaactttgtgtgggcttgccatctttgtcctcccttaattctaacaccaatttgtatcccacggagtgcattatgtaagttcatctgattagaaagtttatcaaacctgcaatatgtagtagtatgttagctcatttttcagaaataacttgctacagcagaagctgactttactgaacttaacaacttcaaggatgcaaagcaatgtgcagtagtgaagtggtcgtacacttctcttttcaaaagtggttgtgcacttgtacagatcgagttgtactactgcatgtttttgcctagctctgcagaaacctgaaaaccacgattaccattccaaaacccaatctgatacaggcagccgcatatacgcctcgtgtgtcctgctcggccaaatcatacgcccaccaagaacaagaattcgttaacgaactagccgatcactacccgccctccgatctgcgatcaacggcatcggtgcgcgcggtcc

SEQ ID NO: 3827 - DNA, 1501 bp, Oryza sativa
cacaatcagtcagaagtatgatgtatattaatagacaggataggataagtagactgaccagtgaccactatggttcactaaagtaacaggtgaactctcttgaagaccttccacaaaatttagtcacttaggtacaacaagctgagggccatcaagcttcctatcttgaagcagccacagcttaagctgcagacgtgtcacagacaacagctgtagtgagttcaaataactctccaagcacttaagcagcatttaagttaccaccaaaatgcaaagcacaaaatgactgagcatatggtcttccaccagttcacaaagcataaaggcagtttacgcaaaacacttgtcgcataaaaggagttaactagcatatcttcgaagtagtcaacatgttgcataaaaataaagacatcttgacttttgatctcaccacttctacctcgcatgactataacttagctaatggttaatatttacagatatgcttagctgattaattcaacctcattatcatttagataaaggaaaaagacctttttccaggttgcaagagtcacaatacattagacagttactaataatatcctaaaaatgtggtatacagagaacgaaagcatcaatcgatgcaagacaaacttgtttcccagtgagttgaaaaccattcagattagaaggatacaacagaagaaccaaatattatttgtaaacggttggtgaacattatccctgaatagataaatagtccatgaaatagaacatcaagggagcaagcgatcaaatacatggaagagtccaccacgtataatgagtaacaagatactgaagtttctctcttttaaagatttatttatataagtgaaaatgaaagttggctgccgaacaggaaagaaaaaaaaaagaccaaacattcacttccaaattcacaattagatagcttatgaacagtaactacaaagaaacatttcattcttccctcattgcatcctacagttgattggtgcatagccagatgggatgggagtgaaaatatagtgctgaacagcactgttgagtggtggatacagaaacatcagttactgttacttacaagcattgttttgcacaaattgttaagatgccaaggagaatacctacagaacagtatcctccgtttttcatttttctgttccattttcctttaatcagtaacccctttttttcatttcttttttagatatatgggaacatgtgtctgtccagattccagacaacatttaaaaagacctatgaaaacacagataaccttcaaccacgacctttcatcacaaatgatcttttgcacgtgcactcatcagttttagtcagcaatacatcacttgaggtaaatggtttttgaatatatttacctttcaagttgtattactgtccattgatttcctggtgaaaagcaaaaggcatccttccccttcgcttctcttgtctcttgcaaacaaaatggaaagatcaaaagaaaaggcactag

SEQ ID NO: 3828 - DNA, 1501 bp, Oryza sativa
ctctaaaatatcagataatatgttttccaaatttataacaattaaaactcaatcgatcatacgttaataccacctcgttttgtgtaaaaaacttaatcttcatcttcattttcagaagaaaagaaacaccacctaagtctctcatctataagtcataaccatctctcacttaatttctctacctattttctcacatcaatcaattatttaaattttaccttaaacttatttttttccaaagatagatatgttgaacatgtgttgggctattgtctattcacagctccattgtttgtttgttggtttattagctacaaccaaaatttaacttttgaaacttaataaattagagttaattttgagattttttcatcgtatttgtttttttacttttaaattattaagacacgattttaaaaatattatttgtaaattattttttattgcttccattattttttttttgaaagcttagagatctagagcaaagcgaggccgatcttcagtgctcaaccgccgcagcttagcgcgccaaaaatattgctatcttctcaaatttccctccaattcccctactcccccttccgtctctctcctccctcgtcggccccgcgccggcgccacaatctctgcctccgcagccgcgcccgccgcctccggagatgtactccccgccccacgccgccgactcggactccgagggatccctcctctccgacgtctccgcctccccgccacgccgccgctcgcctcctcgcccggcgccgcctcctcctcctcctcctcctccgcccaagcaccgtactaggcccgccgcccccaccaaacccaagctcaagcccacgccgcccgctgcctccgcgcccgcgcccgccccgccgcctccgcctacgctccgcgccgccgcgctctccgatccgcacggcctcgccgcgcgcatcgccgccggctctgctctcaccgcggcctccggcactgcctcgtcgtcctccttccgccgtctcgtccagtcgcgcaacccttccttcgatccagccaccgccttcacggctcccgcttcgtccgctccctccgaggttccgagcgccgctccgcggccgcccccgaccgccgccaccgacgcgccgccgcagaccaggcccaagcgggtgcaccccaactccgtgtcggaggtagcggccgcgtcggcggcggcggagcagccgaagcgggcaagagggggatccgagggcaacttcgtgcggctgaacatcaacgggtacggcaggaggaggacgttcaagaattcgcaggccaagcgctcgacgaaatgtcgatcctggcggcggcagcgcgccgccggtgcaacaccccgttctcagggcgacgaggaaggggatctcgtggcggaggccctgctggagcgggagaagcaggcagctagcgatagtgttctggaggctgtcgagagtgtgagggaggacccatcggagcaaaatctcaagagcttgctgaatgcagc

SEQ ID NO: 3829 - DNA, 1501 bp, Oryza sativa
tgcaatgtgcccctgtgccggcatgaagtatgaacacatgtgccgtcgttcacctatacagctccagcaatcatgtgccatcgtttttattgatggaagagtagaaaaaaaatctaataccatgggagattgatttattgcaaggagcagggtaatctgtgaccagctgaatttccagccactataggagcatctccaaacctccaattctgatattttggctatgattataggtctcgagcaagcaaactgatgttgcaatgattttagcttcaataggaaaaaaatgggtacaaatcagctgcatgctaaagatgccatcaataacaaagtaacttaacgggatttacaaaatgatcagagagccatgatctgactctatccctcccaaggttgcgctcctacagaacaaaaacgagacaataagcaagtttcaccagcaaaatgcgtgaaacaaatagtaactcattgcacagatttcagttggcaactaaacatcgaagtttgtgggataaaattttggggagaacttactgctagcatatgggaatttgcctgcgcaatctgccagttagcgagccgcagcttctggcccatttccgctcaactctatgattttgctgcatgcaccaaaacaaagcaaaaatagagtcaaaccaagagcacatagcatcaaaatccccagccactcaaagcctcaacagaagggatgaactgatgcaaggaatcatgtggtttcagggacgtactccctctcctcaaggagccccagaggttccgagttctcctggaattgacacaaaatttagaaaaaaatatcaccgttaaattagtagcaatctcatgaggagatcgagattaacagagagagatgggatcttgccttaccagctgcacaattccctccttgcccgcatccgctgcacacaccggtccgtcatggtccatgggtgtacctcctcattacagccccgcccttggatatcgagctcacgccattcgcggccatcctccccggtgcagcagcggcggccgcctccgcctccaccgctggcagtgccaggatggcgatctggtgggggagcaaagacgacagcctccatggtggctcgtctcaatggaggaggtgcagtggcatccataacgcgaggcggagatcggggatccgcagtgccggggcggggtagggtttggggatttggagtggcggcacgacggcagcggcggggtaggatttagggattgggtgtggcggcgattggcgagtggcaagaatcgcggaggcgatgggtgaagggaacgggcgaaaatagcggtgcgagagagaagggggcgcgtgagaacgggagttacgctgtcacaccattaagatctttcccaaacctaaattgaatttataatccatcagagaaaatatcggtgtaagagcaaaataaaaccctaataaattaatgtaaataataatcggatttgttatgtggaatttttattgagttctaca

SEQ ID NO: 3830 - DNA, 1501 bp, Oryza sativa
  unsure (1)..(1501): unsure at all n locations
gtgaaggttttttttttttttgcaagattttttaaggattttagctcggttgtgcaagggcgtggagctcagtggctgcatttacttaaacaaattatttacatcctcagtttactatgtaaaggatcacataaataagaaattaagtttttgaaaaataataaatgaaaccaattgagaataataatatatatggaccctcttcctcctatgtcgtctctttcgagaatgacggcaatcagaaattaattcaaacgaatatcagttggtgttatcgataaacgaatgtctctatggcaatctgcatttggatcgagggttatgcttaattggcacctgcaacgagcgtatttcaattattgctatctcacgtagagcacacaaccaatgattcctaagaattgaggtgacggtgcactcctatatgtccctcaaatatgggacaagaaaaaatcaagtagagaaaaattagtcctcaattgtactagtgatagagcaagttgaaaccgtgcagtatgccatgtggttagagctcacaaaacttaaaccgtggtaatccatagatgagcacacaaaatgaccatccaatccaatgagttgattcactctcacaacggcttctatttggatagcatatattttatagattttccacatgaaatagttccatttctctaaatttttcagaaaattcctcctatttaaataggctcttaagcttaggcttacgtgccacagctatagttataattttcaaacttaattttagaacatattttatttttacacacttggatttaaactgctaaaatagaagtgtaaaatctgtactgtaaaattatttttgttgcatcaatcatcttttttcctctcacaagacacaacccaaacaatatcttatgaaccatcacaaattcatgatgaagatatatcttacattaatgacatttataaacggctagagacagattttcacccagcccccgaactcaattcaatggcacaacaaccggactacaggagacgaatccacgacgatatgtaagctacgcaactcctaaaactctctttaaaagacggtagtcctacattgaaaacactccttaaactccttaacaccgtacaccacagttacaaaagcacacgtgtcgtggagcccgaaaatcgaccgagagggaaggaaccaggccaaaaaaaccgcaccactccgcgcgcactgtcactgacgaccacggggacagtagtcaccaccaccaccaccactgtggctcggtcacttcttcccaatctcattctcatctccctcttttttttccaccaaaaaccaacccctccccctccccgtcgcagcgcggcgcagcccaacccaaccccaccaaaacccgcaccaccccccatcatccgctccaaccccccgcagtttggtctccccacctggttaaancactcccccccacccccaccaccatgcctcccttgccgcctcccctcctcctcctcc

SEQ ID NO: 3831 - DNA, 1501 bp, Oryza sativa
attctgtctgaagcaggttttgatctgttaaataatcttctaacatacgatcctgagaaggtaatgtgctactgctattttttttttcatgatttatatcatgcattcatatttaaatacttcaatctgagcacacctgttttggctttacagcggttatcagcagatgctgctttgcagcatgagtggttccgtgaagttcctctacctaaatcaaaggatttcatgccaacattccctgctctaaatgaattagacaggtacttcttcgcaaccatttaatctacttgtagtgttgcttaaatatctttgtttcatgtagtgaaatttattttcctaaaattccacaggcgtaccaaacggtatttgaagagtcctgatcctctagaagagcaacgattgaaagaactacaagggaacattggcaaccgtggtctttttggctgagctattagcaacttgtttgggctctattgatcctgactgtcatgcatcattctgaatctatgaggtcagatacactctgaggtgagatgtgccatggacatgaagtatcacgcatcttggtgtctaccagcaactgatagtgttctttagcaggcatggtgctggtttaagttgataggtacctggcccatcatagaaattttgttgcaggattaactccaaccagattgatcataaaagcagtctaatctgcctgcatcgtaaggtgtggcatgttggcttttattggttaacagcagtttcacctttggaacttctgtatgtaaaatattccagattggtacgttgtaaacaatgttcagtgcgttggatttaaaataagaatattccatcattttttttctatattctcctagtgccttttcttttgatctttccattttgtttgcaagagacaagagaagcgaaggggaaggatgccttttgcttttcaccaggaaatcaatggacagtaatacaacttgaaaggtaaatatattcaaaaaccatttacctcaagtgatgtattgctgactaaaactgatgagtgcacgtgcaaaagatcatttgtgatgaaaggtcgtggttgaaggttatctgtgttttcataggtctttttaaatgttgtctggaatctggacagacacatgttcccatatatctaaaaaagaaatgaaaaaaaggggttactgattaaaggaaaatggaacagaaaaatgaaaaacggaggatactgttctgtaggtattctccttggcatcttaacaatttgtgcaaaacaatgcttgtaagtaacagtaactgatgtttctgtatccaccactcaacagtgctgttcagcactatattttcactcccatcccatctggctatgcaccaatcaactgtaggatgcaatgagggaagaatgaaatgtttctttgtagttactgttcataagctatctaattgtgaatttggaagtgaatgtttggtcttttttttttctttcctgttcggcagccaactttcattt

SEQ ID NO: 3832 - DNA, 1501 bp, Oryza sativa
tgcaaaatgtacatacgcaaacggctgggatttaatttattattaagaaaatagattcactagatgattagaggttataatacccgctgttcaaactatgtgtgtatgttcaacaacaatcggaaagggcatgtgaactagtggtggaataagtggattgggaacttgatttgtaatacaaattatttgtttagttgctataaataaagagaggggagggaattcatgctatttgtttcgtatgtggattttgaggtagggtgtgtttagttcacgctaaaattggaagtttgattgaaatttgaacgatgtgatgaaaaagtttataagtttgtgtgtgtagggaagttttgatgtgatagaaaagttgaaagtttgaagaaaaagtttagaactaaacttggccgtactagaaaattattatctcaatagttagtcactagggctaagctcgagcattcccttcttccgtaggaactgatcggactcatgtttccttctcaccaattaccctcaatcttgtgttactaaaatattacgtggatttctaatctctctgtctatctacagtagttaatacctccgttctagaatataagcatttttagagttggacacggttattaagaagttagaagtaaatgatggatggttgtgattgaatgaatagtggaggtaggtgggaaaagtgaatagtatagggttatgattggttgggaagagaatgttggtgtagaaattgttatattttaggataaatcttgagggctacaagttgttatattttaggatagagggagtagtcaacatgtctagctcgaccgctccttttatttgcgatattgattcgcatcttaatatgctaaatccatattatgttgttttaatccaccaacatttatgttgataaaaccaactacacctaccatataagtagaaaaccaagtaaaagaataataaatgcagctttactacctgataagaaataccgtggaagttgataataaatgcagtaagcaaataaattatattatttatacatttgcaagaggttgtaggaggcagggggttagccactttgtaggtggattttaccttatttttctctgtacaaataacacattgtgatatctctggtaactactatcttctgatcctataatccactatgcttataaaaaagtgtgaagtttgtaatggcagagacgtattaacttgattttttttgaagtggtgtattaagatgacaacaatcttatctctcaacagtagagatttaatcaactttttgcttattatgccgttgtcacgggatattttccatcatataattctctcattgtcattcaaaaaggagaaaggagtaacagaaataaatccaaaacaaatcagaaaaaggcaaatttccaacttaggctatacaaattaaacggcaacctccatttttgcaagatattgttcacaatcacttacctcccttttatagtatatagtctcccac

SEQ ID NO: 3833 - DNA, 1501 bp, Oryza sativa
caattcgagtgctgatctcgcgtaactgccaggatgagaaggcctcggcctttttctccttcccatcaggccgaacaggcataaatccttccatccaatggatttaggaaaaagtatacttcgactccctcactatgacccgagtatgatttatatcctccaaccacaaaaccagatatatcgatccaactatcaaaaccggtgcaaacaatgcctctgtgtggttttagaggtggttttggctgacatggcgcctacgtggcggtcttgaccgggtctttgtcctacatgacgcttatgtggcattagaataaaaaacattaaaaaaatatgggacccgttgacatcctccctctccttcccttcttcctcctccctccctctctcccttatctccctttctctcccccggcctggtggcgtcgtggtcgtcgttgcccatggccaccggacgccggcgccgaccgccgccgctcccgaccaccggcgagctccagatcctcccccgtgcgcggacggacggcgagctcctccccgcacgcgcacccccaccgcaccgccgctgctcctgaccaccggcgagctccagctcctcccccgcgcgaggacggcatgcgagctcctccccgcgcatggacggccggcgagctcctccccgtgcgcggatggcctgtgagctcctccccgcacgcggacagctgtcgccgtcgccgtcgttagctccctccgccatccacggctagctgtacgtcgaagcaaaatcaaaggctagctcgccgacgccctgggaagcagcatttgactgcagcacggcggcggcgcagccggggggatggaccctatcctcacctctaccagcacgacgccctcactgggtggacgagctccctctgccgcctcccgccatccgcaatcctgcttccgccacccagacccgtcgccggcctccaccacgctcgaactcagctgtcgccgaggggacgggacccacggaagccggcggcgcaccgatggccttcgtcggccttccgcctccgtcggcttgtcccaccgggcaccggcgcacgagatgacatgtggggcccacatgacagtgggtcccactattttctgtgtgaatgacatgtcggtcccacgtatttttttttgtttttactctaaaatgccacataagcgacacgttaacgacacgtgggacgaagattgggtcaacagtgccacgtaggcgccacgtcagccaaaatcgcttccaaaactactcagggatatattttacaccggttttgatagttggaggagtcaatatacctggttttatggttggaggttatgaatcatactcggaccatagttgagggagtcaaagtatactttttccatggatttaaggcttgttttatttccctcccgggcctcattcccatttgtgctaaagcccagattccctggtcctttttcacccctccctaaaaccaaaatctattgatctcccctccctccc

SEQ ID NO: 3834 - DNA, 1501 bp, Oryza sativa; identical to SEQ ID NO: 3833

SEQ ID NO: 3835 - DNA, 1501 bp, Oryza sativa; identical to SEQ ID NO: 3833

SEQ ID NO: 3836 - DNA, 1501 bp, Oryza sativa
acaaggactggtatatacatgaaaagaacacacgtatggcacacaccttgtccatgttgggcaccagggcctgcaacttcctgagcttctcgctgatcctcgttcttctctcctgtcatcatcgatcgatcatatgcctgaagattaatctggcatgcacgatccaaggaggaacaacaagaatgctactggctagatgcatgcatatgaagaacatcttgaaaggttatcaatattcttatttggtaacatatcatgtgcacacaagtttcgcatgcaaattctatacacaccaacaaacaaatatcacaaaaaattctttaaaaaatacatattataatttcaaaaatgctacacctttgtgtaaaatcttaacctcaaatttgttatatcataggtgtaacaatttttttatagttttaagacaataagtatatcagaattttatcatttttgttgctctatctatgtaatgaatttgaagacatgactttatgtgtaaatataatactaaaaatacatgtatattgattttttttctaatttttttatgatatttgttaatttgatgtacggtgcatactatacacgttaaaggtctatgtatctaggatacgcttccatgctagttgacattacagtatatagttcgacccgctacgtacgtacataaaaagttggtactatgatggggcgtagaattagcaagggaaaatgtcgtctatacataccctctctgcgatgctccgtgggtgcgtcgcgcatccacgcttggcccgtactctgaatggcacctggtcgtgctgcatctgcaggtatttctctacgccagccatctccctgggcgcaacaagctgcatcgcagatgcatgtatatacaaattagacatgaaatcatccctcacattgtacacacacacactaataaatcaaactataaatacgaaaaatgaaaaataaagataaaacgcatatatatatacacctgagattcgtagttgctaagggtggcgatgatgtcgtcgttgccgtgcgctcctgatttgcccgtcgacgtggagaacacgatggagttggagtcctcccatgacccgatcgagaacccaccggaggagaaggagcggacgacgtggtcgtgggtggagacgttctcctcggagcgcccatgatgatgagcggcgccatggatgctgtcagtgaggtccgggatgccgtcctcggatatctgggagaggccgccggagccctgcctgctgctagcgaagctcagtggggccttcatcttcttgttgttgttgctgctgctgctcatggcgccatggcgaacctcaccgagtgatgatcctgctggtctagcactcgatgagaaacctattgccataagaagatgttttttagataatggatgtttcattaatccgatctctatatccacaaatattgttataagaagatgtataaatcgtgagttggtgactaagcagatttttttttttttttg

SEQ ID NO: 3837 - DNA, 1501 bp, Oryza sativa
ctttgagagtgacaagtggaccttgtattagttataaagagctactattatttggataagctaagagaaaactataaaaaaccttatagccagcaggtcggctgtattattagacttgctctactatgctcaggtaaaaattacccgtttttttgacaaattgacccttttggaaaacttatttcgaaactaacccctgccaaaaacttcaaccaaaaataggccgtcgcctcagcgccaaacacattggcgctgacgttggctgtgtcagcgccaacgggactggcgctgacattgtgccaccgtggcggccgggccgatccccagctgatgtggcagctacctcagcgccaaccggactggcgctgaggtgggacttggccgcaacccccaaggcccagaccagcaagccttctggatggcttgcgggctgggacctcagcgccagccataatggcgctgaccgtgggacactcagcgccagcccacttaacggcacattctcctctgcatgtacttcctcccttactgggtcattctcttccctgacctccacatccgccatatcatttactccctcgcccccctccacgtcttcctcaatcaattcttcctttctactacacctctccgacagttcgtgacagctaatgggtgattctatgagtggactttcattaaggtctataagttctttcttccctatcctaccatctttcttccatgcaaacacctcaagagatttgaaatgtgaccccaatactatatctatatatgtttgccattcgatctctccattcaagtctaacataaatttatgtgacatgacaccgccgcccacatcgtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacacttcatccccgcccatattatccatctaataatccatccttagccaactattatcaaaccacgtctacaaccaaaacaatgcaaaatatccaataaaactttggggaact

SEQ ID NO: 3838 - DNA, 1501 bp, Oryza sativa
aaggaaatggtcaacagagtgagagactattccttcagactagtcgccacctcccaattcatatggagcgaacttcgaatatgagtgagatctgttttgggcctctctccctcgcacatattttgtaggattcgtttgaatataatttgcgtatccaccgtttatgtaatcaatcgcaaatatagttcagaacatttacagtaacatggataagtaacaacacctatgatgacttctctttcaataatgaaatagcaacacatatggtgattttatattgtaacaatgataattattcacttgagtaaatagataatgcacctgtccgcaaatatatataagaattttacctagacattatgtaggtccagatacataaacaaatacatgtatacataacttgaatgtgctatttttgagaatggaagttagtaaagtattactccattttatatcttttttaggggagagtattactccatagcttgcacatggaaacacattatagtgtgatggtgcagttatagcatggcattattcattttacagataaaaaaattctggcgtaaaatgaccaaacttaccaatttttcatcacagacagctgcaaggaaaaaaagttactacaaatacaaacgtgaacaagagaaatcacgaacatctcaaacaaaaaaaaaaagagaaagaaagaaacgtgaataaaatacacgcgaagcgcacgccccgccttcgccgtcctcctgctcctctccctcttccaccttcctcccgccggaacttgacgaaatctgggaagcgagccaaggaggagggggaggagaaccccgccgccaccgcccgatctccccgtgcggcgccgggcgggggggtgcggagcgggagcctcgaccgcgccgatccggacaggggccaccagattcgccccgcgcgtgtgccggcgccgagcgcccaggcggcgttagatcccgccgcccggcccccccaccctcccccgtggtacggtcgctgatacgaggtcctctcggatctctccgtcgttcaagctcacctgtgattgtgctacttttttttttggttgttgttgtgtgtggtgctgattgtgtgatctagtatatagaagcacgcgcttgctgcatttggtcgtgatttattttggatgtttattggcgaagttagcttctagtgatctgatatggattatctagctgattgggtgatttgaagtttagtgctggtatttgtagtttacttcggttgatgctgtcggctatgatgtgttttggtgagatgggctgggtagcggtgctacacatgaatttgcgagattatgtgaatttagagagaaatgtgttcagttttcatcgattagtttgcttagttcacaaatgtatttttttgctgcaggcatgcaaagggatcagaggccacggctatagagtgatacatatatcttgctgctgtgcttttggggcctccggtcctgcttagttagaggagatgc

SEQ ID NO: 3839 - DNA, 1501 bp, Oryza sativa
ttttaaaacatgtttgactattcgtcttattcaaaaaaatttaagtaaggattaattcttttcctatcatttgattcattgttaaatatacttttatgtatacgtatagttttacatatttcacaaaagtttttaaataagacaaacggtcaaacatatttaaaaaagtcaacggcgtcaaatatttagggacggagcaagtatattatataacacctccgatttcacgtgtaacctgcaggtaagaaggcatatcggctcttactaaaattcatctattccaaacatagcatgaaaactacaccaataaaattagcagaaatttatttgtacatgtagcaggcttttgtagtccctgtttgtcatctaacctagcacaagtaaattctgtacaatttctagaagtacctacttgtacctatgagtaagaatttggtggcatcatattatctctcaccaaaaatttatgttccaaagagagcattaaagtgtgtttgaggggagacaaaaatagtatcgtgagccattaatttagattaattgagtattaattattttaaacttaaaaatagattaatatgattacttaaagcaatttttcggtagtttttttttaaaaaaaaatgtatagtttagttcgttaagaagtatgcgcacgaaaaatgaaaaatttgttcatgtccagttctttgtattgggatatcttatctttttttttacaaagggagtacgtgagcttctttcaaatgctaaatcccaagtaacaataagtgcctgtttagcacagtttcagcttcaactctcctagaactaaaacacagtcaaacagttttagcttcacctaaaatgaaaatggagctaggtggagcgttcttacaaaatgaactaaagaaatggagctgagtttaggagtttagactgctgtacgattccactacagacttaacttctgaagctaaatttaaaaaagttaaagttctatcgaacagaccatttggtacattgatatgccggaccggacatgttgcttgattgcttcctctcctcacggtctcacctgagcctcacagacgccgtgccaatgtgcctattgacagccacaacactagccggccacaccccaaatccctgatccctcctccctctgctcccagccacaaatcatcgtcgccacatgagcagcagcagcctcccttgctacactacacatactcctacgtgaccgttacattcgccgaaaccgaaacgacaccaaccaaccaaacagacgccaccggataaacaaaaacgcacgtagcagcagcagcagcagcagccgcgatgctcctgacgcgcgcctcccccaccttcctcccctccacctccgccgcctcgccctcgccgcagcaggcgccgtcctccccgaccttcgggaggagccagtaccgccggggaggtggattggtctccgtttcttctccggtggccggtcagcgctgtgctgccaggaggaggtccgtga

SEQ ID NO: 3840 - DNA, 1501 bp, Oryza sativa
attaattatataagggctacaaacaattgatatgatgaactcaagtaagtttttagggttttcttaaacaaattttactgttttaggatctattagatagagtttgccttttgtacatagaggtagatttatttcgagtttgtcttttctatctcttcgttgatgtctatttgttaggtggatcctccacggagacctataaaggtttgtctattgggttgctgatgattcaatccgtggcactggtagtattgattgctaacatgtcacaggaacggagatgtcagatgatgcttagtcatgttctttgtgtgtgcttgcgtttttcaacggtgttattgtgcttgtctattcacgttgcagcaatccaacatatggagctctttatcttttttgtgaggttttatacttcttgttcttgtgacaacaaggttatagttatatttcttattccatccgtcccacatagaccttgtttctagaaattctagaacaaatcagtagtgcggcgaattgatcaaatgtttctcattaattcatggttacaattcttatgttctagtttaaatgtgtatctggagcatgtataacttagaattaaacacctcgtggacggcggccagcgggggaggccacgcgctgctcctccgccgcccaccgacagctcctcccccaccactgccgcgttgcccgttgccgccttcatcgctgacgcctgccaccgaggctggtgcctcgcagagaagggacatagaagggagagagagaagaggggaaaagagagaggaggttgatgtggcctcgctgacatgtagggtccatgtggatcgcacgttgactcagccgccacatcggataaatcgggttcaaaaccaccgaatgacctaatgtgaacggttttgtaaattgagagataccatatatctagttttacggttgaggttaactcaataacaagttgaggcatcttgggtgtactttttacctttagcataatcgaacaaggatgctaacatggcatacaaacctttccgggctccacatatgtccacgggccgacttgtgacttggagcacgtacgagtgcacgacacggaccgagcctgaactctgatgaagtcgactctcaaaaagggtccgtctcctccggaaaacagaacacggctcggtggagaaaaccgaaaagaggaaaaagaaaaaaagaaagaaaaagaagaaaaatcctagggctagcctccgcagacacacgccatccgaaattcccgtatcctctcgagtctcgtcttcctcggcgccgccccatctcagccggacaccgcggcggcggcggcggcggacaggctgttcgcgcagaaccggccgggacgcattgttccgtcggtcgcgcgatccaggccggaggagaggggaggaaggagggggtgggtgagtcaacccctctctctctctgatcggaggtggtagccctcctcctcgtcgccgggaggcggctgatgcggcgc

SEQ ID NO: 3841 - DNA, 1501 bp, Oryza sativa
gaggccgcgaccctctccgctttccatggccgccgcggccgggtgagagagatgcctagaaagcccctcctccccatcctcgccacccgcgggcctcgtcccccgctcctcctcccccaccttcgtcgcctcctcttccccctcctcccccgccgccgccgcgccccctcctcgccgccgccgccgcctgcatcccgacggagggccgccgcggccgccgccatggcgggcgccggcgaccccgtggccgctgctgcggtggcggcggcgtcgtcgtcggctggcgcggccgccgcctccttccggctcgggatggtgcgggtggtctcgttcctcgtcgggggcctcaacgtggccgtgctgctgctcgggctctacctcatcgacggcgtgctcccaccggggtgcggcggggggctcgcgctcgccgcggcgcccgcgctggcggggatccgcgtgctcgccatgatcggcaccgcgcgcgcgcagcacgccacggcggatgccatcgcgaggcgccacctcgacgaggccgcagcgtcggtcgccgctgacgccgttgcgcgccacgagatcagggtgagaactcgagctccttgccggctagcttaggccactttagttgggtgatttgctcggcttaactctgacgtatcgtaaagtcgtgataaattgtgctttgatttcagttggttcaaccgttcaaggataaaccaacgcatttttttgtttgtttgtctaggtatggttacaatacgggattatttgagacacgatcaatctgaacaagtggacttgatttcaccatttatcagaattttgaggcgagttaatgcaaatgcgtgtaactgacgggagttgtcaatggtgctaagatacagcgtattaagcttagatgaactgcgaatacatcttattaagagcttttatctgatgcatatggctggaggacaatgtgcttatagccaaacactatgaagcgactcagtgttacactgtgaccgtgagcttgagcacctttttattagatcacagagacctgacatgagggtttagggttaagatttcgaattggaatctaatatcatatttgtggatttgaattgttttcctgccacttgttggcattctgcattgttcaaattgagttcattaactttgtaatcatatttaatctattgatataggtaatcataaactttttacaataaacaacacgcattaatatcattataaatctggagaatattgttgacgatatatcagtgaggatcatggattcatagttcttaactctctagcatagcattataaatctgtaatctggataccatcctttaagatgtatcagtgaggagggctcagaatattctttatgggtactgatgggatatttgaattctgccatagaagctagagtaggtgtaagaagagtagaatttctactgagcacttatttatcatactgctatttctgttttgttttgctcaacaggtgagg

SEQ ID NO: 3842 - DNA, 1501 bp, Oryza sativa
taaatttagacaactgtgagtttaaatttatagaaaaaactattatattttaagagggaagtagtatatagatactactgttgtgcgtaccagtcgtggctcttgctggggctctcggcggcggcggcgtcgtcgtggggaaagaagccctccacgcgagtcgccgggtcgatacggccgccgcgaggcgacgaggcgtgcgccttcgagcggctcaccggggccgaccgcgccatgccgccggcggcgggggagccgagcggcgagcccgacatcatctcgccgccgtgctgcttccagaacgcctccacctcctccctcgtcagcgacttgttcctcctcgcaagaactacacatatatccaaaaatcaaagtcatgagcaaatcatgcatggattgacacacatctgcaggtacgtaaatgaaaactacgtacctctgttctcatcgccaagaacgggtgaatcccatccagccatcagagaccccatcttttaattcactactcagagataatttctctgaatttggatcgatcgacaaagttggtctgatttgttatccagaaagaactgaagatgaaatcaagctgaagctactagcttgtatgattagttatcaactttaatttgcagatgcaaattgtagcgaatggataaacaacggagagagcagtgcagtgaatgatggctaggcatcgatccgatccagtcgttttatatacgcaattgacgcttgactttggagcgattaaagcggcactagtgcaggggcaaagcacacaggttttataaatcagagtggtttcatctccaaaaccttggactactgaatatgtcgttgtctggttcttgcccaacttaatctcgtggccttctcccagccgtccgattgtggttagcctttgatcggacggtgcgtgaccgagttaggaagcttaatcggggacgaaacatgatcgagtagccagctaggcccgtccaattaggtggtgtgtaagcagcaaggagacatgctcgtactgactgatcaataaacaaagttgctgggcctatctctccacgaaatatctatcgaactatctagccttttctgagcgagaaaaaaaatatctagcatggccttaattaaattcacggggttttggtttgattaggatgtgacgacgtgtacagtagtgaagtccagtggacggatagacttgacagtccatcgtgtagcctataaccgattgcaagttgtaaaaaaaagttgtaacatttattaacgactaaggataaattatgagcaaaactataataataatatttaatactatttttgtttttaatataggacattgttgattttacatttatcttatttaaaaatatgtaattactattttttcctgtaagttatttataaaaaactctaaacatgatttatatcttatatatgcatttgcacaaaaataaaataataagaatggttagatgggtgaggcaaactaaaagtgtta

SEQ ID NO: 3843 - DNA, 1501 bp, Oryza sativa
gctccaaactgctggtggtcccacgaaccagtgacaattgtaagttaggtggtcccactgtcaatgactattataaattattagtaaattaattacctggcaaaactaataacgcaaatattttctgcaaaaacaaccaacatgagctgaagcatcttgacaccaaaggcacgtggggccacgtcaaacgagcggggccacatgtcagtggtatacaaggttatcacgcttgggctacgtagcatcctgccgttgcttcagcagatacgagctattctgaattctttctgaaagtactctatctgaaacagaaaattagcgttactagctgaaaaactggaaaaggttagtgagtagtgactgaagtgactatgagctggagtatttgttatcctatcaataatttagttacctaactaactgtttgttttgttttggagtaatcattgatatacagatatcattggactgctttttttttttcaaatagataagttgcagttacctctgctatgtaaagcaaacaatttatacattgggccaagaatcatcctcatttatcctaaacaaatactagttgtttttaatcagaattatcgtctgtcaagataatatattataagctagtattacttttgtatctaaatttgggctagggattatcctcagcaatttgattatcatattacttggtcgtcttctacacatgtaaagcaaaatttgagaaaccattgtatggttatggcaaaccagtaactagaaaccacgttattcaaaagcattacgcacggttaaaaaaacacaatcaaagtgtgacaacgtaaacagtcgtgtgtagataaaaattgaaacacgggtagcaccgtagcagttctagagctataaatgaactataaatactctactaaaaaaaaatatgatgcacatataacaaaaacggtttcaaactaaaacataccgtgcacattcatagtttaactctaatataccggacccaccattatactggtttacaagacatgcattttatatgatttcttacagactttttttatcattttaccatgtttaagtcaaattcaaaagcattaataaaaggagaagaaaaaacccacagctaaaggctattagatcaagaggaaggatttaaaaaacaggagcaatatataaaggggaggaggtggagaaagggagaggaggaagaacagcagaaagcagggagcggaaagcccaccaccttccttggatccacaacccaaacacccccaccccccaccccacacacgccactccacccccctccccctcctcctctctcccacccctcctcgcgtagtagtagtagtagtattagtctattcgagtcctaccagtagctagctaagcagccgagacggtggcggtggaggaggtggtggtggtggtagtagtagtacgccggggagagagagccgttgctgctgctgtgaggtgagggcgagatctaggagggaggcgtcca

SEQ ID NO: 3844 - DNA, 1501 bp, Oryza sativa
atggccgaatgctaattaatgccagatgcctgacggccaaacactaattgcaatctgcatcccacaacttaatttattaaattgatggattgctttcagattaattaggggtattgggcattttgtttattcaattatgtgcactgccacaactgatgcttaccgtttacactataatcggtaatcggcagtcagccaagtccttaggtaattaactgataattgctttgtagaattaatttgtgtgatcggcagtccaccatgtttttagacatttcctgaggaagcatgactgatatgatacttgtgagatgcttagcaagcagaattcatagcaagtaaaattatctcctaaacaagagcaaataacatagcgagacgagagaaccaactgactaaacatttggggccccgtatcataagcaaccctgcccaaaccctaggtaaacaattttatgaccccaaaataataaaagcacaaaatctttattgtttgaggatttaggaagagaggacatcaccttaacctggagtctgtactgcgtagtgccgtaacccaccacagctccccggcgggcgcacgcgaggaggagccggccgacggcgatcccaaaactccagaggccacgcgcgaggaggcggcggcggtggtggagaaggcgccagccgacggcgaacctgactcaccggcggccgcgaggaggcggcagcggcggggtagggcgagcgtcgggcacgcgcgaggaggtggcggggtagggggcgcggctgcggcgggtgcgcgctcggagttggcggcggcgcccggcggtccggcgggcgcgtgcaaggaggcagcgagcggctccgggaggcggcgacgggctagcgcacgggagagaagttttttttttcttttctgcttctttctcgtgatcgatcgctatatcgctataaccgctgctaatcgaacgtggggatggctaattgcagaggttgatctaacttttgatataaatcgttggatgaatatatttaaaggtcagtaaagataggtatttgatgaactcgtgctttttatattagtatagatatagatgacgatgatgaccgtttgaatgggaatgcttgcttatgtaaactgaaacggtctagactggagttggcacgaaatgcggtgcttcctgtgattggcctgtccattctccattggattgcatggttggtctttgccaaaccataccgtttctcttctacaggcgcatacaaagcgtttgcttgtcatgggctagacacggcccatggaaacacgtccatggtctggatacggcccacgctgcggccctatacatctcaatggaccttgcggtggcgaagcaactcctcgacgagacttcacgccggccgccctgctcgtcgtcgccggcggcatctgcggcgcgcgcgcgtcatcctcatccccagctaagtggcctcaccgtcaccgagcgcccgcgtcggatcgcgtgcgggagagagcggg

SEQ ID NO: 3845 - DNA, 1501 bp, Oryza sativa
cataaaaattttgaataagacgaatggtcaaacatgtgagaaaaagttaatggcgtcatctattaaaaaacggaggtagtactatttatttttccttgcatcacgaaatccaagtcatacattcctatcctaaactgattgatcctagataacaatattcaatttcatctgcatgctccctccgtccaaaaaaaagacaaactctggtttccgtgtccaacgtttgaccgtccgtcttatttgaaaaaattatgaaaaaaaattaaaaagacaagtcacgcataaaatattaatcatgttttatcatctaacaacaatgaaaatacgaattataaaaaaaattcatataagacggacaatcaaagttggacacggaaacccagggtttgtctttttttgggacggagcgagtagaccgctaataatctgaccaattctggcacctaaatctttaccaatcacaccatgacatcacagaaagtcctccacttcttcccgtcttcctgtatgaacttgtgatgccacggaccagatgtgaacccttccaggaacagcaacctaacttcaatagttcaattaaaaagttacaattctggaaccaatatactttatcgtcataattcatacgattacacaactatacagaaaacaattatatcactttttagataatggaaaacagttatcactatatataccgtccaaccagatcaacaattaaagaattgggaagcgacatagtagcgacctgcaggtcgtcggagcacaccgttgacctagctccaggacagcaacatcacgctcagcaaaggcttgtgccattgaacggcaccaagtcatcgtccccatatttatgcatccaaaggaaaaacgatgaagcaataatcagaccaagaaatttttcctctcgatcttcttgccatggaattgcctgcagccaagaggcagttcagcaccaccagccagggcaaagaagtttcagggatcagttcttgcaagcctacttaccagagataccaatcatgccctcctgaggtctaccgtcgtcaggcttcctcttacagcgttccatcttcagagatcagcaggagctcggttcgcagcagcggctcgttcagggcggcggcgcagagtctcgccggagttttcagttgctttgtgcccaggaagtccagaaatgaggatgaacttgagatttctcggacgacgatttctcaagggagcagaagtacaggttaccaagtctcgattgatccaggtaagaactattcctctatcgaggaatttgcccagcaattctgccttctggtgccttccaattcttcagttcttggttgttttgctggttaagtagagtaaatttaattgcagattaactgtacttaggtcacctgttaaaaggggaaatatcaagcagcaaacaattagtgtgaaaaactgcaatttacttttattttagcactagataaacatgaatatcccccaccgtgtgaaaatcaga

SEQ ID NO: 3846 - DNA, 1501 bp, Oryza sativa
acgccaagagattaccccactgaatcaaacgcaaccaactccaaacactcgcaagagcaaccgaattcgtcaacccaaccgacaaaaaaaaacaaacaaaaaaaaacatcaaatcagcaacaggttgctagagcgagagagagagtgaaaaaaaaaatgggatcgttgatgagcgttcacacaaaaaccacccactggatcagacccatttcacagcgaattccagcaggatcaacagctccacgaccgcaaaccaaagcaggagaattagagacgcaaaccgagttccccccccccccaaaaaaaaaaaaaagatccccagaaaaaacgcagcaaaaccaggcccaaatgcagggcgccaccgcaacaaccccactccatcatcaacacgcgcacatccgaaaccagcaaccaaatccctcccccccccccccaaacccaacccaatgcgagagcgagagcaccataccaagcagcggcgacttgaagtgcggcggccaccagcacacggagagcttggagcagcgagctcccatggacgcctccctcctagatctcgccctcacctcacagcagcagcaacggctctctctccccggcgtactactactaccaccaccaccacctcctccaccgccaccgtctcggctgcttagctagctactggtaggactcgaatagactaatactactactactactacgcgaggaggggtgggagagaggaggagggggaggggggtggagtggcgtgtgtggggtggggggtgggggtgtttgggttgtggatccaaggaaggtggtgggctttccgctccctgctttctgctgttcttcctcctctccctttctccacctcctcccctttatatattgctcctgttttttaaatccttcctcttgatctaatagcctttagctgtgggttttttcttctccttttattaatgcttttgaatttgacttaaacatggtaaaatgataaaaaaagtctgtaagaaatcatataaaatgcatgtcttgtaaaccagtataatggtgggtccggtatattagagttaaactatgaatgtgcacggtatgttttagtttgaaaccgtttttgttatatgtgcatcatatttttttttagtagagtatttatagttcatttatagctctagaactgctacggtgctacccgtgtttcaatttttatctacacacgactgtttacgttgtcacactttgattgtgtttttttaaccgtgcgtaatgcttttgaataacgtggtttctagttactggtttgccataaccatacaatggtttctcaaattttgctttacatgtgtagaagacgaccaagtaatatgataatcaaattgctgaggataatccctagcccaaatttagatacaaaagtaatactagcttataatatattatcttgacagacgataattctgattaaaaacaactagtatttgtttaggataaatgaggatgattcttggcccaa

SEQ ID NO: 3847 - DNA, 1501 bp, Oryza sativa
taggacactaacattgcactatgttctttcttcatggtatttatacttgttgaacaataggactatgcgtggccttgatagcttagccatatatgatagcatagcctagcacatatttacttctaaacttagcccacaacatttttccaataagtgaagtaactatttggctgcgcctacctgtagtactgattttttttttgatctcattcacatgacttattttttgctgcagttaaacaatgcaatgcaaacctgcaattttcataacatttctgctttattaattccaggaaagctctccatctcctacagtacctactgcacgacaacaaggctgataggagtgttgctacagagcttggtcttccaaagctgatgatgcacctggcatcgagtgatgattctggagtccgggaggctgccttaggtggtcttctcgagctggcgcgggacaatacatccggtgctggaaacgtgctacctgaccaagacaagctgaaagatgtccttaagagccgaatcgaaggcatcagcacaatggatgccgacgatctctccgcacatcgtgaggagcgacagcttgtggactccctctggaaggagtgttacaacgagccgtcgtctctcagggagaagggtcttgttgtgcttcctggagaggatgcacctcaacagccaccaccggatgtcgttggcagcatgtttgagccgccgcttcgcgcttgggcagcatcaaggccacctcccaaagaagattcagagtctgagagcgccaagaaggatccaccattgctgctaggccctggaccgtcttcctagacttgttgggattgcttagtttttcgcttatgcaattctctagacttaaccttaaaaagatcctacatatttgcaatctgctgaaattctctgcattttaatcctgtcctgagctcttggatgtattgaggtttttggatatctgtaatctgtgatgctattaaaatacgaagatgaaagatacttatctcttccacgatttgattttgagtctctgtgaattcaatctttgtataatatgtgtcggtaatctgtagactggctgactggggattaatcagttctcacatggctttgcctatttattgtgagctaaggatggccgtccgatcctcactgctccaccagggccgcgtgatctgaacggtggtgatgctgtctgctccagttgaaggctcgctgcgagccattcaaaagcaattttttctttcaaccccatccacctccggactccggttgcgttgcgccatggcgctgcagcttcaggccgccactccgcatccccctcttcctctccgctcctcacgccgccgcttcgctgctccgccgtcgcctctcgttctccgcgccgtagcttcctcccgcgatggcccctccacgcgcctctcctctcctgcgcccgcgccgcctcgccgccggcggcgtgcgagcgtgagggcccgcgccggcgcgggcagag

SEQ ID NO: 3848 - DNA, 1501 bp, Oryza sativa
cacgatatgcttcactccagcagctttggctgttaaaacaagcaatgttcacttaacaaacatttacaaactgatacatgaatgatgaagaagaataagcaacaaccttaccagtgtcaatctgattcttttggccaatccaatccacctaacagaccacagcaagtattagcatgagctcagaagtttacaatcacattctatatattaactagaggggtttcaatcagccaacctgctcaggatacattccatcttcatagtaaaactcaggcctcccacctttgctagggtcaaaaccaggtttcatctttggcacagcactcgtgaggattatgagcgcatcgacaccttgaacagcaggcacaagatgatctctgtcccttatgtcggcaatgtaaacatcattgcctccaccaatcttttgtttgctttcctctgttctcactaaacctctcacaacaaactggtcagacctttccttgagcttgttgtagacaatgtttcctgacaagttacaaggagtaacccttgaggattagtacagactacatagtgtcgagcagtcagtatacatccatatagttgcaaaaaatcttaggcacatgcactcatattgggtgaattccgggtttggcgtgggttgctctgtggatacccattgacccacttcaattaatcgactaaatttcagttttccaagtccaaatagtatattcagttcattgagctaaactagaatgggttaatcagtacccaagaagccccactcgtgcctaagccctaggtgaattttacaaaccttgcaaattcaactcatcatatgactagcagccatgcgatacaaagtctcttatcctagagaagatcaagatactgcaacacattacatgaatcccattccgaccaaaattccttttcagaacgctctactggatccaaaattccccatcatataacaagcatgtactgtagatcgcacgaaccttgcacaacaggcaaattccaaattccgctgtcatcagtttgctccaatacccccccccccccccccccaaaaaaaaaaagaagtactggagagcgcgctactgggattcatatcgcagtcggaggccacagggaggacggaggagtacccacctgtgcggccgccggcgccggtgacgaggacggtggggcgggccgcgctcgagtccgccatggagatcgagacgaagacgaaggcgacgagttcacgaggaggaggatttgggaagcatcgagaaggtcgcggcggttcgagggggaggggtcgcgctcgcgcatgccaagagtgcgcgcggcggggaaggtggccacgtcacgctttgctcgcctcgtccggcccagcaaacaagctgcttgggtttcacttgtgtgttgggccgcgaagacgggctaaaaccctagcaatcccctccgcctccgtcgtcttcaccttcgccaccgtcaccgccgccgccgccggccggagaggaagcca

SEQ ID NO: 3849 - DNA, 1501 bp, Oryza sativa
ctgcaagtggggcgggtcgacccgttaggtccgtggcccgaacctaaatttgtggcaccaataggttttcgggccggcccatattttcttaggtgataatgggtccaggagtcagttgaccctaggggtttttgggtcggccttgttcgagcgctccacttgctcgcgttcaaatggcggcggcggctttagggctcccggcctgcggcggtgcggctccacggcggatcgagccggcggcggtggctcccagcggaggcggcagcggtgtcggcgcagctccaccgcggatcgaggtggcggcggcggcagcttcggcttcgcggtgtgctccaccgcgggttgaggcggcggcggctgggcgtgctccttcagtcctcctcccatctccaactccccccaagactggtactgtggttcacatcatagcaactagcaacggattctttggttcttgattttctttttattttctttggttcttgattctttagttcctcttctatgcagttccttctttcggcggcggatggaggcaccggcgggcggcggctacctgcttggtggccaaccggcgaggtgctccggaggacactccaccggcagcaacggcgagggtttcggaggacacccggccacatcgccaccttcttccagctgggtttctctaactcgtgagcacaagtatgatttcctccatgaaccctgtcttgttcatctgtcttgctcggttttggtttgatttgtatatatagtgtctcattcaggagaaagtttcagtgactgttatagctaggctttcatgccattttgctaggcccagatttgtatgccaggaaaaagtttcattttgctttcatgccattcaggagaaagtttcagttactgctaatttaaagtttcctactgccttgtgtaaaatagatggtcttttactttgtctctatataacctggattttctcaatattcaggatatactgaacgaaacactgaataagtagcatttttgcatgcttctgacaacatgctgttgtgcagatttttacaccaaaatttcctttccatacattatgtgatagaaaattattttagatggcaaatgatacatttgtgttgttcgttgctttgtttcaagtgaggaaatgcggacacccaacgcattttttggacttggcactaacagtggtgaagatattgagatgggtgatggtgatagtgactctgaacaagttggtcctgtagatgagcatgtgaatccagtaatacaagctttaacaaggaaattcagatctgaggcttggaaagagtttgtgccgatactcattgataatgaagttggtgcaggaaaatgtaagcactgtgatacagagatccgtgcaaagcgtggagcgggaacaagttcattgaggaagcatttgacaagatgcaagaagcgaattagtgctcttaagattgtgggaaatcttgactctacacttatgtctcctaatagtgtaagg

SEQ ID NO: 3850 - DNA, 1501 bp, Oryza sativa
tgtagctcgctgctcttctctctcattatttatctccttaaaatatgtttgtagctggcttatagcctgctattgtacctgctcttagggcgtttacaatgcatctttggaatttttttagtttctaatttttttttccaaaaatgtcacatgtaaaatctttgacacatgcatggcgtattaaatatagataaaaataaaaactaattgcacaatttgcatgaaaatcgcgagacgaatcttttgagcataattagtccatgattagccataaaatgctacaggaactcacatgtgctaatggcggcttaattagacacaaaagattcgtctcgcgattttcaagcgagttatgaaattaattttttcattcgagtccgaaaaccctttccgatatccggtcaaatatccgatgtgacacccaaaaaatttctttttgtgaaagacccttatgctctctcattttttgcaagcacatttttaaattgataaatgatgttctcttctaaagataagataattactttataaaatcatattaatatatttatttagttttttaagctaatatttaattaatcatacactaatctgttgctttgtttcacatggtaggaagaaggttctcaacagtcaaccccttttaaaaaaacacacccaagtactccagcacatacacttcacattctaaaaaatatatctaatacgatattgaaatttatagtactcctattaagatgtattatactcgctctatctcataagggcttttgcctggatgtgaacaatgaatctggacggtttttctgtccaactgtctagattcattgtattatctattcagattcattgtactagaatgtgtcacattcaatccaaaatcattatatttagagatagaggaagtactacctctatcccaaaatatactccctccgtttcaggttataagtcgtttgactttggttaaagttgaactattttaagttcgaccaaatttatacacaaatatagtaatatttacattactaaattagttttattaaattgataattaaatatatttttataataaaattatcttgggtcgaaaatattactattttttctataaatttggtcaaactgaagcagtttgactttgaccaaagtcaaaacgacttataacctgaaacgaagagagtagctatttctagcacaacatcttatcccaaaatgaaactatttcttcatctacctcctctcaaccaatcacaaccattctctttcacctaatttatcttttcaatcaatcacacaatttcttcaatcattcttacttacttccttaatacccgtgccaaccttaaaattatttatattttggatggaggaaatattctcttcgtcccattttaagtgcaactataagtttttgtgcccaactttaatcaactatcttatttaaaaattttctataattagtatttttattgttgtgagatgataaaatatggacagt

SEQ ID NO: 3851 - DNA, 1501 bp, Oryza sativa
ccaaccgatccaagcaatggcaactggcaagacaaggtgcgcctccttcacagtgtgggccacacggacgcggggcgcagaaggtcgcatcaggtttcccgcaccgaggcgcccgcccggacccacctcccaggtcccgcggctgctgcctcgcctcgcctttggcgggctcggacgcccacacgggtcaacgcctagaggtggaaaccaccttaaaacgatttttgctacttccgtttcacaaatgtaagtcattctagtatttcccacattaatattaatgctaataaatctagatgtaagtcattttaatatttctcacattaatattgatgctaatgaatctaaacatatatatctatctaaattcattaacatcaatatgaatatggaaaatgctagaatgacttacattgtgaaatggatggagtatatacttataggcaaattttttttaaaaaaaataatagacgtaaatattgtacaatactacaatcatagtgtaattatattgtgacatgtatataactataatataatgtaattcgtgcaagagagaaaataatcacaacccacacatgcgagggaattttaggtggtgttcttttcttctaaagataaagatgaagattaaattttttttatgcaaaacgaggtggtattaacgtatgcttggttgagttttaattattacacacttcaaaaatatattaatatgatattatagagcaacttttatttagaaagttttcgcacgaaacacaccgtttagcagtttgaaaagctttgcctcaaaaaatctttatcttcatctaactcttattggagaaatgaatgcgaccttagcaccattatacattcattttcacaaagaaaatatatcacctaggaatttttaaaagttacatataagttacgctataattacatatcaattttgttatatttacatactttctccgtcccaaaatataatgaaatcagataatcggatagaacatttcgtattgcgaatttggacagacagcccatatagattctacctccatctcaaatatatacgaccatgagtttctatacccaactttaatctcccgtcttatttgaattttttttatgattaatatttttatttttattacatgataaaacatgaataatactttatgtatgacttctatttttaaatttttccaaatatttttaaataaaacagataattaaaactggatacgaaaaattatagctttgcttaaaatgtgtattatattttgggagggagagagagagagagcaggagtatgtccaatatataggtagtcgcctagtccctcttaaaatattccggcatttcaaccccacccactccgcacccccgcaagtcaactctcttccttcctcctccgtgcttaatgctctccgcattataaccacccacctctcctcctccccccacctcctctctctctatctccatctccaccgctacgcttcccagcca

SEQ ID NO: 3852 - DNA, 1501 bp, Oryza sativa
aattcatgttcagtacacgcgaagtaatcatctcatatcaaacagaaaaaccctacatcacgacaggccaatcaaacaaaaatgcatcgaacgcaatggtgacatgcgaaatccccaacactactattctgaaccatagtcgcgagagaagaggatggatcgcgcgagggaagggggacctggagcgtgcgggtggcgaactcgacgccaatggtggacttggactcgaggcagaactcgttgcgggtgaatcgcgagaggatgttggacttgccgacgccggagtcgccgatgagcacgatcttgaagaggtagtcgtactcgttgtccacccggtgcgccatggccgaccaccaccacccctcgccgccgcccccctgcaccaccacacgcacagcccgagatccaaacccccaaacaacagcaacgtaagcagagatcccaagcaaagcaaccgcagaagaagcaagcaaccgatcgaaaccagcagaagaagaagaggagaatcgcagcgagcgagtggcgcgcacctcggattcgattcgagtcgagtcgagtcgagtagctgctgatctctcgcgggcgcggcgggatgggaggaggagagatttgggatgagaagaagaagaatgaagaaagggaaaccgaaacgggcggcgaagtgggcaatgtacagcgaggcagagaggcaatcagggagcaaaggattaattaatttcttaattgattattatattataagcagctaattattgggggattaaaaaaataaattgtaacagaggaatttcagggagccatcagggaattttgaatttaaactgtcctcctttggtagtttggttccgttgcatcagatctactattggttgctggcgaatttcacggttcaaataaagaattagtatccctcgtgtattgtcacgtttaacgtcggttgctaaatgggagtataatatttgtacttgctgtatgtgcacgaaataaagagttagaaagtgttttttttttctgttttgcatataattgcatgtgagtggttggtacttgacgaggtcgtgtacgcgactccccctgcacctgcaggctgcagctcgctgtttcgagttgaaatggtccggattttctggtaggtttgttgatccgaacgagttaaattcaaattggaaaattctactagcgcatatgaccatgctctttcacatgtggtttcacactctcacacctggcatgtcaacgatccaaaggtgtcaccggcagatgggctccactgacaatgcttttgagagttttgtctcgaacatgcatgaggcatgagaaaaaaagaagagagacgtatcattgtcaagatcagctggttggtttggacgaattcaaggtccaattggatttccatctcgtcatgggctcatggttcagtttgtagatcatctgctcagtttgaagcactctgttccacttcttttttaggtcgtctgaagaagaaaaggcaatccatata

SEQ ID NO: 3853 - DNA, 1501 bp, Oryza sativa
ggcgcccgtgtgggccggcttggccgtgcgcgggggcggtgctcgcagcgtggtggtggccccgagcaagacgaagacagcgggtggtggcgaagcagcagtggcgcgcgggtggtgctcgcacgggagatgtggccgcgcgcagtggcagcggccgagcgtggcgacgacttggtgcggcggcggagaggggagagaggtagctagcggcggtggggaatggcctgacgggaaggcctttttttgctgacgtggtgcaggggtatttacgtccgatcgcgtcaaaaaacggcctcccatccgccacgtcagcacggcaagattcctttagacgacacgatgtccatcggcaaatatccacgattatgggatgtcttcccctaaaacttcactttcgcggtgtccctgagctaaaaccacacaattacaatgtcctgtagcaaaatttgtcttttttcaaatgagacggacggtcaaacgttgggcacggatatccacggctgcacttattttgggacggaggtaatattttctttctttcttatataaaaaaacaaaccacataaaggaagtcgtgggcttaaaaatccacatcagtaacacactacataccttgtccacgaatacaaaaaatgattggaggtgtgaggtgagaaaattaaataaagagcggtggctaggagaaatagtttttgtgaatacttatatttgtatggcaaataaatattaaatgctaaaattctttatatatagtctatgaatctttatatgtgtaaataaattccaattattaggtatccttatatatacatatgatgtatttcaacttttttaaatgggaggtgtatttctactttgaacatgatgaattgagaaagttgcaataggggtcaaatctcttagatatttgtcatcccttaattattttccaaggatagtagttggcgatatttggtccaacgtttgtttgtagtaaaaagtaacggcaggagtacaaaaattaattaagtatggttggtaaaagctcattgaattgcatgcggctgatgaaaaaaacgtcaattttgtcacagatattttcacaccttaattactactagtattttacttaagcaagtcatctctaaagcagtgaaagactgaaagtagtgagcactagccactagcttgaagataaacacgccaagttaggccacagattatttttttttaaaaaaaaacacgccaataattagtgtagcaaaaaaaatccttgaattcccattaatgcgtcgccttcaaagattttttttggttagctagactaattatttccattttttcacaagattagactaattcaactaattcttttcatcgattcgcctttcacccaaaatcgatcgagctctcctttccctgattcgattcgttataggcccatcgatcttactaataaaatgattacaaatctaatcaacagcgaccactgactgaagccgcagtaatccggtcagtctgc

SEQ ID NO: 3854 - DNA, 1501 bp, Oryza sativa
aatgttcaacttgaccgtccgtcttatttgaaaaaattttatgattaattttttttgttattaaataataaaatacaaatagtattttatgtgtgactaatcttttttattttttttggtaaattttttaaataagacggacggtcaaacgttggacgcggaaacccacgactacaattaaattgggacaaagaaagaactacaccctacgtcccataaaaaaaaatctaagacagcatgcgacatattctagtatgatgatctggatatatgtatgtccagatttatagtactatgatgtgtcaaattcaatagtagattagtttttttgacggagggtgcagtgaattataatatgtgttggctccaacacatgaataggcattctcttttcacagcagcagatcagcatctccgcaagactgattggtaggggtgaaaacggatcagataatatccgatccgatatggtatgggctgcggatgcggatagtatgatgtggatgcggatatgatatctctaaaatccggcggatgcggattatccgacatttttgtcagattatccgataaaccgtttgccggataatccgaaattatcaacatatataaccactctatctattgcatataacataagttggtacatacaatgccttaattcatcaattaacatagatttttttggtctaaggcttttaccatctcatgtcacactcacatagctatattttttatattatggacatcatgtattcatgttgtagtacttaatcatataattattacaatgggtcatttattgattattgtattattgttccttatattgctaactcgatattgcattgattgtatatacatgtaacatccgataaatttaatccgtttccgaaccgattccacagtgactccgcaccatttccgacatccaaaacaatccgctccacatccatatccttatactatccacacccgcaccaaacccgcttaaaaaatatagtttaggatataatatgactactgtccgtccgaatccgctccgatttcacccttactgattggacggtcccgcgcataagcatgcgcacgaagtataaaaatcataaactgtgcttgcacaggaagatgcaactaacagtgaagtgatggcatcagctggcggcctggcgctctgtctgtgtgcgccacgtacgttatcgtcgaccgatcgatcacttctgacccattcaagctcaagccggcaggttagatctatattttccagccagatttcccaatttatttacatgtatgcactgacaccacaagttaactactccctctattccatatgatgagttgttttaatttttttctaattaaaatttaaggctacattaaatttataaaaaataacaacaacatttttaacccaaaataaacatattgtgaaaatatattcaatgctatatttaataaaattaatttgatattgctataacttttttttaaacatggt

SEQ ID NO: 3855 - DNA, 1501 bp, Oryza sativa
ggatgcagcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacaatgacccggccgcgaatggacggcgggcggcggcggcgagcggcggagcgaaccacggcgatacgggcaaaagctagcacaccgggcggttgttcgtgatgaggggagacgagccaacggctcggattcgccagagggagttcgacggcggcgaatcgcggcggcgacaaccggtggggagggaagagggaaacgccgacgaggtcacgagggaccgattcccggcggtgagagcatctacgcggtgtcgggaactcgatgctagcgtcggattggacggagctacgccgagcgaggctggcgacgtgtgggtgctacggagctcgagcggcgacggcggcgagcacacggcgagcgacggcaacggtcggggcggcgccggctaactacggggagtctacttgagctactaccgagcctctctccgacgaggagctcgccaattgttccgcgtcatatcgccagctctacggcatcgcaaagttcattgatcgcaagatgaacgattatgagcagctcctcatcgaccagtacgtcaaacagggctacgccgaggaggagaccgaggccaccgacgacgacgacgacgacgagtagccttgcaattaattgttgctcgttattggaacagtactagtagtattcttgcgcaaatgattgattacttaatttttccataatctgctttgttttatgttcggtttctgtcgattctcaattcccggtctgtgttcgtctccacagaaatccagcatctgctgcatattatgtctgtttttgctcatctattagtacgtaagagttgtcaagttgcagttatggtgatatatctcttctttttacatcaaaatcttcctcttttcattggttaccacctctcatgtctcctatgtcgatctaaacatttctctgttggctttcaacatgaatttgttttcctttgcacggcacccaaagccacgggcttcgttattttctccactcactacttgttcgtttagcaatttgttgttgattcgtggtaacaaggagagtttgtgaattgttgcatgcgctggactaaattatggacagtgctcaattcagtattcagcgctaacaaggaaccaacctgatggaccgaccttcctcttattttcttggataattcaactgtgacgatgacctctctgtagattcttttaattttcatcattggataattcaaccgtggtgatagattttcatcggagaattaaactgtggtggtgatcttcagctgtaaatttcaaagtcaaacaggcagaattttcagacacatttgttggaatggagtatatatttgttggagctgagcagaggcagcaatgg

SEQ ID NO: 3856 - DNA, 1501 bp, Oryza sativa
ctaggtactactcctagtagaaaggacgaggaagaggcagaagaggggttgccgaacaccgccgccgtccagctgggtctcccgccgtgcgattgctgggtggcgcggctggcgttggaaccgagagcgcgcccccgccggctggaacgaccaaagaggccccttcggtcgttcctccgtctccggtacccgattcgaggtatgccttctccaagccctatccccaacgcccgcgtgctcctcaatccatggtcaaattttggattttgcgcagcaaaggcccttccttccttttcgccaccggatgattattttagcctatcctaattaaggacaccttttacctcttcttctgcttcaatgccaaacaagggtttctttcttttgttttggaattattatcctgtaatgtgatgtaataaattcaatccaataaagttctgtgtagaatctagcccccaattataaattttgaatgctctgattctgataggaaaggacatgctgtggctcagaaaactcaaccctaattgcctccctgtaaacaaaaaaatctcgtcttgcagacctaaagcttcaacgaatttttggattgttcaccaagctgcttctttcatcttagttgccgcacattaatctgtttggcttcatctgtaatcctgtttctgcctttctgtttgacatgctgcttctgcgcgccttaaaagacatttttttccaaaagaagataatggcttttcgacgaactgaacgttctgagcatatcatttaactttattattactactttgcagttgtaactagtgcctataaggttgatcgttggattttactcaccagttatgtagattggatcaataagcctagataggtgtagttgcccagaagttaacacttagaatccccctttgttatacatatctagtattctgaatgagttcttctttttcttcttcgtactggttagtacagctaaacaaaatactttgtaagcagcatatatttattggctctatttttgtttcaggtttaccagtgaggggccatatggagttcagtggaggctagaagttcgcactgacattatcaaaagttctagcttgatttattaaccaactaaccagtatgtcccttcctccttatatcattgactgtgttttctcacattaatagacttgcttgtacatgaacttaggttacaaactaaagcatgagccatcatagccatcaattcttccagttgacacctgcacacccatttctattcgtatatatgttactaacatgcttcataatacacatcattgttgttttatctttagaaataataggaaagagttatgggtatatatataaaatgagcacaaggccacaaagcaacatcaaatatatcttttatactgtcttcatcatcacaagcagaacctctcatgtatgatgtattcataacataaaggttgttctagctgataacatcgtgtgaacttaatattgcagttca

SEQ ID NO: 3857 - DNA, 1501 bp, Oryza sativa
cccgcaccggcctccgccgacgacctgttcgacccgccgcaccagagcaagctggtggccaagatcgcgtacacggaccagttccggtgcctggacaaggccgccgtggtgacgccggagtcgagatcgagcccgtggcggctgtgcacggtgcagcaggtggaggaggtgaagtgcctggcgcggatcatcccggtgtggtcggcggggatcgtgtacttcatcgtggtaacgcagctgggcacgttcgtggtgctccaggcgctgcagatggaccggcggctgacgaggtggtgggcgttcgaggtgccggcggggtcgatggtggtgttcaacatgatggcgatgacggtgtggatcccggtgtacgaccgggtggtggtgccggcgctgcggcgggtgacggggaaggagggcgggatcagccagctgcagcgcatcggggtggggctggtgctgtcggtggcgacgatggtggtggcggcggcggtggagcagcggcggcgccggctgggcgcggtgggagtgaagatgtcgttcctgtggctggtgccgcagcaggtggcggcggggatgtcggaggcgttcgcggcgatcgggcagacggagctgtactacaggcagttcccggagaacatgaggagcgtggcgggggcgctcttcttcctggcgttcgcgctggccaactacgcgagcggcttcatggtggcggcggtgcaccggaccacggggtggctggcgcaggatctgaaccacgcccgcctcgacctcttctacctaaccgtcgcggccatcgcggcggccaacgtctgctacttcctcctctgcgcccgctggtacaggttcaagaacaccaccatcgccgaccacgtcgagctgccggattatcatcatcatcagcccggaaccgccaacaccatagcctccaaggtttaattaattttattatcacaatcgatcactctactgtagatggtagatagatttagaggtacgtcatcgatcgatgcatcaccatacacagtaggagtataatatctgtatgtatcagacgcaaaaacactataatctcttcttcctcctcactctcacgcgttccacggcaagccaatagcccaatactacgtacaatcgccttcctattttatgttaacaagaaaaatgttactaactcactttataggaaaaaaccggaaaataattctaaagcgaggagaaccataaaaacaactatatggagagaaaaacagagaaaaaaaactctgatggcatcaagtccaccactactgcaagcagatatttccaatggcttttcgtagacctgccacaaacgccaacagccaatctatctatctattatattattaaagaaatagaaaaaagagcctccacgttcgctctcatggcctagaaattctcacattaatcggagaaaaagaaaaagcagagtctatatagaaatacaatttaaaaataacgaaaattcggaattaaaaaaata

SEQ ID NO: 3858 - DNA, 1501 bp, Oryza sativa
attttaaacgtattgtatactaatttagtataggttgaccggcggttggtgtactaatattgcttgtttcaccggtgaaaaataacaggcaaaggtcgcaaccgtcacagcaacctatatatgaaatgaatgcatatatatatatatcgtggaaaatgttaagaaatgcactctataaactaaagtgagtggagtgaagtgacaagcagctagcccatgcgttggttcataaattaatattgcggccccgagggccacgagctgcggactccacacgaaaatgaaagtgatgcatgcatgatatctcactcagattcagaatgcatgcatggcagctaacctagctaagaaattaatctttctttaatttagacaacaaaagaaagagtgaaggagctgaacaaaacaaagaaaacgatcgaggagcaatatttgcagtgacaaagaaaatccaaggtggttgttaattaagaaagtggaaactacatataattgaagagagatcatatctagtggtaggaaggaattgaaggtcgccataagcaggcagttggttagttggggatacgtacaggtacacacacttccttccttgaatcatgcaagtatggcaactacagatgtacctctgcttccgggaaaaaacgagcaattgccaggtcaatcagcaattacaatcgcaaatatatgaaagcattgaattgatgtcaaatggattagcaagtcatcaggatcggagtacagtagcagtatgtaatgggtagttaatcatcatacatatgtgtcaacgttgtcatctcacattaacatcctgcaaatatggagggtttgcctctgtcctattttaagtgcagttgatcttatttaaatttttttattaatatttttattattattggatgataaaatatgactagtattctatgtgtggcttattttttaaaatttgtttataaattttttaaataagacgaacggtcaaatattaaaaaaaaacccacaatcatacttaaaattagactgatggaacagcatcttgttggctacgccctcctactcctgccggccttcaattatttgtccatgagttcctgagtagcattgctaaattactgttactcctctactgtaggtagatcctctgctcgtctattcattcccattcatgtcatgcccccataaatacttgtatacgtacgtacgtacgtggcacactcgtatacatacatatacgtacgcacgcatatatcatacgtgaaattatttggatttggaggtgagatatactagtccagtaggtttgtaagtttgtagttgtagtatataaatggcaggtggaggcagggatgagccggcgcccggccggccggagacctcttcttcttcatccatcctttctttctttctttctttcctaggcctaatcttacataaattattcacacggacaaatctagctaagcacaaggtatgccgccggcgccgtcgcaggagcaaacta

SEQ ID NO: 3859 - DNA, 1501 bp, Oryza sativa
gggttcggagattaaaacgacgaccctttgtttcttgttttttaacggcacattttctactatatattctctttattttttctcatgttccttgctttcaatcgccttgaatgaactattactagtttatgcaattatgaccggagcaatgaaccttgagtgaactagtattattttctttaccttttttttccttctatcttaatactaacatgcatttggatattgtctgggtaaaagaccgtatcaatggccatgtattaatggaaaattattgcaagcaaaatgagagtagcttgtgattggcttgtcttttttatgggctggacctggacaaatgtgatggatgatgcagaaaggtcaaacaatgattaacctggacaaatgaagagaaaatactgaggataaggcttacatgagcagcatcgataggttctgcgattaaaacgccgacccctctggatcttatgcagttttgttttgttttgtttgtccttatatatatgttcctcgcatgacgaaacacttacaagcagatagtcactggcagtgagctagcgatattcactgatatcttagttggcctttggtaaaatacttgtactaaaattgttcagctaaatattaagtgtgccaaggctgctagcctttaaagcctactgcccaattaccgttgatactcaatgaggttacgaaccgggactaaaaacgatttctccaccagtgttatttcgtcttaaaggatttagctcgatagatagcgacaataacttccatttattactagccacgtagttatgttttgcgtgacttttaatcccgtttaacaagttctgtatctgatctattagtttatctcagcttttaagaaagttataacattagcacagtatcaattagtctagcaaattataaatttagctaagttatacttatagatatatgagagaaatcactataaacctctttttttttcattatcttcgtctcctctctctttatatcatctgtccagtagacagcagaaacctctagagatacatgttcagcctatttatgattttttattatctatatacccttttatccaactatcagtaatttcttttgcgagaaatgctcagtattgtttacacaaactttctattcggctcatatggttttggtaaaattggttatataacattaaaagttcacgttttttttatagcaccaaaaaataccggttcactttagtagttatccgttctaatttttaacacttccgtcaattctcgatcatttttcatccgccttgatcgctattgatctagccacacacgcgatataatatttttactcacaagcacaggtagaatgcagaatgcatggcaataagagataaaaacgtcgtatcttgaaaaaaaaaagtttattactactctactttcacgcgcgttcgacatcacactacactgctgcctggaatcatggcgcatggagccaaatcccaaccttttgt

SEQ ID NO: 3860 - DNA, 1501 bp, Oryza sativa
gccgcgcgaccagtccacccacgtcacgctccggttcgcgatccgccccgccgcctcgatggacagcaccgtcggcaggtagtgctcgtccacgtagcacggcggccggcacagctcccggaacctcgggtagtaccgctcgtcgccgacgacgaacacggccagcgaccggtccacctcgaaccactgcgcgcccttgcgccactgctccggcgacacctccggcgccagccccgccctgtagcggccgcggccgtgcgggcccgggtcgtcgaaggcgccgacgaagctgtggcgggaggcggtcaggtagccgtacaccgccgggaagccgtgcagcggcacgcacgactcggagacgagcacgaagcgctcgttgccgccgtccagcagcgcgttcgccagcagccgccgctccgcgtcgaacatgttcgtctgcccccattgcgccacctgcacacccatttcaatttccaatccatttcatacactcttcaggtttgcttctggaattattgtttcagagatgctgacgatggatgagaaaacgagatgaaatttgtttctagctaattgtatgtagcctgtacaagtgtgattgaatattcttatttttttttgggattattaaggagggagacttttacaccatgtcattttcacccttgcattcgtggcgcactgcacttgccaagatgccacggaagctgaacattcatctggacacgaacccgactcaacgctctccaaattccccccaatcttttaatttaattgagaaatgaaaaaaatcatctcgcatttgaaacggaaactaatcaaatttgatatgagatttgagtttgtagtacctggctgggcacctggcggcggtagaagacggaggttgtcgggaagtcggggttgtatccgggcgtggagtggacatagatggagaagagctcccggccgccgctgccattgaagaacctctcccagagcggcgccaatggcagcggcccacgcgtgaggaacatgaacgccaccttgggcacccgccggtacggataccgccgcacccgcggctccatcgacgccgcccagagcagctcctcgtcgctcatgttgtgccaggcgctcgccgccggtagccgcgtccaccgctccagcgccgcccgcccgccgtcctcctgctgctgcgcgcaccgcggctgctgctgccacgccgttgccgagaggacgttggggacgtaggaggcgccagcgccgccgccgaggaggaggagggcggctgcggcggcggcgaggaagccggtggcgagcacggcgaagatgaggaacggcttgaggagcttgagggggaggaggctcctcgacggcggcctcgccatgttgccgaagctgtccttgccattgccgccgttcactgtcaccaccatcgctacccctccttgcatgctgtccatggcaacatccaagaacaagacatcttattgaaaaatgaaaaatcctactagtaaac

SEQ ID NO: 3861 - DNA, 1501 bp, Oryza sativa
ggatgaattgcagtggcgcgctcggtgcccggtgcgaaaacaggtgaaacagcgcggggggtcgcggcacgccgatgcccggtggtcgcgggctagacagacgaagcaacgtcccctggttctagccttgaactcctccaaggagagggcggctctccttccagcgccgtcttctcgccttgaatcgggccgttggccatggattgaatgccctttctctctccaccagcgccgaggtttgacctctgtccatcctggctcggccggcgtgaatgcggggcgtggcgtcgtacgcctatgagggaggatgtccctcctctctctcggagccagctcgtaggcgcggcggtaggcgtcgcgtcgcggcgaaggcacagtaaagacggactttaatgtgggacgcggcggtggttggggagcaagccgactggagctggctcccggagacctgcgtaccgcatcgacgaaggagcgtgggggcactgtggactcggagacgtgggtagtgctgtcttgagccaggcggacaccggacgctggtggaggaggcggtggcggcgagatttcccagaacatgccggcgctcggtcttggcgaaccggaggacagtgctggggcggccgacggccaggaggccgccgagaggggcgtcgggatctgcgggcgacggaggagcatgggcgccaccggctggggcgccgacggcggcggaggtggagtgctcgctagcatttcaaaaaaaacccttctatctttcttttcattttaatttgtaagtgaatcatcctgcccctttttctcaattgcaagtaccaaattaatttctttttctctttgaagtatatgtactttcagagttgtaagcaatccgaattacatgaagaccttgttcttttcttattatgtattctggatttttgtttacacgctttgcaagtttttctaaacggtatgtttgtgtaaaaaaaaaattctaaaaattttattagaatactatttaaaacaactttgttaacataagaattcagattatattactcaattttagttatcagattaaaaggagtactaaaagaaattaagattattcattaattttagctatcctaaatgtacaactaagagtgtttggtcctggcaacaaccaaacacgtaaggaaggaggagcaaaagagcacgcgaatcgtgcctctagaaacccaaaacagcgagcctaattttagccgctccggtcccttctcctgacgtttttttaaagaaaaggatgaaaatttagagagagtctcctgtcaaactcaccctttttttatgcaaaaggccatctagaactctaattataaatcaataaattcgtcaaagaaaatcaaaaatcagaaacgagagcttgagctgaccgacaaattcatccgaatccaataaataaactcgaggctatatatatacacacacggacgaatccctttccatccacccgaccacacgccgacgccgacgccgacga

SEQ ID NO: 3862 - DNA, 1501 bp, Oryza sativa
tgccgagccaacccagtgcgtgaagggcgttcatgccgaggaagcttgtgttagccacagtcgcctcgatccctttgccgtcctcgtccagctcctttgcaatcccttcacaaaccaagaagaaaagggagacattttaggaacataacgaaactttcgagctgtatatacacgaagttgcaatctttgggtggttttgtacccagattttagtccaaaattagagaagagcacccccccacccccaccccccaagaatccgtggcacaaacagatcaacatcataccagaagaatccagcgcaagcacccacacatgaaaaccccgcagccatgttcagcaagaaattcgtaccaaatgcgatgcagaagcagaacccaaaggggggaaagaaaatgggttcttggatgtggcttactcttcatttcgcggacgtccccgtagtgggcggcgacgaggaacgcggccccgcgcggccaggcgtctcgatctgcacggatggagcaatggaaaagatgagattattaagaacaaactgaaacaaacgatcgatcgctagggtttagggagggaggatgagggaatggatggatggatcacctctgccgaggaggagctcgaaggcctgaggcagcgccatgtccaggtcgtccatcaccctcaccggagctaccggaggaagcttcgaatgcgatcgattgggagaaggaggaggaggagaagaaggaaggaaacgaaaccgaggaggagaagagagagaggagatggggaataaaaagggcgggaaagagagcagaggggcgcaggcgagggacccaatgggtgctcgacacgtgcccctccgctctgacactccttcagtctcgcctcggcttttcgtttcatcagtagctttcgagttacgctacctaccatacggatacggagttatgaattttgaattcgaattttgctacctcacctcattactaaagaaatacatttagtaaaaatgccgttgtattgtaatttcatactactccggtcaaacaagtcaaaaccctgttcaaatctcaatgtatcagaaattcaggattcagaaagtctcatcaaatagattctactattacagatagtgaacacaaactcagccaccatttcccacagctacttggcattaaacagttttttgagtcttcggaaaaaacttcttggaaaaagaaatgcagtatacaactaacacactcgtattcattatttaaccaaaggtacaatggacagttaaaacacattctgaaagctagtagagataagttgacagaaagacaccacaaaacacagatatgatatcagtgcgatagtctttagtacaagccatagaggaatacatttgtgctccaaacaattgcatagcctgctcattctgagcatcatcatatcaaaaacacaatataagtatcattgctctagttcattcagacagagcttccatgttattcatgaaccacagtacacatatgct

SEQ ID NO: 3863 - DNA, 1501 bp, Oryza sativa
cagggagcgcctgacaagcgcgcccccatgccgcccctccccctgctccacagttgccgagaagcagagcttctgccaccgccgccgccacccactggtgttatggcgcaattgggtgacccggagacgcgccccctcgaggatgtcgtctttatcccgacgtcgcatgccatcgatgcatagctgtgcgagtgggagagcacggccacggtcacttgggcgatgccccccccccccccccccgcgtctgccactgccaaagacgtcgagcgcgtcattgccgacgagttcggcctacgcgcaggagagcttgctgtgtcactccactatccggaggccttcctcctcaagttcaagcaccgccggcattgcgaggaggtggtaaagcagggcttcgccaagggccgaggtattgaggtctacttcatccaatggcgcagccgaacatgcacctaagaatcggtggaaaccgacctcgtccaccctgttgacgccggcgacacgagggtgatctcgctctgggcatggactccaaacccgagccgcatccacaagcgcgtgtgggtgacaatcacgcgccaaacccgtgatccactcctcgagtcgatcacgatctcggagacgctgccggagcattggcaacaagaggtcaagcacccggttctcttccatattgaggagatccacgactacaccgcggcggctgtcgacctccgcaacccgaagtcctgcaggccggcgacgcgcaccctgccgccgtggcacctaggggttcttgacggcgagcgagccccgccgcgcctcttcgagaacttcccctaccacccgcatccgccgcggaccttcaccttccgccaaggtcgcgcggagggcgtggagaacaacaccgccgccttccagagggaggttcgcgaccaaggtagcagaacggtgagggacgccattggccgagacggcggaagaaggcaagagaaggggcaccgcgacaggcgccgggatgaccgcgatgaccgtcgcgggcgcaacaggaggtataacagcgaccacccagatgacctccgacgtggaggacggcgcgacgacgacaatgatgatcgcgacaacgggggacgtgatgtcgcgcacggaaggggcggcgttcgcggcccagacgtcaacttcaggcgggaacgcacgcactcgccgcgtgcccgcgatcgcggcgacacgggaagacgcgacgggcaacgccatcaagcaaactgcggcggcaaggacgacggggccaacgaccgcgacatgggcaacccacccccagcggtcctcaaccctgtcatgatggcaccggcgcgggtcatccagccgagtttgcccccacgcaacaaggggcctctcctcccgctgcgacgccctcgcgtcgaaaaggggaatgaagcccggtccgccgcgacgatcccggcggcgcgggtcttcacccgcatcaacgaggagatcactgccgcctcggtggagggggcattgc

SEQ ID NO: 3864 - DNA, 1501 bp, Oryza sativa
aggaaggaaaccacgatcgattagttgacacagaaaaactttctactacagtagaatgaacgcaatccgcgtatatagatcgaccaatgatacacacacagcatatgaatcctttccaaaatgaaaaaaaagagagaaagaaatactaagtccagaagaagaatacggtacgatgggcctaatggaagcccattgagaacacacacaacatctgttgggccttcacaagatagattgtcggcccaatacttttgcaaacaaaagcaggtggccgcataattaatttttttactattaggagtactatagtagttacggtaaaattaaaagagttatataaaattagtgagaaaaaaagaaaaagattagagggggacccacccacccatgcgggacccgatcccctcgcccgcctcgaaccttctccgccttcctcttcctcttcgtcttcctctgcggcgcacgcaggcggcgaatcctcctccgtcgacgcgactcctcctccgccgcccgccggtgagtcatccgcctctatcctctctacctcctcgcgagcttgatttgctcggcctcacgtacgtaccctctgcgcgattaagattcttcctactttccagattagattagattagagcagctagatcggatcgcccgcagcggatctccccctccatggatttctcttcttccactcttactgctgccctggttggctgctgcacttcaactgctgtgctgctgctgctgcccatcaccgatccctttaacctagtttgtttctgcccatgcgtgcgggggttactgttcatcgattcgagttgcttgcttctgccgcttcatattcagatcgatctctataggaaacgatgtctagaactaagccccggttcatgtttgcatttatcaggaaccagcagccagtttacatcattttctcttcttcttgtcgtactagagacatgcttcaatcttctcagctagactagattagacttggtctgaatcccaatacctgcattccataccacacacaacggccaaaatgtaaaccgcttctcaacttccaaatcatccatcatagtcagcggttttaatatttcgacacgccgaacctcttcctgcatatccacaccttaaatatagaaaattgtcacaaccaactttcatgtccatatcatagaaatgatattccagataaacgctaggaagttcagtcacagctacataatactaactcaagagaacaaatgacgaatacttcagtttctttgcaaagcagacatgttaaatcctcaagttgctgaactacggtttttttttttatttttgctctaattcttttccattttctttccctgttttagcacacaaaagtggtgcccctgccctagattataataattttgcactccaaaagagttggaactacaattgtacgttccatcatgccaactctgtgttgctgacgagcgtaccaatttcctccattgcagctcatctc

SEQ ID NO: 3865 - DNA, 1501 bp, Oryza sativa
ctggaaatgttcaaagttcgtcattcctttttcattagtacatcttgaaagattgattcgttctccgtattataaatcctcgaattgctaattaatccacagcatcactgtctacactgtgactaaatcctatggctgtacagttgcttggtatgaacggtatgagattcttggctctagctaagtagttactagtagttagtcgtgcaactagctacaaaaagatggtaactgtccaacctaatcagaagcttcttcgattataataagcacttatgcccatttaatttaagtttttattttgatatgcattgttgcagtatttgataaaggatcacgaggtgtcgaaattttagtgctaatttccacaacgcgagaaattcgagttgtctttagcagattgaattgagagttatttgaatcaataattttgtaaacacttcatacatcaagaaattattcttttatttgctaaaatgtactccatccattctaaaatataagacatagttaaacttgacatgatgtcttcaaaactactatttgactttcagtttctcacataatataatgttcgtagcaacaaattaaatcataactataaaaagctagtacattcaaatatcaatccaataacattgtttttatttatcaaataaattaaatttatatttgactaattgtttttcaaatattatgagagttgaatcttaaaatgcattgacatcttataagttgcactaagggagtaatttgggttgcatgtctcagttggaagaaatgagtagcacacctctaccaagtcaatcaatattatctgcctttgacttggtagaatgtcaatttcccatatatgtgcattgcctctgaataaactgagactctaattaaggtgttcaacggcctcccacaactctgaaaaccacgtgctacatatatattcaggcctaccactagtatatataacaatgtgataattttacttcgaaataaattaatccttcctgtatttaatttgctgtggcgagatcgaaataaagtatcgtcgtcactgaagaaaaatctcctgattcgacatataattgagttgagcaagtcatcagaggtacgacgatttatctgcagagacccatagggagagagagggttcaactcgattgacttagactcagcttgctcagacaaaaatttccagcatcttattattatcccaggctatagctttgtctagtataattaatcatcaaatgtgttctaatatggtcaaatatagcacattaatttattaatacagcagccatggccatacttctccatcaccatatgtaagcaactatgtatagctaacactaaacctcatacactatatataactagctgtatataggatcaaacaagttattatagctctgtccaattaagctagctagctagctactacaagattaagccatggaggaggagaagaggttggaaaggattattaaggagattgacagtc

SEQ ID NO: 3866 - DNA, 1501 bp, Oryza sativa
aaagttatacttaaagtacggtagataataaagtaagtcacaaataaaataaataataatttcaaaaaattttgaataagacgagtggtcaaacgttgcaagaaaaactcaaaatcccttatattatgggacggagggagtaaattttatcttagattaaaataattcgacctcattagcatttttttaaccgcgccgatctaacttttggtcaaatgacgagatcgagtgctccctgtcgatagaaacacgttttccccttaatttgtttttatatttcaattgacagttttagtttgtttaatggttcatttgttacgggtccgtcaagaaacacgtagcagtgagtacgtctaatggtacgcggtgacacttgcagacttgcagtccactttgtcaagtttcctttttgacttttcacttcgatcaggaattgaagcaactatagttattaaactatattaaaatgtcatagtacaattaaattatactacctccattttaatgtatgacgccgttgactttttgtccaacgtttgactatttgttttatttagaaaatttatgtaattattatttattttattgtgacttgatttatcatcaaatgttctttaagtatgacataaatatttttatatttacacaaaaaatttgaataaaacgaatagtcaaacttgttaaaaaaagtcaacgacgacatacgggagtatattccaaggacaaacattggcctggtcacgcatatcttaaccatatatatacgtagcattatccgtgtggaccgtgtccatcggcatgtggcaattaattgaaagataataacgaccaaactacggttagctaaggagcataattagtttactccactcactcaataatcaggtccattaattaattaattaactccaagagatcggaggtagtatatccatggattcatggattaattgattgatcatgtgtggttgatgtggatgatcagttgtgtgtacgtacgcatacagagcatgtgaatttcatttaattaagtcgcttgactaaatatttggatggtcaactgcatgtgttatgtaacacaagactgaaaacagtattactttgtttctagtaggtggccatcgaggaagagagaggggctagctggttgattttcgtgtttgtggggcttatatgtggcttccacttatattttatattatttttttaatgtcacttaggtaggtgggaacgtccaacagattagttatgccataatcaatgattgaggcagttatatgattgaactataaatacgatatatgttatgtttgattgcttttatcgagtgaacatttttgttcttcgtcccatctgtattttaaagatgcgtccgcatgtctcatagttgaggaggataaaataaactttttcatacaaacgaagcatttgataacagatgtttgtcagggttacgggttaggcataccctttacccttcgatatacgttacatatcggta

SEQ ID NO: 3867 - DNA, 1501 bp, Oryza sativa
ataagcgaccatttttacttgaccaaggctgtttatgtgagtgtattgtgctgtggttggttacttctctaagtttttttttggtttagtttgcttcttaaaagaaaaatgctccttcgtttttaattttctttcttactaatcaacgttaaatattactagaagatagagtagtagatgacagtggcggcacctgtttacaatattatcgtcaagtttttgtttttaaaagtataatttatttgcttttaaatatgagtacccgtgctaagtcttactaaaattctgtggattggtttcaaccagggtttcccaaaccgtcggggccggggttactgtgccccaacggtaagcacggttaccgcgcggtaaccgcggtaaccgtgaaaaaccgtacaaaattcatcaaaaattcaaattattttttaaatttatttgaatttaatgaggttaccgcggtatttacattaccgtacccccgtggtaagcccggtaaccgcggtaaccgcgcggttaccggcggtacggtgaaccctggtttcaaccactggaatcctaagctaaagctattcacagtttcacactcattcacctcgtttgattgcacattatgtccttggagttcttcaacatagcatgcctgtacaatgcaatttcttttcctcccagccttggaaaacaaacaaacaaataaataaatacaaaaaggtcaagaatggctgaatttttccgtaataagtttgaatatcccattgatgcaaaatcacaccaattaactttgaatataatcatgtcgtgtgtaccataactttatcaatagcaaatgaatgatcaactttaaccagcgcatcacaatccacatcgattggttacttacgactgattagcgactaaaaatgatttataggtaaaacttttgcacatgtattttagcgacttaaatccaaactaagaaaactacgttgaaaaaacatcaaaattatgttttagtgcatattttggtatcggtttataagtcatagggcaaacgacgagaaacccccccccccctcttttacaaataataccttgtacttgctaccaaagcacatcacttgagtgaaaacggtcggaattagtagcatctctttaaaaacgatactcgatcggtcggtaattgactatatttatcatttaaactattcaatgtcaatattaatacaatacataaagaaattaaaaaacaaaaaatataaatagccaaaaacgatatggtcggaataacctttttcaaactatgagccaatagaggcagagactggagacacgtaatccagaaatccgcctccctagtagcgtagacgtaatcgaaacaagccgtcggagagaaagagaaatattcgccaccggctgcaggcggcggcggcggctgaacccctaaacccaatgtcgccggcggcgaggagcctcctgctatcggccgcccgccgtcaacgccgccgcttctcgacggaggccccgt

SEQ ID NO: 3868 - DNA, 1501 bp, Oryza sativa
tcaaccacacatgatcaatcaattaatccatgaatccatggatatactacctccgatctcttggagttaattaattaattaatggacctgattattgagtgagtggagtaaactaattatgctccttagctaaccgtagtttggtcgttattatctttcaattaattgccacatgccgatggacacggtccacacggataatgctacgtatatatatggttaagatatgcgtgaccaggccaatgtttgtccttggaatatactcccgtatgtcgtcgttgactttttttaacaagtttgactattcgttttattcaaattttttgtgtaaatataaaaatatttatgtcatacttaaagaacatttgatgataaatcaagtcacaataaaataaataataattacataaattttctaaataaaacaaatagtcaaacgttggacaaaaagtcaacggcgtcatacattaaaatggaggtagtataatttaattgtactatgacattttaatatagtttaataactatagttgcttcaattcctgatcgaagtgaaaagtcaaaaaggaaacttgacaaagtggactgcaagtctgcaagtgtcaccgcgtaccattagacgtactcactgctacgtgtttcttgacggacccgtaacaaatgaaccattaaacaaactaaaactgtcaattgaaatataaaaacaaattaaggggaaaacgtgtttctatcgacagggagcactcgatctcgtcatttgaccaaaagttagatcggcgcggttaaaaaaatgctaatgaggtcgaattattttaatctaagataaaatttactccctccgtcccataatataagggattttgagtttttcttgcaacgtttgaccactcgtcttattcaaaattttttgaaattattatttattttatttgtgacttactttattatctaccgtactttaagtataacttttcgttttttatatttgcaaaaataattggaataaaatgagtggtcaaacgttacaaacagaaactcaaaatcccttatattgtgggacggagggagtaccaattaacgttaattgataagaaaattaattttgtcctaataatattgtggttcagtttaatttcacatcgtatgaccacagtgataaaatctactagtgtcttaatagagtagagtagtacatatttatctattgcaatatatgcttattggtggacttggaccatcgctctaataatttaaactagtgatagagcttagcctgatcatacaaccacacctcaaacttcaccaccaccggcgtgtgggagtctcttttagcgtgtgaatggcttttgttgagtgttgagctcggtcgtcctgttcttgacttctcgtctacttacttggtagcttagattagttggtggaatgtatgagtatgatagttgtgtggtttttaccccgttttcgctaattaattctgtatttatggcatgatcatgttatc

SEQ ID NO: 3869 - DNA, 1501 bp, Oryza sativa
tgccgaaagcaacctctcctagtgtactatatatatatatatatatatatatatatatatatatatatatatatatatatatatattctcttgtaataaatctatcatttagttattatgcttttaatataaaagttgtttggaaaagaatcttgcaataatgtcactactctagtcatgagttatagaatatatatggatggatatgaatatatattcttctacaaattttagatatgattttgtggatctggtgcgtgcaatgatagatggtgatacaaaattccactttgtttaatctaaaaggaggttccactttattttctataaaagcccctaacaaagaaaacaacaatgattatcttgactgaaatgatatggattaccatgtttaaagtggatcctttttctatacaaagtattattgatatctaaacaagaacatatatacttaaaaactcaaaagctaggctatccacaaatatttttatgagtagagtctatccacatatttttttcgctaaaaggaaatggaaaatgccataacagattttaagaaaactagcaataaaatgtgaatttttcccattaaatagtaaatacaacataaattccatcgctagccaaaacgatacaataagatttgctcatttacttggaaaaaatcctctccaccaaagtgaaaggtgaataaaacctttcaagtatgtggttgtggttagcattgctaaagaaagaaacacatagtcatcaaaattgatcccccatccacataaaaagtgcacaagaaagggatgctcatgagctaaagtgaaaatacacacgagtgcgtgctttacaaagaatatgaacattgcgtgcaagaaacgttacaaatgaaatggtgagacaaaatgtgctccgtgcatacgtggtggtgactcacattcgtatgaatacggacaaacaaattcatgcttcgtgtatatatactagttgcaaacgtatcggcatgtaagtaaattaagtgtacgtgcttagcctaacttagtaagttaaccacactaaaaaaaaatgtatacgctataagcgtgcgtgacacattgctacgcacgcaaaaccaaaagaaaaggaaaaaaaacactactccacgtcatgtagcaaaagggcggaattctttccattatctttagaaaaggaaaatatcatgtacagtatactactagtggtgtagatacttggcgtgagcgtagcaaaaacacaaagacaacttgaccccccgtatattccaaaggcacccacctcatatccttatcctgcgcccctcaccccccaccgtcggatgcgatctggacggccacggattcccctgagccggctataaatcccacctgaggtgcagccttcttccccgtggtctctcagaggtgggttggcttctcctccccctcccggttcggttcggttcgggtccggttcgatttcgtttttttttcttcttcgtggggttggtgggaaagca

SEQ ID NO: 3870 - DNA, 1501 bp, Oryza sativa
aaaacactactccacgtcatgtagcaaaagggcggaattctttccattatctttagaaaaggaaaatatcatgtacagtatactactagtggtgtagatacttggcgtgagcgtagcaaaaacacaaagacaacttgaccccccgtatattccaaaggcacccacctcatatccttatcctgcgcccctcaccccccaccgtcggatgcgatctggacggccacggattcccctgagccggctataaatcccacctgaggtgcagccttcttccccgtggtctctcagaggtgggttggcttctcctccccctcccggttcggttcggttcgggtccggttcgatttcgtttttttttcttcttcgtggggttggtgggaaagcatggcggcgccggatgttgagtaccgctgcttcgtcggcggcctcgcctgggccaccgacgaccgctccctcgaagccgccttctccaccttcggcgagatcctcgagtccaaggtccgatggattgattccctcttctctgtgtttttttggatgtgatttggtggtggtgttcttcagatctggttgcgtagatctgactatgggggttgtggtatgcggtgcagatcatcaacgatcgggagacggggaggtcgcgcgggttcgggttcgtgacgttctcgagcgagcaggccatgcgcgacgccatcgaggggatgaacggcaaggagctcgacggccgcaacatcaccgtcaacgaggcccagtcgcgccgctccggaggcggaggcggaggcggctacggccagcgcggcggaggcggaggctacggtggcggcggcggctacggtggtggcggcggcggtggctacggccagcgccgtgaaggcggctacggcggtggcggcggctacggtggcggccgtggcggcggcggcggctacggcggtggctacggcagccgcggcggcggcaactccgacgggaactggaggaactgagcggtggggccctcatggccaagttatctatctatctaatcgagctaccatcatcatcatccgatcgttatcatcgttagttttgtgtggaactactatctagtttgtgttactgtgtggttgcccatctgtgtttttgatcgcaagaagaaagctcgtctcgtgtttgctttgatcaaatgaaatgaatgaatgaatcttagtgtgctccgctctcgtcaaatccatcgaattatttaatttgtcatggttgtgaatcatgggggttgatactatttgttgttgatgctagtgcaaatgatcatcatcatcacgatttgatgatttgctaagcataagcagcatcattagctaccactcacactgactgtgatgaagctgtgaactcacactgatgctactactgaagcgtttgtctgatttccttacgattggatttgttgctaaacagcatcgttagctagcagcggtgacagtgatgagcagtgatgctgctggactagagatctgctgat

SEQ ID NO: 3871 - DNA, 1501 bp, Oryza sativa
ccaaattctcgccatctgcatcatcttggataagccccgagccattcggttgctcgctcgtccccttaaacgtgccgccccgccgttgctctgcttcgccgccgccgcacccgcctgtgagccgccgtgggccctctcgccaatacctcgcgccaccaccgtccttgagctccctaggacctccccaaaccattccctagcgccgtcgccgcccagcacagcctcgccgccattgccgtccgctcccgaaggccgctgctcgtcgccagccctcctcagtgattctccgccccatccgacaccggaaacggattccttgaaccccggagatgctccaccccctttgaatcgaaccctcatcgtctcgtcgtgattcccctctttgctcgccggcgattgccgccgccacaatccgccggattccggccatcctccggcgaatccgagccgtcggctcgcttcgtctcgtctctccccttcccccggtgtgcttcctttttccattgaggtcgcgccttgctcctgcgaacgccgccgccgtccgccgtccatcccggccggcctcgtcttcgtccttccgccgacccgcgtggctgccgccacgtcggcgccacctcggcacgaccgagtcaacagacccggtcggcccctcccttccgtttccccctccgtgcgcgcggaccacggtgtgccatgcggctgcacgtgggcccgccgcgcctcgatccatccggtgcacccaaaaccctagcgcccgccccgcgtgcgccgcttccaccgtgcaccgtctcgccgacatatgggccccacccgggaccccgcgtggtgggctcggtccaccggaccgctccctcccccttccgcgcgccctaatgggccacctttcccgcgaccgcgccggcccaaatggcttggccgagcctccttcaacccttgggccgcgcccttgccgcccgaaaaagtctaatatacatccctccatccttttctttttcccgggatgtaataaatcctttttcctttgtcccataaatcaattccttattccaaaattccatgaatcattttccttggtcagtgactgtcaataatattcttgagaatattatttctataaaattccataaaccatttctcctattccagaaactccaattaaacttccaaaattcatatcttctcaaccgctcatccgattgactccgttccacttccagtaattccgtaaaattgatatctatttaatggcactaataattagtctaaataggatctttcttttggtcttttgtttaggttttcgattgtttgcgtatagttgcggttatcggattttcgtcgatcgcgggttttctcgaagattcgtgaagcttcgtgaagactttgagcaaggcaagtcaccctttgatcaattgctcctataattgaaaagtcattattatttcgtttgcaacttgcattattagaatcacacacttaacttgcttggcctcggtttgca

SEQ ID NO: 3872 - DNA, 1501 bp, Oryza sativa
tgagctgttgaaaagcatctcttaaagtcgaatcgagacgcaagtctcttttcgcccaaacatagaaagaaataaatcacttagtgatttcaaaatgatttcaaacaaaagatttgcaaaacaaccttgcctctcttccaagctagcaccaaacacctaagttcccgtgacttgctgagtacgaaagtactcacccttgctctataaatatatatatagttcctccgccctgaagagaagataaggagaagtgaagattagggtttcgtcctggttcccagccgtcgcctgtggtgttgggtgttagaccgttggttccgctgctgctgctgctgctgttggtgtttcctcgtccgcgtcgtcggttgtattctcgggctgtctgagctgcaacctaagttaaggtaaataagtcctctatttattttaaggattgctatgattcatatttgtcaccgtgggtaccagcactatgtcctgggactggtaccgagatcgcggtttcgtaggaagcggttcgcgccgttttccctacgacacgctcctgtcaggtgccgttgtacggcggtatcagattggggtgtgacactactccaaattatacgttttgcatgaaaattttctatatagataattgttacgtctccgaagaatttgtgccacaacaagggaagaaattgaggatttagggagagaattgagagtttggggaagaacagctaagaacaggtagaggcagcaatagaacagggagagatttgaattgatttccaaatatttgtttctacaatgttcgattcgttctcttccctgccggtctcttatagcgatgagctatggacctctctccctcactgtggcccagcccaattctactaggtccacacactcggttggtacaagctgttgggccgcttttcacgtgtcgatcgccgcaacaagggttgctttgaatcttgtctcctgccttgctcttcgccttcctgagatggtcctgaagtagtgcatgccgtgacaataatactttaaaaaatcaaataaaatctatttttaaaaatttcaataattaatatttagttaataatcatgtttctcgttttaggtacagttaatcggtaaaaataatctacaaaagaagtcggccttagaatgatttacatactggagtactagtagtaattctgctgttaggaggcccaaggtgtgtttagtttgagaaaagaaaatttttgagtgccacatcggatgtttgatcggatgtcggaagtggtttttggacacgaatgaaaaaactaatttcatatctcgcctggaaactgcgaggaatttattaagcctaaataatccgtcattagtacatatgggttattgtagcacttatgactaatcataaactaattagactcaaaagattcctctcgcgatttccatgtaaactgtgtaattaaattttttaatctatatttaatgctgcatgtatgtgtttaaagattcgatgcga

SEQ ID NO: 3873 - DNA, 1501 bp, Oryza sativa
tagattaaaatacagagggagtatacagtatacctagctattaatgccatcacctcaacaactacgtgcatccatcgagaatgaattgtagcgtccttttgttttaattcatactccctcctttcaatttgtcacgaagactaaatttgtttaactcattccacgtgtaacaaactcatcccatatgcatgcagttaaaaactgtatgcatgcatgcaacgtgtattaaagatggttactcgggttccggtaaacaattcaatcgagcaccacaaaacaaaacgacaatctctttatttaagtgttgaatgtgtgaagaatgtgttaggttcctagctatattttatcaccatttaccaataaatattatcatacttatctaagttgaggcgatgtacatcttcacaagcttaaggaaatcttgctatatatactttttgagtaattttttttttgcagggacacttttttttagtcattgacgtgtgggatctggtttattggaagaaaatcttgtcacatctatagctacaaccaaatggttgtcaaggtgatcaaacttaactaaccttagaagtggcagattgtgaatggcaaccaaacacctctataaatacgatcatctcatttggaaaaatcacaaaataaaatatattaagactttaaaatggagacagtaccgtttaagtaatttcgcagcggtatacttatagacaacacaccacctgttaaaaaaatgaattaaaagtacattttatgaacacaattttgcatcgcgtaaataatattacaacagagtaatggcggttcaaaaccttatattatcctaacagagagaaatagagatagtacataggaagatcacggataggggagaaaactagaatttttttagaaataatattattttaataaaaaaattataaaaataggagctgatcagctaaaatcgcaagtttaatatcctgtcgaacaaccgcagttcgacaggttcgatagggtagttggtccataaaaaaaaagtacatgaacagtgctacgcattgttcggcaggggcatatcgaacttacaaagttcgatatgtcccgcatgaacaatattgcacagtgcttgttctccttttttttaaaaaaatatcacctgttgaacaaccgcagtttgtttgatatgggcccccgttaaactgcggttgttcgacaggatgctaaacttgtgattttcaacttctatttttataatttttcattaaaataatattattgctaaaaaaatcagaaaactaagccacatatgttgtttatagtatataatcaattgagcaggtgggcagaacgagcgattagtcgcatgcatgaaaaccatactcatgcagtccaagcaacgacgaacacacaattaagcagacacgccatcaaattaacaacaactcgatcgatctctagctagcttatttatacctggccactctcgcatctccctttcgatcgagcgagcgagcga

SEQ ID NO: 3874 - DNA, 1501 bp, Oryza sativa
gctgtgtgctcgccgccatcgccgcccgtgctccgtagcacccgctcgtcaccggcctcgctcgacgtagctccgcccaattcgacactagcaacggattcccgtagccgtgtagatgctctcgccgccgggaatcggcccctcatgacctcatcactgtttcccccttctcccaccgccggttgccgccgccgcaatccgccgccgtcgagcatcccccggcgaatccgagctgttggctcgtctcccctcgtcctgtgcgacatcccggtgtgctcgccttcgcctatatcgccatggttcgctccgccgctcgccgctgtcgttcgccgtctgttccggccggcgtcatcgtctacctcccgacggtccgcgtggcagccacgtaggcgccacgtcggcgccacctcggctgcgaccgggtcaagcagaccccggtccgccgcttccctccgccccctcgcgcgcgcggtccaccgcgagccgtgaggctgcgcgtgggcctgccgcaccgcgtcctccgcgaaccgcgcgcatgcgccgcatctcccttcccaaaccctagcacaccccgcgtgcacctcgctcacggtgagccgagtcaccgacaagcgggtcccacccaggaccacgcgggatggacccggcccaccggctctctctctcccctccccgcccgcgcgcgccttgggccgccttcttgggccggccggcccattaagctcggccgagccgcccctttctctcaggccgcgccctagccgcccgagtaaagtctaatttccctccctccttcttttcttttctttttcaaaaaggatttaaataaatccttttcctttagaccaaaaatccaataatcttagaaattcaatatcttcccaaccgtaagcccatttgactccgttcaacttccaaaactcctcaaatcttgagatctatctaatggcacgcctagaggtccataatagggctttattttcgccgtttgttgagttgtcccgtttcgcgtgtagtttcggagcctgaagacccgcagtgcgaggatttcgaggatcaagctcaagatctcgagtaaggcaagccacatttgaacatcttgaacctatatttgaatgtaattatgttacttgaaaaatattatgcattgataggattgcacttaatctgtttgccccgtctgcaaggcagaccggtgggcctacctaacttgttgcatctgatccttccattgttaattgttatatcatgtttccttgtaaccacctggtcacgcctcggtattcgtgcactccgtgcgagtatcgacggtcgcattcaaacttaaaatctgagaaacatcttgggtaaaacttgggttttacaaaagacttggaaaacccgacacctgggtcggtgcttgcgaactaaatgagtttccaaaatcgtggaccggggaacgtaccgggtgtacggtttcccgctcttgcacttaaggaccgtttccttggaatttcatccg

SEQ ID NO: 3875 - DNA, 1501 bp, Oryza sativa
gtttgggcgaaaagagacttgcgtctcgattcgactttaagagatgcttttcaacagctcatttagcaatgtaccgacctcccgggtcagatcattacttctcggctcccagagccattccacttgattaatcggctcccagagcctttttcattttctcggactcccagagtcctgctgcccagcagcacaacaatccgcttccactcgggaagcctagtctatgatgcccgcagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagacacgaacttactccagacactggccggtgtcagaggttcgcgacaaagcctttccccagccgacccagggttacctcatgccacatagaaggatcaaattctctcataaacataggcctttttaggcgtgcacaaatcaaactccaaccaccttgatcggtaagtgagcaagcttctcgttcttgccttaccaggaacccggtttgtccgaccccgccccggcgttcccaactattggcatgcgaggtttccctgaaccgtctagttacttagccagggtgtcccattccaccttgtggttgcacttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaagcaacggtgtatgtgggatatttggtatacgcgctcagagagcacgaataccgaggtaccacaagggtggagcgacaaggaatcagggtagtacgacctacggaaattagtgtgactactgggtaggtccgtcggtctggcacgcaaaccgaggccaagcaagttaagtgtgtgattctaataatgcaagttgcaaacgaaataataatgacttttcaattataggagcaattgatcaaagggtgacttgccttgcttaaggtcttcacgaagcttcacgaatcttcgagagaacccgcgatcgacgaaattccgattaccgcaactatacgcaaacaatcgaaaacctaaacaaaagaccaaaagaaagatcctatttagactaattattagtgccattaaatagatctcaattttacggaattactggaggttgagcggagtcaatcggatgagcggttgggaagatatggattttctaaggtttaaggattttctaatcaaaggagaaaggatttaataatttattaaacccctttctggaaagagaattgaaggaggga

SEQ ID NO: 3876 - DNA, 1501 bp, Oryza sativa
tatatgtttgaaagaaatggattattggttgaatttagctcagttcctcttgagattttgggaagaaattaaagaaacgaaatctagctgtaactagcatgatagttttatttccatttagagtatttacctggacttctggcattggattgaatggacatcctaatggtcttacatctcgctagtgtaaacttaaaatattcaaagggaaataaccaagaaagaaattaaagccgcctcttttagttccacttgatcttccttactaattttttagtattttttagaaagctcatgtagaagatcatattttatactacccatgaacttgacaatttctttggttagactttaagaggtaaaaggcagaatcatttggaagaaaacaaatgtgcatagaaacatgagattgagctaatcagtactatcatttatacttattttatattgtatttggatgacactatcttatttttggctgtgttctttgatgtgagttgacaactaatctatgttcacagaaaacagagtgacatattatcacatgattaattaagtataaactaaaaacttaacaaatggattaatacgatttttaaaacaacctttatatagaattttttaaatattgtttaacatttttaagtgtgcgtgtggaaaacgagagattgaaggttgagaaccatcacaaacgaacttaacattagtctgtcttagaatatttatagtaaaatcgtaacggatttacttagcaaattgcaaaggatagacaaatgtcaaacaacttgcaattttttttaccacaatttaaaacacatcgattgatagctacctgacgagactaccctatcaccagccagtccagcccctttggctgctaacccggtcaaaaaaacgatcaaaatcatcaagtacaggggacgatcgttcagccgttctcaccaaccaaacaatgaaaagaaaaaaaaaagccacaaatgtcaacgtgtcactaggaaaagtcaaaataattccctcacttttacaacccaatcttgtcgcttataattatgcatatcagccaaaatttaaacttttaactttaaatttggagttaattctaagaatttttaccgaaatttatttttcagtctttatttttagatcgctaaaaatacgcatataaaatttatattcacaaacaattttcagtttgtgaatatatgtcctatggcttattcaacgacagggataatcctcccacgattttatttcattttcaaaaaccgcgccggcttaccgggcggcgactcgacccgccaacccgcctccacgcctacggagactgccacgcgggccccacccccgcacaccgccgcgaaaaagcttctcccccgggcccaccaccacccccccgggctaccgccgctgccgctgccgttgctacgcgtcccccgacaacgtgcactccctcttctcctctcctctccaattcgtctcctcctcctcaccacgcttgctt

SEQ ID NO: 3877 - DNA, 1501 bp, Oryza sativa
caaagttacaaagggatggattttcttattaagttattcaaccgtataagactaatactacgggctatgccttcgaatataaggtaatacaatgtctaaattctaatctatttacatacttcagtcggataagctttccgtgggtatatatacaatgtctaaattctaatctatttacatacttcagtcggataagctttctgtgggtatatatgtaacccgaaggtggccttgtttagttctaaattttttcttcaaacttccaacttttccatcacatcaaaacttttctacacacataaacttttaacttttccatcactacgaaacgaatttattaagcctaattaatatgtcattagcaaatatttacggtagcaccacattgtcaaatcatggtgcaattagacttaaacgattcgtctcacaatttacacattcgatgtgatggttgaaaagtttttgtcttgggaactaaagcaggcctatgtataccaagtgatgttcacttgtttgtcagccatcaccaaaagaacatttacggcagttgaaccagcttcagaatctctgcagttaaatatttaattttataaatatttcttcaaactaaatattttaaacattattaatagtcaaggttgtactccctccatttttaataattgatagctataatttgtttccatttaaacttggaccactagatacaatttaacaacgaaatgagcaaaaaatatttttatatttagggtaataacatggctttatatctagtttttgtaaatattagaagaagaagacaagtggtcttagtttgaaagtgaatattccaaaaaaaacaattttataaaaatggatcttttaaccttaatcttattcaaaacaacaatagttattgtcgattctagaaatcgacaccgagaaaaagggtagcatatgagatctaaagtggatgagtacaaagacaaagatttcgacatattcagaccttctcgatgagaaataatacattatttttattttggggattgtatccaccggatgttgtattggtctgataatcttggtgttcctatgccctcaggggactccctccctaggttcgggggcaaggttacaaaggggaaaacctagtcagacatgatatggattttcttattcagttattcaattgcataagactaatactacggactatgccttaaaacaacttttaacactcaagacttatcctaaaatataataacttctccaccaacattctgttccaaccaatcaccactatccatcattcgctttttccacctacctccatttcttaaccaatcacgacctctccctatttaattctacctactttcttaaaaatcatgtctaactctaaaacttcttatattctgggacggatgtagtaatatacaaatctggtccacctcctaccttcagtcggataagctgtccgtgtagatatatattacccaaaatctccacagctatgtaa

SEQ ID NO: 3878 - DNA, 1501 bp, Oryza sativa; identical to SEQ ID NO: 506

SEQ ID NO: 3879 - DNA, 1501 bp, Oryza sativa
aattataaaaagtataaagaaaataaagaaaaagaaaaacacaaacggcccagcgaaaagtctgcacggaaatgctttgggaaaagaaagaaaatattagattccaatgattgaacaagatctagcagtggcagcgacaagggattatgggcttgactaaaggatgagggaatgatcaattgaggtcactggtgacatccaaatcccatttttgaaaaaaattcccctgtttttgccaaagcaaaataatgggaagaaatttcgtttataaaagtttgggactgtgtagcttccagtctcctcaaaatacctacaaatttcactcactcttagaaagccaagatctcggcttctattttgattacttttacgaaatataaggaaaattaagtatacttttttgggtgaatagctaatttaatctctcaagtttcaccgaaggctcaatttggttcttcaggttttattttgtccacatatatcctctaagtatttgttttggcttaaaatcatccttaggctcacttaatagttaatatgccatatggctatttctagtcaacaattctgttagaaaatgtctcttttgcctgtaatttgtatgcaactataaactagaaaagtgaaaaccaagataaataaacaacatttttacttcccattatttcaacatgtgcatatgaaacttagtctaatggctatcgtatacacttgcaagtacataatttatttttgttttacataaattgctatccattatctataaaaagaattcattgcacgcaattttttctcttatatatgtgaatgagggagtataattgtcatttatcaatagagttgttggttatgtgagtttaaggataagtttaaattaaaataaaaacttgaaggactaatatggacagattagaacatcaagaactaaaccgagcctcgcatgaaacttggaggaccactttgactattcaccctacttttttcaaaaatgtcgacacataatcaccacttccttgccacttgaaatttgaaaacacaactatccacatacgttgctcctgttatggaatattatctcccaatgagataatatcctttcttgtattataatctaaaccgaagtatagataagatctatttcctcctaagacctccctatatatacagggacagagtgagatatctaaggttgatttgtactccagataagatttataatgaaaagagagctccaccctacatatgtgttcattgtctatttctacaatgttttctgagggcaaagggaagggcacggatgttctatatcatctcacacgtctactgttatgggagctgagggacaggaaacggatccgtgatccgctaatgaacgcgttgatttacaacaactccaacatttcgaatcaaaggtgggggtagcttagcaatggtagcatgatgggccgcaggaaatggcgggaaagataacgaggaacatatcctgcgccctttccgataa

SEQ ID NO: 3880 - DNA, 1501 bp, Oryza sativa
tggaaaattttaagtgtgaatttgattttctgtgattgatggacagtacgtagtgtgcatcttgttattatttgtcaataagtggactctgttatctgtatatgccccgctcaaatatgaaaggtgttcagtttgtttcagagtcaataagctgattgtgctattctgtctgtccatgtcccgaactagaacgtaaccccccatcccaaaaggaaaaaaaaaaggctatcggaagttttctcagtagtagtggattgctgagatagtgtacagtttgtctaaagaatttggggatggttgtagttctaaacttttgtgctattcgagaatcaaaataaacccatgatcagattaaggatgttcattacaaattgacaaacactgattttaaaacgaaaaaatttagaaaaaaatatatttttgtaggaagttttttgacaaaactcagcatatgacaaaatttatgttgtttaattcacaatcagcaatggtttcgtggtgtagttggttatcacgtcagtctaacacactgaaggtctccggttcgagtccgggcgaagccatatttttattttttactctcatggaccgtccattttaagcccagtagcttttaaaaaaatcatgggccggccggccgtcctactgaaagcccagtatcgtatgttgcgtggttcaccggtgacctactcggcccacgggttgatataagccggcccaacccaaaaaactcttacttctgttgcctcccgaagcatctggagaattggaagactggaaggccgacctgccgctgccggaaaaccccgccccccgcgccgccgcttcgatctccggctcccctccgccacttcccttgcctcccccacctcgggtcggccagttcctcctcgcagttgacgagctacctccggatcgagggtgcgatcctctactctcttttttttgttctactttcgcgagctgatgaaactcgagatgaatccgcgtatacggcactcttttacgtttttggagaaaatttcacccgatttgattgggttagcgattctccgtggggttttgagcgcaactagggcttggggttgggaggacagttcagggatgatgcacagcccctagaattttaagttaggtgcaatggttaggtcatgttttctgaatttagattttcgtgacgtttttaatgtgagccgatgatagttgtatgtttgagagcttttctgattgtttgatggggaattagaggagagatgctaaatagaagaggggctgcgattatattgttttattcaaaatttggattgtttgatgcaatgaattgcctgcctgttaatttatgaaagatagaaaatgctaggggatgagcagaacgaaagtgctccactgtactgctgcgatttatagtgttcatgcatttggatgttcctagctgacacagacaaactttgaattgcagagaggtgttctcatttgtttggacttggaaactctgggaaaa

SEQ ID NO: 3881 - DNA, 1501 bp, Oryza sativa
atcagggggttaaacctagtgcattggttggtaacaagattaagtgttcctcattgtttttgtttgagtaggctaggtatccaaactggcgtctttctgaacaaattttaatctacaatttattttctcatgattggggggggggggggattgtatgagatgtactccctcccgtcccataaaaaccgaatctagatgggatgtgatatattctatatgtccagattcatagtaataaaatgtgtcatatccaataggattggttttttatgagacggagatagtttttttttttataacaacatgagatagttgattcgttggtgaaagagtgatgcagcctatcatagcatggggcacttaactgaacatggcaaccagagctgaaacttgtgacttgggtttaccgaattgtgagggtgaggagaggagtggggaatttagggattgggaaagaaggatgtgatttttcactgattcgtctgctccaatgtattgctgttcagttggatactttggagtgcaggagatacacactttggggagactgcggtatttacaaaattttgcgcctgcgcactatgaattgttcttttctcttagattgctacaagttggaaactcaattggcattcaaaagctggataacagaagaaaattttgatttccctgtgcttgtttgtgtgcttcgatttgtccgcttccttctgttattgtttgaattaactataaccatgcatgatgtgcttgcagatagatcaattgctaaattgggtaaaaggaaattctcaccctcccaacaagatgatgattctcagggtgctaaaagaatgaaaaattcagggatgttgctttcaaaggtatgacatagaaaatgaatgatttacatttcaagggaatatcactatgactgctccaacacagattagtacacccgttacgcttgtttcattggtatgccatggtctaggtccactatttgctgtttattcttaccagaatcctctagatgcaagttgttcttagcctattccacatcgagcacattccatcttcattctactaaagaaagaacttttccccccaaaagcaagactcatatactatttacctacgaaggatatttacttgaattcgtcggaaattttcatactaatgtgcatttcattcttatatttcactcatgctacaatttttaggacaccatgccagaaggcctgcctaaattatatttcaacgaattacactgttagagcgaaacaattatatcgaatgcttaatttaggcaccacaattacattctaatgctcaatatgcctatgtcatgcagtgtacttgtgcaatcatgagtgaatacctggggtagagatagaatgataccccatatggttttgttctgctttttcacccaatcaaagtttatcacaatcacaatatccaaactttatcccatgatggtgtgtgcaggacatctggcgccgtatacattgcctgatgccaa

SEQ ID NO: 3882 - DNA, 1501 bp, Oryza sativa
actgaagatttttctcgatggattttgtgttttgaccacaggttcatcggcagcgggcgtccctcctcctcgctactgctgagcggggtagagaccggcgcgggggtggtggccggggacctcgccctgcgagtgacccccatcccggcgcacaagatggctccgctccagggcctgcgcggcgaccgtaacggcgaggagggcgacgacggctagaggagagaaaaggaagaaggagacctgaccagtgggcccagcctatttattattattatttttggatgaaactgccacgtaatcgccacgtagtatgaacacctagtcaaaggagccacgtaggcgccaagtcagccaaaaccggtaacaataccaccgagggatctattttgcaccagtttttgggttgagggatgattttgtaattcggtgacaagatggaggacctccggtgtacttttttccaagaaagaccatatgtcctcaaaacccttaacaggccggacaaacagaaggccaatcgatctcgcctacaagcccagcaacgttgccactcgcccccacgtagacgcgtgagacaacatccaccgacgcgtgatcaagtcgtcgcccttcctgctgtcgtgcgtgcgtgcgtcgtgcggcagcggaccgcgtcgatggcgcagtcgtcggtgtttggttgcggtgtccgtccgtgtgcagtgcagccaaaatgacgtgcgcgtcagggttcacaatttcagtggactgattcatcgaatacataaaccactcagatttttaggttagattaaaaaaattgaactgaattttaaaattttgatagaatttattcagattttattggtttttgtcggtttatcaatggattcagcgaaaatccaatgatacttatggtgagcggattttgatccgatatcagaattgtgaaccctatagccacgcacattctaaaggaggaaggatggatcaaaattgtgaaccctatagccacgcacactctaaaggaggaaggatgaggcgagggggtgatttggttcgacgagaaaaggcaggaggacgagggattgtgcgtttcttctcgctttcctctctttagctgcatcatgttattcctcctactagctactccctccgtccaataatataagggattttgaatttttatttgtattgtttgaccactcgtcttattcaaaaaatttgtgtaaatataaaaaacaaaaaattatgcttaaaatactttggataataaagtaagtcaaaaaaaataaataataaatctaaatttttttgaataagacgagtggtcaaacagtacaaataaaaactcaaatcccttatattataggacggttagagtaacagtgctactgccaaaagccaaaaggataaagaaacaaaagcgatggaaacttcctacacatatatgctcgttgcacattctctcttcatctaggttgcgttcgagcgcaggagaaagagagaaagattgttttgt

SEQ ID NO: 3883 - DNA, 1501 bp, Oryza sativa
atttttttcatggagacaaagtcaccagttcgttcttaacaggaacatctagtgtgcctgagaaacatagggagtagtacataaaccctggtaaaagacttaaacatcattatgaacccaatcatataacaataactacagataatagtacagaatataatcaagactgaactaatactttcagttcaagataacaaaaagtgacataccggaggaggcacttgcgaagcggacaatgtctgcacttcatcatccagagcttccacatcaatgggggaggcgcgcgcaccagtggaggtcggcaccgcgcgacggcttccaaccactggggaggagatcgcgtccaggttcacaacgactttatcaccaggaccatcttgtgattgcctccttggggcacgccgagtgccgctgacagtactcatgctaactttggagctgaatcagtggcactcaactctgaaatcaacctgaaattcaaggggttacgaacttatatgattcaattcaaactaactgttgagaaacacctaggggtcttccggctagctccacaaggtggtgggctaaatgacctgtgttcgaagcctcgccccatctaaatatctaattatttgatattaggtccttccctaatattcgcgtctttcaattcaaactaactgttgaatttattaggatttcatacttctaaaattcagaacacaaatttacgaatcttgaaacaacatacacacttactaggaaatgaaaatcgcgaacagtttaacagaattgggaaattaacctctcgacttgccaaatccaatagccttatcaccaaaaaacctaccaacccaccaaccccctaccaccaatcgtacaagtagccatcaaccccggttaatccacacgaacaatccagaaactgaagaagtaaactagaacacgtagttcacgggctcccaaatcctaacctcccccaagaagaagaagagatctccaccgaatcaatccacccaaaccaaaattccccgatcaaatccaaacctaacacccccccccccccccccacgaatcggaaccatcaaacctaaactccccgtcgatccgcacgcgaaatcgctaacgcctcccaaacccgagccaatcccacccacgcgaaatcgaaacgaacagaagcgggagggattggagattccgcacctgctcgaatcctcgatccagccgcgcggctcgatgaggaggagaccgcgatttttttcttctttttttttcttttttttttatcttgaccgcgatttatttcaatttcaacacgagtgaagagagaagaagaggagaggtcgtttcccattcttctcctcctgtttaaaagggagacgaggagggggtagaggacgaggcggagtgggcttcgacctcttgcgggtgggccccacctgccgtggcccatgtggctgagaagccggctggtgggccggcccggcgcgtgggcccgttggtttagtggcagtggttg

SEQ ID NO: 3884 - DNA, 1302 bp, Oryza sativa
ggggagcgcggggcgggagggtgtcactgatggcgctgctggagcaggcggagcggcagtggacgacggccgccgccggggacgccagccggaggcgcgtcgcggacgaccacgcggcggcggcggaggcgggcacgaacaagggcttcgccggcgccgccgccggcgtgggagggcggtgctgcgtgtgcatggcgcgcggcaaggccgcggcgttcatcccctgcggccacaccttctgccgcgcctgcgcccgcgagctccgagtcggccgcggccgctgcccgctctgcaacgccgccatccacgacgtcctcaacctcttctgatgtcaccatctccgccgccggcgacgacgccgccaccattaattccgtcgacccaatacaccattgctgtaatgtacttgtagataaaaaaaaggttctactacttcttggcttcttggcaactgcaaatcatatcaaagaattctcagagcatcacctgttcatcaatcacccacccgtgctacacaaccaatcgcgcgattcttggatcgatcgaataaccctctgttcctccatggcagcaacgatccgcagatcccggcacaagtgctttgctgctgattagtaattacgtttgcagccacgcgagtgattgaagattaagttggcgcatgtaattagcacataattaattaaattttaattattataaacttgataaatgagtgtatttgatttttttaaagcaacttctatatagaaagtttttacacggaatatattatttagtagtttaaaaaaaatgctaatgaaaatcgagatataatctacccactctgttttataatgtaagttattttagatttattaatatttatataaatacggacaatattagaatgatttatattatgaaagcaaatcttaatgagaaaataacaggttgctcggtttcagtgcatcgcagtcaccgttgaactccacccgtttgctcggtttcagatcaacgcattagttaaaataaatcaattgttttttcagacgatgcgatcatgtgatgtcatggctggaggagagaagattagatagggatgagttgaaccgtgagcccatctgaccaacggtactccaaacctgacaccttcgttctgatgatgttgacttccctgaagaaatgatcaaattaatttatttcagactaagatcacaccaattgacggcctctgcatgatccggagttccggacagtccacttaaacggctaaaccctgaactgacaaaaatttactgtactataaaatggtttcagagg

SEQ ID NO: 3885 - DNA, 1501 bp, Oryza sativa
tgaacaaaaagagtaagtcaaaatagatggagtcaatgataaaatataaaagaaatcatatgattgggtatgcaatttgatgagatggcaaccaactggaacttcggtgctaagcttgaatcgcattcatataattaacatagaagccactttgagtggatataccaggatgacaaacagatctatgactacgtagtacatgaatagcacgtcatagatacatcacgcatgacaaaatacaaaagcttcataccatatatgttactaaatttatatcaagaaaccacaaaaaatgatcatttatgaattgacaatggacggtcaatgcagtaattcaaatatagcactagtgaagatgaactttgtgatcaaaataaaacacaaaccatgatgagatgaaactagagcacgtttctaggtctggatggatgacattcaagtgaccggaaaaggcaacagtaccttaataggcataggacgaaactagggtctcctggggatgtcttcttaaatttgctattcggtagatacacttcaaaggatggatgcatatcatctatgcacatttccttgagcaatttagttatgtcattggaggcaccaccgactctatttaagctctgaatctgatcagtttcaaccacacttgtggaggcatcagtgacgctgtaagtatggctacgcttaactgtccagggaacgccatatcgtccaataatatagccgagcaacttcaagtgcttgtaagcttggaaggcatcccaggagcacccatatttccctccagcaatctttccgtagatttcctccattccaattgtttcaccctcgtaatcaagaagaaccaatgcccctctttctgccaagaacctgcacggtttggtcagctgacaagcctcaaattgagaacgaagcgaaaatccaaggcgtgagaatcatctataatctaaaagcagtgcagcagcgctagtgtagcattgtaaacagagtgcaaactttgggaatgtgaccgaagcaagtgcaatcaagtgtacaaggaatccgagtagcgcaggcatttcatcgaacaggtggcgtacccaatctcctcgacattgtagtacagcttgccgtcccggttgacaccggtggtcagccagagcttgcccttgctgtccacaacctccgccgcaccagcctcctccagccacaccgcgcgcgacgccaccttcctgctcccccgctacacaacccgatgagctaacacgaagcaaaggaaaaaaaaaaaaagacagcacctgaactggactctcgacgaagacgacgacggggcggcgtccaagaacggattgagatggtgctcctcgccatcatcctccgcggcaacggcgacggcggcgatcgccggagctcgcccgctcctccgccgccggtggtcgacggcgcgcgtgggcttcggcatggccacttccgtaatttttcccaccaaatttacccttttacctttttaccccccaaccac

SEQ ID NO: 3886 - DNA, 1501 bp, Oryza sativa
aataaacatttcttccttccatggtcttcaacttgggaggaaaaggtggaacaacttccattttaattaacacatattcttgtggctgtacaccttcaccagatgctcgatcatggtcagcacaaggttgaccatccaatggagagtagattgtgtacctcatatctttgacaaccttgcccattttcttcagctttctcatttgccaccggacaaatgcatcatagaaggggttcatgtcagtagttatgaatgacctcctccaatcacagcccagaccaaaggccttgaggtcctccttcgccaatggagggaagtaagttaaccagtggtaaggatcctgaaatttggcgatttcttcatctgataagccaaagcctctcatgatctcccactgaaacttctgcatgccaaccttcgaagcagccttagatttcttgctcttaaatttatctgggacaacagaagccgcattgtcagcctggctactatcagcaacttctgcacttgaatcatcctctacttcaggaaacgctggaggatatccatattgttgcgcctccctagagagtttatctgctgaggccttgatgggcattcccgtacagtggaaagcaaatggcaaaagaacatttgaaccacgaagcctctgatatgcagcaccaaactcaagtttagacaaggagaacgcatggcccaaatgtagcaagccattcatgtaaggatatggaaagttgccaaagaacttttccccagggcccggaggtttattcccaggttcagcctcaaaaaccttgctctcctcccaccatttttgagcatctgactggatcttgagtaaaatatctctccgagcaaaacttctgcctccatcaggatttgatgacattttcctaatcaatcaacaaaaaacaagtggttaaggctttttgtttaataaaattgaactcagtccagtacttaaacaatgtttctacacaaacaagaataactaaccaactcatcaagcacacataaaaaaataagtttttaatgaaccattgttatgcaataagatttgattgaagtcttgtgctaaacatacctacaactcatgacagggcaagtcattgatatgaagctattatgtgatctaggataacaggatcataaatttataaccaaacaaacatcttcaagaagcgaaggggggggagaaagatcagaaagaattagttaatttacacacttaatagcttgaagagaagaaaattcacactaactcaagtgttccataaacctaaagactaggtggatcatgcatcctatggatactacagcatatccacaattccacataataccaaggcagacaaatgatggaaagaagaaatccacctccaggaaataaagtgtgaaaaatacacttcctaccaacggctcaccataacaaaaggaaaattttaggggggttttttccctagaaatgctcatgtaaaactacacgaggaagtagatcccc

SEQ ID NO: 3887 - DNA, 1501 bp, Oryza sativa
cggcccggccgccacggtggcacaatgtcagcgccagtcccgttggcgttgacacggccaacgtcagcgccaatgtgtttggcgctgaggcgacggcctatttttggttgaagtttttggcaggggttagtttcgaaataagttttccaaaagggtcaatttgtcaaaaaaacggcgctgactatgcccgaacatacggcaaccaaacagacggcacggaaacatggatacatgatgagaatacaagtccttcatggcccagaagcccatatacaaagtttacaaactctttgccctcttttacctgttttcttatttatgctgtataaacctaagttaatatctaaactgacagtctgatctaatctacaacgatactaatctagactgcatgcaaagaggtatgtccatcttaatccatcttatttgggcatcacaaacatattctttgttacgctagtcgcttttttttttccgtgcaatgtctaagagtaagaccatgtatttagctcttgtatttttttatattagtattttaatataaactttgctttgcaaaacatgtcatcataaactacttcgctttgcaatttattttagtatgcatgtgggcggagcgacacaaggtaaatctatccatgtgggactaaatatacagcagttaaacactggagaagtgtttcatcgtacaactattgtacaaaacatatcgtacgtatagcagccctcgaaagagtagagccaaactcaatggcataggctgtatttagttcctaaaattgagaaaaagtttgaggaaagttgatattcccccatttcacaatgtaagtcattctagcatttctcatatttatattgatgttaatgaatctaagtagataacatcaatataaatatgagaaatgctagaatgacttacattgtgaaacggagaaagtagtttggaaaaaaagttagagtttatgtgagtaggaaaattttggatgtgatgtaatgtgatggaaatttggaagtttggagaaagtttggtgtggaactaaacagggccatacatgtaccatgcatcagggttaaatttcactcgaatttcatcgaccaaatttcggtgctctcccaaaccgccggcctttgtatcgaatcccaaactgaatttcctcgtttcaaacgcggggtggggtgggggggggggggggctcgcatttcaacccaagacgatataaatgcaatcgcaaccgtcaccatggaaagcgggctcgctaaaaagcccattaaaaaccacgggccggcccatgcccgatccatatccagacccaatacgaagttgggccaaggcccatggcctcgtgggagtcggatcaagggtggagaaaagcgcaacgcagcgaggcgtgtcctttccaatactctctctcctcctcctcctccactccggcgactcctccgccgcatcccgagcaagcaagccgccgccgccgacgacctagctccccgatcgcggcca

SEQ ID NO: 3888 - DNA, 1501 bp, Oryza sativa
atcgcgtccaggttcacaacgactttatcaccaggaccatcttgtgattgcctccttggggcacgccgagtgccgctgacagtactcatgctaactttggagctgaatcagtggcactcaactctgaaatcaacctgaaattcaaggggttacgaacttatatgattcaattcaaactaactgttgagaaacacctaggggtcttccggctagctccacaaggtggtgggctaaatgacctgtgttcgaagcctcgccccatctaaatatctaattatttgatattaggtccttccctaatattcgcgtctttcaattcaaactaactgttgaatttattaggatttcatacttctaaaattcagaacacaaatttacgaatcttgaaacaacatacacacttactaggaaatgaaaatcgcgaacagtttaacagaattgggaaattaacctctcgacttgccaaatccaatagccttatcaccaaaaaacctaccaacccaccaaccccctaccaccaatcgtacaagtagccatcaaccccggttaatccacacgaacaatccagaaactgaagaagtaaactagaacacgtagttcacgggctcccaaatcctaacctcccccaagaagaagaagagatctccaccgaatcaatccacccaaaccaaaattccccgatcaaatccaaacctaacacccccccccccccccccacgaatcggaaccatcaaacctaaactccccgtcgatccgcacgcgaaatcgctaacgcctcccaaacccgagccaatcccacccacgcgaaatcgaaacgaacagaagcgggagggattggagattccgcacctgctcgaatcctcgatccagccgcgcggctcgatgaggaggagaccgcgatttttttcttctttttttttcttttttttttatcttgaccgcgatttatttcaatttcaacacgagtgaagagagaagaagaggagaggtcgtttcccattcttctcctcctgtttaaaagggagacgaggagggggtagaggacgaggcggagtgggcttcgacctcttgcgggtgggccccacctgccgtggcccatgtggctgagaagccggctggtgggccggcccggcgcgtgggcccgttggtttagtggcagtggttggggggtaaaaaggtaaaagggtaaatttggtgggaaaaattacggaagtggccatgccgaagcccacgcgcgccgtcgaccaccggcggcggaggagcgggcgagctccggcgatcgccgccgtcgccgttgccgcggaggatgatggcgaggagcaccatctcaatccgttcttggacgccgccccgtcgtcgtcttcgtcgagagtccagttcaggtgctgtctttttttttttttcctttgcttcgtgttagctcatcgggttgtgtagcgggggagcaggaaggtggcgtcgcgcgcggtgtggctggaggaggctggtgcggcggaggttg

SEQ ID NO: 3889 - DNA, 1501 bp, Oryza sativa
gcgtgggccatatgagtcgggagtgcgtgctgccggtgtccgtgtgcgaattaggattctcgcgtccgttcgtactaatttcataagtgagaatcgtacgtgaagcctactatttcccccggccaaaaaggtgacattgcaagtattgataaaaataacatgcaccccaaattatctacgtgcacttaaaaacttgggtagtcatctgtggtctagttggtatagtgttgtggaacgagatcctctgactttgtgaagtcagagaagcacagtaccttggctttgatccattctcacccgtagcgagattaatcgatacagtactgctgtttttcgcgtcaacaagtacgctacagtatcagtgaatagtgaattagcacaatggtttttactgttttgtattgttgctacagccaaaacttcaaaacactgttatgtaccatagcaccaggcttattttactgtgtttatctgccgttcgcttgcaaagtcaaagagccggatccgtaggtgttgtacatccacgatttcacgtcatgaaccaactaaactctgcttttgatacaattgatcggtatatatactacacgccaaaaatctccctgcagtttttagtaagcgatgccattaacttttaaacatatatttaatcgtgtaaataagtcatacttgaaatatatatcttccatgataaaccaagttaaaaaaaactgataactacataacttttttaaaaaaaaaagaataatctacatattaaaaatcatctattaaaaacctaaggaacttggtcaaaactccggttttcgaaagctgctaatttaattcaagcattgggaacagtggaacacactgcctatgaatcgtactgtacattgatttgcttgtaccttgtattgatttctgcatgattccttggtttctttttttacacatttacttttccttcaccagatggaataatacacaggaatactagcctaagggcctatttaaatagcaggaatgaaaaaaaaaattgaaggaatagaaaaatcacataactctaacaagaatggaagtgattgaagtgtaaaatagataattgtaaaacacagaaccgtttgattgaatcgtggaaaaaaaacataagaatcggatgagaaaaatatacttaaagggaagtttcatccaaaatctctatagaattgtccatttcatatgaattttttttacggaagttccatatgaattttaaaggattggatcatttaattcgaaggcatttataggaattttttcaataaaattaaaatccttcaaaatttctattttttttctccgaattaaaggagcctaactttttttttctccatgcatgatgcatccaccaccttcctgacctctccctctatatacacaggcgccaccaacaaaaggcacaccaaaaaaaaatctcactactgatcatcacattcatcagtggagtgcagctagctagctagagctaagccaatcgaga

SEQ ID NO: 3890 - DNA, 1501 bp, Oryza sativa
ggggcgtaatattcggccatttactacagtggttaataatacaccaacaagtcaacaacaaaatgcagttagcagacagctgcgcaattacgttgcgtgtttgcatacaaaccgataattgattaacaaagttaatgatgcaagcacaggcgttagctgcaaccgtaagttgacttaaatgagaaagaatttgagatcgaatcgtttagtcgctgtcagcatgtgtaccacacctctcccgtactgccggcgtgctcagctaatgctcgaagcctcgaaatcagcaaaaaggattaataaaataccatttactaaataaactacaccatgtaagcaaataactagtaataaaatgccgtctgaattggtttgattggtggggaaaaatattaaaattatgtaagatttggatcatattagaaaatttctcctatttggtgctttaaaataaagctccaagaatcctatgaaatgctcaagaaaaaaaaaagataattcgaaggaaagttagcatgacgttgaactgtatgaaaaccttttctttttgagtctttttattcattctttaagagtgttcataattatattattcctcttatattttctctctacaacttatatgaaactaaaaattcttttagttttcatatactcattttttttgcgggaaagtttttttttaatatactctcttcctacaaatcgaatgatacttatataaattaattattaaaaatccaaatccttttttttaaaacggaataaacccttaccgtatcatacggttaaaaggaccctcaaacatttaggatatttaactatttattaccactcttatatatgataattaaccatttatcacttagatccacatgttacttatgcataaggccccacatatcattgacacatggttgccaaatggttaaacgccaaatctaagagttaaaataaaaagttaaatgccccccaattttagagcggaaatgctactaggagagccctcgcccgcccagagcgatcagatttcccaccccctcccttcacctggttttcttttttagcatcgtattacttttctattttagtaaatttatgtacctaaagtttatatacctcaagtttacacatctaaagtttagagaccaaaagtttataaatcaaaagtttatatatccgattcaaatttgaatttgaattcaaatattttttatatatagtatttctatacatctaaagtttatacacctaaagtttatataactaaagtttatatatccgattcaaatttgaatttgaattcaaatatttttcacatatagtatttctatacatctaaagtttatacacctaaagtttatagacctaaagtttatatacccggttcaaatttgaatttaaattatatccgattcaaatttaaatttgaattcaaatattttctatatatagtatttctatacatataaagtttatacacctaaagtttatagatccaaag

SEQ ID NO: 3891 - DNA, 1501 bp, Oryza sativa
gacgacgacgacggcggcgggcaaggtggtcgccgccagccgcggccgctgcccgacgcggtggtggtggcggcggggcggcgacgcacgctgctcgacgtcatccgcggcgtcgacgacgacgatggccacgaccacccgcccaccggcgtccttgagggacaccgccccgcgacgtcgacgaggacggcggcggcggggggagcgcggggcgggagggtgtcgctgatggcgctgctggagcaggcggagcggcagtggacgacggccgccgccggggacgccagccggaggcgcgtagcggacgaccacgcggcggcggcggaggcgggcacgaacaagggcttcgccggcgccgccgccggcgtgggagggcggtgctgcgtgtgcatggcgcgcggcaaggccgcggcgttcatcccctgcggccacaccttctgccgcgcctgcgcccgcgagctccgagtcggccgcggccgctgcccgctctgcaacgccgccatccacgacgtcctcaacctcttctgatgtcaccatctccgccgccggcgacgacgccgccaccattaattccgtcgacccaatacaccattgctgtaatgtacttgtagataaaaaaaaggttctactacttcttggcttcttggcaactgcaaatcatatcaaagaattctcagagcatcacctgttcatcaatcacccacccgtgctacacaaccaatcgcgcgattcttggatcgatcgaataaccctctgttcctccatggcagcaacgatccgcagatcccggcacaagtgctttgctgctgattagtaattacgtttgcagccacgcgagtgattgaagattaagttggcgcatgtaattagcacataattaattaaattttaattattataaacttgataaatgagtgtatttgatttttttaaagcaacttctatatagaaagtttttacacggaatatattatttagtagtttaaaaaaaatgctaatgaaaatcgagatataatctacccactctgttttataatgtaagttattttagatttattaatatttatataaatacggacaatattagaatgatttatattatgaaagcaaatcttaatgagaaaataacaggttgctcggtttcagtgcatcgcagtcaccgttgaactccacccgtttgctcggtttcagatcaacgcattagttaaaataaatcaattgttttttcagacgatgcgatcatgtgatgtcatggctggaggagagaagattagatagggatgagttgaaccgtgagcccatctgaccaacggtactccaaacctgacaccttcgttctgatgatgttgacttccctgaagaaatgatcaaattaatttatttcagactaagatcacaccaattgacggcctctgcatgatccggagttccggacagtccacttaaacggctaaaccctgaactgacaaaaatttactgtactataaaatggtttcagagg

SEQ ID NO: 3892 - DNA, 1501 bp, Oryza sativa
ccctcaaacttgttttcaacggtttctagttcttcccttgatggtggtttgttgctgcaccaaattgaaaagcaatacatcaaaggtaggaacaacaatcgaagtacacgcaaataacccaaaagtcatgaaccatacgtcgttctcaattttattgcatgtaatgtgacctcttgcgcatttctttacctaccttatgacttgtatggtattttcgttacttctcagtattctttaggggaagttggtgaacaaaaagagtaagtcaaaatagatggagtcaatgataaaatataaaagaaatcatatgattgggtatgcaatttgatgagatggcaaccaactggaacttcggtgctaagcttgaatcgcattcatataattaacatagaagccactttgagtggatataccaggatgacaaacagatctatgactacgtagtacatgaatagcacgtcatagatacatcacgcatgacaaaatacaaaagcttcataccatatatgttactaaatttatatcaagaaaccacaaaaaatgatcatttatgaattgacaatggacggtcaatgcagtaattcaaatatagcactagtgaagatgaactttgtgatcaaaataaaacacaaaccatgatgagatgaaactagagcacgtttctaggtctggatggatgacattcaagtgaccggaaaaggcaacagtaccttaataggcataggacgaaactagggtctcctggggatgtcttcttaaatttgctattcggtagatacacttcaaaggatggatgcatatcatctatgcacatttccttgagcaatttagttatgtcattggaggcaccaccgactctatttaagctctgaatctgatcagtttcaaccacacttgtggaggcatcagtgacgctgtaagtatggctacgcttaactgtccagggaacgccatatcgtccaataatatagccgagcaacttcaagtgcttgtaagcttggaaggcatcccaggagcacccatatttccctccagcaatctttccgtagatttcctccattccaattgtttcaccctcgtaatcaagaagaaccaatgcccctctttctgccaagaacctgcacggtttggtcagctgacaagcctcaaattgagaacgaagcgaaaatccaaggcgtgagaatcatctataatctaaaagcagtgcagcagcgctagtgtagcattgtaaacagagtgcaaactttgggaatgtgaccgaagcaagtgcaatcaagtgtacaaggaatccgagtagcgcaggcatttcatcgaacaggtggcgtacccaatctcctcgacattgtagtacagcttgccgtcccggttgacaccggtggtcagccagagcttgcccttgctgtccacaacctccgccgcaccagcctcctccagccacaccgcgcgcgacgccaccttcctgctcccccgctacacaacccgatgagctaacacgaagcaa

SEQ ID NO: 3893 - DNA, 1501 bp, Oryza sativa
atttacccaaaaatttcacatacatatgctaagtttgttctaataaaagtttgaactaaaactggggttaattaatttgaacctttgaagcaaaacctaatgatgattcagaatgacattagacttaatcacatgtatcagtactattagtgttattactgaagaattggagaattcagactcacatggttcccgcgctttgtctgtccggcggcggcgacggcgacagcgccggcggcggcgaggcggtactcgtgcatgacccagtgggtgcgcgacggcggcttcgcgcggaggaagagcagcgtcgtcttgacgccgacgaggtgctggccgccgccgccgccgccgccgccgcacccgaagccacgcaggaacaccggcttctccgcccccgtcgccttccagtacccactccccgccctcctcctccgccacccgccgccgccgctcgccgccgcgagctgccggaagctgaagaagtaggcctcaccatcgccggcgcctgcacagaaggagagagttcacgatcagtctcccgctcggtcgagcttggcaatggcgccgcacctcctcgaaaccaaaacggatcaagaaaaccgcaccggggaggtcccaggggtcgagcacggtggcgtcgtggacgtccgggatgacggcggcggggagcggccggcacagcgccctccgccggaggtactgcaccaccagctcctcgtccgtcgggtggaacctgaaccccggcggcagctgctgccccggcgtcgccattgctaaagctcttctgctcagttagctagctaaccacgcagtgaatgcacagtagcagccaagctgagtgatcaacgatcagtgagacactgtcacagcttcagctcaagcttcacagatcacaggtaacttatgagttcttggaatgttcagagttttcagagatccagagattcagagagagagagagagagagagagagtttgatgatgagtggagtggagaagaaaagggcggggaatttataggatccatgtggcgtggagcagactccaatcctgccaccattgttgcttaaatagtatgattccttctccgatttgacatgatccaatcttgtttcaccctaaacatgtctcctaaattctgattgatacaaaaactttttcttctcctccctcttttttcagaaagtggagaaaaaaaatccaagtagcgcttgacagagatttaattaattgtttattttggttttaagatagactagagggtttatggtcaattgttaatcatgccatgtaagcaattcacttgactcgatggcttggatttatatgcccattggccattgcacaaaaaaaattgagtactattgtttctatgattgctatatgattccatgtttttagggacatttttgtctggttattcattttaaaaacattttttctgataaaaatcatgaagcaaacttcaggattggcactttgctcgtttttgcacatcggat

SEQ ID NO: 3894 - DNA, 1501 bp, Oryza sativa
gatcatatcatctccttttgccactcaatggaatctgctctagttaattatttggattgtgtgccaaatatacaccattgcttgtatccacaggatcttcaggtgcaggcacttaggagtatgaattttccatgtatgacatgccagtttctgaactttgatttgttggaaaatttgatgtttctggatcagttctagtgctgcactgctgctcgagctggaggccactactactacgtacttactggcttcatctgcttgcatcaggaactcctggcaggggaatcaaacatgcattttcctgcttgattctgcttgattcttagtgatgattatttattcactctcacatgaatccattcagattttctgtacttaactgtggttggaacggttttgatttggtgactgatgtgtcacaacgatccaacttgacctaacacaatggcttatggattatcgtgggcacgctttccagcctcctaaatattacattttttttgccaaaaaaaaacttcaacatttcttagaaaacttttataaaacaacttttcgactttctaatatataattaattgtttttgtccttgaataatcgtcataaacccgagtttgttttataggactctaacttataaacctaactttaggagcggagtctaaagtgtagctgtggagtggcccgagactcgcttcacccttctagtttaattttttaagatcactttagcccactctgctctcttttttagcggaactgaagctctgtgaaacatgtaagaacatgcctcactgaacatatgatcatgacacacagaagaacactcaaaatacaaagtttcttatgatgatttttctctggtatgagcaagaaaatggtggtacaaaatatacttgaatgcttggcactggcgatgccacagaattttcatgggagcaccaaaagcgacgctgcttctgcattgcattgctgcgagagcaggagagtgcagctcagcatgtgccctttttgcgttggaaagcatgccaaacacacaagcccactgttgcaactgttgcaggttgagtgattggtcggcgcgagccagatgctgcacacgcttcagtggcatctgtattaaaataacccagcagaacacccccgttgcaattgcaactgggcttttgtttttctggataaattacatggagtatatgctaatgaaagttttcgagcaaattgaatttgaagttaatttttacaccgaattcatagtaccaatgagcagctcagtatgcaaaggaatacaaaaggttgagcagataacacaagaatcaaataaggagcagctcagcatgcagaagaatgcgaagcagatggtataccatgtcccaaaaagaaaaaaaaaacaatccaattagagacttgaagaaaaagaattgcattagaaaaagaggatgatttgggtagtagtatttcttgagtaagagtcgagcagcatggtacagttacagaacgtcg

SEQ ID NO: 3895 - DNA, 1501 bp, Oryza sativa
ttaaattaaaaattaaatcagatataattcaaattcaaatttgaaacatgtatataaaacttttgacttataaactttagttctataaactttagatctaaaaactttaggtctataaactttagatgtatagaaatactatatataaaaaatatttgaattcaaattcaaatttgaatcggatatataaacttttggtctctaaactttagatgtgtaaacttgaggtgtataaactttaggtgcataaatttactaaaataggaaagtaatgcggtgccaaaaaaagaaatcaggtggagggaggagggggggcaactgatcgctaccagatcgcccttgcgatcgatcgcggatcagtttttccgtatacctttacccctcccgctgaaaactgttggtgatgggtcttagatccgcagttggttttttagagattcttccccccccccccccctccccttatcagtgaccgggttcatgtacttctttttctgctattactgtggtttagatgcagtttcctaatgtatgtttacagaaccgttggcctgcaatttgtctttagtatcttcctcatcatccatcaagcgtatgccttcctagttcagttgaaaactaactttcataaagaagttaataccggcaacttggaagtgatgagaactgcccatggacatctgagtttggtcactgctggtaaccagagttatatgtggcacaaatgtttgtcaatatcccattctgctctcaaaatcttcttcagtgggcattgagatgctgggcaatatgtctgttgcaggattgttgacaactaacatgtctagactaggagagtgagaaagctttgaagtaaaccatgcccattttgctggcttcacagttcatgtgaagtggtttcactactgttcgctctaatttcagtataaatggtgggagaagtgaatattcttgtaggatggcgttcttttgttttcctggtctgttcaatctattatctctcacggtgtagctgccaaagctattggtttcttacatcggctttctgccaaatctgttgagaattgtaccttataaagaatatatgtgtatttttttctatttattttctatcttttataatttgtaggatgctattgtacaaaaaacacatcatttcatacatcttagtttacccacatatgctcagatataatatattattggctagtccttgcctaactaagcataagtttcatattagtttatcattactagtcactgacgacggtctacatacggtatccttttcaggacagactctactaaaactttgaaagagaaaaggagcaaaataaaaatgcagttcaatttgcctaccacaaattccaatgcgctatacggatataccctatatgctagtactgttttcccttccaactgaggcaatagtttacattcacaatattttcctgattatacatgcaggacatctggagtcatatacactccctaatgccat

SEQ ID NO: 3896 - DNA, 1501 bp, Oryza sativa
ttcgccgcgttgccatggggaagatgctggatccgaagcgtctcatgtctgcgcgacaggagcggcatcgccgtcggcggcgacggcaactccgaccccgcagtagccctccctctcctaccttcttcttcttcagcaattgtgtttgatagccacgattgcttttttggggaaaaaaagagcatctcgcttgcaagcaattcaagaaggggcaatgggacattatgatctgtggaatttaggaacaaaatagtgtagaattgtttttttcttttgggaggtaaaaggtagcaatgctcggttgaatttgatttgtaggaagtaatgaaacaaattggagtgaatacccgctcttttcacaaaaagctggacaactgaaccaaattgaattgttcgtgttcattcatgtgctttgatctgatgttttcccctgttgattgatgtctgcatataaccacgcaaatgatgtgtttgttcaattgcttcactggctaaaaggaagggctcattctgtcaccacgttgcagattctgaaggcgccaaaagaacaagatattcagtgcctagccttccagaggtatggtacctaatgctgataagaaatacttatattagaagcaaagtgggtcactatgattctatgactgctctaagtagtctctaactacacactggtggtcatatggtggctagatcaaaaggattgagatcctctaccttcaaactcaaaggtaccatgtctttgtcactgacagatgggtccatggttcattgggcctacatgttagtgacaaaggcacgtgcctttgaagttagaggagcctgatccagatttatgaacagatatttatagctgcaatcttctacaattctgcatgagggcaccttttctctgttctagctgttgcacctttatcactcaagcagaaaattgtttgtgatggcgtcaccttaataatcttgttaaggcagttcactttctaaaggttcttcctcacttatcagcgggttcctgtacttcttttatgtgattactctggtctcgaccagtttcctgatgatcaatgtttatgtttaccagaacccccaatgtgcgatttgtccttaagatacatgtttatttttttcttcattacctttgactaatttataggatgatattgtagggagaaaagcatcatttcatacataacattgttgactaccgctgcatacttcaagcaagaataggtttcatactatgtgatcataattagtcactggctacaatctgctttatctttttcccgatagccactaagaaaactttgaaagggaaaaggagaaaaatgaaaatgtgccgttcagtttgcgtaccacaaatcccaaagagctattccttataagctactaatagtactgctttcccttccaattgaaccttcacaattcttttaaaaaaacttttatccttgctagtgcttgtaggaaatctggtgccatatacactccctaatgtcat

SEQ ID NO: 3897 - DNA, 1501 bp, Oryza sativa
attttttaaatttatttgaatttaaggaggttaccgtggtatttatattaccgtaccccgcggtaagtccggtaaccgcgcagttaccgacggtaagggaaaccctgggtaggtataggtaggtaaccatgtaccgaatagctggataagactgtgacaaactctgcattttgccctcctttttcttgtgctgatctgagaaaagaacacatttatgcatctgcttaactagacccaagaaacgtgcacgaatacacatcagctcagtactctccgcagaaaagattttctcaggcttgtcttcagccacagcaggaactccacttgatcagtaataatgcatgcatgcatgccaagcacttactagcaacactacttcttcttgttcatcttcttcgtcgccatctcgataaaacttgccgttcttggagaaagtaaaggcacagttgggcagctgcattattgaatggttcagctattcaccagcatgctgaaaattattcagctgttcagtagctagtagaagcagagaaggtgccagtgaaacaagcactgaaacatttccgtttcatcgcctcctcattgccgcgatgcagaaaaggcctcgtcgctgcatgcacataatgtattaccaccaagctttgatccgacaagtggcaggcaaatgtgatttgcagctgtaaagcaagtaaaaaaaaggtataattgtccatggtttgatggtgaaatgtaacttactgatcaaccagatgcaaagctagtttcagctggtaattaactttggccatctctgatagatgcaactagcttaattgtgttgtgtttctgtgactcttgtgtgtggtgcatcatgtatccacatacttacatttactctttgtgttcatgagaattggcatgcagctagctagcagcattgctgaacctgaatgctgatcagttcagaaaaaatcagatatgagcgccgatcaatggatggaaagagaaaaggcctaaccttgactgaaccggccacattgctatagtgctgtactgttgtctgcatgcatgcatctctcttgtcagtgctggtcatggatgtgtattaacagtagtagtacattatgtaatgcgtctttgcaattaaaatgcacagtatagtagtaacaaaaacatgcccttttcttcccatagttttggggtccatgcaggtaattcatgtgcagattctgatactgatgatctgacagactgacaacacatgaaacctcagatgcaactggagaagacataatttgattacactctacaatatctaaatatgtctctcctatgtactaactttttgaatacattcctgaatttagttaatggaaggattattatctgacaaatgttcaattattcagtaagacttcaggttatagcaaacagtaggagtataatatctctggaccacttaggcacttaggcaccatgtagatacgtacatatgtaacatatgagaagaagagaagctcta

SEQ ID NO: 3898 - DNA, 1501 bp, Oryza sativa
cacacgtcttgatatctctctctatataaaccgagccaccacctcctcacaacatacgccaaaacaacctagggtttgtctcctcctctatactacattattgctcgtaatctactacatcccgctcgccggcattcactgatgatcgggagagcaggtctccgaaaccttcgccttcggtttcatgcaccgggagaaggcgacgataagagttttgggaaacgattcgtgcgactggtcgctgttctttcacaataatttgtcttcctctacgcttgacgtaagattaagtgagaaagctattatgttcacattttagacaaggtagtgtcttaaatcactttattttagtctacaaatgtcatatttggcacagctcaggatctgacattttctggagctgggtgttcctagcttcacaaatccatggattggatttaggattacattgataatatatggatgaaccattttgttcgtattttataaaatttcaaactgtactataacttaatatacaaactttaaatttagtgtatctaggatttagagctgtaccataccaaaccagaccaaatttagtacacactccatatcatgtaagaatattaaaaaaatatatagctctaacaaaaatctgaaaattagctagagctctaccaaaacccggagttttcagctgctggcagcccacagacgacaaaagcacaaaatgccatgatacagcgcacctttccctttgggcaccatcatatcagtccagcgcaagtttaacatccgtgacataatttatgtgtacctaatgtggcccccatgccatcaccctacccacaaaaagagacaacaaataactctagtttgctttgctagccactcccttgttttatgaccaaacttaaactttttattagtggccatcaaattgaatataacggcttcccttttagactagaagaggacgacgcagagagaaaactgaaagtttttttttcactaatgtcttgattaatctcaccctcagtgacgatgcgacactagtttcatatctagattgaaattcactaagggcccctttgaatcacagaaatgaaaaaacggaggaaaaaaacataggattttgatagaaatacaagtgtaaaacaggtgattggaaaaaacaggaaaaacataggaatgactgttcgattgggccgcaggaaaaacacggaaatttaaggagagataaaagactcaaagtattctttccatgaggttctacctcatgttaaatttactctaaaacttacatggggaaggacaatccataggaatttcataggattccataggatctatttctttgattcaaaaggctatatagaaaaaaatcctatagaaatgaaatactctaaaatttctatgaatttcctttgaatcaaaggaaccctaaagttttatatcaagtacaaattgggaaattaccggttggtaggctagctaactttaacttaactagtggcgc

SEQ ID NO: 3899 - DNA, 1501 bp, Oryza sativa
gagagggtcgacagggagagcgcgccgctcgtcgggcggcggcggggcccgtggtcgagcacccagcacattcgaacatctccgccgccgagctcaccgttgcgccgaccgccatctctcttccgctcccgccgccgccatcgcatcgaccacctctctcttcctctccgccgccgccgtccccgctccccgccgaccacctctctccccccggtcgccgcgcttgctcgagactcgagagaactcggagagaagagaagagaaaaagaaaaaaatacaaagaaatgtgagacccacaccattgtctcacttacatgtgggccacacatattaattttaatttttttttgctggctaggatgccacgtcagtaaaaccacccgtatatactgcctagggaccttgagtgaacggttttgtatagtttaggggtggagatttctggttttgtggttaagggactttaaaaaatctcggtgtaaagttgagggacggccgatgaacttattccctcaattatttcccggcccattatacgcatcagcttgtcaccggcaggtgggcctgggtcccgtgtccccacgtgctcctcactcgcttctcgccacaaagtccaaaaagcccacgagatcaagccgttaatccaacgtaaagacaagttcccgtgctctctaatttcctcttcttctgatctcgcaaacaagaaatccccgggaaaagagaagcggcgggacaagatcgccagagattccacggacggacccaaggtgagcaagctcgatccatccccatcaatgcctgctcggttcgatctcgctacttctggattgcgccgggcgcgtgtcgctggtcgaatcagccggttttttgggtggaaagattacgacttactagtttggtttcttgtttaagatttgtgttcttgggaggaggcggagctactcaggcttgctgggagattgctcgttgtttgtttctgttactgcggttcgatgcgccgtttgtgattcgcgtgttcgttactggattttgcttccgtggatggcggacaaagggcatatcgcgccgattcttggagagttctctagatctggcgggaatgctcggctccttgatttgccactgctcttatgccccaattagatgggaggttttagctcttaccctaggaggatttgtgcatctgttgcctgctacagttaggtcatgggaagtgcgtacttcttcagtgatgtgggaattttacttgtgcgtctaatagtgagaatgagacaaataatttgtgtgtatgtgctaattcacgtgatttttagtaattctacctttgtattttgtctctgcattgtcgtagggagtgagtcagtgagctatttcttgaataccgcactatctacctgctgcttgaatttgaaccctttaataactactccctctatcccataatataaggcgcatacacatttcaagattcaacatttaaaacatttaaccaacacttagt

SEQ ID NO: 3900 - DNA, 1501 bp, Oryza sativa
  unsure (1)..(1501): unsure at all n locations
ggnnnnnnnnnnnnnnnnnnnnnagcagcaccatcgccttggggagggagagagggtcgacagggagagcgcgccgctcgtcgggcggcggcggggcccgtggtcgagcacccagcacattcgaacatctccgccgccgagctcaccgttgcgccgaccgccatctctcttccgctcccgccgccgccatcgcatcgaccacctctctcttcctctccgccgccgccgtccccgctccccgccgaccacctctctccccccggtcgccgcgcttgctcgagactcgagagaactcggagagaagagaagagaaaaagaaaaaaatacaaagaaatgtgagacccacaccattgtctcacttacatgtgggccacacatattaattttaatttttttttgctggctaggatgccacgtcagtaaaaccacccgtatatactgcctagggaccttgagtgaacggttttgtatagtttaggggtggagatttctggttttgtggttaagggactttaaaaaatctcggtgtaaagttgagggacggccgatgaacttattccctcaattatttcccggcccattatacgcatcagcttgtcaccggcaggtgggcctgggtcccgtgtccccacgtgctcctcactcgcttctcgccacaaagtccaaaaagcccacgagatcaagccgttaatccaacgtaaagacaagttcccgtgctctctaatttcctcttcttctgatctcgcaaacaagaaatccccgggaaaagagaagcggcgggacaagatcgccagagattccacggacggacccaaggtgagcaagctcgatccatccccatcaatgcctgctcggttcgatctcgctacttctggattgcgccgggcgcgtgtcgctggtcgaatcagccggttttttgggtggaaagattacgacttactagtttggtttcttgtttaagatttgtgttcttgggaggaggcggagctactcaggcttgctgggagattgctcgttgtttgtttctgttactgcggttcgatgcgccgtttgtgattcgcgtgttcgttactggattttgcttccgtggatggcggacaaagggcatatcgcgccgattcttggagagttctctagatctggcgggaatgctcggctccttgatttgccactgctcttatgccccaattagatgggaggttttagctcttaccctaggaggatttgtgcatctgttgcctgctacagttaggtcatgggaagtgcgtacttcttcagtgatgtgggaattttacttgtgcgtctaatagtgagaatgagacaaataatttgtgtgtatgtgctaattcacgtgatttttagtaattctacctttgtattttgtctctgcattgtcgtagggagtgagtcagtgagctatttcttgaataccgcactatctacctgctgcttgaatttgaaccctttaataactactccctctatcccataatataaggcg

SEQ ID NO: 3901 - DNA, 247 bp, Oryza sativa
tccccctcccgggcccacccgacaaccaccccgtgggccccacccccatcacgcccactccccgccctccaccgtggccgccgtcacgtgcgcgcccaaacgtccaatcacccacggccgcgcgggccctataaatatcccccgccccccaccctgtcagtggctcactcgcactcgctcgcgatatttctctcgcgcggcaaagaaagccaagaggagaggagacgagagatcggggcgaaggcga

SEQ ID NO: 3902 - DNA, 1501 bp, Oryza sativa
ataggaaacgacgtatttatagaatacaactttaggtcatgagacatagcggcgaatctatggaataatatggaatgtgggtccatcagtagatactcgtcgttaacaaaaccacttctagatatgaatatggatatgactagtgtgtttaagttatcatcgtcgttgcatgttactatagtgacttgctacggggtatttctactgtcccataaattataaccatgcaaacgggaaggagatcaaaggtcttaactccccaataaaagctgagttcgtctgtgggtgttccaaacttctctccttcgttttccacacgcgcacgctttccaaactgctaaactgtgtgtttttacattaaattttatatgaaagttgtttttaaaaaatcatattaacccaatttttaatttttagctaatatttaattaatcgtgcactaattcattgctcagttttctatgtcggaaggtgagtgttcagtgttcacaaccctcacccatctttagcacggctttggactcatttttgttttaagttggatattactagctttacaaatttatggatctagattttcaattacattgataacatttgaataaatcatttcattcctattttatatgaagtttagaatttttttttcttttacacaatataatttagcatacaaactttaaatctaccccgaatatcaaattcgaaggcatgccaaataggacttaagttaattggtttgttaaaatggttcaaaatggttcaaagacaacaaagtttaatccctgccaatattgtatttttcttttaccaaagccttcccatgttttattagtttcttgtcttgatccgtccccaaatcctctatattagagcaagtttaatagtatagccaactactgactctaaatcataaaatagttaattcatacaatagttacctataaacatatactactatacaagtaatatctggtcccacctatgatacacacattgcgtcttatagtctgtgctacaggtggctacaaatctattgtccgctgctcttatctcttctcatttatttactccatatatgtttatagctggcttatagtctgttattgtactaacttatttacatagtagaaactccacataaattagttaatattctgtatgaagcagcccttaacttcttcccaaaattctccctttaacttctttccaatttcccaaatattttctgttccaactttttttacgggattttccgatccgacattaataactatcccaaacgccacgtctttttctttggagcaaaggaaatcaaaataaaaggctagaatctctccttttccatttccctctcctaattggacgcttttcgccttgttggtgcactgtccccttcgtctcggagggaagctcgtattggacgcgccgcgagcaggtgacgtcagcggcagcggcggcggcggcggcgggcggcggcggagccgaggaggagcgacca

SEQ ID NO: 3903 - DNA, 1501 bp, Oryza sativa
gggctaagttcaaaagtgtcgcaattaacaagcatatactccctgtgtactactccctccgtttaaaaaagggcaacctaggaggggttacatgctcctagtatctgtccagattcgttgttactaggaggggatagttgtctttttatgggatggtcacatcgttattttttttatggggagtacgttccaacttccaacttccaaggttagtgtactgtgttttgttttttttttcacgtgccaattggcaattttcctttcgtacgtgtgggctctcgtctccgccaataagaaagcgttgcaaatgtcccaagttggcaattttccttgcgtacgtgtgggctctcgtcttcgtcaatgctgctcaagtgctcatcatttgttggattaggcggtgcttggatctagggacttaactttagtctctatgtttagacactaatttagagtattaaatatagactacttacaaaactaattacatcaatgaaaactaattcgcgagacaaattttttaagcctaattcatcttgcgaattagtccaagattatagatgggttttattaataatctacgtttaatatttataattaatgtcaaacatcagatgtgatagggataaaattgtagtcgtatctaaacagcgtcgtactctactccactctaccccaaggtcccccacgctttacacgggcgccaggctttggatctcgatccacgggctgctgatcaaaagcacgtggtgccggtttctgcgtccgtgtggtcaccgatcagctccatgctggttcctgtataattttggcccctggctaacaagccaatttggagatggtgagagtgatactccctccgtttctgattgatcacctaactaaaaataaaatcagaatttatagattgattgttactccgtacataaccttgtcttcttcgtgtgccgtgcaaaattgtgtatataacctctccggcaaaaagaaaaagaattgtgttggcttattagcgcatgattaattaagtacccgtccgttccaaaatataaatatttttggacttcgacacattcttcgagatactactttgaccaacaatatctataagataaatatgttttaaataaaaaattgcatattatgatagtttgtttaatgataaaaaattgcaggaattcaaccatgcggatacagtcactactacttacgcgccttcgacatgtacttaagaaataaaaacactgaaattaaagtcatccggccccaccctcaccctctctagctgatgattagtcgattactgttttcctatagccatcgttatacacgagtttctgtggtgttagcgttgatcttttgctaatctctgaatctagcacgcggtcggctgcctataaatttggttgctcgtcaagcctctcatgccaccattaattgcgagctgcttcttcttcccgttcttgtcaagactgaaactcactggatcatcgaggagtggcaatgg

SEQ ID NO: 3904 - DNA, 1501 bp, Oryza sativa
tccaaaataattaattcttcaaacttctaacttttccatcacatcaaaactttcctacacacacaaactttcaacttttccgtcgcatcatttcaatttcaaccaaacttccaattttagtgtgaactaaacaaagcaatgtgcagcatgtaatgtaggagtagttatgttctttttccccttctttttcctaggtctcaagaaatatgagtcgccgaaaggatcttttctacttatatttgacggctcagatatcttctctctttttgtccttttagatccgatggttattatttgttacatgatatggcatattctagttctattttaatattaacttttcactagttaagattggaggcaaaaaaaaaatgctctgaagtgaagcgaaacgaaggatctcctatagtgtgctccctctattttaaaatatagtaatttaaaattaaatttaacatcaattagtattatgaaaagctagtatcaaatttaggttgatagtagtatactattatatattttaaataagagaggtaagagttccttaacgattgtaaacttcttcattgcgtacgtttgtgccaaactgccaagcctgtcatcaactttactaaaaaccgcctttttcattgttgaccttagaccttgctaaggtatgtgcaatcaagggtgtgttttttaagtacatttacatttactctctttttttcgtgtacggctttccaaactaccaaataatatacaattttaaaaacaattataacaaagtattattttaaaggtttttatcctagttcttaatagattctaaactaatccgtcgctctatctttcgtgttgaggtagggttcccaaaacacacacaacacaacacaccaaacccaacccgagtacccgaccgcgcgcgtgccccctttcccctgaaaacccacaccaccaccgcgacacgacacgtacgacacgacgacgccgcgagtcacgggagattagccgaagaccgcagcggcgccccccgcgcgcgcgcgcatgtgatccgccccgcctccgcgcgcccgccgatcgattccgacctgtgtcgccgccgcacgccaccaccaccacggattcctcttcttttctctcgcagccatgaataatcccccgaaccccagtatctatctatccatctatctatctgctccatcctctcacgagacaagataccaataatcctgtggcttccgtgatttctcccaaagcaacaacccgagccgtgcttcccttcccctcttccgtccgtttgttttgtccgtctctgcttgtgtttttggttggatcaggacagcaacggccgaccacaactgctgatatgatgatatatcactgctaacacccgaaaaaaaaaattgggcaacgagaggaggaaaaagaaatccggcaatcacctggcgggaaaaaagaatgaaaaaaaaaatgaatattgagagagagaaatttgatggacacagaggaagtgcaagat

SEQ ID NO: 3905 - DNA, 1501 bp, Oryza sativa
agagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattttatagctctaggatcgtgtttacaacatagctttgagcaactaagtgtcttttaatgctatttactgcaactcctaacccctatattataattccattgtactcctttgcaattatgctgcacttgtgggtgtgtcttgttgagtacggtggttgtactcagtcttgctcaatttttcccaaacccagaagaggagcccctggaagatgaaggctttggtgtctagctcgtgcctgccgtcaagtgcctgtggtcgtcgccctagtcttccgctgttcttcgttgtctttgagtgtgctgggccgtcgctgcccatgtaataattaactatttacgcttccgcttgttaaactctgaattgtatcaacttttggtgtaccttgcctcctgggacaaggaataatacacgcacgtaaggaacgcccgttgggtgatttccggtcgtgacaaccatcatccaatggatcatcacaataaacaaaatacacaaataggcatcatgcacacgttagcttagaaggcactgtcttcgactcttcatgtctcaaactagtgcaagtctctgcatgcaaaagacaagcaaaatacataggcattagtcaattatttgatagcaaggaaatgaagggagtacaatgcaatagtcaattatttttagtttgaaaagaatacctccatcttatcttggatctcttgaagacagctccaaaaatcttgcaggttcttcattatcagcatctacaaaattagttgtaatgattattatgcaaccatgacaatggaaaaatataaatgatcacactatgtttgaatggtacaacacatacacctttgtacttgtttcgtagccaattttgggaacacattaaggcctccaagatatctgaagtgagtcagctgcggtgctcactaagaaccctcccactagtgctgaatgcagcctctgatgcaactgggctaactggaatggcaaatatgtcccatgctacttttctcaatgtaggatattgtgtcccagccaccttacaccaatcaaaaatcttgaagttttccatattaattgagactaactcatcctccaagtacctatctagctcagatttaactcttattgctggtggcctccttcaagcaacacgtgcactaattgaagacaatacacctgaattagcaagtgaatgagctgaagattctgtgttatcttcatcctcttccatttcatactccttcatgaggtcatacaaattgtttttaacctcttcaagt

SEQ ID NO: 3906 - DNA, 1501 bp, Oryza sativa
catgctattttatttcccacacttactttacttataaattaatttaattatacatctacctatttaaaaatacctagatatctcaggaaatttataatttaattaactacaaaatgtaaatctttctcaattgttcctcaattttctcgttttttcttcccttgcaacgcacgggcactttttatagtcttttaaaatatttgtagtgtttttatcatctcacctgacataatgacgctgaaaaaaaataggaaatcaaaaatagatagctcccttcacaaacccagattcgtattcctggtttgcaacctaggactaaaggggttgcaacccggactataaattctctagcagttccaatttctttaaagtattatgtaattcacgttcttattagctttgaaccatttatttaaaaagtggctccaactagctaaagagtactgtactctctccttcccaaattgatcattatataatgaaatctaaaatttctcaaattgatcatcatataactttatggacgcggatttcatcggaatacaattaatgcaacatcggagaatgtgtgcatgctagcgaccaattttattaccatttctaattcgatctttattcctgatccaattggtactacatctcctagcgccggtccccctgctccgtgccaatcagatctttgttcccgatccagcttctcctagcactggttacaacgctcggaggccggggaaagaccggccgcgacgatggccccaacctttggcaccctgtgtcatctcctcgcttagagcaggtacaatagtagtagactataaaccagctataaccactgcatatatcgagaaaaaaagagaagagagaaaaaagcgggctacaaatttatagctagctgcaacacggactctaatatgttatgtgtgtatgagatgtgggaccgggtattaatggtgtagtatatttttatagttaactattgtataaatgggctattagattatttatagataatttagagtcagtagttggctatactattaaaatactcttaaggattagagcccgccctctcgtagtgagttcgtttccaaggttgggtgctggggttcttggttaaatatggcgtatatacataagtatataacgtatataaattttatataagtatgtattaaaaaataaaaaaactagaaaatatattatgtatacaaagtttgtatacacataaaaagttttttacacgtatataaactttgtatcccgtaaaaaaaacaaaaaaaaaacggaaggaaaaaaccgaagaaataccgaaaagatacaaagaaaaccgaaaaaaatcccacgcgcggcgcggcttctgccgccctcctcatccgcgcggacgtcggcgaattagcaatttcgggtatttttgctagtaattaataataggtatactatatatatataatctcctagggcttagggttttaccttaatttccttctccaactcgatcgat

SEQ ID NO: 3907 - DNA, 1501 bp, Oryza sativa
tggagtagaaccaaagtccaagttgtgttgagagagaactgaatggaacagacaaattaagagatgggggtgcaggatcttctcgccaaactgaacattggatggtccgattttatcacggaatttgtgcaaagctattgccaattacagtgcattattttgtgaagggactgatgaagaaaatgattgtatgttgtctacacgttgaaacatttaaagagtaaaaaaggagagttcggcatgaccgtggacatgattaagaaccacaccctgcaccctgcagagaatgacaagcttgtcaacaccgtatcatgacatgaccagttgcaaaagagaaaatgatttttttttacggttgaaagacaaaatgaaaaccactcaaaacctatacgacaaaaggcattacacacaatttcctttctattgggtgaagaaaattggtataactaaaggaacaatctatatgatgtggtgtaactatagagatatataagtgggccgacccgtgagtctacttatatgtcaaataagaagtaacactcaagtttttacgtcatggtcctagcttattgcacctaaagatgtaggtgggtagatacataaatctatttataggtcaaattacccacaaatggattcgcgggttacccactaattttacatgcggattcgtgggttggtccacttgcaaccatagacgtaactagtggagttgtaagtacatgactccacacacactaattcaagttagaagaatataatgcatatatgattgcactttcaataaaacttagcgagactaaggactagcttttaatacgaatttgttgagataaaggtttaccgatggtgttcgtctcttcgaacgtattgccgtgttggtttttccctgtttgggtatgtgttggtggcatattttacatgtatgtgctaatgtgcatgtagtatgagcacacagtacggtgcgtgcgcgcatgacagccatcgtttcacttatactgattatatacataaaggcttatcagcaaccaacatatactttgttaatagaacttctatatacatatgtatagcaatttaaagcaaatgctggaaataaaatacgataaaagccctaaaatcaactctaaaatcaaaatttaaaactaattttttattcggttcataaccgtcttaggataaacgataggtgtatgtcatgtgtaatcgaaagagaatggtgcaaaggaaatcaatgaaaatgatgatagagttatgggtgttacccatcaccaaagattaagggcccctttgaatcgtaggaatgaaaaaatggaggaataggaaaaagtaacgtaggattctaacaggaatgtaaatgaaaaacagaggattgcagaacgcaggaaaaacacaggaatgaccgtttgattgaaccgcaggaaaaacacatgaatggaatgagagagatagactcaaaggaatgtttccaagtggttggagctcttgctaaatttcctcc

SEQ ID NO: 3908 - DNA, 1501 bp, Oryza sativa
ccacatacaccacttctacctactcttcttttgggtggggactcaccctatcttccaaaaaaaaactggcttgcgccttcgcctggaagctaaatcacagcttgtctttgagtgaggcccagcgtcatcactcgcctgacaccggggatctccctgttactccctcattaatgggcggagatttgccatggctgctgtccgaatgaccctccgatgggatgggccatacctacctccactcggccggaagcaggcgtaacgtgggagcacggttgtctgccgatgacgtgaccggcgtcagaccagtcacaaaccggtcattcttgtctaccacgtgtcagtttagcatgccacacgtcagtttagcatgccacacgtcagcccttcttcataaaatgacttccttgtaatggttgcgatgaagcctggtatgaatctagccgggactgacgtgctgactccaggagttagcacgtcggctccggctagggacgagtgcctagaggctctcatcattccgacgggacggggcgaggcgtgcgaaaggccgcttgttgccacctaacccgcgatctgaccggtctgtgaccggtcacacactgtgacctgtcacggaccgaacgagtgtgctgcgctgcattaaatgcggcgtggggcactcgtccaacccgcaataaacgcggttaggtgagcgccgctgtgctcacctaacccacacacgtggcgccaaacccacagggggtcggggcgccccagccctcggggccgaaacgggagcggcccgacccctcggggagacagagggaggggcggccacatcaccctcgggcccgacccccccgagggggtcaggccacgtgggtgaccgcggctgccccaaaacatctagtcaagatacccccggtcccatgtcaccgactgtagcccctggcgttatgccagggcgatcgccctcctcgagaaagcgctcgggcgtgacgccactccttaggcctggtgataggtggggccggtctctacaggcgggcaggaatccagtggtcgcaaatcgcgcgcatcggcaagggaaaaccgaccgacaataatgagcggctttcttcaagaccgctacattacttgagtagcgcgcgaatcgggacgagccggttcgtttcgcctggagatgtgatgatggtgcatcggtcggcgagcgtagttaacgcgcgcacgatatgtcccatctcgaccgccacggccgcacatccgcctcgtgcgccgcaaacgggcgagcgggattagtggaggagtgggtgcgagaaacgagggggtgagatagtgggcgcgggaagcgaggagccgggcatagcgttggcaagggtataaagacgccgaggaagagattcgtttccttcctctcgccattattccccttgccttcgccgcttgcgctctaacttctcgtttcctgtgccctaccctcgccgcactcactcgctctcaagcccctcctccgccggcgtca

SEQ ID NO: 3909 - DNA, 1501 bp, Oryza sativa
acaccggctgtacggtgaagaaccaccggaacagccggagagatgggcgcaccccgatgaacatctcgcacaggtgcgcgaagatggccaacgtcattacagcgttgggggtggggtgcgccatctggagatcataaagctccagaacatccatgaagaaagaagagaatggcgggaccagccctgccattgcgaaggaaaggaagaatacggaccgccccgggtagtgtggcgccgggcatccctcgcccagcgcaaccacctcccggccggtggcagattccggcatgaatcggcgcggcagcccggcctgcctctcgctcacgatgcgagaaggcggcagcacgctaccgtcgagcggtgcggagccccgtgccatgacgccggcggaggaggggcttgagagcgagtgagtgcggcgagggtagggcacaggaaacgagaagttagagcgcaagcggcgaaggcaaggggaataatggcgagaggaaggaaacgaatctcttcctcggcgtctttatacccttgccaacgctatgcccggctcctcgcttcccgcgcccactatctcaccccctcgtttctcgcacccactcctccactaatcccgctcgcccgtttgcggcgcacgaggcggatgtgcggccgtggcggtcgagatgggacatatcgtgcgcgcgttaactacgctcgccgaccgatgcaccatcatcacatctccaggcgaaacgaaccggctcgtcccgattcgcgcgctactcaagtaatgtagcggtcttgaagaaagccgctcattattgtcggtcggttttcccttgccgatgcgcgcgatttgcgaccactggattcctgcccgcctgtagagaccggccccacctatcaccaggcctaaggagtggcgtcacgcccgagcgctttctcgaggagggcgatcgccctggcataacgccaggggctacagtcggtgacatgggaccgggggtatcttgactagatgttttggggcagccgcggtcacccacgtggcctgaccccctcgggggggtcgggcccgagggtgatgtggccgcccctccctctgtctccccgaggggtcgggccgctcccgtttcggccccgagggctggggcgccccgaccccctgtgggtttggcgccacgtgtgtgggttaggtgagcacagcggcgctcacctaaccgcgtttattgcgggttggacgagtgccccacgccgcatttaatgcagcgcagcacactcgttcggtccgtgacaggtcacagtgtgtgaccggtcacagaccggtcagatcgcgggttaggtggcaacaagcggcctttcgcacgcctcgccccgtcccgtcggaatgatgagagcctctaggcactcgtccctagccggagccgacgtgctaactcctggagtcagcacgtcagtcccggctagattcataccaggcttcatcgcaaccattacaaggaagtcattttatgaagaagggctg

SEQ ID NO: 3910 - DNA, 1501 bp, Oryza sativa
gccttcaggtgtatgagcgtgccagttgatttgatcctgcaatcaataagaaatagaacaaaaaaaccgcaattaatcctataaatgatagccgatcggctaggtgccgatgacatatcatttatttcaagccgatgtcatacgtacatcgatcggcaaatatcaataagcaaatcataactaaatctactcgatcggctgtagatattaatgatatataatccttatatcgatatatatttaaatcaagtgattgggatagatcggtcgccttgccgagacagtataaatcatttagatcgaaatatatattaatagtgggattagatacatttatatcatagccgatcaaatgtatctagcatgcatcggctaatactccgataccactctatattaagatgttaaagcaagtagaatataccaaacagaagtctaatatatctagatgcgacaagatcctaacataaagggcagatttaacacatagatcaagcatatagaataaaaagggtggcgatgcgctgagattgtattggatgagtcctttttttacatagggctcgggtctacttatatctgagaattacaagatacgtccataacggacacgactattatctctaacaaactctaagataccataagtctttacggcagacttttgcccaaacatattgtcacgccccaaactagtaccgaccggaactagcccgtgacgctccaaattaacctgttaatcgataccagtcccaggaaacagtgctggtatcacagggagacagaatatcacaacaacagaggtctctttattatagagtagaagtacagtcatgttgggctgcggacagatcccgagctcacaactgcattacaaaaggaaagcggaagtcaggacttggaccaatcatcacaggcgcgacttgggaactaggccgaaaccctaaaactcatcgaagccgggttgctcttggaagaactcttcatcagccggatccgcttcatcttcttcagcaactgggggggggttatttatatagagcaagggtgagtacgggagtactcagcaagccaggggaaataaggtgtttattgcaggcttcaagggaaggctgttgttttagcaattgattttatttgaaccattttctgaaaacaactaagtgagtgcttctcaaacgacacggatgagacagtgcgtctcgtccggtcggagtatgtgcaatgtatcagtctttagaattgaaacaaggttggcacccggccaacagctttttcaaacggccacctgggccaacaacttttcaaacggccacccgggcctagctgatctcatcagctacagatttttcaaacatcgaaccccttttctcaacagcaatttcacaagcagtagtcaaacaaaactacgctaggaatcacctcacatccgcccatgaccgtgggcacgactattcgaacagtttgttaacctctgcagagggggtacactttacccaca

SEQ ID NO: 3911 - DNA, 1501 bp, Oryza sativa
tgagtagcctccccgtagttagccggcgccgccccgaccgttgccgtcgctcgccgtgtgctcgccgccgtcgccgcccgagctccgtagcccccgctcgtcgccagcctcgctcggcgtagttccgcccaatccgacgctagcgtcgagttcccgaagccgcgtggatgctctcaccgccgggaatcgacccctcgtggcctcgtcgccgtttccctcttctcccgccgccggttgccgccgccgcaatccgccgccgtcgagcaacctccggcgaatccgagccgttggctcgtctccccttgtcacgtacaaccacccggtgtgctcgcttttgcccgtatcgccgtggttcactccgccgctcgccgtcgccgcccgccgtccaatcgcggccgggtcgtcgtctacctcccgccggcccgcgaggcagccacgtaggcgccacgtcggcgccagctcagcctagaccgggtcgagccgaccccggtcagcccctccccttgcgcgcgttccaccgcgagccgagaggctgcgcgtgggcccgccgcacccgcgtccaccgcaaaccgcgcgcgtgcaccgcgtccctcccgcgcccgcgcgcgtgcgcagcatgctcccacacgcacggtgagccgagccgctgacaagcgggtcccacccgggaccgcgcgtggtgagccctgtccaccggcccatcactctctcctccccccccccgcgcgcgctgtgggccgccttttgggccggccggcccattaagctcagccgagccgccccaaatctcttgggccgcaccctagccgcccgagaaaagtctatattccctccccctttttttttgcttttctttttcttttccaaaaaggatttaattaaatccttttcctttagaccaaaaatccaataatcttagaaatacaatatcttcccaaccgtaagtccgtttgactccgttcaactcccaaaattcctcaaatctcgagatctatttaatggcatgcttagaggtcattaatagggctttattttcgccgtttgttgagttgtcccgtttcgcgtgtagtttcggagcccgaagacccgcagtgcgaggatttcgaggatcaagctccagatctcgagcaaggcaagccacctttgaacatcttgagcctatatttgaaatctaattatattgcttgaaaaatattatgcattgataggatcgcatttaatctgttgtcccgtctgcaaggcagattggcggacttacctaacttgttgcatttgatccttccattgttaattgctacaccatgtccccttgtaactacccagttgcacctcgatattcgtgcactctgtgcgagtatcgacggtcgccttcaaacttaaaatctgagtaacaacttgggtaaaacttgggttttacaaaagattggaaaacccgacacctgggtcggtgcttgcgaactaaatgaatttccaaaaccgcggaccggggaacgtaccgggt

SEQ ID NO: 3912 - DNA, 185 bp, Oryza sativa
tggggcctgggaataatggtagaggtttttcttttcatttggccaatttttaaatgacatagtgttgccatacccgccccccccccccccccaaaaaaaaaaagtcattggctgctactggtcttagaacgacgcctttctatattatggaacattatggaacataatgttttgtgctctgcaga

SEQ ID NO: 3913 - DNA, 1501 bp, Oryza sativa
gctacaccatgccagctaggcttttcgtgtgcgtggcagatggatgcgcgccctagctgagctcctcgcccccaagcagagccgcgcggaacctggtccaagcgagggagcgcgcgacgccgaaatccccgggcatgcgcactgtgggcagcatcgcctcgcacacgcgtgccctagcaccgtgaaatcccagaatcgtcctcccaaaatccactcccgccgcagcgaagttcctcctcccgccacaacactagcgctcccgccacagccactcttcctccagacaccaagttaggcacgaaaattttcgggattggaagagaataactcaaataagacggattcaacaaaacaaatcgagacgtatgtacaccacatgatgaaaaaacaaatccgccgtgtccgccaaatccgacgccgaccgccgcatcggagtcatctcgccgccagggggagctcggggagaaggagggaggcctggagcggcagcgtccccatggcagcgctagaggaggcggaggagtcgaggtgcgcggcgacatccaccatggcggcggcgtctcaccgccggatctacgcccccaccacctcctcctcgtcgctacagggccttgcgccgaagaacgccgcgtccgccagatccgccgccttggccaggtcgtcgccgagctccgcagccaacactgccgcaccgagcccgtccaccacgctcccgtgcggggccagtgaagagggggtgcggaaggaggggccgcggtggcggtggggagggcggaaggaggggcagcggccatgcaggagcggaggagtaggggcggggcgggacgagacgaggaggaggaggagcggtggcgtgggaggaagtagagcggagaagacgatggaggaggtgaaagcgagaagagaagacgggtcgttgtccgagggtaggtggggaaattgatttccttcggtccccttcgctgccatccaccaagtcacgagcgttgtgggccggtttccttgtacagtgcccaaatccaactagtcacgcaaaataagatccttgtaccgtgggaaagggtgtctttgagctaaatgtctggggtaagacactaccgtcggtgcttgcaatgtgaatggcctcacctcaccccaatccataggcgcgattggtcacgtgacgtggcgctcacccccacctcgtcctcctcactctcccactccacgagacggcttgactttcttcgtcttctcctcctcctccgcttcgcctcctcgcgcagatcccgacgcacacctcgcgcccgcgccgcctataaattcccccgcctcgccgttgccgccgccgcgggaagcgaggcgaagcgagggagcgcgtctagatccgcaccggcgaaacgacccaagctgcctttcccgtcgccgcacgcatcatccgggctctgttgctgctgctataccgcgcccgttcgctgtagcagcaggaggaggaggaggaggagcggagtggtggcgatgg

SEQ ID NO: 3914 - DNA, 1501 bp, Oryza sativa
gaaaaaggagcctccacgttcgctctcatgacctggaaattctcacattaatcggagaaaaagaaaaggcagaatccatatagaaatacaatttagaaatagctaaaattctaaatttaaaaaataaggaatattagaagaggagactagagtccatatagaaatacaatttagaaataattgaaattcagaattaaaaaataagaaatattagaagaggagactagagtccatataaaaatacaattagaaaataactgaaattcggaattaaaaacaaggaatattagaagaggagactagagtccatatagaaatacaattatgaaataactgaaattcggaattaaaaataatgaatattagaagtagagtatagagtccatatagaaatacaattaggaaattaggaaataatagaaattcggaattaaaaaaaggaatattagaagtagagtatagaggccatatagaaatataattaagaaaaaaatagaaattcggaattaaaaaataaggaatattagaagtagagtctagagtctatataggtatttaaaactaactaaaattcggaataaacataataaaatgaaaagtagtgtttagagtccatataaaaatgcattttataaataaataaaattcgaaattaagaaaaacatgggaagaagagtttaaagacaatataggaatacaatttagaagtaactgaaatttgaaattaaaagttattgcaaaatttaaaattatgttgtcattgtaatatattttaataaaataatgagaaaatatatatgctaaatatatgagagaaaatataatgatgctagccgcgcaatctgcgcgggctaccgtgctagttcttttgatttctcaaagggatgtccactcgtttgctaaaaagtattatctcctatcaaaattcatacaatgtatatacatacaacttcataaaatcctaaatctatactcaactcacatattgagaaataataccaaaatatggtaaggtttattttggcgacaaatcaaacacatcagctggttatatattggtaatatatatagcctattaagtaattgtcagttaagtcaatgaataattattaatattagatataaatgtaatttgcacatacacaatcggcaagcaccgatattgaagaataggtgactttaaatgttcgtggaaggtggcatcatgtcgaggagcaatacaggggagcaaaagtgaagggtgttggtctagagaggtagatagctaaaaagagatggatcgatcatgcatatataacgatgcactgcactgcagctagtgtagtagctttaaaattagttggcgacacgcaatagccacaccaaaacctcctgaaaaccactataaaacacgccaagaagcgtgctcgccacactgcccatccatccactcgatcgatctcagctaattaattaagctaacaggccagccaatcagccatggcggccatgatgaacaacg

SEQ ID NO: 3915 - DNA, 1501 bp, Oryza sativa; identical to SEQ ID NO: 505

SEQ ID NO: 3916 - DNA, 1501 bp, Oryza sativa
ttgccacggcggtcccttcagagtggtttttatagccacggacgatgacgacgaactcgttaaggcgagcgtctactcgtcggagacgtgtgcgtggaacaagacagtgattcttgctgatggttatcaaacctggcaagagcgtttgcaagccatcactagaggtgaatcataccgtacaccttatgtccagcccaggcgaggtgcccttgttggagatgaaatctacttcacgcttcggaatgagaatgcaatcatcaagtacaactgggccgcgaactgcttatctaagattgacccgccgatacgagatgtgtatgacatttccctcatggagatggagaacggttcactgggttatgcctgcattcagggttccagcctttatgtgtggtcgaggaatgccagttcagaaggggctgcagaatgggtacagtgctgggtgattgagctggagcaaatggtacctgttgccaatcgcggtgatgaagcatttgttgttggctctgcagagggtgtgggtgtcatattcatgagcacaggtgttggattattcacgatcgagctcaagtcaaggcgggtgaagaaggttgaagagcctggggtctactctagcgtcttaccctacatgagcttctacactcctggtattgtactaaaaattgcttatctcctgtccttcatttcctttacagcttctatatatttgctttgtcataatgtaactgcaatattgtaatttcaattgacaaaaacagttttgtgtatgctagagaatactgaatagaggcattgcaaatcagagccttaatttttgtgatgagagtttgcttgctaagaaccatgaccttgcattggtctaatatattcgggatacaaacttgttgatctggtatatttgttactctgttactttcaagcatatctgttactcaggcccagttgattcatggaatagttcatgcagcagtaagtagctaataggctaaactggctattgctaaagatttatagaagccttcttgttatgatatttatagaaacattagattttccttaaatggtattggtaccttctggcatagatgaagctcatatctcagacccaaccttgtaacctttggaactggttctctgtacatagttcgtcaaactgtaaagtttgagctggacagttggttatgagttgtgtgcttgactgtttggtgtgtttctttttttcagatcgtggcacattgttatcgctagcgaggactcactgatactcaaaacatgttgcaattgacttcttccagaactaccactatgaaatcatttattttctgttcggcagtataagtatgaacaatgcaagtaatcatgtttcgaatgtggttctagtgtcgaattcatcctaccaaccatgaactgtatttaatttatcatgtctggcatatttcagttgagcctcaggtacaggaaactaaaatctaaaattatgttgacttttgttgcttccatt

SEQ ID NO: 3917 - DNA, 1501 bp, Oryza sativa
tggtattgtactaaaaattgcttatctcctgtccttcatttcctttacagcttctatatatttgctttgtcataatgtaactgcaatattgtaatttcaattgacaaaaacagttttgtgtatgctagagaatactgaatagaggcattgcaaatcagagccttaatttttgtgatgagagtttgcttgctaagaaccatgaccttgcattggtctaatatattcgggatacaaacttgttgatctggtatatttgttactctgttactttcaagcatatctgttactcaggcccagttgattcatggaatagttcatgcagcagtaagtagctaataggctaaactggctattgctaaagatttatagaagccttcttgttatgatatttatagaaacattagattttccttaaatggtattggtaccttctggcatagatgaagctcatatctcagacccaaccttgtaacctttggaactggttctctgtacatagttcgtcaaactgtaaagtttgagctggacagttggttatgagttgtgtgcttgactgtttggtgtgtttctttttttcagatcgtggcacattgttatcgctagcgaggactcactgatactcaaaacatgttgcaattgacttcttccagaactaccactatgaaatcatttattttctgttcggcagtataagtatgaacaatgcaagtaatcatgtttcgaatgtggttctagtgtcgaattcatcctaccaaccatgaactgtatttaatttatcatgtctggcatatttcagttgagcctcaggtacaggaaactaaaatctaaaattatgttgacttttgttgcttccattcagagatctgcaagtcatgcgaagctgaatagctggatcatgtttacttcgattacaaccttacagggccggggtagtgaggtgggtttgatcagtcttgcaattttttggtggtcagttcaacccgaatatgagtggaatattcttttttttaccaactaaacccacctaatcctcaaaccaaacagctgcaaaaaaaaaaaaaaaaaaaaaaaaaaaggatggccccgacccgacgttcaacttgcagctacatactggtattcaagtagtagctcctgccccatcttaactgccatcttagtgaaccttttgcatcatgtcttattggcaggaaaatgttttggacaaggacgggaaatatggattatagcatcatcgatcctcttgcaccaaacaatgctgccgtttttgtttccgtttcatgaataaatgaatgtcaagtggtacagctcgatcgaaacttgtgctctcaacattttatctgcttgtttccgttcctacaatacttgtggactacgattactttttcagttgtagactactgagtaccgactacggagtactaggcttttgtctgatcactactgtgctcaacttattcaggagttctttatattgtttgggacagggagtcgtatgttt

SEQ ID NO: 3918 - DNA, 1501 bp, Oryza sativa
ttacgtcgtggacaatggtgccggtgtgttctccaaggacccgagggaagccgcgagacaggttgccagatggttcaccacacacacaaacgagctccggagatactccctcaacgcgctgaagctagcgcagccagaagccgtgttcgacatcgtgaaggacatccacaagctccagcagcagcctgccacggtgacgcggatcccttactccctgacctcatcgttctcatacagcatatgaaaaaccatcaaggttacaggatgtactatgctatgctctgcaaacatgctttgcctcggaaggttggtccgcttgctgaagaacttgtacatactgaattggatttgttcgtttgtccaaatgtgtaaatgcaataagaacagatgaactgaagatgttgtctaactggcctgctgctgatatgaagatgaagttgtggtgagagtgactgactacgagtgacaaatcatcccctcccatagctaaatatgtcctgatagaacatcttcatcttttgtacaactacagtatagttacgtggctaactggaccatctgcatagtttttctttttcactccttgtcaatcgtattgatactagattgtttggcaccatattctatcttataacttagcgattgtataatgttgtttcatgagagtattgaaatttgaaatttatatatatagttctaaatagacagaaattgtcttgatagtttttcatatgagttggaaagtgcttataaaacaaaaagaccgcgcctgtctagacattgtccacgagaagctggtgaagaagttggagcggttatgtactgccagaggatatgaggatgtgactagttttgctgctccaatttgtctatgtttgtttctttgaatcgtggtagggttaaaggatgagcgtctcatcgtttacaacctctgatggaattggagaacatttatattgagctggtgttcccagtcttttcttttcgtaacttatttctgttttttaaagaccttattacttatcttttatttttttccaaataaccggataatagtatttacctgttggctgaaaaaaatagacagttgagtaacctcttattggaggtttgttagatggcctagcctatatgctaatatattaatataaaagagggtctaataagtgtataattgtcctttgttttgctgcaatattaatgagcaacttactatataattcattgatgacaattaacataatgatgcatgtgtagaatttgcgaacatataccaaaacattgtaacaaaggaacaacagaaaatagagaggagttttaaggaaccgtaatatttacaaacgatataaccagttaaccatccgacactgatcacggaactagctaaaccctaacatattttttttttgcctatcaacttatatccactcaatttttaatcaatcattataaaacatcattttgatttgtacgtgcaacaaaataaaaacgatgcccacaa

SEQ ID NO: 3919 - DNA, 1501 bp, Oryza sativa
atcttgggagcgagcacttctttggagagagaagcgagatctagttcgcggggttataggagaatcgccatcgtgtagcgggattagggggaaatgaaaatttcctgcggaaaaaccgagggaagtgaattattttcgcgcgcacatagaataaaattggcatgcatgcctgatgagaaacacaaggtcccttgttcgattcctgccacaatttttttgaagtatttttcgaaggcattatttcctttagaccaaagctggttcaaattttctagaaaatattcaaaaaaaaatcctttagaccaaagttggttcaaattttctagaaaatattcaaaaaaaaatttgtaataagtggatggaaatactagatttttagatgtatttttcgaaggcattatttcctttagaccaaagctggttcaaattttctagaaaatattcaaaaaaaattgtaataagtggatggaaatactagatttttagagatttagataatactagttttttggctgactacaattttacatatatatttatatatgtatatcaattccaaattttagttctttatcacgaaaactgatatttagactacaagaaaaatacaacgttgtatataacatttttttgacaggattgtatatattattttcgaaatttgaagaataaaatcaaaatagttatcactccacaacaaatacaacattctatttataaatttgttcccatataggacttactcattattagttttgatgaaaaggatggaacttattaattttgaaaaggagtaaaactttgtatttatgaatttcaaatctaagaactattaagctaataacataaaaggtaacggtacgaatacgcagttgcttctatatataactttgtaactactaaattcagattttgaaattattgcaaaaactaattactttcttcttatatatttacaagcaaaaaagttcacacatacacaaagtatcttatataaattcttggcacaccacggcatggttgccgatattccgacaaggtacgacccaagcatgagcattgcccaaccgacccatctgtttccctatttccccctatattttttttaaaatttcacatatttttttcctattttcttcttttttttccattttctcatgtatttcctattcttcctaattatgcctatttttctctcttttttcctcccccctcacatttcttcttgtttttctcgcctcacatttcaatattttgatcatgatatcttttttagtacatgttttaagaaaataaaagccttttatcgtaacaaaatgtattatgaggaatataataaatactctaattaagttttgtgtatctttttcaaaagttttaaagcaacatcgtgaatggtgagtgtcaaattcacacaagtaatatgttagaggaataataaagggaatatatttggctcttggaaaattaaggcaaattcatgccttttaacttatatgtt

SEQ ID NO: 3920 - DNA, 1501 bp, Oryza sativa
ctatattttcagattttcttttctaaaagactatatattcctgtacacttgttaaattttgcaggaacaaaaaagtttggagagtgttcagtgttctcaactgagcaacatgcaggacagagcagctgaacaagttatcaaagaaaaagaactaataggtatttatttgtgtaatatatgattaaaatcagtcttcccaaaatgcataaactcaaaattacataggcacagatctaatattacatatgtaatttcagtggaattggactgtaactaactatattttcagatttgttaaataaaaaacttgcataaactgaaaattttatgaatattttcaggtttgtttacaccaagagttacctacagcccacaagcactacatgatgagttaacaatgctcaactcacaaacgacacaggttggtttttataaaagcattacaaaaatctatgcaattcatattaatttctattatactaacattgaaaaaattgcagccgggaaacatgtcctatactgaatctaatgcaacatgtcattaatagtccacgcgttacactacaaccttcccaggtaagaatatttctagttatattaaagtacatataatatggatcagtaataacaaatattgcaggaagggcaacaaaacttcacaaggttgtttcagacaccaacagcatatcatgtaagcaaaaaaaaaaggagcattgcctatattttgatgacatagaaagaaaaaaaaattatacaatcatgcacctataaaaaagtatacatgtactaattttgtttattactaacaatgattaattattttaatcatgcagaactcaatgatctttaacaacaagcagattttccccaaacttgggaacaaatcatgcactgccaagcattgaatggaactaccaggaatttgatgaaatttacaacaacagcagtcacaatacttatgaggtaatattaacaacaaatttttccaaacttattaataaaaaactcattgctgtgaactaacatttgtttgaaaaaaatgcagatctcagaatggacaacaattgaagatttgtatgaattgaagaacacacatttcaaatcacaggtatatatatatatggttcaaaaataaacagttatattgacaagcatagaaaaaaaatagttaaaattaattttgctactaataaacatgcagggaaaatcaagcagtttcacaaatggagatgaacaaccagcaatatacacaaacaatgaacaggtgaaattgaaaacttgacagtgtaattagtagatatcatgcattattcataatagagcttacataatagtactatttaacttttgacaggaaattagtctatgcatacaagatcaacatatggacaaggagaatggaactgctcaagaaacagttgaagaaattcaaatacagcaaacagagcaacatgagacaatgccagaaagcaatgaaacatcaaattcagaacctaacagc

SEQ ID NO: 3921 - DNA, 1501 bp, Oryza sativa
tccggggtatccatgagttttgtgggtgtaggtgttggatccgccccgtcatcggtggccacaaagaccactcggaagggaccgccgtggcagtcgaggtggtcacagccgctcacggcacagaacacagcgctggagtagatcagccacgggatgccgggctctggcacgcggtgctgttcgccggtgacggggtcccagacaatgagataccaatcatcgtccgaagcgtggaggagggcacggccatggcggcaatcgagggcccggcgaaaggtgggatcgggcgagaggggcactgcggtggtgcgggcgaggtggggggcgggggctccctgtagaacttggcggcgtaaaggaggccgagcaggggaggggatcggtggaaggcgcggtagcggcggaggaagccggggtcgcagatggcgcggagccattccttgcagactagggcagcgcggaagagttgctcgggctcgtccggcgggaggcggaggaggatctcggagaggagctccggcgcgagcgaggcggtgaggtcgtccatgacctccggcgtcggtggcggcagcgccatggtgcgcccgtggtcggcggagcgggggcaggcgagccgcgcgacacgagagggtttgggtggggattgggaaagagagagtgagagaccaagaatgggcaaggggggaccgaccgcacgcccgcacccgcgctgccttctacccggtccggttcgaccctatcctatactacaaatttgggtttgcgaaccttcgattttgagtaaacaaggcaatattcgtttctgttgaattttgatctgctttaagatctgcattggatggtgggcctgcatcatggactgtaacgtgatactcccttcatccacaaaagttacacatattatttttgacaccaagacgtaatctttcacattccgccaaagaagaaattagaaaaaaactataggctgacgccaaagattccatccaaaaaaaaccatattttgactgtgcttcaactatatcaactgtacttgaactgttggataatcatagtcgacgataacatcacagttcccaccgctattccaaaaccgtacatgaaaccttagtttcatacggctcctctatgatcagaaaaaaggaaagtactttttcatttcattattatcttcttgggcgtagttagaattatctaagataaaatcgatttcaacgtcctaaattagaccaaaggaattctgtctgctagaataataaaaaacgcttcggaattcatctcatcctttataatataatggtatttttttctttgttcagcaataacttaatcttgaaatgaaacactcgttataacaattaataaacgaagaaattaaatcatcttagatgttacaaaatcaagtagtaaatgtaaacatgcaaccaatgagtatttcgaggactccttaggatctaataaaaacatttaatttatctcttcatttaagtcctgaatgtat

SEQ ID NO: 3922 - DNA, 1501 bp, Oryza sativa
cgtataagcgcgcgggggggggggggggaggggggggggccctcgagatatgacgtcaccctctcgggctctgccgcagcttcgccccgaggccctcacccgactgccgtgtggcagagggagagagcaagaggggagcgcaggctgagcaagccataaatgtgcgacgccccaactgtccctcaccgcatttaatgcggtcagggcagatgtgcggcgtgcctagctaacccctgtccatcggatgtgaccggtctgtgaccagcccgtctccgtcacatccgatggataaggcaaacatgtccccacgtcgccctttgtccccggcggagtgggggtgagtatgacccatcacatccgggcgccactcgaggaaggactgttgcatgtcaccgttcatttatgagggaatgatagggctgtcccccgtgtcaggcgggggacggcaccgggttccgcgcaagaatcggttattgcttagcttccggaagaaggcacagttggaagccaaaaaaggtggagtggggtttttcctccccccccccccccgcgatggaggggaggtagaggcggcatatgtggtatccccttaagctataaaaggaggaccctgcccaccgaaaaaagggggaggcccagaaaagcctgaactccagaagagaggaagcgagcgcgctctctggagtaaagaaacccttgtaaaacttgtccataatcccaaacacaggagtagggtgttacactctatagcggcccgaacctgtataatccgacggtgtgcattcactcctaatagtcatagggacgagcaagcgactaacgagagacgagcctccgcccccggccgaactcatgaaaagggggtctcacgactccctgctattgagggtcttccctcaacacaatcaatgtatgatagtgctgttgcagatatattttgtatatattttttaacatataagttaaaaggcatgaatttgccttaattttccaagagccaaatatattccctttattattcctctaacatattacttgtgtgaatttgacactcaccattcacgatgttgctttaaaacttttgaaaaagatacacaaaacttaattagagtatttattatattcctcataatacattttgttacgataaaaggcttttattttcttaaaacatgtactaaaaaagatatcatgatcaaaatattgaaatgtgaggcgagaaaaacaagaagaaatgtgaggggggaggaaaaaagagagaaaaataggcataattaggaagaataggaaatacatgagaaaatggaaaaaaaagaagaaaataggaaaaaaatatgtgaaattttaaaaaaaatatagggggaaatagggaaacagatgggtcggttgggcaatgctcatgcttgggtcgtaccttgtcggaatatcggcaaccatgccgtggtgtgccaagaatttatataagatactttgtgtatgtgtgaacttttttgcttgtaaa

SEQ ID NO: 3923 - DNA, 1501 bp, Oryza sativa
ggcacgccggccacggtgagcaaccgctcgaggacctgcttggcctgctcgggctccgccgtttcacactccagctcgtagttcgtaccaaagtcgaagcgcgtctcgtcgagctccacgacgagcccgagggtgtcgccctcctccagctggtacacggcgcgggtgttccggaacccgccgaggcagacgaacggcgcggcgtccccgccgacgccgtactcttcggagacgagccgaatgatcggggactcgaccccgccgaggcttgccgggtcgtcgacgcaggcgagggcgatggcggggtcgagaggctcctcgacctcctcgacgcggctgacgcccgcgtcgatgcgcgggcggcgcttgagcgcgaggacggcgcgggagggggcgcggtcgtcgagcccgtagaggcggacgcggagcgcggcggtggcggcggcaagggggcgcgcggcggcgtcgaaaaagaggttgcgctgggcgtcggtgcggcgaaggcggggcgcgaggaagaagaaaagccggcggtgcgcgccggcgtcggggaggcggagcttgatctcgacctccatcaaggcgggcgaaggggggagaggagaggctagggtttggggttgggattgggattggtagggaggccgatgcggtgggacttggagggcgcggcgccaggcggcgggtggaggaggtggaggagggggttggagttggagggcggcggggtcgtggtcggagtggatgaggcggtgggggtgctggccgctgcggcggcggcggcgcggaggtggtcttcgagctcgtcgcggtcggaggagcggagctcgatgcgggtgggcttgcggcgcagcatcgatgtgaaaggaatgggttggcccggtgcactgtggtgaccgggtgggctcgggatgagattataatggagctggaaaataaactgcgatgaaaaaaatcttaaaattaaaaatttaaattttagcttgtcggtgacatgggaccgggggtatcttgactagaggtttggggcagccgcggtcacccacgtggcctgaccccctcgggggggtcgggcccgaagggtaaagtggccgcccctccctctgtctccccgaggggtcgggccgctcccgtttcggccccgagggctggggcgccccgaccccctgtgggtttggcgccacgtgtgtgggtgagcacagcggcgctaacctaaccgcgtttattgcgggttggacgagcgccccacgccgcatttaaaaaagcgtagcacgctcgttcggtctgtgacaggtcacagtgtgtgaccggtcacagaccggtcagatcgcgggttaggtggcaacagacggccttttacacgcctcgccctgtcccgtcggaatgatgagagcctctaggcactcgtccctagccggagccggcgtgctaactcctggagttagcacgtcagtcccggctagattcataccaggcttcatcgcaaccattacaaggaagt

SEQ ID NO: 3924 - DNA, 1501 bp, Oryza sativa
ggcttcaaacgtccaccaggaagcttgcaaaatgtattaccaatttgcaacagcagtatgtggggatggttgtgttcttgcacctatttaggacaatgcaagcaaagatttcagtttgtttgacacactgcagtttatatggactagtagtaataactacacaaaatttgacaactgttggatatttcaaacacaaaattgtgtacataaataatgtgaagaaagtataaacacaccaataggattgcttcaacactggtccgcattccttctttcatgtagctgtcattacagaagcaacttgtaattaacttgcattattggacagataatcttagaaaggaatatactgaggaaggagcctagctgttcataagttacatcggaaacaaagtagatatatgtaattaacacaacaatgcatcgcaatcaactgaagaaacagaaaaaaaattccagtgtcatactattttggcttgacattccgggtattcttctgacaaacgtaaattatcttgtaaaactattcatgacatagtgcttggcagctagatcaacagcgtgagaggaaaaatacatgagcaaataaatagatggtcgtggcattttagctataattcaagtcaacacccaacgaatcacccaccattataagccatgtaactaaaacaatttcccatatcaacatacggatcaaaataagtgcccacgatgaccatctgaacactagggtggcataaacagtcagaacacaagtgtttagtcttaaatcccagttaaaatgtaacggcttaagcaagcatagttcacaaaaaaaatgcctaatacactcctgtttcagtactatctaatttaagcagaccttggacctgttcaaaccgaaggggggaaaaaagcgggcatgatctgagctctagggtttagggttccggggagaagaagaaacctagcgtcagatcagggaggggtttgggggcggggacacttacttgaccttcatgcgggcgaggcggtcggcgacggaggtgtccttctccatcttgggctccttggtgccgaacgtgtagttggcgagcgggtacacgttcaccaccggcgacgaagagctcaccatcttcccctcaccctctcctcgcgctccctgcccccacctcgggcgagctctcctccctccctcttgtcgcgctctgcccgcggcggtcgccggaggagggaggcggcggggtggcggcggcggagaggagagagagagagagagagagagagagagagagagggtggctggtgcttgggcccttgggtcgtcggcccggttaggtgagggggcgtggcgttgagaagcgtctcgaccaggctcggctcgcgtttgggttttggttcggtcgcttttgcctgcgtttatagcgtagcctgtgtgttgggtatttgggtggtgagacgcggggtgcggctgatcgtagccgtccgatcgggtccatctcgaaggtaaaggtgtcgctga

SEQ ID NO: 3925 - DNA, 1501 bp, Oryza sativa
gcaacttaattttccgcagcaacgtagcggggtattcattttgtttgctttcaagtacatcaaaatttgttttgtggagtgacaattgcaatcatattctgcatatatagtaatctatccgttttatattataaggcggttgacttttttttccctaatcaaactttgttaagtttgaccaagtttataaaaaaacagtaacatctaaaatatcaaattagttccatttaatctaacattgaatatattttaacaatatgtttgttttgggttgaaaatactataatattttttctataatcttgatcaaacttagagatatttgactggttaaaaaaaatcaaatggcttatgatataaaacagaaggaatatttttcaagtccaaaagaaaaattctactatactattgttatttattattagtatctttcaaacctaaaaaaagtgtgcaacacgaggaactggccattacgtaccttgaacatatatatgccttgaattaatacacgttatatgatttgtgccggcccccatcggtgcacttattcaacgaacaagagaaacgacatatttgtaaaaaaaaattgtgaacaaaatttttatatacatgttcttagcgatctaaaattattaaaggataaaaaataaacttcgataaaaaaacctctaaatttaacttcaaatttaaagttgttaattcaatttttgactgataagtataagcgaaaagatgataccatacatgtttttttgaaaaaaaagatgagatgagcatataattatagtacatacatacctgaagctgcggcaggtacaatcattgtccattggctagcagagtcgcgggtgctgcaaaattgtcgtctctgttaatcgcgcggatgccaatgattttcatggatcaaccgagcacataagccacatatgttatatatacacgtagtattataccttgataacgtcgaagtgggtatggttggagtaggcagtgttgtatttggatacagtataggtgtatccgtgtatgtgtggaaaaaaaacgaaaaaaaaaacgaagtacttgagagcgtgccggtgaggcaatggactttgtatttatacctcagcgacacctttaccttcgagatggacccgatcggacggctacgatcagccgcaccccgcgtctcaccacccaaatacccaacacacaggctacgctataaacgcaggcaaaagcgaccgaaccaaaacccaaacgcgagccgagcctggtcgagacgcttctcaacgccacgccccctcacctaaccgggccgacgacccaagggcccaagcaccagccaccctctctctctctctctctctctctctctctctctcctctccgccgccgccaccccgccgcctccctcctccggcgaccgccgcgggcagagcgcgacaagagggagggaggagagctcgcccgaggtgggggcagggagcgcgaggagagggtgaggggaagatggtgagct

SEQ ID NO: 3926 - DNA, 1501 bp, Oryza sativa
aaaaaaatccatttctaccatcccgtagaattagtggagagtgagaatgactaaagtaactttaattattaaaaaaataataagagtattgaatggataaaatttttcgtttcacgtgttaatggtaggtaaaatgatagaagttaatttttcgtgtgataaaattcaaactttgagtattttttggaccgagggaatcttacgtggccgcagcgtatactctcaaaaaagaattaaaaaaaagtggccgcaaagtacgctctcatacgacggcgcgtccggtcaggtgccgctccatgcggcctccgtctcctacgtggcgtgtgccaagcggttctctctggcagtctggcacgcggtccccccctgccccaccttgttgcgtccgccctctcacgcaaacacacacaccaacgcagaacacacagaagaactccaaaaaaaaaacagtcagagagagagagagggagagagaggcagaaaccatatcgtttctctgaacaaatcactactactacctcaaatagaaaaaagacgaagtgaaaaaaaaagaaaaaaaacacgcatgaaacgtagaacaatcagcacgagcacgccgaggaagtagtagacatgcaaactttgcaactcctcgatcggaaaagtacttcagtttctagtaccattcgcaggtctcatcacacaaaacaccatcactagctacttaacagataactgaatccatctaggactatagtacctatcaaacgacgacgaatctgtcatgagacgataccaaaaaaaaagataggatatcatctcggtaaacacacatacggagtatgcccttcacgatatgatctgccgcgaccgcgagcacgaacatcctgctgctactcctacggcgccgcgcccgcgtcgtccgcggccgcccccgccgccggcgccgcgccctcgtcgtccgcggccgcccccgcgtcgtccgctggtgccgccgccaccacctcgtccgctgcagccacctcatcttcagcgaactcctcaaggtcgtcgtacttgttgaggcggactagttggtccttgcgcagcggcttcttcaccgggacggccaccttgctaccgtccggctgcacctccagacgaagctgttacggcatcaatacagagcactacccataactctagtatcattgggcctagaagatccaaacgagaagtccacaccaacccaaagtatatgagctgtgattggtctaatagttgaggaagtctataaatactagaagaatcttctagaggcgggtgtggtaattgaatctaacttctatctgaagaaaccattcctcctcctaactctgtttccttcttcctctgctctgaaatgctatgttctgttctgttcttcctcctcatccccaatttcatctgtgattcgatctagggttcgtaacatcttggtatcagagcccgatcctggagcggccaacattcaagacgcgtttgcaaggtcaagtggacgcca

SEQ ID NO: 3927 - DNA, 1501 bp, Oryza sativa
tagcttgcccagctctgaaggtatattcccagtcaacccattggaatgaaagtttctacagcagatgaatgaaagcagccttagtttcaatagcaaagaagcaccagagacaggaaaaccctgaatatataagcaaatcaattggcatcttacattacgcttacgctgctcaatccagccagctcaggaggtataggaccagtaagcctattaacacccaaatccaagaccctaaggttcctcagtgaacctagctgtttcggaattgtcccaaaaagcatgttgcgatccaaatacctgcccaaaaaggagaccttcagaaaccttgaagctaattcatcataaccagttgaaaaaacaataaaacagaacatacagctcttgcaagaagctcagctgtccaagttcaggcgcgataaatcccttcagcgacgagtttgacagcttcctgcaaggtgcggaatcatcgagtcatgacacatgagaagaaattccatcccagaaggattttgactgatcacgcaagtacgggttttagttggcgtttcattgcaaacaaaatctactgactacatatctaaatggcacatcatactccattatttccagctgtttgcacatgcaatatgcgtctatgtcaaacatatacagcattgtacagctccaacgataagctagtggcagtgcttatagtatcaaacaagtcttcacctacaaaattgtagtacctgctaatgtaaacattaataaatcaccataacaaactcttttccctccccactttatgtacacagtaatgttgaacaggatttgatattaccggctagtaagtaccacagtagtaactagtaaagcagtaggtgaaacattagtgagatctagctgagtgcaggtgcaaggggggggggggggtttcttacagggagatcacggagccctgcggcgaggagcagatcaccccgtgccagtcgcaggcgttcccgtccgcatcgctccagtccgcgagcgccgaccgggggtcctcgatgattgcgcgcttgaacgcgatgagcgccgagactagcacaaggcgtagcaaagcgcgtgtgagcagaacgccacatttctcatggaggaacagaacgagagtgtacgagacacagcaaaaccgttggtcacagatcagaaatgcaccatagaaatggaggtggaattcgagttttaggcacgaaatttcgcggataaatctcgaaatttgcatcgcctccaccgagtaacaggtggaaatttcgaagaagatagatcagaaccaaaaatctgaacagccatttcaaactcggtaaaaaaatgtaaaaaaaaaacccgtaaaacgtctcccagaaatggaattcacaggcagtgcataattagaaaaaacaccacgaattcaaacaaaactccctaaaatccgaccaaaaaaaacaggaaagaaaaacaccaagtcagtggaagaacacacatacacggcgcaaccgcgcaagcg

SEQ ID NO: 3928 - DNA, 1501 bp, Oryza sativa
tagagagcgactcgcatcagccgctctatgatgcgtgtttccccggttcccgcctgtccaagcgcgccctcgcctcgcctcgcctcgcctcgatcgcacagtcgctcgctcgtacgcggcgccgcttgcttgcctggttggtctttccatttcgatcgaaacattggctggccggctgcccgggctcgacacgtcttatcaccgttacgtcccccgctactatacaactgcgcttaaatcacagccgctactaatcaattgtttcaatgatagttgtatttaaagaagtagtataagtactaactgagctgagttgatatggacgtcgagcttgttggcaccttacaatttggcaccttacaatttctgttaatttgtctccttatttatagtttataattattatagttctaacggacaagtgagagagagagagagagagagagagagagaggaatatcctcgatcgagtatattctagtagatctctctagtcatacacggtcacggtgtcgatagcttttgcttctagtattacgctctgggttaccgtcggtggaaacggacgcggattaatcaatcagtttgagcgtttccacacgcactttgagccacaaataaccggccgggtcgacgtttggctgaccaccggctgctgctgcatactgagcacgatcgactcgtcctgttttcttagctttatatccaaaagaaaaggaatttagaactgcatcagctgcgcgcactcgtgacgcttgcaatgcccagttggatgggcatataaaaatgctggcttttcccccttgaacaccgtgagagataacataaaccgcacaagacaagaatcccggacacgtaagaaaggaaacactccaacttaattattttccagccttttgcgttctcttcggtgccaaacagtagcaagtgattctctgcctcccagcgaggcctaaaaaaagacagtagtttcgttgaagaaacaacaaaaaagactcggcgcagtggtggacagggagaatatcatatcacagaaaaatgtttaatcaaaaggattttgtgtcgtattaggatcaaaatgtttaatctatgcgtccacgtgcaacagttgtggggtccagcaggaagacactcgtcgctacgacacgaaccctcgaaaaaaaaagaaataaagaaagaaaaaggcctcccatcgtcaacacgcacacacctggtgcaatgcaaggaggcaaagcaaaggccaaacatccaaatttgattttggttgtgagctgagctccagtaaacctcactatcagagcacagcaataatccgtggctgacgaagcagaggcccaaacgcgaagcagaggagggcctttcggttttccgcgcctatataaaccccacacggccaaacggtttgagaggcgccaaacacacgacacgttctccccacacacacaaaccaacgcgacgcacgagagatttgtacgtgaagcacctgcagcgggcgacccaa

SEQ ID NO: 3929 - DNA, 1501 bp, Oryza sativa
taaaattatcagattttttttgtcacggctaaaatgtaatgaatcttaatatgaattttcgcatatatgtgtagtactattagaaataactgtttatttttttctaattttttatgacatttgctagttggtgtgtgtgagaaacctatatgcatatttttcacttagacacaggagcggagctaggtaggatagggggtgcccaggaacccggttaagaaatttttttaagctatagttcatctattttcaccatatatgcacctccctcaatccaaatttaggcacttatatcagtctaaagtagagtaaaataagtgagtggcagctctcttcatttcgttctagctccgctcctgcttagacatactatctcgatataacaattcaaccaagtcttacgtgaactatgaaccgcccaacacaaaggttcatgagatatccgccgttggtggtcaggtgaggtgaggtgaggtgaagctttgggaagcatcaaccttgaaaaccaagaaaaggtcgtgggcgacagggcgagcgccataaatatctgaaaacatcttgtggagagctgacaggtgggacccgaggggaggtcccgatcggactgtagcgtgggggcggggatcgagtgggcgggtagcgacaggccaccgcccacccagcccatccgcgcgcgtggacgcaaaatggagtggcgcgcgccgaacgaaacggaagccgcagccagcaaattgcaaaggaaggcaaatcacaagcaaatccacccccgcgccgcgccgctcgcgctcggctccgccttttttccctttcgacgtcgttgggccaaggaaacggaaccaaatcttatcgcctccttgtgtgggcgccatccgtccctccgtccgctgcccatctctctctcacgctcgccgtcctcttgtgccttcttggcttgggtttgcctgcgcctgcgcgcgcttggcctagttgcatcgtctgcgttgcggctgctgcgatagcatgtaggccaaccgcgtcatcttatctctctctctctctctctccccccatcatttcatctgatctagtatctcatctcctcctcccctccttttccttctcccccaaccaactcactcttcatcttcaacaccttgctgttcgtcctcgtctcgtcgtgctgattgttcaagaacaggagaaagaaaggaagaagcagtttgattgatctgtttctgttggggggagctcggtgatccatgcatggatggcaaagaactcctctcaccgtccgaactgtcatactatgcgcaccagcagcatcagcatcagcatcagcagcatcagcagcaacaccggatgctcgggggcggaggaggcggcggcgggcatagcgcgtcgccgctcgccgggatgcacggcggcccgtcggtcatccgacccatgcccaacatggggatgagccccaccgcgatcctccagtccatcggcccgggcccgctcgccggcatgcagttccaga

SEQ ID NO: 3930 - DNA, 1501 bp, Oryza sativa
aacagaaacagatcaatcaaactgcttcttcctttctttctcctgttcttgaacaatcagcacgacgagacgaggacgaacagcaaggtgttgaagatgaagagtgagttggttgggggagaaggaaaaggaggggaggaggagatgagatactagatcagatgaaatgatggggggagagagagagagagagagataagatgacgcggttggcctacatgctatcgcagcagccgcaacgcagacgatgcaactaggccaagcgcgcgcaggcgcaggcaaacccaagccaagaaggcacaagaggacggcgagcgtgagagagagatgggcagcggacggagggacggatggcgcccacacaaggaggcgataagatttggttccgtttccttggcccaacgacgtcgaaagggaaaaaaggcggagccgagcgcgagcggcgcggcgcgggggtggatttgcttgtgatttgccttcctttgcaatttgctggctgcggcttccgtttcgttcggcgcgcgccactccattttgcgtccacgcgcgcggatgggctgggtgggcggtggcctgtcgctacccgcccactcgatccccgcccccacgctacagtccgatcgggacctcccctcgggtcccacctgtcagctctccacaagatgttttcagatatttatggcgctcgccctgtcgcccacgaccttttcttggttttcaaggttgatgcttcccaaagcttcacctcacctcacctcacctgaccaccaacggcggatatctcatgaacctttgtgttgggcggttcatagttcacgtaagacttggttgaattgttatatcgagatagtatgtctaagcaggagcggagctagaacgaaatgaagagagctgccactcacttattttactctactttagactgatataagtgcctaaatttggattgagggaggtgcatatatggtgaaaatagatgaactatagcttaaaaaaatttcttaaccgggttcctgggcaccccctatcctacctagctccgctcctgtgtctaagtgaaaaatatgcatataggtttctcacacacaccaactagcaaatgtcataaaaaattagaaaaaaataaacagttatttctaatagtactacacatatatgcgaaaattcatattaagattcattacattttagccgtgacaaaaaaaatctgataattttaagagtaaccatctctaaagatttttttttacaattaaaatataatgaatttgaagatgcatgtttcaccacaagaaatctaaccaattgacatatcaggctttcacatactaccttcatatttcatattttaatgtatgacaccgttgattttttatccaacgtttaaccattcgtcttattccaaacatttatgtaattattatttattttattgtgacttgattcgtcatcaaatgttctttaagcatgacataaatattttaatatttgcacaaaaaat

SEQ ID NO: 3931 - DNA, 1501 bp, Oryza sativa
ggcgacgacggcctgcagcttgcggacgccgagggagggctggacggtgacggtgccgaggtcgacggtctggtcgccgtcgacgaagacgacgggcagcaccgccgcgggcggcggcgaggaagccagctctcccatggctccccctaccagcaagaagcaatcgaattccggcgagtctctcccggggcggagggcacaagcatcgaatcgaatcgaatcgaatcgaaacgggtggaattcgtgaatctgtgaaagaaatctggggagtgggggacggagggggaggttttatagaggggagataaggcggtttggggttgaggggtggggatgataatttggggaggacggtgcgggcggacctgaagtggtcgctttccttgggaaccaaggcaggccaaggtacttgaggccccacgcggcagtgaggggcgaggtggtcccacgcggtgactggctgatcggcgtgccacgtcaggcgcgcgcttacttgcccgcgggtgcaatcgccggcgtggccgccacggttgcgagtaccagatttttcctgccggtttccgttccgtacgcgcgaggcgtggtcggccaaggcggtgacacctgtgcgccaacggtgaaacggaagaccgcctcgcgttctcgttgtttggctggcctgctcggctcggctcggttcggttcgggtcgggtccctgcagctgcagcctgatgatgatggccgcggtccacgtgaagccgccatggattcggcgtgataaacgcgttgaaggcggcggctatatacacggaccgtttccgccttcctccgtagcaatagcagcttagatgtattctttttttttatttctgcttatgtatgcccgcacaaggttaaaaaagcgtgtaaatactctacttttaaattccggctgtttttatccgtccctatcctagttaattttctctatctatacagaccagtggaacaatgtgtctatatatatatctaaaatcggaaaacaattcctccaaattaatttactatggtcaaatcctactataaattccagcaacattaataaagcagatcctgacaatacatgtacaattgtacagtacgcaagttaaacaccgtactaccaaagatttaattagaataaataggcattcatttcattttatttattaccgtgctactccttaaaaacgggttaaaacatggcaaaatagatgcacatgtgataaaacgtttatggactccaacagacaatacaaaccaagcagagagtacgcgcaggagaaaggatatcataacggacggattcatatggccgtcgcagcaagttatggggggccctttgactgggctgggctacctttttcctttcttttcctccaggatataaaacaatgggccgtcactcctatcaacgtactgtatgatagtgtggcccaacaatatttgtctgtttaagcccctttgcttgtcttttctggaatgaaccgacctgcccttccc

SEQ ID NO: 3932 - DNA, 1501 bp, Oryza sativa
caaaatcaggacgggaacatcagagaaacgcatttagtatttctgatatcatgtctttgcctttatgtactgccatttctgttcattaaacttcatgagaagacataggtttcagacgactctattcatccgtcattacctctgaactcaagtctaaaggctaaaacagtgcatggcctgcaggcactagtaaagatgatatcatatcactatatatatcagttgagttgatcaccattatctaattacaaacatcagttgagttcatcagctagtttatttgtgcaaaccattttgcttagggagatcaagaaactaaagcatccaattaattaattgactgggtgagactagctaggtaggtcgagacatgacagatgggctaagctaggatcttggcaagttcaaataattctctcaagcatcaggcacggagaagtacacatgaaaagcaaaaagaaattcagcaaacaccgcttgcatgtcccccacctcctccctcctgcatgcatggctgcacagttcttgcattgacagccgcatccaccctatatatgaatcaatatatatatgatccaatccatttatacaatcatagaggacaagtcggccaccatcgcagcagcatgtagtattcatttctgatacgcatgcacaaggggaattaaactatagagctactagcattttctgctgcctgaccggcctgcgtgtgatcctggatttcgatcaattgtgtgtcagggaaacgtcgctgcgctttcttcgtgtattgctggtagagaacaatgcgagcagtggactaaactgtacatgtataattaatagatatcaagctagctagcaacttctacctcttataaaatacaggaaaacatggatcagatggccgtgcgattacacatgatataattaattaattagcgcgcggttccacctcccggtcatgtaattcatccgtatcaatgtggtatatatgctgtttgctgctggccattcatacatacagccacgactgcaaatctgcgttctcaaaatgacaaaatggtacgtacttggtaccttaccttacctgcatgcgtacatttttttttatgctccagttgcagcgtaaaccgacaacatacaagtttcagttataattaagtagcattagtatcagtagctgccaattaagctgtgtgtgatgggtagctaacatattagattagacgtgttaagtgcaggtagctgctaattaattaaacaacatgcaatgcaagagaagaagaagacaggctttcgctcgctcgcatctttgatagctacttgcacacgccgcagcagcctctttaaaagcacagctaagcgcagctcgctccgaccaaaaggccaactcagtttacagcgacatccgacatagcctagcttaagcttcatccattgatcgatcactctcacacagctagctgcacgtaagctagctaggagttagctagccatggttcggaagcttgttgcc

SEQ ID NO: 3933 - DNA, 1501 bp, Oryza sativa
agaagtcttaatagctggctttctttcagttagctcggaccaaaggtcctagctcctttttttttttcctttcgctttgtaaagttctccttctatattcaatgaaattggcgcccgttgattcgttcaaaaaaaatccaatgaagaatccatttcaaacgagttattaaatactatctctatttttaatagaaaaatagatgacgctatgaacttttggacaccatttatttattcgttctatttaaaaaatttacgtaattgtcatttattttgttgtgagttgtttcatcgctaaaaattattttaatcatgatttatatcttaatacatttataaaaaaataaaataagagaaatagtcaaatatccaaaagtcaatggagttatttattaaaaaacggaagaagtaaaaacaatccgtgataggcgaggataacaaatttaaataagtgtacatgtgcgttactttgttttcgctagaaaaatatggacgtgcaaatggcggcaggcagggagcactgtagggtacatcagggctggcttttccttgcttgactagagaacagccagtactacaaggaaaacattaatactgtatactataggtgtactagggctacacaaatcaaacgagtggagataaagaggatgtgatgtatggttgtgaacttgtgaattgcgatggacggagaggagagatgcaggggggaggggtgaaaaagtgacgggtcacttgagaaatgacttgtggtaaggtagatgaagtatttatataatcacagcttgagcttgtagctgcagcagtgcagtgcccatcgtgcactgcactaccacagatcgagaagaagaggaaggaagccaagcccagcagcattcagatttcagaatttggatggtgcgtacaggtgcagggcgacaattgatcgtgcttgcatgtctccaaacctcgtacgatttccctttgtttaaagctactactactgccctgcctgatcaaatggcccatgccttgccgccttcttcaattcacccgatcgtgtgctaagcctcagtgaccttaaaatttttcaagtaaaatgaaccgtacaatgatcaaattcaggtgaatatattttattgtcatgttgaagtacattagaaaagttagagcttcccctgaaagagaaaaaaagaagagcttacttgacgttgtagtcaaatcaggagaaacaccgaggggttttccagctaacttcacaagatggtgggctagacgatctggattctaagcctcaccccttttaattatttgatattaggtcattccctaatattcgtgttgttgtagtcaagtcataagttatgatttgggcgaatggatcatgcgagttttcgtccgatcgatttgtactgtaacaaccgaattagtacgacaaccaagcctgagatcctcggtcttaataaaccctgcaattcaggggctactatacaacggaatcctgttgggacagaatgatacc

SEQ ID NO: 3934 - DNA, 1501 bp, Oryza sativa
gtgtttttgattggaaaaaatcactcttattttcctttattacttcagggatgacgcatgaataaaatgtgtaattatatattgttataaatacatgcaacaaaaagaatgcaatttctctaattgggtagttgtgcttagagcaagtttaatactacagcccactaatagctccaattcaaatatagccaatctaatagtcaatttatacaatagttgtttgctatactattagtatatagtcccaactgtcatgctcttctctctcatcttttatctcattaaaatatgtttatagctggttaatagtttgctattatacctgctattataggaccaaactatcaaacgtggattgttgatagacaaaataatggatgcactcaagttgaggagttacctttctctttcttctcttcacccatatttgttcctccactttccttgaaaaaacaagatatttccctctacagaaatacccaatcacatcactctcacgcacacgcacacgcaccaattggtctctctttatgtatgtctcccattcacgtaggcgtgttatccaaacgataaagtttctaaaataaagggttatttgttatcaaatattttaaatactcaaaatacatagtatttaatttacatgattttttttctaaccttagactgctaaaatcctacgttttaagtaaatatcgagggttgtttttgaaagcagaaaacttactgtactttattagcagaaaacttattgttttttgaaagcagaaaacattactaacattgtgtttcataggtcctctgctataaagaagaatgaaaagttggtagagttgaagaagagcaatggacattagggtttttctgatcgttcttgaaacttttttagttttaaatgtaaaggctcgtaaaacttatttctaatttgattcttttagccatgccactacacgcggtagactaatattattgtttcgccaagcagctagatcggcgtggctaaaagattcggaaataagtttttttaggtttatttttaaaattagaaattgtaaaaagcttcaatatttttatattataagaaaaaaaagaaaaaaaatcacattaggggagaggaaatgcagaattgatccatgtgctactacctgcaaagtaccagtaccagtataggacccacccagcagcaagcaagcggtccatggctggactggactggacaatcccgcgtctggcggcccacgcgacagacacttgcacttgctctccgctgccgttccccttcccccctcttcactttccttcccagctgcgctaagcaatccccacccaccaccgctgcagctgcagttgcttcctctcctcccctctcttctcgccgtcggtggggtcctcctccaccctgtctctctcctcccccccagatccacccctcccccttcccgaaccttctggaaccatctggaggaggaagcaaccgcccaagctgtagcggcagcggcgg

SEQ ID NO: 3935 - DNA, 1501 bp, Oryza sativa
  unsure (1)..(1501): unsure at all n locations
acgcatgccacctcgtctcccatgcataggagtagcttcgtcggggttgctttccccgccaccaccttcccggtggcagtaaggtgacgagggggggggggtgaggggggttgcggcgcgggtggctagggttttgcccccaagccgcctgtgcgagtgcgacactaaggttttttttttttacaaaatttatcatcatttcccgtatgtacttgatcacaaattcagttgggatcaggggcggatctagcatggggtggcggggtctcgagccctcactactggcatgaagactattagagcccccacgaagaccccactaatgaatagtctcctacgaagaccccactaatttttttaccatatgtagatggaaagagaactgtaattctatctagtttgctcagacctcactgctatttctttttagatccgccactgtttgggattcaatcatagatgcgcctcttattcggatttcagtaatgtttgagaatgatgtttcattttcttaaacaggggcggaaaattatgcagaaagtctgcaaaagaatggagataagtgcatcctgacagttcatccttcaccttcatttcaggattaatctaaaaccttatcccccctgcatttccggcgcaactgtcaagcacctgtcctgaataaactagtagccacggtgtaatcgacgaaacaaaatggactagaaaactagtagtataatgcagatttgtttgactgtttctctcattgaccggtcggctaactgaacgaaactagcatgccacgcatgaactagcaccctgaactcacactcatcgtctgaccttaaaacgagtcaatctcaccgtttcattcatcataagttcaggactactgtagccttttttttttccttcttcatgcataggtgtgtttagttcacgctaaaattaaaaatttaattgaaattgaaacgatgtgatgaaaaaattaaaaaattttatataggaaaattttgatacgatgaaaaagttaaaaactngttgataaatttggaactaaacccggccgaccatagtacactagtatgcactttgaccgaatgacacgcgctgctcgtttgactcccaacatgcgacgcgattcgctgcgctgcacacggtgcgcatggccttttttgcctttttgttcatacgacgcgtttttctctatagccgtttcatcatgacaaacaacaggggaagccgcccaattttttaacggtgaaagtttaaaccaccacacgagaaaatcaaccgaatttaaccaatcaattaaaccatctttttttccctcttattattactgtacatctgccgaaagaaatcctttcttgcagacgacgaatcaacaaattttacagcggaggagaggagatcgtatcatctcgctgccaccagcggcagcgagggtgttttgttgctgggcatgtccatgtcgagctccaggccgaagagcacgccttggtaggcctcgacgcca

SEQ ID NO: 3936 - DNA, 1501 bp, Oryza sativa
cctcgtctcccgcctccgcgccgccacgagctccgctgccctcctcgacgcgctgcgcgagctcagggacgttgccgccgagagcgagcgtaacaggaagctcctcgccgccgtccccggcgcggtggatgttctggccgccgtcgtcgtcgcgtcgtgtcgagacgccaaggccgcgtgcgacgaggccctcgagatcgtctgctcgctggagctctcggagcggtgcctggcgcggctcgtcgagaggaacgaggagctcgtcgacgcgctcgtcgccacgctgcagcggacgaacaccacgtcccgggcgcacgcggcgctgctcctggaggccgtgacggcggtcatgccgtcgaacaggctggtgtccctcccggaggaggtgttcggtgaggcggtgcagctgctccgcgacagggtatcgagcccggcgacgagggcggcgctgcacgtgctggtcggcacgacgtcgtggggccgcaaccgcgtgaaggcggtggacgccggcgcggtggcggtgctggtcgacatgctcctggacgggccagtcgagcggcgcgggtgcgagctggccctggcggcgctggaccggatgtgcgggtgcgcggaggggcgggcggcgctggtgtcgcacggcgcgggcgtggcggtggtggggaggaaggtgctgagggtgtcggaggtggcgagcgagaaggcggtgcgggtgctgcggtcggtggcgaggcacgcggcgacggcggcggtggtgcaggagatggggcagacgggggcggtggagaagctgtgcgtggtggcgcagtcggagcagtgcggggagaggacgcgggagcgggcgcgggagacgctgcggctgcacgccagagcgtggaggaactcgccctgcttgcagcctcacctccaggccctctacccttcttgctgatcgaattctgattcatgatcaccggcctcatcactagctagctaccaacatacagcacagagagaattgaacacttgttcgattcttcctttcgctcgattaattttattgagttgagatcgttcgatgtagtcctatgaatcaaagtgtacagatcgacgcaatagatgaactaaatcatgcgcgagctttttttgtttgggtctcgaaatatctccttataatcgtctactgtcaaattattcttaatttcgatcttggaagctgagttctgtacataaaatttagaactatatatagctagtttttccaccatcatcgatcgatcatagacgaccagagtgctggtcaattgacatgcagaaacgcccagaggtctttcagctagctacataaggtggtgggctagccgacctggattaaagtctcgctccttttatttatttgatataaggttattttttaatattcgtattttttttctagtaaatcgacatgcaataatgtttttgtacatcggagattcattcatcgagagctagatcgatcgatcgatcgatcgatgaggataat

SEQ ID NO: 3937 - DNA, 1501 bp, Oryza sativa
aggtaacagcatccttttgtgttgtttaaataatcatttttaatgtgtcattgacagtgctgtatttgctgtattgaagggcgtgtatttaaatcactgcatacatccggcatgattccagcacaaggaaaacagattgctgatagggttgatggcatctggtaagcagcttacacttcaacagacaatgctgtcaaacactgatgggattatgttgattttttcgtcgtgttgacaattatgatcgtcttctgggagtagagtagtgcttcctacgagttcgtagctcgtacttttctacacgttttaatattttatttgcctttagtctaaccacgctgtatttttctgtagtctaactgccctgtatttttttctgtagggtctcagggagccaaattctgatgaaccggcctcgtgcaaggctagggctcatggtgtattggctcttcttgcacctatggttgataggcagcatcttgtgaccattgccctcgtagcataattgtacaatactagcagatatattcacagttttattttctttcttcttaacttaactatacctggtacatatggcattcttttcatttccctgccctctgctctgaaattgtactcgagcagtacgtgttgagttccgcacacagaatgtaatacgtgcagaatagaacaatactagtaccattctttgttacgctgtagaagtggatgtttctgttgtaaccatgataaattcatcatggtttcttcgggaagcatgatgggaataatatgaaattgaaatgtttcttggttgtaatgaaagcgttcgaaagtttgagcttattttcgaatcatatcatgctccgtaggagtacttggcagttggctatactcgcttcatccgcttttgatgcataattcgactactttatgtcctatctttgggatttgtcaaaagtcaaaactgagaaaagttagttaattgctgtatcgaagaaaagaaatatgcaaaatttaatgacatcaattctaaccttacaaaaaaaaaaagcttaggctgagttctcatctccactttcctaactcacatatctcgttttccacgcgcactactttcctaactcacatctcttgttttccacgcgcacgttttttaaattgctaaacgggagtgagggtcaatagtatactaccggtagcatgttctctaaaaagtacaattgaaattcgacattttaattccttcaatttttttttatattctctaacacatcttctctaataaaagttcatttgaaaatttgatattctcaaacatacccccaaatttttatcttaaccaacggcagccaaggcgggcaaaactgtaatttcacctccaaacaaaacccccctaattactcttgctccaaaacctccacccttctcaagcgctctctcgtaggttcgtcctgtgtttcccttcccccgccccccccccttcccatggcgagcaacccaagcagctccgcggcgg

SEQ ID NO: 3938 - DNA, 1501 bp, Oryza sativa
tggctaaataaaacagtgataacgcgggaatttaaataaagcgataatgcaataatttaaatcaacataagtttataaactgggattcaatatgatcaagatgatgtgtcttgccttgctcgctttcccaaacaccgtcttcaacttccacgaagagcggatcttccgaagctacagcgtctacacgaccaacggaaaagaaaaggctcaaactgtcacgtcctgataaattcatcccaaaataaaaatcattttcaaaaaggaataatagaattaattaaaattcgaaaagaaattggcaaaccctaaaatacgtacaagaaaaattcaaatgtggcccggagaatttttgttaaattctccttggtctaaaaggagccctcaaattttagtggaattttcagagcacaaataataattgaaaagaaataaacaaagttgaaaaggtttataaaaagaaaaatccctaaaagtcttttttcccccccccttccttcttgggccggctcggcccagcccctccctctctctctcttcccctccggcccatcggctcccccgcgcgcgcgcgccgctgacaggcgggcccgcccgccactctcgctgacgggtgggacccacctgtcatctccctcctcgcgccgcgtccgccgctcgcccgtgccctagcgccgccgccgccgcggattccgccgcatcccgccgtccccgcgcgccataatgaggggggaatcattccccgcgattccctctcccgtttccccctcttttccctctctctctccctcggattcgtccgatttgaatcccgcaatcgtcgccggcgtcttcaatggagccgagatctccgcggccgtttcctccctctccggccgcgctctccccctctcggcgctatatatttgctccccgtgcctccctcctccgtttccgccgttcgccgcttgctctcgccatcggattcgtgctcgcgacgtccacctctctctccgccgtcgccgccgacctccggttcgccgccgtcgtcgctccggacttcctcccgtctcggcgtcacctccatcggcttcgccgcgttgtcgccgaccccgtccgccccttcgcttcgcccgccgaccgccggagctccgtcgccctcgtcatcccgaaccgcgccgccgcgttcctccgctccgttcgtcgtctccgccgtcctcgtgtctcggggtgagccgtggaccgtccctttcgcttccctctcctctccgctctctcgggcgccgctccgccgcgccggtggtcgccggcggtgaccatcggggcgcgggcgcgccgcctcccgtcggccgtgccggcgaggccgccttcgggcgcgccccgcggctgccaagtggggcccggccgtcagccgcccgcgcccgcgggtgcggctgacgcgtgggacccacggcgccggccgccgccagccgcgtgctcccggtccaccgtggaccgagaggctgccgtgtgggccccactctcg

SEQ ID NO: 3939 - DNA, 1501 bp, Oryza sativa
ataactaaatcccccgacatatttttttttgaccgaggaccacactgtccacgcgattccaccccagccaaaacccggctcggtatcacgcgcctccgcgtgcgaaacctcgccggcggcgctgccgccgtgactactccgagcaggagtgctccttcctccaaccagctagaaccctgctttgcacgcaatacctcgctggcgccgcctgcaactactcctaggaagacttccccccagccagagcaggagaggaggactttggttgcgacagcaaataggagacaaggatcgagtctaggtaaggcagaagacaagagaacacgtgtcgtgcttgatacttgatacctcgcaaccagccatgatacctgatgccttacaggtgctcggtactaggtctgatacttgataccttgcaggtaccaggtctgatacctatgggtactagccatgataccataggtactaagtatggtacctactggtaccatgtctgatacctggatatcaaacatgatacctacatgtaccaaagtatcatgataccactaaagtatcacggcaataaagaaccaaaaatcatatgtttatcaagagagagttgaataaaattaataaaggaaatcaataccatgaataagtcatcatagctgtagaatcacccatagaacatgtagaacccaaaatcaaacacagaacaagacaacacctgagcttggaggtcgcgagcctagatctgggtgtacagatcacaaagaggtctcttgtccttgatgacggtgacctcgtcgacgatggccacctcctgaaatgtggtgagcagctccgcctccatcatgtgcttgggcacctaccccacgaacagcttcacgatcttctcctctactccgcccatgcctccaccagcagcaatggcggcggcggtgatggcagcttcctccacgctcgacgcgccaccctgcaaggccagttgccgccgttgcctccgtgctccatgagggtgctagtcagaaggagagagagggagagaggagatggaagggaaagtgatgagaggataaggttgaatagatggtgtgaggagtgagagttagaaatttagtggcagtagttatcctgtgcctatggaatactgttaagtggtttttctatttaattaattaacattaaatttgataatatgtttattttgtgttaaaaatactactatatttttctataaacttgatcaaattttaaaaagtttgagaaaaaaataaacgatttaatatgaaatagatggagtagcctctttttgggtctttcaccaactcaaagccagcgtgcaacggtattccagcagatcaccctggatggtgcaccggttccaccaaccccacgttcccagctaatatagctctgaccgcttccgcaccgcgccggatcgaactcatcagcatcagcacatctctcttctccgctccccccgaaatcctcgcgcgagccgccgccagccacgcca

SEQ ID NO: 3940 - DNA, 1501 bp, Oryza sativa
acgatttgagatctgctgatcctttacgagtcaactagctacggagtagcaaagcaagtgccatggtatttccacgtttcttttgtaaagccggacgagtagctgagtagctagctgctaactccgtttcaggttataaaactttctagcattgtctacgttcatatagatgttaattaatctaggcacatacatgtctagatttattaacatatatataaatattgacaatcctaaaaagtcttataatattaaacggaggaagtagcagtacgtagcatgtatagcaccaccgcaatatactggcgccttcgtttttacaaaagctagctagctagcgcggctttatctcccattactctatttaacacatatagactgtgtttagtttcatgctaaaatttaaagtttaaaaaaattgaaataatgtgacggaaaagttgaaagtttgttgtgtaggaaaattcgacgtgacggaaaagttgaaagtttaaagaaaaaaaagttgaaatctaaacagggccataattcgaacataaagagtcctactacacatacaactataccttatatatttagtatccgacctcgtctaatccaccaattcatgcgttcaatttctcttcatatgagtttacgaaaacaacagccatatctatatacttgttgagtcggacatagatttgggaacggatccagcctagcttgacccaaggtctcggccaacccattacagtttaggataaacttgaatgaacatggtaaaattttatattgcataatgtgcattcaatcctaggactcggaccatgcatgggccggatgatccgaggcatggatccgctcctgcatacacacgtttcatacgtatagccatcttcaaagcataaaagttggtagtgtcttgtgccaaatgcatcactctttttactgcacgctatcttaattatcagctgcttaatttggaggataattagtactgccgctatatttacctttattcacctaagttaaccacctcagttattattcgctaactaatctacctcggttattctcgacgcatatataaaattaagtataatgaatttacttattttcagtgtaatttaaagctctctatgtttggcaccctttgctgccacgccgccatctacgctacgtgccgcccacgcaaccttcgtatccaccacgtatttacacaccggagcagtagcagtaaaacggtaaaaaaaacaaaaaaggaaaaaaggaaaagaaaaaaaaatccccgattcctcgcgcgcgctggccccaccagcaaaccgccaggctgtcatgctccccttctccaagcaacacgacaaaaccccctcgtcttcctcctcccccgtgtatataaagccgcgcccctccacctccacctctccatcgccatctcatctcacccatcaatctccattgctctctcctctttcttcctcaacctcctcacactacttgtactaccaacgcatcggca

SEQ ID NO: 3941 - DNA, 1501 bp, Oryza sativa
ctctcttcttccccggccgcgccgtcttggcgccgtgccgctcccgtcgcggcgaccgtcctgccacgagcggacaacgccatccgccccgcctcagcgtcgaacccgccgaggacatccctgccgccggcgcgttccttccttcccggtgagctccgctccccttctcccctataaacggcataaattctctaggcatgctcatttacacgggagattacggagctgggtcgtcgccgttgctctgtttccgccgccggccttcccactcgcttacgcgccgcgctgccatggccgtctccccttcctctcgctccctcgccacccgcctttttcgccgccgccgtgcgcagttgcgttccgccgtcagcctccctcctctccttgattcccggcgccgccaccatccccgaaccccctcgaaccttcccagcgcgccgccgcggccgcccgcctcgccggccgcgcccgcgccgtgccacccatcccgccgtcgcgcctcctctccatgatccgcaccgttgaactagttccccttgacctccgcttgcttccagtgcacgccgcccctccaggttcgccgccgcccgccgccagccgtcggatcggccgcccggcctcctccctcgcccgtgccaacgtggctgtccacgtggacgccacgtctacctgcccggccccgcagagaccggtcaaggtctcccggtcccccgacccaccccgcggctctcgcgtgcacctattcctcgtggaccaggccgccgccatgtgggccccgtccctggaccccacgcggtggatccggtccaccgaaccgcctctctctccccacccgagccccattgggccgcctcctagcgcccgcgtccggcccaatcagctcggccgcgcatgcaaatccccttgggccacaccaatgccgcccgaggaagtctgattgacatccctccttccttttcgtttccaaagggattattaaatccttttccctcgttccataaatcaattctttattccatgaatcatttcctttggtccctcatatcaatgaccatcaataatattcttgagaatattatttctataaattccataaaccatttctcgtaatctagaaaattccgataaatcatttccttgtccggaaaatcccattcgagcttccgaaattcatatatctcgatccgtaagtccgattgactccgttcagcttccagtatttccgtaaagttgagatctatttaatggcactattatttagtctaaataggacctttattttggtcttttgtttaggttttcgattgtttgcgtatagttgcggttaccggatttttcgtcgatcgtggttttctcgaagattcgtgaagcttcgtgaagaccttgagcaaggcaagtcaccctttgatcaattgcccctataattgaaaagtcattattattttgtttgcaacttgcattattagaatcacacacttaacttgcttggcctctgtttgcg

SEQ ID NO: 3942 - DNA, 1501 bp, Oryza sativa
ggcatgaggctagtgcttgatattgacaaggctgcagggagggctagttctgcccctgtctttgctcacggcggatggagaagcttgaattggcagcgagagggcatggaggcggaagggaggattagttccacatcctccgaagtttgcaatgacgagggaaaacttggagctagtctcctagtcattttcatttcgttttttttctttgtatctcaattttaagatgttgagtgtatgcactcgtgtaacttttgcctgtgtatatccaattatggaatggatataaaggccggatttctatacattatttaaaaagttatcgaatatcaatctttcaataaaaaaagggaaatacaaatactcaaccaagaggttcaaaagaatcggcagaaaatagctaaggaatattcatcctaggccttacggctgtaactgcttagcacatccacaaaattttctgatggcattgtcgattccacacaaccccagaaaatgctcaattagcaatctcagggtgatacccggtgttttagttcaatcaagacatctcccctacaaaaatgggggaggaaatagttcagcattggcaatgatttcacgctgacatatgctccaggtccaggaaatttatagagtggcttcgcaatattttacatatataagtttacatactttttttacactttgcattaattctaagagttgacatcaaccataatgataaaaattagcaaacctgcctaacaagcagaaagttggatataggaacaaacagcattaactatagctgtgtcttcacctggaagcaacatggtaaaccatttcaacgtttttcaatgaatagaactaaaggaaagaactggtcatgcaccgaacaaaaccagaagctgctacggttgaactgaaattgttagtcctagcccttgtttagttcccaactttttttcaaactttcaacttttccatcacatcaaaattttcctacacacataaactttcaattttagtcaaactttcaattttggtgtggaactaaacacacccctagataggcggtgcataaaactatcagagataatttatgagttgcatggagatcgaagtcagagatctacagtgaaaaacacaaacagtcaatccatcatgaaccaatacactgtcaaatagttaatttcagatgcacatacttggaccagatattcctatatatagatctcaaatctcaatatatagcatgttctgtcaaaaaaaaaagaaaaagaaaaagaaaaaaatcattgtcaaacatgatatagagtgtttaataaggtgacttataggcatgctgttgagtagaactaaaccaaaataaaatagcatatagtagggggagctatagatctgcattactctctaaaatctgtataccaataattgaaattgcatatatacctcactaaacaaacaccaactccttagggaaattaacataaaccacaattattaatgaatcagtaga

SEQ ID NO: 3943 - DNA, 624 bp, Oryza sativa
aattaaaacaaagcgaataggcgatcgataataaagaaaagaaaaaaaaaagagagagagagaagacgaagtgtgtacgtacgagcgggtaggggaggtggaggtagtcgaggatgagggcgtactggagggcgtatgcggcgaggccggaggcggcggagaggaggaggacggcggggagggggaggtggatgagggcgaggcccgacgaccagcccagcgccttgcccaggtcggaggcggtggccaggtagttgagcgcctcctgcgagacacccagggacgccttgagcgccgacgagtaggccgagaagtcgaagtttgtccccgtcaccgcctgtatccacaccgtcgccaccagcaccgcccaacgccgccatcctgcgcctctcctccgcccctgctgctgctgctgctgctgctccgtcgtcgtcgtcgtcgaccgctccatcgctcgatcgatctctccttttccttgttgtttcctctggctagcttagcttagcttgttgcttaattcctcctccggccggctgtgctcgctcttgcccggccacatatatatatacagcatccatccagcgccgccccgctgtcgtagcccccctatatttatttctctct

SEQ ID NO: 3944 - DNA, 1501 bp, Oryza sativa
acaaattgacaaccagtacttcattgtacaggtactactgtactagcagacgctattacttttcactcactccgtttctaaatatttaacgctgttgatttttttaaatatgtttgaccattcatcttatttaaaaaatttaagtaattattaattctttttctatcatttgatttattattgttaaatatacttatatgtatacatatagttttatatatatcacaaaaatttttaaataaaacgaacggtcaaacatgtacttaaaaagtcaatggtgtcaaatatttagaaacgaagggagtattttataatcttaaaaatgtacatatacttaattacatcgatcaatacgtgttgcctagctcgaaagtcgaaacccaaaattcaattagtcaatctactactactaccttgtaaaaggctcagggggtgtttgggagagaggggcctcagtttatatgcggtttggtttaactatagtttgatcatcacttaagactaaaatgtcttctcaaaatttctgctggtgcaactctacataatatttaaagcgtgcagatgcaatccgcataatacgaagtgacagagcatattaattaatcgatgagaatcaatttcataatcatggaggttttgttatgactgatcagaacattatttgcctaaatgatgatcaaacatggatgaaggagattgtatataataattatcaaattaagatgttgtcacatcaatgtcctaagtgacaaataaaaaaataagaacaccatgtcggtgtttgtaattcattttatataatgaaaatggattatgtcggtgtcttcaattaataacaagtaaaaaggagaaaagaatggaggtagtaactaattaattgatcagaggaaagtattacagtgatgcatatatccattaatggacgcatggacgaaattgatcggaacggttggaatcggtagtaaatctttgaaaacaattctcggttggtcgagaatgaaccatgcatatttaccaatttaactattcaatgtcgatataacagtacgatgttaaaagaaattagaaaaagaaaatccaaatattatatatgactagaattagaaatgatatcacttatataataataacgatgccgggtcaatcagaaaattcggtggcaataatatatataccagcaatatacatgtgcgcatatatagagcatacattaggaaattaatttcggaaaaggagaatgaagtttgagagtgacatacatagtcttaatctggctgcgcgtatatagttagctagccaggtggtaaatggattaaggagatgagggagacatgcatgtttgtgtcgtttatattgagaaagagagaaataaatataggggggctacgacagcggggcggcgctggatggatgctgtatatatatatgtggccgggcaagagcgagcacagccggccggaggaggaattaagcaacaagctaagctaagctagccagagga

SEQ ID NO: 3945 - DNA, 1501 bp, Oryza sativa
gatgtgcatcgcaatcgaaacccagttaggtgtagaatgaagagcaaacaaaactagtggatatgtgcacatgattaatggccccacaatcctggccacaggcgctgaggcaagtcatcggtgagtgaggaccttgacatctccggcgagggcgaaggcgcgcgcgaagaagtcggccgtggagagggtggtacccaaatcggggacggaggagaatgcctgggcggcggccttgcgcagcagacagcgggcggatgagcgagtgtggagcagcgaggggacgtcggcgccggcggaaagcgcggcgtcgagtaggcggagctcctggtccccaaacctgagcagcgcgaggagaatcagaatggagcggttgtagaagactgaaatccaagttggtggatcgtagaggaagaagggtgtgtggttacctgcggtgggagagggcggaggcgaagagggagaggaggtgctcgtccccatccccggcggcggcggccatggcttgcctccctctctgctcgacgaaggcgaaggcgaaggcgacggcgacggcgattcccagagaatggatggaattggattggattttgtatttgggcctaggcccactaacgaactcgcttccaacgaagcccagcagaacttttgtccgttttctttttttctttaaaatgaaaacgttagctcgttctagaagtatatactatatagaaaaagaatacgagcaaagcaggagtctcgatgaatcaattttgtcaagagacaaatgcgctgttaaaaggagaaaagatggttttgtcactataggagccaagtaaacatatggttgcaatgcaaggaagagggtaccgtgtatatgtggctctgtgcaacacatgaatactgacgaagacagataagtatgtaaaaaggtggaaaaaaaaagaagatgataattgtggtggagagaaatagggcaatctggtccagagcgggcgtgaggcctccacacgcctccaaatgacttttttgtgtaggatatcgacaccgcatctccacagtccacactgtgcacgccattcttatcttgtctagcttcatctagctcctcctcgatatcccccttgtcttctctgctgaccaatcatcagaggaaggagagaaatttgccagcatgcattgcatctagacgtataaatttgtgtggaattttgtacaactcatcgcaatcaacttggaaggaaagcaataaacacacaaactccaccaaaccaagtataagctgatgacgaaattaacaagactaaccgatccatcagagacaatccgggaaggaatagtggttaagcttgaccgactccggtgcggccgggccgggctccacatcaaccaaccacaagcccaaaatatcctctccagccacgagcccgccacgcgctccctcgccttcgtcccatctcgaccgtccacgtgtggcccatccgtgagctccacgcgcctatatctatccctttctatcacc

SEQ ID NO: 3946 - DNA, 1501 bp, Oryza sativa
ggattaattagactcaatagattcgtctcgcgaattaattcaggttatagaatgggttttattaatagtccgcgtttaatatttataattagtgtccaaacatcggactaaagaggttttagtcccatctaaacagggtctaaatttagctaagcacaagtgtcttttctcctatttacatcaattattgtggactaaaataattttgtatccgttggtccatgtaaaaaaaatgtttgggaaaatctgcagcactgtagaacagacgcatcccaagagcagaaattattataggatgaaaaatgaaccctttacgaaatccaatcactaacaaagaaaataaaatgaccaggaggcacagagatttttgttaaattttaaaaaagaagaagcagaagaaatgcgcacatgaaaggggaatagaaattcaaaaatggaaggcagagtgaggaggaggaggaaaacagacttgatctgctcgctgatggcggcctcgcactcgtcgacgaacttttgcctagcaagagactggtccttggcctgggggacgagggagagctcccccttgagctcctcgaatggctggaagaccacgccgctgagcacctccttccctttcccggcggccctgcacactgccacggctccggctccacgcggcacaggcagccagacggaagcaggggtcgaggccgcggcggcgagataggtaggcgccgcggcggcggcggcggccagagaggagggggcaaccctaggaggaagcatggcggattaagtgagaggaaggcgcgtgtggcgttcggttccggagttcgcggcgcggcgggtgaagagtgatgagattgtgcggtggtaggggtggaggtgatagaaagggatagatataggcgcgtggagctcacggatgggccacacgtggacggtcgagatgggacgaaggcgagggagcgcgtggcgggctcgtggctggagaggatattttgggcttgtggttggttgatgtggagcccggcccggccgcaccggagtcggtcaagcttaaccactattccttcccggattgtctctgatggatcggttagtcttgttaatttcgtcatcagcttatacttggtttggtggagtttgtgtgtttattgctttccttccaagttgattgcgatgagttgtacaaaattccacacaaatttatacgtctagatgcaatgcatgctggcaaatttctctccttcctctgatgattggtcagcagagaagacaagggggatatcgaggaggagctagatgaagctagacaagataagaatggcgtgcacagtgtggactgtggagatgcggtgtcgatatcctacacaaaaaagtcatttggaggcgtgtggaggcctcacgcccgctctggaccagattgccctatttctctccaccacaattatcatcttctttttttttccacctttttacatacttatctgtcttcgtcagtattcatgtgttgcac

SEQ ID NO: 3947 - DNA, 1501 bp, Oryza sativa
aattaagctgcgaaatgcattgcatgggagcatgggtgtttgtagtacatgtcactcaccacctgactcagactgaaaccacaaccaccggaggtcccattcgcatttacacaggcatgacgtatactttgtctctagccacaacctgctgtatgcatgaataatgcttatcttaagacatcctcggtttgatggatgttgtaaattgctatgctcgacaaagtcctaatctcgtcgttgttggatagcctcttccggcgtttatacgtgtcatctggtctcctgctgttggctactaacatgcacgtatgggataaacaaatagacaaacaggagtactggaatactacctgtcgttttctcatgttttaattaatctatatccttgatttacgattttccttttatatatatagctactttctccgtttcataatataagtcattctagtattttccacatttatattgatgctaatgaatctaaatagatatatatgtctatattcattagcatcaatatgaatatgaaaaatgctagaatgacttattgtgaaacggagggagtgctatgttatgatcgacatatataaaaagagaacgatgactgggagaggtgatgagatctggtgaggtgtccaaagttgctaatgtccaattgctagagcttagaagaagctacaattaatatttttgctggtactgtcagttgtttgttttacgtggattgtgatgaatactagtactgtctagcaattaaaccagaagttaacatgcaagtgttgcatctcaaggtcaactctgagaacgtgcgcaggaactaacattaacagttcagtaaccaaaggtcaaacaaactgcactagagtccacatttactagtgtgtagtagtagtacgtttgaacgaacttgattaccagctgtcgtcgtagtcgtagctagttagggtccaactcatttttgtcgatcgcgggggaggaatgttaacggtgcatgtggttggttgatttgattagtgaaacaaaaaaaaagtggttttcggtggtggtaatttgagcttgctttgaactttgaaaagtgatcgatgcctgcaattcacacttcagaaaagaatgaaggcttagctcgtatgtagacttttgatggcttaatcttatttgctgccaagtagagacaaaacaagtcagagaacccattactgtacatatttatacatgagtaatcaatgatatgggtggatgtgatccatgcctccagcaggacatcatgattaacatgttatgagggatcactatacttaatactcctcatatgcttagttgtttagtagtgttaattatgtttgtcgtgactcagcttagttgttgctgttgttgagctataaaaggagaagctctgctcccgtgcaccctcccccctgaagcctgctcctctgcatcaactgtttgctgcccagtacagtagaggcctgcacttgcaagttgcaactgcaagcaatgg

SEQ ID NO: 3948 - DNA, 1501 bp, Oryza sativa
gctaagcgtgtcatacaaccaaaattcacatgacagagtcgtgaatgtcacacattagactcatcatcatcattgcttacatggttcacaactttattacacatatcatccaaggaaaagcggaacaagcctccgctgtcataaccttttccaataaacgttccatatttagatacaacacatttattggattcaaacacaagtctaaaaccatctctacacaatagagagccgctaactagattcttctttattgaagggacatgctgcacgttcttcagctgcacgatttttcccgaaataaacttcagatcgaccgtaccaacaccatgaacagccgcaagcgatccgtttcccatcaacaaggaggaacctctcccgacctgataagaagaaaacagggaaatgtcgacacacacatgaatattagcaccagtatcaacccaccaatcaggtgagtgacagacagagagaactgtaggtaaaaatttaccatacctcgatgttcctccgccctcactaataaccatgtttgtagacttcttgtccttgcactcaggacaatccttggcccaatgcccagacttgccatacacaaagcaacctccttttgcctttcccttgcctttcttcttaaaattggttgtagccttgggtttgacgtcaggtttgactttcttgttgttgttgtgggatgcgtgagggttcttcttctgcaccaaattggcgctagaacctccctcgatctttttgccccggttgtcctttgccctcgccttctcctcaacacccaaagagccaataagatcagtaacactgaactcttgcctcttgtgttttagagaagtagcaaagtccgtccaagaaggtggcaatttggcaataatgccacctgccacaaacttgtcaggcaactcacagttgttgttctcaagttcctttgccaacatctgaatctcatgagcctgttccactacagaacgaccatcgaccatcttgtagtcatagaactgctccatgacatacagctcgctgctggcatcggaaaccccgaacttggcctcaaaagcatcccacatgtccttccttgaaggcatgtgcatatacacgtccacaatattgtcggcgagcacactgatcaatgctccacggaacaagcaatccgcagcctcgaacttagcctcctcctcaggtgagagaggcagttcacttggtttgccccgtgagacaaagaaacaatgcaccgccgtcaaccacaaaagtgcacgtgctttccatcttttataatttgaaccatcgaaagcatgtggttttagggatgcagcaaagccaactaccgaaaaagacctatcaagtttttggattgttggaaatttggtcataattcggcatattttaatccaaaatattaagacaataaacatgacatttgtaatttgagtagatctagtgacagtgctagatgtgtacaacatgagcatgcttaatatagaataagcat

SEQ ID NO: 3949 - DNA, 1501 bp, Oryza sativa
cttgagcttttgcatcagattgggccttttgccaaagaagctgtatctgctagaagaactgtcaactgaaacgttgtcgaagtcttcgcttctgggtgaagaaggtgcagaagaagcagtttcaaggtcagtgtcgccctgtcctcgttctgatcctgcatattccagcattagaagtttggccctctcacgcgattttgggctcagggtcttgttaaggtcacgagcagaaattttctcagacggtgcctggtagttgcggagctcatatctcagacaagcattaacccaacgcaggtaaaccaactcttctacttcactgaatctgttcatttgtaggccttctacttgcttggtaaggtcttcatttgcatgcctcagcttgttgatctcctctcttgcatgggaaactacatcactctgcacaatgataagctctgttattaatatatctgtatatgctgaaaatgaacataataaaaatatctattgctagttcattcttccttttctgagagaagcagtgtgaaattatgatgtggttttgaaatataagtttagctcttaatatagctatgcattattgaataggcaagggatttttcagttaaaccaatgctagtgtgtgcaagtctagtccaatggataatattcagcggttcaatcctttaccctctctcttcagcatgctcagatcatgctcctcttttcctaatcggtaatgacaaaagaggtagaccacccagttttagatttgaggcatattggttaagaattccaggtttcctagatgttgtgcaagaatcttggaacaagccgatactagccacgaactgtctcgctactttcagcctaaaacttcgtcgtcttgcccgtgatcttaagagatggaatcgcagtcaggtgggggatattacgctacagcttgcagtggcgatggaagttgtctttcaacttgacgtggcacaggagtcaagagttttaaccaatgatgagcggcagctatactcaaacctcaaagcacgtattttgggcctctcggttctgaataagttaaagatcaggcaacgttctaggttaacatggattaaggagggtgatgtaaattccaagttcttccatataaaagcaacctcaaggaggagaaagaacttcatccaatcactgaaaactccatcaggcttagcagtttcagccaaggataaagaagatgagttgtttagattctatagtgagaaattggggacaaattttcaaaggacgaagaatctgaattggaccaatttgcaactgccttcttttaatctgtccgagctagaggaagacatctcggaagaggaacttagaggaacgatttttggcatgcctcccgaaaaggctccaggtccggatggtttcattggagcttttttcaaagttgcctgggaaataatcaaaggtgaccttctagcagcggtgacttccttcatgaacctaagcacttcacatcttgaggagctaa

SEQ ID NO: 3950 - DNA, 1501 bp, Oryza sativa
ccctccccgctggcttcccgcccttctcaccatcgggccatcgtcgccgacaccgttcctcctgtcggtgagctcctcaccttcctttttcgccgtccccgcactcgcctagctcgctgtgcgctctgtttccgcatcgccgccttcttcctcctcgtaccgcacgctatgctgcgtccgccaccacgcagtcgcgcgccgtcgttggcccttttctctcgtcgaaccagttcgtcgtcgccctcccgtaactcctcgcgccccctctctgtttccccggtgacgcccctctcagtgctgtgccgccccgccgtagctctgcttccgccgccgtcgccggccggtctctcgccgatttcttgcgccgcgaccctccccgtgtccccttgaaccttctcagaccgccaccccagtcgcccgcctcgccggctgcgctcgggccatgccacccatcccgccgtcgccggccgcctctccctcatccgagccggtggatgggaccgcccttaccccctctcgcttccggtgcccgccgcccactccggttcgccgccgctcgccggaattcctcgcacgccgtggaccgttggatccccggtcggcctcaccaccgcttccctctctctcctatgcccgcgtggtggccacgtcgtagccacctcggcttgaccgagtcaagctgacccggtcagccctcacccttcccgcagccatgtgcgcccgcgtcgtgtgcctgggccgcgctcgccccaccggcccgcaatagctcggcctcgctccaccagcctgccccgcgccgcgtgggtcatgctcagccggcccactcgccccgcgcctcagcccgcaaccgtcgcgcccctcttaggccgtctcccacacacgcgcgcgccagcccatcggttcggctgcgctgcgcaagccacctgggccgcaccaatgccaccctaaacaagtccaatatacatccctccttgatttcctttcccaaaaggatttgataaatcatttttcctttgttccataaatcaattctttattctgaaattccataaatcatttcccttggccccgcacgtcagtgactgtcaataatattctggagaatattatttctataaattccacaaaccatttctcgtattccagaaattccaactaaacttccaaaattcatatctcgcaattcataacttcgattgactccattccacttccagtaaccctctaaaattgagatcaatctaatggcactattatttagtccaaataggatctttttcttggtcttttgtttaggttgtcgattgtttgcgtatagttgcgattaccggattttcgtcaatcgcgggatttctcgaagattcgtgaagcttcgtgaagaccttgagcaaggcaagtcaccctttaatcaattgctcctataattggaaagtcattattattttgtctacaacttgcattattagaatcacacacttaacttgcttggcctcggtttgcg

SEQ ID NO: 3951 - DNA, 1501 bp, Oryza sativa
ccacggcgtcgagatccaccccgcgcgcgacggcgccgagagagggaaagagagctccaaccgagcgtcacggcgtcgagctccccgacaaaggccggctgggagagacgagagaggaggaggtccggcggccaacgaccggcaaccggcaggggagaagagcagcgtgccgccgtcgcatttgttggtgacgaacgcggcggagcagccggcgcggaagtagcagttgaggaggagctttgctctggtccttgccgctgtaccagccgacggtgacgatctcagcgctgacgacgagaacgttgaagaacactagaatcctactgatgaatgcatttaagatactacattagggaattaaaccccgcttgtttcctactactgaagtatgaagagattacttgatccttgttccttttaatatgtcattctgaattctgaagccttgctcttgttagattggctgataccccaggcatcaaaagaggactagaatctccttcagcatggaagtccccttggttcgtagatatgcaatttcaggtacatttagcactttgtaaaatttatgtatttgaaatgcagagctcaagtgtttggaacaagcatataacttggtgaactatggctaaatctaagcggatggaaatatatttcttattattgagtcatgcctgagagtatttttttttcattaatcacttatattgtcacgcactgtgggcattgcttgctattgttttctctgctgaacttcttgtggccatatgttcctcccagggttcatacttcgtcagcccagctgatagaacctacgatgcgctaagattggtgaagcagatagtaataatgcgcagactgctgctgctttggcagaagcccgtgagagggaaaggctggcagttgtgtttctgtaatccaacaactgtaaatggttttgataaatttccatccatgttgagcataaattaacatcattacccatgccacgtgtagcgacggtcatgaactccacgctgccgtcgtcgaagcagccgatgagcttgatgtgctcgagcagcccggccaccggaatgcgcagcggcttcaggcacgcgaagtcgacaagcccgacgcgtcgccgcttcacggtgccgggagtggtagaggagcaacatcgcgaagtcgacgagattcgttttttattggatggaggagtatgcattaaaacataaaaggcctattagctcagctggttagagcgtcgtgctaataacgcgaaggtcgcaggttcgagacctgcatgggccatttcctcttttttactgtattaccttcctttctcattttcctttttccttttttaaacagggctgggcctgggcatatgacatatcagcatatggcattcccacttcagctctcaaggtttgttccgcctcttttcagtgttgagaatagcttcttcaggagtagcttctataagcagtctagctgattggtactactagttcttcttttg

SEQ ID NO: 3952 - DNA, 1501 bp, Oryza sativa
aggtctgactcgtagtctacaacagggtagccttcctcctcgaatccgtgtctagcgagatcagagatagtgctttcgtctctcctgacggtatccggagacaccgtaagggagtagccatgcctatccctaaagtcgatatcaggcggcgtgtcttggcgtatgtaggcttgtatgttgattgtgttgggtgttgatgaggtggtcgtcccgatcgtggtgatcgtgttgatcgtctcatggtcagtgtgtgtcccctgtcctcctagggggcttgtatttatactcataggtgtccccttgtccaagtagaactagagaaaccaatatggatataatccgagtagttcttgtcatttccatatagaattttagttgtctttccttatcggaactcctcctaaatccaaagattgtttccgtataggacatggtatgtggtgggtcctaccgagatttagtcaactactattaggtatgtggtatctataaccatgacagattgtatccttaatcagcaacagctagcgacccaatcagaaagttcagaaatcagtcagtatgagtgaaggtagactcagaaactaaaaatcatgtatgatttcagcttgtccttgttctattttgtacttgtaagtttccatacctgttgcttttcttcatctgttgcacgatatcttctgcatacgtttttgcttcttgcattcttcatgtataagcaattgttgcttatttagttatttttatcttgttgctggaatcagtaatcacccactgtgacagatccttttctcctggcatctttctattgcacatttgcactgatatgaacaggtacaatatatacggtttttagtttagagaaaatccatgaaatgccattgataaacaccctaatccaagaaatgccatcgacgaacgcgacttccagcaaatgccatcgtacgagccattttgtcccaaaaatgccatcgccgtcactttcactctgttagacaccgttaattttgtcaaaatgaccaaattaccctcctcaacaaaggataaatccccttctcttccatcccatcgccggccactatttctcccctccacttcaatcgccagctcccgatgggcgacagcggcaaggcgacgctcccaggcggtggcacgtcagttccaggcgtcgacgcgatgggcggcgaggtggcaggcggtggcgcggggctcccaggcggcggcgcggtggtcccaggcggcgcctgcggcagcggtcccaggcgtcgacgtgacgggcggcgaggaggtggaaggcagcggagcgtcggtcccaggcggcggcacgtcggcagcaggcgtccgcgcggtggtcccaggcgttgacgcgatgggcggcgaggaggtggcatgcggcggcgcggtggtcccaggcggcggcgcgtcggccgcaggcacggtggtcccaggcgacggcgcctcggcagcaggcatccgcacgacggtcccaggcatcgactca

SEQ ID NO: 3953 - DNA, 1501 bp, Oryza sativa
aaatactaggaaaaagtttgacttactttatcttgattagttctgttgttccattcctttgtcttgctctttatctctttggcatccaagtcagaatgctacaaagtaaaatggagtaattgtgatccactgttcaactcttatggtacataaggtaaagtacagctcgcaatactttttttttcaaaagataatttagttgcataatgttggtctccataagtcaatcaaaaaattgttcaagatcaaatactgagctctattgtctatataactccctgaaaagtaataacaggagatatactcagatgctgatgagtaatgacacattaactgaactgattatgccatatgcgaggaaaccaaattgtagaagactagacaaatttaacaagcaaggaaaagaaaatgattattaccagaagagagtgcaaaacatcttgaactgcctcagaatggtgtactgtctcaatgtgctgtaccagaagtttcttaattcgtggttcctctgaagctgtaagcacagaaaatatgaatatcacatttatgtgcagtgtcaaagtacattatatgcaactcatgttcgcggtatcatggaggctgattaaccggtaagtagaatcctactattgtattatcaggacgagtatcttccggcaccaatttgcacagacaagcaactgctggtgtgattactgattaagttaatagcgtgtcacaaatgagaacctaggtgtagctcagtggtaaagatgttgccttgcatctgtgaggcctgcattcgagccatgctttcgacgctaatactcaccgattcaccttatatttaatgcataaatatgtttgcccttaatttgatactaatttcttccttagtatctcacttatatattcttctgaaagaaaaaaaatgttgcttctgtcctaatatttgatactaattatctcctcagtatctcatatatgtttatgaaagggaaaaaaaaagcgtgtgacaagtagaagtagatacctttattaggagcagaggatggctcggagactgaaaggctggagaaatcgagcatagccttcttcaccggcctctcattgatctctagccctaacgaatcacaaaaatcatgtctgttttttttccactatgaagttgggtagagaaagggggaggagcaatgagaggaaaggagagaggtttactcacagaaagcgtcggggcgggtctgggagggcttgcgcttgacacggacgacgatgggtttgtccctctcctcagcctccgcctccgtcgcggacgccatcgccgccgcccgccggcaaagccaaggtagggttggttggttctctcgccgtcagaacaatcgagaacaaagttgggtgctttaagattcgtgctaatacatctcgacacacctacgtggatggatatactcgctctcgaccgcgcgccaaaaaaaaaaaaactcagacatggcggccaccgtgtcgctctctctcgtcgtct

SEQ ID NO: 3954 - DNA, 1501 bp, Oryza sativa
agattgcagagcaaacaaaactaggggatatgtgcacatgattaatggccccacaatcctggccacaggcgctgaggcaagtcgtcggtgagtgaggacctcgacatttccggtgagggcgaaggcgcgcgcgaagaagtcagcgacggagagggtggtacccaaatcggggacggaggagaatgcctgggcggcggccttgcgcagcagacagcgggtggatgagcgagtgtggagcagcgaggggacgtcggcgccggcggaaagcgcggcgtcgagtaggctgagctcctggtccccaaacctgagcagcgcgagccgagaagaatggagcggttgtagaagaatgcaatgctagttggtggatggtagaggaagaagggtgtgtgattacctgcggtgggagagggcggaggcgaagagggagaggaggtgctcgtccccatccccggcggcggcggcggtggccatggcttgcctccctctctgcccgacgaaggcgaaggcgatggatggatgggattggattggattttgtatttgggcctaggcccactaacgaactcgcttccaacgaagcgcagaagaacttttgtccgttttcttttttcttcaaatgaaaaacgttagctcgttctagaagagtagaagtaagcaggagtctcgatgaatcaattttctcaatagacaaatgcgctgttaaaaggagaaaagatggttttgtcactataggagccaagtaaacatatggttgcaatgcaaggaagagggtaccgtgtatatgtggctctgtgcaacacatgaatactgacgaagacagatatgtaaaaggtgaaaaaaaaaagaagagaagaagataattgtggtggagagaaagagggcaatctggtccagagcgggcgtgaggcctccacacgcctccaaatgacttttttttgtgtacgatatcgacaccgcatctccacagtccacactgtgcgcgccattcttatcctcatctagctcctcctcgatatcccacctgtcttctctgctgaccaatcatcagaaggagagaaatttgccagatgcatgcattgcatctagacgtctaaatttgtgtggaattttgtacaactcatcgccatcagcttgcaaggaaagcaataaacacagtaactccacccaactatttcctccgttttataatataagactttatagcattgtccacatgttaataaatttaggtatatatatatatttattaacatctatataaatatgaataatactaaaaaagtctcacagtataatgctgatgacgaaattaacgagactaaccgatccatcaagtagaacgcagaagcaatccggaaaggaatagtggttaagcttgaccgactccggtgcggccgggccgggctccacatcaacaaaccaccagcccaaaatatcctcccagccacgagcccgccacgcgctccctcgccttcgtcccatctcgaccgtccacgtgtgg

SEQ ID NO: 3955 - DNA, 792 bp, Oryza sativa
taaaaagtcaacggtgtcaaacatttcgaaacggagggagtaccaaacactgatagggggggggggggtttctaccttcatcccgtcctaatgaccccctcaatcctcactactggtaaaattatacttggttaaaaaaaagatatatagatgatccttacgaaccgatactgatgaggtgtcctggagtaatacccattggtatgttaatgatattagaattgaaacaagcacacatactttacatgctacaccctccgtcctaaaataataataagtttgatagttcaaattttgttgttgatgtagcaacctaggatatataaaaagtaacttttgctacttaactattatattatgctaatatcctcttgctctattataatccgagcatatacctcaactatctggagaaggcaaataagtttttctagtccttcttaatgcatgtgtcaccttctaaaaattgttttattttaggagtaatattttttaaaaaaataaaaattggtacaatgtgtagacaaaataaattacgtgagtatatcaggatgggaggacaattgacacgtacatcctcctacatagaagtattactaaaaactcgtgcgttcacatagacaagcatagagacaaaatggcatgtagtgcaaggagctagtcaaagacccggacctcttcatacttcatctgaattttgtctcttggactcttttctccatctctcattttcacactgggtcgatccttttagtccactgctcttactatactagctaagagacaaaaagg

SEQ ID NO: 3956 - DNA, 1501 bp, Oryza sativa
gaggtagaattttgtgtcttttgtgtgacgactaatcgagaacaatattatctttgtttgctagcattgctccaacatgattttattctgtcatccacattggaaacaaaatctgggaaaaatgacaatataagggattaagggatgtcgttatggactctgcatctatcataattaagctgcaaaatgcattgcatggggcatgggtgtttgtagtacatgtcactcaccacctgattcagactgaaaccacaaccaccggaggtcccattcgcatttacacaggcatgacgtatactttgtctctagccacaacctactgtatgcatgaatgatgcttatcttaagacatcctcgatgctcgacaaagtcctaatctcgtcgttgttggatagcctcttccggtgtttatacgtgtcatctggtctcctagtgttggctactaacatgcacgtatgggataaacaaatagacaaacaggagtactggaatactacctgtcgttttctcacgttttaattaatctatatccttgatttacgattttccttttatatatctagctactacgttatgatcgacatatataaaaacagatcgatgactgggagaggtgatgagatctggtgaggtgtccaaagttgctaatgtccaattgctagagcttataagaagctacaattaatatttttgctggtactgtcagttgtttgttttacgtggattgtgatgaatactagtactgtctagcaattaaaccagaagttaaaatgcaagcgttacatctcaaggtcaactctgagaacgtgcgtaggaactaacattaacagtccagtataccaaaggtcattcaaactgcactagagtccacatttatttatataagatatactagtgcataggagtagtaacttgatcaccagctgtcgtcgtagtcgtagctagttaggatccaactcatttttgtcgatcgcgggggaggaatgttaacggtgcatgtggttggttgatttgattagtgaaacaaaaaaaaagtggttttcggtggtggtaatttgagcttgctttgaactttgaagtgatcgatgtctgcaattcacactgcagagaaggatgaaggcttagctcgtatgtagacttttgatggcttaatcctatttgctgccaagtagagacaaaacaagtcagagaacccattactgtacatatttatacatgagtaatcaatgatatgggtggatgtgatccatgcctccagcaggacatcatgattagcatgttatgagggatcactatacttaatactcctcatatgcttagttgtttagtagtgttaattatgtttgtcgtgacttagcttagttgttgctgttgttgagctataaagggagaagctctgctcccgtgcaccctcccccctgaagcctgctcctctgcatcaactgtttgctgcccagtacagtagaggcctgcacttgcaagttgcaactgcaagcaatgg

SEQ ID NO: 3957 - DNA, 662 bp, Oryza sativa
tatactgatgaattgtattcccagcctcagcaactctcaactctcagcgtgttagacctgtaactagctatgcatgcctgcaggtcaagtctaggagtaagatccccgaattattaaatatgggagaatttcctggcgaattcgaacgtgtaatcattgaaggcaagcagcttgttgttggataagatagatagctcattgctggagtcattgttgaaaaaaagtctcattttactcccgttactagtatagcatattgttggtagtatcttgtcggctctgcccttgaaatatcttgtttggttttcgatgctgctgctggctgtaactagcttgaattggatgagaagacgactgattcatcatcatcatcatcatactcatacagaaagcttagcttttggtgatgcctcattaacagtttgaagtgatgatgattgcaggcccagcccaaataggaggaggtccagacttttcacagtgtgaactgaagtgatgatgattgcaggcccagcccaaatagaaggaagaccagaaaagtctggactccggaagaaagcggcgcggcggggcggggcttcgcttctttccgttgttcgtcccaaatcccaatcagattccgagggagcgcagtcgcagtagcaggccaacgatcgagtcga

SEQ ID NO: 3958 - DNA, 1501 bp, Oryza sativa
agcaccacagcacaactgggaaaagtttaaactctggttcaaagaatggactcaagagtcaagagcgtcaatgtgtttgacaatttgagctgctcctataatcattgtttacaaatcttaaaattgaagaatcagttaataggaagcgcacgctaccacgcttcatatttctagtaacaagatgtagaacttgcggaactgagggcagtaacccagcatggagatcgtaaagcacgcattgagataaaatttgataataataactagcgaaagatcaattgtgcacaagtgatatcgattaactgtctacgggtctataatagataagatcgattgtggcaggaaagtggtaattgaagacaagttgcccctttactcaataaggtcgatctgtatgtagagtagatgaggggctttgggaagctaattaaggcgtaccgatctcggcgccgaggccgttgaggccagagacgaggacgttggaggcgaagaggcgcttcatggtctcgcggccatagacggcgagctggcggctgtggaggtcctcatcgatctcgggcgctctgccggtggtcatggtgtggttgtcgtcggcgggttcgtcgtcggcgcgggtcttcttgtgcaagtcgtggacctcgccggcgagctcctcccgcttgcgggtaagcatatagtgtagggcgccgccgaggaggccgacagcgagggtcgccgcgaggacgaggctgaaggcagccggcgagagctgccgcgtcagatccaggtcgcaaccacggcgagacctacacacccgagcggctcggcgtgagacgggagggaacaccgcaccaagagatgagggagttgggcgacggaggaactcacctaccttggattcgtctcgttcgtggatcgagctgttcttccttcgcttcccttgtactatactctatatctagggttttgaggaggaaaaaagaagaagaagaagaagaagggctaatttgtaaattgtggccgcttctcttgtgcgtctgataataagaggagaaggggagaaggggagttgtttgagtttgagacgagacggaagatgtgggggtggggcccagctggcagtgaaagaaacgaaaggcaaagcaaagcatcagtgctttccttggcgttggcgccgtgagcatctgcagttctgcacatcaactccatggaaccatctcgaaggaataagttcatctaaggtccctcaactttacaccgaatccgattttcgtccctcgatcggaaaaccagacacaacggtccctcaactatcaaaatcggtgcagattaggtccctcggcggttttaaggacggttttgactgacgtggcacctacgtggctaatttgactcggtcttcgtccgacgtggcattgacgtggcgcttacgtggcaattcgacccggaaaaataataaaacccatgggacccacatgtcagtctcacatagaaaataataaaaaaaatagtgggacccacg

SEQ ID NO: 3959 - DNA, 1501 bp, Oryza sativa
ccgattcgtgacatgtcaatcaagcagccaaaaactgccttgtcgtcttcatcatgcgcaaaacctgaaatcatggtattccaagacacggtgtctttttgtctaatcttgcgaaagacagaagcagcagtttccttctgtctggctctgaaatacatatcaacaagggaattcatgaccgaggtattggactcgagcatgctgtggatgacaagacagtgaagctgtcgcccaagatcccactgcgcactgattgaacaagccttaacagcagaaatataggtgtaccggtcaggtgcaagcccagaatgatgcatcaggagcaccgtacgaatggcatgatgcccaaaaccattcaaaacatatccttcgagcatggcattccagcacgtcaaatctttgttcctgatatgtgcgaatgcacgctgtgcagcagcaatgcggccatgctttgcgtacatgagcagcagagagctccccacaaaaggattgctatccaggccagctctgacggcaacaccgtggagcgaaagggcgatgaggagcttattggaggaatgggccaccatggagtggcaggcagtgagcatggttgcgagcgagaactcgttggggcagaagccgctcctgatcatggaaacgaagaaacgaaagcccaggtggggcgcgccattgcccgttgaggcagagaccatggctgtccaggagacgaggttcctttgcggcatttcgtcgaacaccttgagtgctgagtcgagaaggccccgcctagcgtagtagatgaggaggtgattcatgttgaaggtgtgagcgagcgtgcccagcttaagggagtgcgcgtggaggtgtgaagaggaggaggaggaggaggccatggaggcgatggcgaagggatccctggagatggaggtggaggaggtgcagtaatgcagcaggtggagaggagaatgcgattggaggaggtggcggcggtgagtccaaggaaacatgccgccgtcgctgctcgatctcatgagtccaaggaagttgtttgtgtgatctctctctctcagttgttccttgagagaaatttcgtttcttttaattttctgtgtggggtaactgtaatactaacgcaactgcacgggaacggaattgcagggagcaagatgggcctatttacctttgttgaatgagtccgtgagattatgggaccatcaactgttgtccgtccctctcccagcacctccagctccagtcacttcactgattcaagtaccaccctactccagttaatgcctgtagactatacatcttaaattaaatataatgttttttttttggcatatcccatctggctggagaagaaaaggaaggccttgtctgtattttcctcatgaatcacacatgcagcaacagggtccagaatggcaggcagctcaacgcctttcttcctaatataggacttgtccacttcacttggaacttggaagaagatgtctctgttgccttcctaattact

SEQ ID NO: 3960 - DNA, 1501 bp, Oryza sativa
taggattctatctctaggatatatcttatctctataatttgtatttgactcttatctctaactaccatattatacttctaacattccccctcagtcgtaacgggagcgaagtgaacgattgcgactggatttgaaatcttctatttcttcatctttctttgactcaccatcatcgactgcatctctgatggacggtcctccacctggtgcctgcgtccccttctgtgtcgtcccttgactctcctttattccctcccgcagtcatagcgggagtgtcatggacgatagcgatgacacggacgcttggactggagtttccgtcaatgatttttgttgtagacgttcgtcgatgtagccgatcatgaagtagctgtggttgtcggtgtagccgcatatagccgaaggcgaaaaaaaaatatttacgccatggtgtgaagacaaaaactgtaattgttagcatcttgcaccttgtagatgtcagaggatgccattggggacgtcttgcatatgtcagaggacgtcgttggcgatgaggccaccactttggttggtccttctgcgccgtatagcggtcatcacaatagtgatgccgggttgatgcagtcgttgtagtcgtacatgacgtgatcgatgccgttgtcggtgacgcggtcgttgccgtcgtagaggacacggtcgatgtcgtcgatgaagcgtcttgcagattaatctgtcagaggatgcgaggtgtccatctatgtagacgagtcggcagcggcaagttgatgaaatgatgtagaatcggcgaagacgatcgtcctggagagctcggcgacttgacttggactccgcgaagacgtcgcagatgatcggccggtgtcttgatgcaggtgtgcagcacaggcgtgtgcacatgttggcgacgaacagcatcaggcccttgcttcttgtgaagtaggcgatgcagatcgatccatggatgaggccggatggtatgatgcttgttgacgttgtctgctcctgtaacacctgccgcattgctcctgacgatcatatggttttctgtggctagctaatagatctaaaactaattattagaaaacgcatctaatgatatgcggtaaactaatctgtaaatgattggagaggctagctagctaatgcggtgcggtgccccagggagaaattgatctcatctccctggggcagcgcggatggaacctagctggaaccgaggatcgatcgacgtttgtctacggctctgataccatgtagaaaatctaatacgttgtattttggtattttctgatatattggatcgaccctctcatggggtatatataggagtacataggggatagagacttggagtacaatacaaataagagtagatttatctctaggattctatctctaggactctatcttatctctaggattctatctctaggatatatcttatctctataatttgtatttgactcttatctctaactaccatattatacttctaacaatgaga

SEQ ID NO: 3961 - DNA, 1501 bp, Oryza sativa
caccacgctccctcctcgccgcgccgcccttcctttgcctcgccgccgttgtcgggagatgacggcctggccctactcttctctgctcctctaattggtcccaaaccggcgccggcagcgcgtcgtatgccgccgccgccacccggagtcccgcgccttggcgtcctcgccgccaccgctcgggcctctctagcggcctgaccccgaggtcgcacgcgcggtgagccggtgacgctctcccttctcccgtatcgtcaacgatgccgccgccgccgccgcatcgccggcccgccggatgtcctctcccacctcgccccgacgagctccccacccgccgagcatcctgcagaggggaaagagagagagagagagagagagagagagaaatagagagagaagaggaagggggagaagggggaagggagaggtgctgactgtacaccctgacatgtgagacccacgtgggtcccacgctgactcagccgccacatcggacgaaactgggatcaaaaccaccgaaggacataaagtgaacgattttgtaagttgagggatgtcttatatctagttttgtggttggaggatgattttgtaattcgatgacaagttgagggaccttcggtgtactttttcctctatggcatgaataccaaccagtagatcgttggcgcctcattcccttcctcctgggccgcaacgggattaatggctagcttgaggcccatattattgttgggccgtaacgggaatgctagatacgtgcggcccgtcttctctggtagtcgtcgacaagacaagccaaggggagcggaggcgacgacgtccgaccatcaccgacctctcctcctcttccgccgcgcgcttccttgccaccgcatctaggccggccatcggcggaggagagggaggccagcacgcggtggagcagcgagaggttattgcctgaggcgcttcgcggaccttctacaatggtggtaagagctccctccctcctcttctctcctctcctctcctctccttcctccatccatgacatcagtttggccacacccaatggttcccgctgccgcgtgcaggcgatgcgcttctgctgctgctgttgttcgtgtattgctccatctgtgcacgatttgttcgtgcatagggtttccgactggaattgggttggaggggcttctggtttaccctttattcaatcgcacaaggatgatctgcattctgatcctaaaattatctcttactgtgatggctgatgtcgtgcttgtgaatttgattcatgatatcgcgtggatatattgcgaaccgcatgcggagaagcataatattttttcccttgtgatttgatgaggctatgtgatattggggtggcactggcagtatgccttacacaagatgctacattaaacccgattcaatctttcgctatttttttcctttcctctgaaattgccttatttccactggtagtcgagatatttggggtgaggtgcttaacttatgt

SEQ ID NO: 3962 - DNA, 1501 bp, Oryza sativa
caaaacccgctagttcggcttagcttggtgcggctcggttcgatctttgtcttgggtgtataaaacccacaaaacccgcaaaacccatggaggcccttcgccacctaatgggccagcccgggaagaccacctcagggcccataaatgcaaagacattgtatacccactttaatgtctctagcataagggtaaccatgtaaattcccctataataaccgaaccctagagggtatgagcatatactaggagtataaatagccccctaggtacgccatgtaatggagagattccaaaatttttaaccgattaatatattgctttaccattccagttattcactgaattaccacctccttcgacgtgacgcagttgttattcgacaacaatgtgggttaattgtctcaaaattccttttaattaatctattttttatatgaaatgtatgcatgtatggttttgattaaataagattatcgtggtcatttgtctatcctcctaatttgttttaaattagctagaattttaatttttatgggacagtgagttttaaattagctagaattttaatttttatgggacagtgagttttatgggcctaagcccaacgtgcatatggaacggagttttgggcccaaagcccatcaagaaaaatactactatctgacaaaaaagaaataagttcaccggacatccctcaacttaagagcgagattttttaaggtcccttaaccacaaaaccagaaatgtatacccctaaactcacacaaaccgtacataaaaggtcccaagacagtatatatgtgggtggtttcgctgacgtggcatcctagttaaaaaaaaatataaaaaagtacatgggcccacatgtcagctgcacatatttttttttcttctctattcttctcctctcctcttttctctattctcctcttcttcaggccagcggcgggcggagagcaggagagacgatgggcacgcgcggatgcgggcggcgggcagagcggacggcggagcgaggcggcagagcagcgaagcggcggcgggctgccggcggagccgacggcgggcgagcgcggcggtagagcagcgagacggcaccgggcgggggtgcctggggcggcgaagtcgagggcggagtcgtcggagtcgatgtgggagggcgtgggagatggcgatgtggacgaggaagaggagggagagcgggaggacgaaggtggcggcgatgcgggcaaagagcggccggtgggcgcgcaggatggatgccgcctccctgtagatccccaccacgcccaggaactgcagctcctccggctcgcattccattggactccttcgattgaggattggatttgatttggattcctcgtccgctacactgtcagtagcttattaatttggtaggtagctaacgaaacgagatgagatgagcttgagatgggattggggattggggaattttggagaagtagtcgtacgtaagcaattggttggggaagcgagg

SEQ ID NO: 3963 - DNA, 1501 bp, Oryza sativa
tagtacaacaaatctggatatagagaggatgtgatatatcctagtacaacaaatctggacatagagaggacgtgtcacatcttagtagttgtttttttttgacagaggggttatagggatgaaagtatatcaaattatgtttgatttgtttcaaatctaatcaggttgatgatatagtaaaagaattctaaaagccaacatattagtttttcttttgaaataaaagcatattaggtatttgtctctccacttcgatagaaagcatgaatgagacacacaaggaataagctatctgtccatcatgcaggcagccactagcttgagcatatctacaaaagtgataactcgtatcttggtatgtatgctcatacctaaaaccaaccatccattttagctcatgtctctggagtagtgctccatttataggctatttaatcaaattaatattaagggccattttttagacttagatttattggcttaagattttaagttagtttttttctcatatgatttataagccagtaaatttaaaatcataagttttaaagtggagtcatacctctaactcacataagaaaaaaaaagttttctatactaatttttggcttaatagtgtaatagtaacttatgactttaaaaaacaaacgaaaaatatgtttgtttgtttaaacttagactttctgactcattaactagcttatataaccctaaataaaaagggcgtaagattaaagagaaatgttctctgcttttgataccttattgatgaaattttagattttgaattgcttggattccttctaagcgtctgattggatgaaaatatttaaatttgttagaatcagtgtatcaaaaatgtttatattgcacataaaatttatacctaaaaatgcttatgtttggaaacagagaagcaaatgaaattatgaatgcagtgatgacgtggcacgagcaattgaagccaaaaggctatcgaaaagcagtagcaattagcaaaaggtgaaagcatatatctggccagccgttcatgcatgtggagagatggaaaaaaaactgaataataaaaagcaggttaggtcggtcggtctgagtggcacgccgtacctagaaaggacagaattcagttccgttccgttccgtttggtactggaacatgaactagctagatcctctcctcctcagtacatacctgtcctgataagcactcgctccaaaccaccactccagactccactatgtacacccaaaatcttgaaagaaaaggcgcttcaagtacaggagtaggcaccagctgattgcttatctttatctgctcgcatttccagtaaaaattcctccttgtccgttctcttcttgggaaggcttcttctacaccgtactctaacctgcaattgttttgattctacaaaagttaagggcccctttgaatcgtagggtagaaaaaacagagaaataggaaaaatatagaattctgacaggaattgaagtgtaaaacaga

SEQ ID NO: 3964 - DNA, 1501 bp, Oryza sativa
cacaccttccgcgacgccggcgtcaccctcctccacggcgacctccacgaccacgccagcctgctgcgcgccgtccgcgacgccgacgtcgtcatctccgcggtgcgcgcgacccaggtccccgaccagaccaggctcatcgacgccatcaaggaggccggcggcggccgcgtccggaggttcatcccctccgagttcggcatggacccggggcgcggcgccagcgcggcggtggagccggtcaggtccatgtacggcagcaaggtgggcatccggcgcgccgtggaggcggcgggcatcccgcacacgtacgtggcgtgcaactacttcgccggattcgcgctgccgtcgatcgggcagttcatgccaaaggcggcacccgtggatagcgtggtgatcctcggggaggggcacaccaaggtggtgttcgtggaggagggggacatcggcacgtacacggtgctggcggcggtggatccccgggcggagaacaagacgctgcacatacggccgccggcgaacaccatgtcgcacgacgagctggtgagcatgtgggagaagaagacggggaagaagctggagagagtgtacgtgcccgaggacgccgtgctcaccaaaatcaaaggtacgtaacatgtatggagtactccactgcaataaaccatacgcaattatatatatattgctaattaattgcaattgcagagttagagtacccgaagaacgttttggtgtcgatcgcgcacgcggcctactgtagaggggagatgagctcgccgctggatgatccgcaggacgtggaggccactcagctctacccggaaatccaatatacaaccgttgacgaatatctcaacaccctcctctaattcatttcgtcatgcatcatatcaccctaaatatgcatgcgccaataaaaacaagtcttgattttattttgttcattgctccatcttcagtcagtgtccactggtttgtctgtcatgcatggatcatttttactcttcaattcagttctgcatttcagttgagctgttcagctgagtgccttgatttgtaccacctatctgccttgttacaaatttatgtcaaagtcttcttgctctggtacagttttacgttttcttctgcaatactagtacgcacaggaagctaagctgacaccttccaactcttcaagaaaacgaaagctgcaacaagtgtagcacgattcacgaccccgagcatgagctaggttaggcaaaacaaacaaatcagcagggtcggatgactttacttactggtcattttcataatcaaccgggccacaatcagagaaaaaacacacgcagcgagccagcgaaaaaatgttcactagcttcagatgactcagcttttcatccacgcaagcagacagtgccctgttgctccaacaaagcagctcaccgccaagtgcaattgggtctacaatttgccgtaccacttgtaaagagtagctgaaccgttttgtcatatttttaac

SEQ ID NO: 3965 - DNA, 1501 bp, Oryza sativa
ttttgtggcttatctgcaactgagaaaactacatgggttgcttggttgcatggttatgtaagataggtatgttgcgctaattaggaaattcactatctgttagctgactattgcccaagcttgatccaatgtgtcatacgaaattggggcacatatttttttcactgacgaagtagcagtatcgaatacaaattaccactagtactggttgtttcacctgatgttatagaaacaacattctagagatagcagtagtgtgctttctattgaaacgagttactatgtgtgtgtgctaataaaatctcaaatctttattaatgtgttcttccatcttcattgagtcgtctgcaggtaatatgtcatggatccttgtgctcggttcagttccgttcagctgttcagaccttgatctgtactgcctatctaccttgtctgaatgaatgccaagggactatcttgtggatttttttttattggcacacacactcactgactcagagatcaattagaagtcgagaaatattggtctcatgcaagcaaaggcgaaacaataatcaagttaaacttcgattcgaggcttgccagttagaccatcggttagacaggcgtacctctgtttggatcggtcagcatagctcagtaaacatcggtacatatgactggcctttgcgtgaatgctttgatcatctttctaattaggaccaaatttaatggtcgtcaacacttggttgccaaatttggccaatctgttggtagatatgggcggtgtaatggcatagccatcatctatacatagaggtttttgagaaagtttgctacattttaaaacaaagaatgaaatagcaaggctcttaggtgcggtgtgacagtccacctgtagagtgcagtgatggagatttgtgatatttcggtgttggtaagctgaatataatggccgctcgctgatgggtgcgtcatgcaccctaatttggttggtccaccataccggaaacagcttagaaaagacggtacctaatcagttaaaataaatttatgtcaccttaaaaatgaaatgatgaaagagttcattgggtaaagttggaatccaggccagtgatgaagatgtgtgagcggaaaatggtgctctgaatcctgactggtggatactatttggttggtggatccaaaactgggctggaaacctaggcgaagttcgttgtccgctcgcgtccaggtgcactgaaccaagtgctcgcaccgcaggaggcatacaatcgcgtccaggtgcactgaaccaagtgtaatgccgtcaagatcatgattgggaggacgtcgattaataaataaattaacggtacgaattactagtacacgggcgtggtggttggcccagacgttctagaaacaacattctgattgggacaaaaatgaagagaaatttgaataagaaatacttaatttccccgtcttggaaaaaagtataaaaggggccggaatcgatgaaggcgatgcaagctgtgac

SEQ ID NO: 3966 - DNA, 1501 bp, Oryza sativa
ttatgtaagataggtatgttgcgctaattaggaaattcactatctgttagctgactattgcccaagcttgatccaatgtgtcatacgaaattggggcacatatttttttcactgacgaagtagcagtatcgaatacaaattaccactagtactggttgtttcacctgatgttatagaaacaacattctagagatagcagtagtgtgctttctattgaaacgagttactatgtgtgtgtgctaataaaatctcaaatctttattaatgtgttcttccatcttcattgagtcgtctgcaggtaatatgtcatggatccttgtgctcggttcagttccgttcagctgttcagaccttgatctgtactgcctatctaccttgtctgaatgaatgccaagggactatcttgtggatttttttttattggcacacacactcactgactcagagatcaattagaagtcgagaaatattggtctcatgcaagcaaaggcgaaacaataatcaagttaaacttcgattcgaggcttgccagttagaccatcggttagacaggcgtacctctgtttggatcggtcagcatagctcagtaaacatcggtacatatgactggcctttgcgtgaatgctttgatcatctttctaattaggaccaaatttaatggtcgtcaacacttggttgccaaatttggccaatctgttggtagatatgggcggtgtaatggcatagccatcatctatacatagaggtttttgagaaagtttgctacattttaaaacaaagaatgaaatagcaaggctcttaggtgcggtgtgacagtccacctgtagagtgcagtgatggagatttgtgatatttcggtgttggtaagctgaatataatggccgctcgctgatgggtgcgtcatgcaccctaatttggttggtccaccataccggaaacagcttagaaaagacggtacctaatcagttaaaataaatttatgtcaccttaaaaatgaaatgatgaaagagttcattgggtaaagttggaatccaggccagtgatgaagatgtgtgagcggaaaatggtgctctgaatcctgactggtggatactatttggttggtggatccaaaactgggctggaaacctaggcgaagttcgttgtccgctcgcgtccaggtgcactgaaccaagtgctcgcaccgcaggaggcatacaatcgcgtccaggtgcactgaaccaagtgtaatgccgtcaagatcatgattgggaggacgtcgattaataaataaattaacggtacgaattactagtacacgggcgtggtggttggcccagacgttctagaaacaacattctgattgggacaaaaatgaagagaaatttgaataagaaatacttaatttccccgtcttggaaaaaagtataaaaggggccggaatcgatgaaggcgatgcaagctgtgacacactaacactctacttgtactaggtagatcgctagaacaatggcgtccggtg

SEQ ID NO: 3967 - DNA, 1501 bp, Oryza sativa
ctactacctctatagtagggatatatacaattgcctctatcctctctattctcttttcttgtacaacttccaatttttttactaaacatacaatgacccttttataatagaatttattgttgtttttgcttaaataaattacatccaattactaccgatattgcaaatcgaacggtcacgattacaaattcatagcttgattataaaagcaataaaactacttagaataacaaactaaagaaagagataacacctattactaaacttctatgtatgattaacgataatcaatataaccattttttttctcagcggcacataagttattaaaaatataacgataatatataaccagtattttgggatagaggggttacaacaatacaaaattatataatacaattaacatcactcattatataatgagcagtggcatgtatgttttatattactttattttacaacaccacagataagaagacttgttttactctttgattacatcttacgtttcctatttgcatacgtttgtattttaaattaactgttgagtaattttcaaaaaaaaagctacgtacagtatactttaactaaactatcacaaaactatatattcaaaaatgtgtatccaaaaaatgatagatttaatgccaaatttattataaaactacatatttaaagtatcataacacaaaactacagattttacgatgaagttatgaaagaactatacattatagagtttatatccataatatattgaggtcagaaacattgtagttttgtaataaaaccaatattatatctgtagttttctgatatgatactttaaatctatgcttttgtaaaaaaaattatgttaaatctatatattatgatacacattattaaatatatagttttatgatagtttgaacaaaatatatatagttttgtgaaatttattcttaactttttttatacagctgtcgatgacaccataagctatgttaaacattgtcactaaattttgaatttatataccggtggttatgcaagtggagtggacgcgcaatgggaggagatggaaggatggcaactccgcccgttacaatagtatagaaaatactatcactgcagtagtgtatatatagactatatacagtagagctctgaaaaaaatagatgaaagatcatattccagtatggaagtgtgggtgtacgtatcatgttttgattggcaagccatggtgcacgtacgccacggcaatgaggaagaagaatcagatgcctaaacaacccacccattttcctgctcctgctcctgcactgtacttggattgcaaatgcggcagagaatcgtttcgtttcgcttcattttccgcaagctgaaagcaatcgaaagatacgaataggatcctcctctcttctttccgtcttgtatatatagatttctgtgggttattcccgccatttcaagcaatccatattccgtccgtcagctactgctagtggtaggcta

SEQ ID NO: 3968 - DNA, 1501 bp, Oryza sativa
ttacagaaaaaaacaaaagaagaaagggagtgagagagtacaggtattaacacgtgtgcagtagagtatagtgtattaatggatggattcagatttttacctaaaaataattggatggattcggacgcagcctgcagaaacaacaaagagccaagacaagcaagagggctcaggggagtggcagcgcatcgctcagcatccaatcatggagaccgcccgccgcccgcctgcctgcaatctgctgctacgtgtcctgtgctgtatgtcgactgctccctccgtcctaaatgataattttataatcttttgaataaaataaataatcaaatattataacaaaatctcaaaagtcaaaacgatgatggagatagtatcattatctatttcatatttcatactgtaatactaacacttctaaccctatactactctaaaaaaacaaatctaaaatagtagtagataagttttctttttatggaagaagcgctccactgctacttcatttaaacaatgtagtgctccttttagcatcaataaatttgtaaacacgtattctaaatcaacctttcaaaaaagggcgggttttgctaattttttttataaattttctccccaaaatgtatcgaatataaatacgatacagtaatagtaatagtataattatattgtaacttatatataattacgatataacatataattacgatataacttgtacgtaacatttatataatattcaatcgttagatatacttcaatattcatgcaagcgggaagaaaaaggtcacagtgcatgcatgcacaggtgagtagatttggttccccaacctccgcttcacaaaaatagcgtgttacgtcaggatttttgaaagctacatacaaggtataggtataggtatagtgtaattatactacaattttattatatttacatttgatttttttttaaagaaatttatcgacaaacgtattgatagtaaaaaaaaaagagaagtattatgaatctcactattagggtgagttccatgtatactaccctagctctatctcttctgtagcaccgtttcaactctaccaaaagatgagtgttctcaagaaaatgaattatagacgcgaagctgggtgtagacaactccatttctgatccaacccttaacagttagagaaaaagggatatgtgtaactgcaacggcccatgcatgataaatatgaggcagcccaaaccaacctctctctctataatgtatagaagcccaaaagaagagcgaggcccaataataagtccagcagtagtaggcttcgctagtagtgttgtccaaagacacaagtagtaggaggagattagagagagagggaagggaacaccgacccgcatcgcatctgatcggcatcggcatcgtcctcgtcctcggcatcagcagcagcaagggaagggaaggattcgccgcccgcgaggtcgtcgcctccccttccggcttccgtccaggattttccatggacg

SEQ ID NO: 3969 - DNA, 1501 bp, Oryza sativa
gcttctattcaacggcccgtcactggtatcctctcacctgtgacgggccagaaatgaaagccgtcacaggtggcggcccatcacctctgacggcttctaatgtatcggcccgtcacaggtgaggggataccagtgacgggttggaagaaaaactcgtcactggtatacctctgacgggttttcctttcggcccgtcacaggtgaggggatacctgtgacgggccgcggccagatgcctcaccggtgacggcatcccgtataacccgtcaaaggtaatggtcactactgaccaattcgtttgcccgtcacaggtatcccgtcagaggtgtgaggatctggcgtagtgccagctgctgctgcttaatttgggtggtggtcacaagcaaactaactaaaggaaatgttaatactaacatatactaattaatagattaagatcagcagcaagcctgcagttccatccaaggtttaccttaccgccggggccgccccggcggtaagcacggttaccgcgcggtaaccgcggtaaccgtgaaaaaccgtacaaaaccgtgcaaaatttatcaaaatttcaaaatatttttaaaatttatttgtatttaaggagtttaccgcggtatttatattaccgtacccccgcggtaagcccggtaaccgcgcggttaccggcggtaaggtaaaccctggttccatctccattagtcctctcaggagttaagaggaagctccactttaatcaccaactagtgtagtaggataggagcagcagaaaaaagcagacaagctcatcatcatcatcaaacacaggtcgatcagggggcaagaagtagtgcttcttcctttattattattattattattattattattagagcaggtacaatagcaggctattagccagctataaacatattttaatgatataaacgatgagagagaagagcagcgggctacagatctatagccagctgcagcacgtactccaagacacactgtgtatatgacaggtgggaccatatactaatagtatagtaagcaactattgtatgaattgactattagattggctacagatgaattggagctggtagtgggctgtactattagacttgctcttatggaccaattgggtgggggtgcttaattaatactactatagattatcataccatcaataattatccttaattactcccttatctccacatagtagagtatcgatcgtactacgtacaatagggcgggccggcgatgatgaatatcaatgctagctagctcaaccagcacgcactagttcgatcgatgtactgtactgtctgcagccatatagataatcttaagggaaagcaaaaactcaactaattaatatatagcatcgatcatgtagtatcttgatagtgcatcagtgagttcgtcgttaatgaatgaatgataattaattaagtagagctagcgacgtcgtccagatcgagataataaatacgaaatgaatgaaataagt

SEQ ID NO: 3970 - DNA, 1501 bp, Oryza sativa
gagaggtcgagagaggcgaggcggcggtcgagagagtgagtgagtgagagtgggcgccggatctggatcgatctagaagatgtccaaccctaggtcaaccctagtcaaactcacctgtgacgggctccaactatgtggccgtcacaggtgaggtcacctgtgacgggcgccaaccgtggagccgtcacaggtaagaccacctgtgacgggcccagcactctgggccgtcacaggtgaggtcacctgtgacggccctacagatagggcccaaaaggattaatgccgtccgtacacattgcgaaacgcatgtttcttgggtcatttgagaattcctggtaaatcctatcgattgtcctccactgtactgaatctgctgggtgcctcagcatagtatcgactttccgttcttcggcatgccagcgcacaagcttagcttgttccttgttcgcaaacattctcttcatgcgctccgcaattgggagataccacaccacctttgctgggcctcccctctttgacttacttccttcaccttcactctttgctcgtttgtatcttgatgccccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatgagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctctacatcctgatccaacacttcttcagctgcgacatcaggcgcctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatgttgagaatgaatggagaataatgtgttttttaccttgaattttagcaaaaaatcgccccccttgccctcccaaccgatttgtgaacagtacaatggtcgggatggaaagcagttggcagtttgggggtatttatagacccaacacacctcaa

SEQ ID NO: 3971 - DNA, 1501 bp, Oryza sativa
agtgaaaaataaaatgcaggtggttcaagtggcggcaaccggggagagtaatgcggtggacgcgacgggggcgggggatctgtttgcgagcgggttcctgtacgggttggtgaaagggctggcattggaggagtgctgcaaggtaggggcgtgcagcggtgggtcagtggtgagggctctgggcggggaggtgaggccggagaactggcagtggatgtacaagcagatgaacgccagtggcctgctgctccctgacctcaagaactgaagaaaaagaaaaaagggcttgccttttacttgtcaagcttccaagaaagaaacaaagattcagaccatggtcattgatggcttgattgtttgttagttagacctcctatgctcggtttctttctttgtttcttaatttgtgagatgagatgaatggaatggatggtggtaacctgcactgcactacaagtctcgctgattattcaatttgctcgagaaaactcatatatatatatatagtataataaagtaacataaaagtttggatgtatgaaaatctgaacgtgtttgttgtcagctgtcacctcacctgtgtgcagagtcttaaaagtaaactagagactactagtaccaaattacgatcaatcatttgctgagctcgtgaattctgtctggttcaatgttttgcaaaaggaggttctttcacttctccgcagcaggcagcaagatgatgtttggtttttatgattggtggatacgtagagtggattgtgaggttagaaaaggtgtcaattcctttatcatgctatgctaggagctggagccttgtcgcttgcttgctagggaggaggtggggtctggccggggctaaggacatcttcttctttcttcttgccccttgtgccagaccagacggagaacagtgatcaactgtttagtttagttagcgcttacttatctttttctttttattgtcttgttctcgtgcgtgttgaaaaaaaaaaagattgtctatgggtaatccggctgaaaatttcagccgaatttgtagccttacaatcagccaagtcagcacccgcgcgtgcgactccgtccaggccttattgggctggattttgtgctatgatgggatttgaggcggcttgggcccagtacagttgataggccggaagtaataggcttgtgggcctcggcccatacatacatcgagaatcttcttcctttttgtgccgttctccacgagtcctcctcttcttcttcttcttccttcctcctccttcccaaggccaaggccaagaagaagaagaagggtgtgtttaactttaacaccgggggtggaacggccgccggcagcggaagaagatccagccaattcaatccaatccaatccaatcctcaggtgaccctcaccctcgctcgccatttgtcttgtgagttgtgaattcgaatttgtaattctccatatccccatgcaggctgcggagcggaggaatcaattcaatgtcttcctccg

SEQ ID NO: 3972 - DNA, 1501 bp, Oryza sativa
cgcagcgagggcgcgaggaggaggagccacggaagcgtcgtgggaaggggagagcgatagagaggagacaggcgagtgaacggtggcggctagggtttcgggggagacggggaggaggaaagataatgcgaaaaggcccctcagtttccataattcagagcacggttcttttttcccatttttgtctccttcgtctcggatttctcaggactcggagggtctaaacgtaagattatggagccgaaaaagctacaacgaggacgtataacaaaataactataaaagcgagggcttttgtgcaaaaattccaagacgacgcggaggcaggagagctcgcgaaatcccacccattttccagcgccccgtgacgtgtcgcgccccggccgcgtccacgccagcgcaaaacgctgagggacgagcagccctatacctggccaaatgggccgtgccaagccgggccggcccaagcacgaccgcactgtagaaggcccaggcccggcacggcacgccggcctgtgggccgtgccggcacggcccgtttacccgtgccgtgtctgggccgacgccatagcccgtgggccagcacggcacggcacgtttactgtagagggctggcacggcccggcacggcccgcgagcacggcacggcacgggatcggctcggccgcgcacaccgcggcaccgcgcacgtggcgccaagcggccgagccgccgagggcagccgcggggccaggcggcgggaagcgcgcgtcgcttcgttcgcgcgtggcgcgtggcaagcggcgtcgcgacgtgtcggcgtgtcgctggggctggccagctgggaggctgggacgctgcctcacgctgggtcggtcgctcactcgctctcgctgcctgtctgcctgtctgccactctgcctccgtgcctcgttgggagcagccgagacagcgactcggcgagaccccgtacggcggccgaacggctagtcaaacgacgaatgcgagagtgccacgtgtcccccaacggctagtgagctaatccaacgaccagaagtagccgttggagagcaaaaaaaaaggaaaaaaattcgaaaaaaatatgaaatttatttctataaataggacacccaccagagcattctgaatcatccatacctcccattttgtgctctgttgtgctctttcgtgtgatagatcgattttttgatttagacaaaatttgacaaaattttgtgtaaaatcaaaaatagtttgtgactaaaaatagtgcatacaagaggtgtaaagccaagcaaaggtggtaagaaagaagtacgtcatatattcagttttatgtattattttattttatgttatgcgaataaatattctgaaatttgtttatgttgttttaaattttcagaatggatgaatcgaacattccatcgttcacgttaggtgatttcgaccctaactacgtgtcgaggtcattcccaactggtgagtatgatgccaccggatcggctccaacaccaccagt

SEQ ID NO: 3973 - DNA, 1501 bp, Oryza sativa
atttagtcagaatatggatgattaatcaaacatatacacgacacatctgtagttttgttttcttgcggtcggaccaataccactacaatggcagatctatgtgagaactatttcctccgtttcacaatgtaagactttctagcattgtccacattcattaagatgttaatgaatctagacaaatgtatgtgtttagattcattaacatttatatgtatgtgagcaatgctagaaagtcttacattgtgaaacggagggagtaccctacaataaaatttaacaccaaatacccatacagatatatgtgccttctacaatagaatctgtaaagcagatgtctcctcttttttttttttgcatataacttgaaatcacaataaattgatcagctggatagctgcacattgagccaagaacacaataaaagtaactcttacatcttaaataactaaagtatctaaatctagaatctcttaagcaaagctcttctctggatgtttttttagctacattgcacaacagaagcatagagcaaaatagatcaggatggggagccaaagaacacaattattaaagtaaaatagttcaaagccagggaccacatatctcatacccaaccaatgcatatcagtaggccatgcatatctagttgataacttcaagatagtttcatactctgtgctcataggaagaataacaaacaccttaaaggcaaggtaaccaacacacaactatactctatactatgctcatccaaaggtggctttcatgaaaagaaatagaaatcattgtttactcttctgtgcattacctctgcaatattaccccctgccacactgcatagtaagccaagcacctgctaatatgtttgacctcacaacaatctattcgctgctaataatgtacctatttgatatccaagaaacaataactactaaataatatcgtatgcagagataaatcaaaatcagtagattattacttgtttggtgtttaaatgttacagcaaacagcacagcagtggtaggcagccaatctctagttgctccagtcatatggccatgtcttctacagcagcacaaggccaagccagaacggtagattgccctgattgacattaattccattacaagctccccgggacagcaaccggtggccagatccgttgtcttcgatggcaagaacgatgtcaacatgaaaagcaacagcaacagctagaacacgggtgaagcattgcagagtgtggagattatgggtaccccatacccacacggcatggttatccgacaggttataggggataacttatatctatggaatatgtaacgaatcatgacttgggtattacgtttccttgtatattatggaacggcctaaagtcctggtttgataatattgtaaagtagattaggaaaccgataccgtattggttaaggtttctatcttgtaatcctgccccccaccatatataaggtgggcaggaggccctctagggggcatg

SEQ ID NO: 3974 - DNA, 1501 bp, Oryza sativa
gcgtcgaggactcgtggacgcatgcgtgggacactatcctaaactgtcgaggagacaactatcgttgtttgcgtaccatatgtatgtggtgtatgatcatgagattgtcatttcagcactactttgttgatgctcctgttacagatttgcagtctatcgctgagtgtaaactgattaggattaccgtggtggaatcagtttatctgatttaaacttatagatttgacacatgcatttacatttatggctaattattctttaagaggtagataatatatttatcgattttaaaatatgcggggccccatcttttaaatgtgttcatatggatagggtgtgcgcggatccgtttataagtacgagtgtttatatgtgttcatatggatgtgattacgagatactttcttggttgagttcatatcactagcgtaacgattgctcgcacctaggcttctcagattgccacagtatttttttccttccatcataaatatcttatgttttggataaaattagtcaagcttttgatattttgatcacaaatactccatccgtttcaggttacaagacgttttgactttgatcaaagtcaaaaatatcttataacctaaaacggagggagtagtttcatataaaatacttatagtttaaaggaaagaaaaatggtgtgccgtaaattttatttcaaaaatacgatcatagcattataaactccttatattttacaaaccatttgttttaatgcaaaactaacggtcaaagttttaaacatttaacacaattttgcttttaaaacacaaatacatatacttcacccgtcaaaaaacccaattctatattgtattcaggttcaaacgtttttttagaagggattactatgcgcgaggagtgctctgttttttcctttttaagaacagagtactgcgatacaggctgcgtgcagttggcatttgtgtctatcacaacctcacaagctgtccaccctttctcactgacagtaggccccacggtccccacacgcccatcccggtcacactttctgtctgcatgcgaccacggtccagccgacgcgcactccgcccgtcactgccaggtgggccccacccccagctcacctcatccgtcacttcacttcactcctctccccgaaccccgtggagtaatcaaaaccccagcaacaacccaaccatctcatctcaaatgcacgccaaaaatctcgaaattttacgggggttttaattaccaatcaaccgctaaaccccggagtagagtagagtgatacgcgagcggattcgattcacttcacgctcacgcttgcggtttcctcatcctcgctggtgccacgtccttttcttgtcccgtttgattcttgcaagcctcctcatccagcttgtgctgctagctacgaggtcggctttggcggtggcggggggcgccttgaatccgaggcgatttggtgtctgactgattgatttgcctcacttggggtgggggggagttg

SEQ ID NO: 3975 - DNA, 1501 bp, Oryza sativa
acgtggcaccagcgaggatgaggaaaccgcaagcgtgagcgtgaagtgaatcgaatccgctcgcgtatcactctactctactccggggtttagcggttgattggtaattaaaacccccgtaaaatttcgagatttttggcgtgcatttgagatgagatggttgggttgttgctggggttttgattactccacggggttcggggagaggagtgaagtgaagtgacggatgaggtgagctgggggtggggcccacctggcagtgacgggcggagtgcgcgtcggctggaccgtggtcgcatgcagacagaaagtgtgaccgggatgggcgtgtggggaccgtggggcctactgtcagtgagaaagggtggacagcttgtgaggttgtgatagacacaaatgccaactgcacgcagcctgtatcgcagtactctgttcttaaaaaggaaaaaacagagcactcctcgcgcatagtaatcccttctaaaaaaacgtttgaacctgaatacaatatagaattgggttttttgacgggtgaagtatatgtatttgtgttttaaaagcaaaattgtgttaaatgtttaaaactttgaccgttagttttgcattaaaacaaatggtttgtaaaatataaggagtttataatgctatgatcgtatttttgaaataaaatttacggcacaccatttttctttcctttaaactataagtattttatatgaaactactccctccgttttaggttataagatatttttgactttgatcaaagtcaaaacgtcttgtaacctgaaacggatggagtatttgtgatcaaaatatcaaaagcttgactaattttatccaaaacataagatatttatgatggaaggaaaaaaatactgtggcaatctgagaagcctaggtgcgagcaatcgttacgctagtgatatgaactcaaccaagaaagtatctcgtaatcacatccatatgaacacatataaacactcgtacttataaacggatccgcgcacaccctatccatatgaacacatttaaaagatggggccccgcatattttaaaatcgataaatatattatctacctcttaaagaataattagccataaatgtaaatgcatgtgtcaaatctataagtttaaatcagataaactgattccaccacggtaatcctaatcagtttacactcagcgatagactgcaaatctgtaacaggagcatcaacaaagtagtgctgaaatgacaatctcatgatcatacaccacatacatatggtacgcaaacaacgatagttgtctcctcgacagtttaggatagtgtcccacgcatgcgtccacgagtcctcgacgcaacgttcccgccatccacgcgaccacgcatgcacggggggcgcgcgcggttgatgcactggacgtcgagcggaaaaacgccctgatcgatctggtgtcctgagcccccgaggattcactagctcttgccaattgtatccatggccgccgccacgg

SEQ ID NO: 3976 - DNA, 1501 bp, Oryza sativa
ttaccgtggtggaatcagtttatctgatttaaacttatagatttgacacatgcatttacatttatggctaattattctttaagaggtagataatatatttatcgattttaaaatatgcggggccccatcttttaaatgtgttcatatggatagggtgtgcgcggatccgtttataagtacgagtgtttatatgtgttcatatggatgtgattacgagatactttcttggttgagttcatatcactagcgtaacgattgctcgcacctaggcttctcagattgccacagtatttttttccttccatcataaatatcttatgttttggataaaattagtcaagcttttgatattttgatcacaaatactccatccgtttcaggttacaagacgttttgactttgatcaaagtcaaactgttttaagtttgaccaagtttgtagaaaaaaatagtaacattttcaacccaaaacaaatttattatgataatatattcaattattgatttgatagaactaatttagtattataaatattactatatttgtcatgaacttagtcaaacttaaaacagtttgactttgaccaaagtcaaaaatatcttataacctaaaacggagggagtagtttcatataaaatacttatagtttaaaggaaagaaaaatggtgtgccgtaaattttatttcaaaaatacgatcatagcattataaactccttatattttacaaaccatttgttttaatgcaaaactaacggtcaaagttttaaacatttaacacaattttgcttttaaaacacaaatacatatacttcacccgtcaaaaaacccaattctatattgtattcaggttcaaacgtttttttagaagggattactatgcgcgaggagtgctctgttttttcctttttaagaacagagtactgcgatacaggctgcgtgcagttggcatttgtgtctatcacaacctcacaagctgtccaccctttctcactgacagtaggccccacggtccccacacgcccatcccggtcacactttctgtctgcatgcgaccacggtccagccgacgcgcactccgcccgtcactgccaggtgggccccacccccagctcacctcatccgtcacttcacttcactcctctccccgaaccccgtggagtaatcaaaaccccagcaacaacccaaccatctcatctcaaatgcacgccaaaaatctcgaaattttacgggggttttaattaccaatcaaccgctaaaccccggagtagagtagagtgatacgcgagcggattcgattcacttcacgctcacgcttgcggtttcctcatcctcgctggtgccacgtccttttcttgtcccgtttgattcttgcaagcctcctcatccagcttgtgctgctagctacgaggtcggctttggcggtggcggggggcgccttgaatccgaggcgatttggtgtctgactgattgatttgcctcacttggggtgggggggagttg

SEQ ID NO: 3977 - DNA, 1501 bp, Oryza sativa
gacgcaagcagcaggaagagattagctagatcattaattattagattagcttaattaggtcggtgttaaccacgtggtttgtgtacgcttagctagcttgagccgccatccatggatggaacgcacatgcatgatacgtacgtaggcacgcatgaacgtacgtcgacgttaattaattttctcttccgagaaagtaatacacacgcatgaaatgctttcttgtttcttgtttctttttattttcgcggtcaggaagagagatggatcgagtagttgacctgatcagtgatcacatgcaggtaagtgcgtactacactgcatgcatacaaccaagacgtacgacaccggccgctaatgtggattataatttcaggcacattttttgtttgtaggatagagtacagattaatacactcatagtattatatatatatatatatatatatatatcttgtgattggtgaaatcaccacaacagatcttactgtcattcggtatttttcgatggcggagttagaaaaatattaagcccgggtaaacttcattataagtttataaccattatttaatatagaaatttcattatcaattcaattaaaaatattaaaattaaatggagtttctgctagttaacccggacggcggaggctcccccttcagggatgaatccagaacaatatttaaggtgggactcatctccttctttcttcttcagtctccctactctttattttctctatattgttctcctttcatctccctttctatcattagtgatccagcggggtagggggactcgagtccccccagcacccacgctggatccacctctgctccccttgtaccattgtatgaataaaaatagctatagatacacaaaccggatagacaggtttcaccacggaaaattaaacctagctatacgatcacttcataattgcaggcaaaatttgtgacatgtgcacgaagaatctttgtgttctaccaggggtcctgtgtgtgcgtgcatgcatggcgaccgatgatacgtacctacgatgcgtgtgcagccacacacgcttgaaggcatatctagctacgtaccaaacttaattagggctcgagctaattaactaactcagccatgcatctccctcttaattagctgctgcttctttcttcttccggggaagcaaacgcaacatgcacgtactacgtgtgcttgcattgcatgcatgctaactcgatccttcccgcccaatcgcccatgcaaaccccgaatctataaatacctcgccatggctgcaccttcgtctccatcgatcgatcgatccaccataatccaatagcttaattcaaagcctgaaaaccatacagctcgatctgtagtgatcaagttctggctaattaactagctagctcgtgatcgataatatacagtagcagagcgtaagtgatcgagagcgattaattcgagcttttgcgtggaattaattcatggcgtccggtgcgagaaagctcg

SEQ ID NO: 3978 - DNA, 1501 bp, Oryza sativa
tgattactccacggggttcggggagaggagtgaagtgaagtgacggatgaggtgagctgggggtggggcccacctggcagtgacgggcggagtgcgcgtcggctggaccgtggtcgcatgcagacagaaagtgtgaccgggatgggcgtgtggggaccgtggggcctactgtcagtgagaaagggtggacagcttgtgaggttgtgatagacacaaatgccaactgcacgcagcctgtatcgcagtactctgttcttaaaaaggaaaaaacagagcactcctcgcgcatagtaatcccttctaaaaaaacgtttgaacctgaatacaatatagaattgggttttttgacgggtgaagtatatgtatttgtgttttaaaagcaaaattgtgttaaatgtttaaaactttgaccgttagttttgcattaaaacaaatggtttgtaaaatataaggagtttataatgctatgatcgtatttttgaaataaaatttacggcacaccatttttctttcctttaaactataagtattttatatgaaactactccctccgttttaggttataagatatttttgactttggtcaaagtcaaactgttttaagtttgactaagttcatgacaaatatagtaatatttataatactaaattagttctatcaaatcaataattgaatatattatcataataaatttgttttgggttgaaaatgttactatttttttctacaaacttggtcaaacttaaaacagtttgactttgatcaaagtcaaaacgtcttgtaacctgaaacggatggagtatttgtgatcaaaatatcaaaagcttgactaattttatccaaaacataagatatttatgatggaaggaaaaaaatactgtggcaatctgagaagcctaggtgcgagcaatcgttacgctagtgatatgaactcaaccaagaaagtatctcgtaatcacatccatatgaacacatataaacactcgtacttataaacggatccgcgcacaccctatccatatgaacacatttaaaagatggggccccgcatattttaaaatcgataaatatattatctacctcttaaagaataattagccataaatgtaaatgcatgtgtcaaatctataagtttaaatcagataaactgattccaccacggtaatcctaatcagtttacactcagcgatagactgcaaatctgtaacaggagcatcaacaaagtagtgctgaaatgacaatctcatgatcatacaccacatacatatggtacgcaaacaacgatagttgtctcctcgacagtttaggatagtgtcccacgcatgcgtccacgagtcctcgacgcaacgttcccgccatccacgcgaccacgcatgcacggggggcgcgcgcggttgatgcactggacgtcgagcggaaaaacgccctgatcgatctggtgtcctgagcccccgaggattcactagctcttgccaattgtatccatggccgccgccacgg

SEQ ID NO: 3979 - DNA, 1501 bp, Oryza sativa
gtgtaaacatagtgaatgcatgactgcgtcgacgaatttgttaaaagcacataccattaacacatttaaaaagcctaacaagaagtttagaggaaaccaacagatgctagaccaaattacatcctgcataatcgttaaaaaagagtttctagtggcctcaactgagttgattatccaaaaacacatcaacaatgaactactacgttaccaaaccagttcctcccacaaatttgaaacgagctaaccgtaacggggcaaccagagcagatatttgcaactagcttagaaccctaaataaaccctggagacaggtatacgtaaacagatccaaggagatagggaattacttcggagccgagcatcttcgcgccgcggcgctggatggcggcccacggggcggcggcgagggagccggcggtctggtcccgcaggacggcggcgagggtggcgacggcatgggcgtggccgcggtagtgggcggtgggcgcggaggggaagtagaaggggaggcggcgggaagcttccagaagtttccgccggaggatctgcatcgcggcggcgggcagccgggagtgggggagttcgcaggtggcgggctggcggcgaggaggcggaggagaatggtgagctgcatgtgcaggttgggctgtgggcgtggactgggccgctcctagaatatgggcttaatttaggcccatgtattctgtgtggacttactttaggcccacgttgaggcacatgtgattacctttttttttcttttcaaaattcacgaatttatcagaaggatttttgctattgatagatacatcgtttattactgaaagaataattagcagtaaatacgagcacacgcgtgtcaagtttaaaactaatccgtgaacaggctgtatcactataaatttaacatattgtgctacgctcaatatatcgttattaacactattgtgtgttatctcattttacactttgaatatctctcccttttcttttgaaattttgaatatctatcccatttgttaagctctctcctaaatcccatccaataaaaaaaaacacaatgaaaagaactgaaaaaaaaaacagtacaatgataacaacaggcccatgcagaaacaagaaccgaaacaagcgaaaaatcagcccacggtatcagattttttccaaatacagccacgtaggatgattacaacagatcacaaaccaagattagaacgcccgtcggtcgtccatatccaccgtaacaaaccgacctacagccactgacatgcgggccccgccaccccccggtcggcacgcgacgatgccagccaggcgaaccgtcgcgccacacgtggcccaccacaaccactaaccactatagacccgcacggcctcccaaaattagctcatctcgcaaaaaaaaggagaaaaaaagggaaaaaagaaaaacgagcaaatccaaatccaaatccaccaccacccacccttcccgaggagagagagagaggctatgacgcgc

SEQ ID NO: 3980 - DNA, 1501 bp, Oryza sativa
ggtgcgccaggaggaggtgccgtgaacgactacaacaacggaggcaattctgcctcaccatccagcggagggccattctcggggtataatcttctccttctactgctgttagcgctactcctgttcccattgttagcgctatactgtgtgcgctatgttcttgttcctgttctacatgatgcctctagcatgttatcgcattactggtatgttcctgtttctgacattcatgatgcgcatagtatgctactggttatgttaagatcaccctacactgcttatgccatgatcatagtttcaatttcttggattaaaatatgccgaataatgactatatttccaacacgggataccactggtccagccactcgaaccgctcctccgcccctaccaccggcggcgccgccaccgtctcggtctcggccgacggcgccggcattgacgacagccatcccgtgctggtgcatctcggctgccggagccgccgccgtggcgctagactggctgcgcgtggcctagggacgccatggcggagaggaagcgaagtgcgcgcccggaagagcaggtggagggagaagggagccatggcttccgggtgcgaagctcaagcgtggcaaccaacttattatatctgcagtgggccgaagatggagcctatacagacactgtccgtattgctgacagcatcaaaacatgccgtagtgtgtaatccacaagaggaatcattttattgctagtactattttcatctactggaagcttaatagaaaccactctccgtccaaatataaaggagtaacaacttctagcctttaaaaattaacgtaaaatataataatttcttcaccaacattctctttccaaccaattacaatcatcttccattcaattcagtattcaacaagaagttctagaattattttcagagctgttgctaggtgtgaagtgatttcggacatcttgttctgggatacctttggaatgggtctattggaagccaaacacatccagaattatgtgctcactctttagacagaagcatctctgtaaccaagttatgctataacggccccatcgtttggcttatttatgaaataaaccaaacgatatatttgcaaataaaaagtattttgtgaataaaaaatttatatacgcattcttagcgatctataagcaaaggctaaaactaaactttgatgaaacaaaaaatctcaaaatcaacttcaaatttaaggttaaaattcgaattttagcagataagcatgagcttaagtgaaaacatgaggccataagcctgtagaggattgcttcaggctacctcttaatgagaaaacatatgtccagtttcaggctcttcagatagaggttaatgatttacaattactggatgtaaacgaggataaatggagctatatttggaactctccgaattatacttcacagaaattttacaaaatgaactttctaggaactacccctcccaggctatacatttggttgt

SEQ ID NO: 3981 - DNA, 1501 bp, Oryza sativa
acttcccatctagccacgtggccgtgcggcctgccttttctccaccccctcgggaggaggttaggtagttattaggtggtcaggggggcctcggggtgccacgtcacacccctcgggcccgtgaggcatgctgccccgaggcccttacccggccaccacgtggcggggtgagtgggcggagcaggaggcgctgttcagcgtcataaatgagcggcaccccaaccgtccctcactgcatttaatgcggtgtgggcggacgtgcggcgccgcctgattgacgcatgtcaatcgaccttgaccagtctgcgaccggtcgtaggcggataggacaggtggtcgtgcccccacgtcccgccctgtgtcaggcggagtgggggcaggtatgccccatcccatcggcacactgccaagtgcaccccctgtacatggtgaatccaccaaagtctccatacatttaagagggaatgacagggatgtcccccgtgtcaggtggaggacggcgctggccccacctaggggcggacaaccactttgcttccggttgaaggcacggatagtgatctgactcaggctatgtgggcccccctcccatggaggggtacgtatgaacggtgcatgtggtatctccttgaactataaaaggaggactttacccacaaaaaaaaacagggacgactcttgatagctgtcacgccccgaactagtaccgaccggaactagcccgtgacgctccaaattaacctgttaaccgataccagtcccaggaaatagtgctggtatcacaggaagacagaatatcacagcaacagaggtctctttattatagagtagaggtacagtcatgttgggctgcggacagatcccgagctcacaactgcattacaaaagggaaacggaagccagggctcggaccaaacatcacaggcgcgacttgggaactaggccgaaaccctaaaactcaacgtagccggcttgctcctggaagaactcctcatcagccggatccgcttcatcttctttagcaactgggggggaattatttatatagagcaagggtgagtacgggagtactcagcaagccaagggaattaagtgtttaatgcaggcttcaagggaaggctgttgtttttgcaattgattttatttgaactcttttctgaaaacaactaagtgagtgcttctcaaacgactcggatgagacagagcgtctcgtccggtcggagtatgtatcagtctttagaattgaaacaaggttggcacccggccaacagcttttcaaacggccacccgggccaacaacttttcaaacggccacccgggcctagctgatcccatcagctgctgaatctttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccaca

SEQ ID NO: 3982 - DNA, 1501 bp, Oryza sativa
aaagaagtaagaaaaagaggaggttagtcactagcccaaacacatgagggtggttgctcacatccatggtatggtatatactcacattaatagataatatattaatattattaaaattgttctttgtagtgaatggtgtgaaactaacaactttaaccttatattcttttgttgttccatcttcttcttgttttctcattcttatttatttttgataataatattgctacagtcagcactcaacactattacttgcacatgaatactactccctccgtccctaaatataagcgattttggttagatgtgacacattctagtacaataaatctagacataatcccttatatttagagacggaggcagtagcagctagcttatgtgtgtgtgtgctctgtaatatatattatctatgttttttatatgagaaaataataactattatctttgtaaatgatattgtatttataaaaggtatctgactagttttttagtagaaagatatttttgctaaatataatctagaatgctataaagtttaataatattaaacgatatagtcatataattttttttggatgaagtagtgatcaacacttgttatgaatccaatgatcataatgtgatatatattattcaagtgagttgtgatattcactatttactagttacatgcctatgcattataatgagatctacatataaaaatgagatttagtttatctttagtctatttttataatgtattgaattttttacatttctttagataatttattgttttataaatacattagtttaaatacatgtaatataaaaaataaatacttaagtaaataagcgctactttaaatccaaagatctatgtaggattttataggatttcaatcctatagaaaatttttcaatgtagccatttaattcaaatgattgaaacttttcaaatcatatgaaatataaatatcatacataaatatatatattgaatttaattggggcagcatggtcactcattccattttgtagtgtgtcgtctgaattcaacaaatgcatatttgatgtctgtattgagcttatcaattcaaacttcctcagaatatttgatgtctgtattgagcttatcaattcaaacttccttagaagatatatatttttttggcttgtttagaattcttatccgagtgtaacacaatttcaacattatttatgccacattgcattgtttaactctgtaaattattatgattaacgactaatacgcaatgatcatttaatgattgaaaaatactatttaatcagttaccttgatgaatttatcatttacctttgatgaatttgtcatttctgaccataaaagaattaagcttctttcatagttatcagtccaaataattataaatcgaggtgatccaattacaccgagagtactcctagactctgcacagctaagataaccacagtcaaaatagcgtatccgcgaaaataccggactcgctatatt

SEQ ID NO: 3983 - DNA, 1501 bp, Oryza sativa
attatgattagctcaaaaaccctatattttgagacagaatatttcaagaaaccttatatttattaaaatactcatttatattattatacatggtattttttacattatatatactcacatataagtaggctcaaaatgcacattcataccacatagttttatcttcttcctcattctcacagagcaagattgcaaaattgttacatataaaaacaagtattgataactcacacatgttgacaatgtcactattgtataactcacgtaagttaatctctcagtactttctaaagaactataaaaagcatattataatttaatagaaatctgtctagatttattatactaggttatgtctgctatcattttatgttagggttttctcggacggccggagtttatgtcaggtagcaactagtaataaatagtagtacacactatcccgtaagtgtatgtgtccatctctaggtatggtcgatgagcggtgcatcattcatcggctgccgacacatctatccatgcaatgcaatgtcaacaacgaccatgaatgctgatccattttataaactgatcgagtcgcttctgttttacacgggtacgccgtgtaaaacaaatactccctccttccctaaatgtttgacaccattgatttttttaaacatgtttgaccgttcgtcttattcaaaaacttttgtaatatgtgtaaaactatatgtatacataaaaatatatttaacaataaatcaaatgatagaaaaagaattaacaattacttaaattttttgaataagacgaacggtcaaatatttttaaaaaagtcaacgacgtcaaacattttgggatggaggtagtactattttagatgctcatgggaaccacgcatctatatatacccgtacatacgctcctgaaaatgctcaaagggcaaccatatataataccttcatcttcaattcctcctgttccaggtattgttctcacctctcttagtcttatgtataacatatatactacgtgtgatgtttagaaactctatgcttttcttacatactagcaaattactcatgccatgtcatgggaaacgaattaagaccgctttgccgtgtttttttaggcaccgttttggttttgtttcctaattttttgtttttttttctaattggctagttttttgagaaaccgttcgttcttttctggaggggacgagggtaggatctgtttctaccactgaattttttgcagacatgtgggaagaacggtgcggagaggaggatgactcctcttttattgtagtagagatattagaaaaaggaatcagtaaatcagctttgattaagttaagacaacttgagttgatatgtatgcttagctttgattagtgtttagcatgcgatatcttgtgcagatcaacacacccacacacatctcaattttctctcagaaggtgtatatatatttgcagctgttgtctaatcgatctgcagactgaactgaagtataa

SEQ ID NO: 3984 - DNA, 1501 bp, Oryza sativa
caggtataacttttgaaagccgccttggctggctgtaccaatcctttaccggaagcacgacaaccaggaaaaccacatccaaccgaagatatcaacaggactgtatattactgccgcaacacgtcaccgtccgtcttgcgggcaacagagagcgtcagcgtcggtgtgtccgttccagtttgcggaccgacttgatatttcgattggctttggattgctatcccttgaccctagaatcacctttgccaagtgctcctttttcgctcataaagttccagttcaggatgatgctactagtggctttgcacttcaggagtttactacataattgtttgtggagtttagacgtggcgattgtgggtggatggccggcagctggtgtgatatcctccgtcgaacggcggcggctgtgatcgaacccggcggcgacgctgcgcttcacacgtgtgtgacgctcgccaccgcgtgtctcccggccactgagcacgagcgccagcccagcacgggacagttcagggtcgcacacgcgtcgagccgtcaaccttcgtttactcgctcccggggccgatgtccgcttccggacgacgccggtttgaccgcaccttccggcttccaggagagtcgtcgtgatgcccgcgtgcgcgttttgcagattgggccgcgtaggggacacgctgaaaactgggctgccttttttggtccaacgtgaaaggaaaaagtacatcgaaggtccctcaacttgtcaccgagataaaaaaacgtcctcgaaccataaaaccagatatcgaaggtcccttaacttaccaaaaccggtcacaagtagtcccagggcagtatttcacacggttttatcctacgtggcactggttttgtccaccgtggtgctttaaccttggtcttcgtcgctgagtcaccagcgccacgcgaagctggcgcctggcgggacggagtggggcggcggtgagcagacgcgcgggcggagtgacggcacccgaagccgacggggtggcggagccaagcggaggacgccagcctcgttgtcgtcatcttccgacatagggaggaggcgtgggagctggagccggaggaggggctccgctagaagccgctactgtagaaccaggagcacatgatcttgagctccagctccgacgccgcctcagccgcgtcagttttgccgcgcccccacgctgtcgtcgacgccacctcgtcgtccatcatatcgaacattgatgcggccgcgataatcgccttggcgctccccgacagcgactcttccggggcggccctcctcttgccccctcatgtagccacaccgccccctgcggcggcctcgactcttgcgccgccgcttcatgactcactgcatgacgccagcagggagcctgacggtgacgaggagcaggatcgctgctcccttcctcctcctctctccctcttgtctggggagggcggccagtagcggtcgacttcgtcctcgaactcgccggcggcggcgagc

SEQ ID NO: 3985 - DNA, 1501 bp, Oryza sativa
ctttggagatttgctctgcaaattgtttgacgatatatattgcagcttagtctgcacttggcgattggaattaattctgcctgagcgtgggctgttttcctttgaatctttcttcactagcttctttggaacccttgagactcttttggctctggtatcttcattgctgttagcctcaccctgagatgaaacagagtctctagctggttcatagtccgattcaacttcttttccttgtttaccatcccgttccacatcagtcgaacgctcttctctcccttccatattctctacagtacccatctcaaaggttgtttagtgcactagaaacttgatacctgtatataacaccaagaaagttagtaacaagagcaaaggtctagcaacttgatcaggtcaatgagcaagatagcaaaagagctttcaagggtggtccgaccctgcaacataatgattatgacaggaaaaagtcacgcacaaaacagcttgtacataaattgctttaactgaagagatcaagaaaatgtactacaagtgcagtacaagttcagagaagataaataacttacactgcacccagagtaaaacgctaagaagcccatgttcataacttcataacattgaacaagtgataggacatcaaatgaataactgatctccagcttgtctcaacagctgtacagctaagcagaatctccaccttaaagaagcatctcaagcaagatttttcaccttaaaccgacgtaataacacgagaattcagtacaattatgcttccttgtccagtcgatctcaggaagaaggtggttgttaagcacatggcagtggggcacgctggtcttggaccatcatgcgacttggattgcattggagaatttgaggtcccaacggcgcgaaagagccccagacataaagctgtacaataactataatacaggcagatctgacaagccgcagatttggaaaaagctaaccacaatccatgatgaatatgcatactggccaccagtgacagtgagctatccagtactggattccataccaaataaccccaagtcctcctagtcattgcccacattcaccaatcaccacacgaagcagctaaatactaggcaagtgcagtgatactactttggatggatggagcaaatggctagagcaattcaccatgtaaaagttcaagattaacacatactagtgtatatatattgacaaatttcggatgccaccgatggtccccaaattcacattccgatgctccgtacgcgcagaatttttttttatcaggtaaccgctagtgcaggagaattcaagccaatcatatgcgcgaaagaagtaaaggaaaaaaaaacagaaaggtgacatgagaaaactatcatctccgatcaatgcgcaaatgcggatcaaaacatactaacaatcggctatacggctagcttcccctccccaattacgaacaaaaaaaaatgcggacatctcatccatgtcgcaggtacagaaa

SEQ ID NO: 3986 - DNA, 1501 bp, Oryza sativa
gctttggagatttgctctgcaaattgtttgacgatatatattgcagcttagtctgcacttggcgattggaattaattctgcctgagcgtgggctgttttcctttgaatctttcttcactagcttctttggaacccttgagactcttttggctctggtatcttcattgctgttagcctcaccctgagatgaaacagagtctctagctggttcatagtccgattcaacttcttttccttgtttaccatcccgttccacatcagtcgaacgctcttctctcccttccatattctctacagtacccatctcaaaggttgtttagtgcactagaaacttgatacctgtatataacaccaagaaagttagtaacaagagcaaaggtctagcaacttgatcaggtcaatgagcaagatagcaaaagagctttcaagggtggtccgaccctgcaacataatgattatgacaggaaaaagtcacgcacaaaacagcttgtacataaattgctttaactgaagagatcaagaaaatgtactacaagtgcagtacaagttcagagaagataaataacttacactgcacccagagtaaaacgctaagaagcccatgttcataacttcataacattgaacaagtgataggacatcaaatgaataactgatctccagcttgtctcaacagctgtacagctaagcagaatctccaccttaaagaagcatctcaagcaagatttttcaccttaaaccgacgtaataacacgagaattcagtacaattatgcttccttgtccagtcgatctcaggaagaaggtggttgttaagcacatggcagtggggcacgctggtcttggaccatcatgcgacttggattgcattggagaatttgaggtcccaacggcgcgaaagagccccagacataaagctgtacaataactataatacaggcagatctgacaagccgcagatttggaaaaagctaaccacaatccatgatgaatatgcatactggccaccagtgacagtgagctatccagtactggattccataccaaataaccccaagtcctcctagtcattgcccacattcaccaatcaccacacgaagcagctaaatactaggcaagtgcagtgatactactttggatggatggagcaaatggctagagcaattcaccatgtaaaagttcaagattaacacatactagtgtatatatattgacaaatttcggatgccaccgatggtccccaaattcacattccgatgctccgtacgcgcagaatttttttttatcaggtaaccgctagtgcaggagaattcaagccaatcatatgcgcgaaagaagtaaaggaaaaaaaaacagaaaggtgacatgagaaaactatcatctccgatcaatgcgcaaatgcggatcaaaacatactaacaatcggctatacggctagcttcccctccccaattacgaacaaaaaaaaatgcggacatctcatccatgtcgcaggtacagaa

SEQ ID NO: 3987 - DNA, 1501 bp, Oryza sativa
gctgcagggacatggccggagccagctgaggcgaatcttcgcgagaagtgagtcgtcggtggccgcgacgacatcgacgtcgtcgcccgggcagtacacccacaacctggcctggttcctcaagagaagcgacggcggcggcggcgccgccgaccacctcaagaaggcgaagtcggcgagggtgtcgccggtaagccgcggcaagaagcaggcgagcttctgctcggccgcgagcgcgagcggcggcgccgccgccgcgtgcgagaggtcattctcgttcgtgggcacggaggagtacgtggcgccggaggtggtgcggggcgaggggcacgagttcgccgtcgactggtgggcgctcggcgtgctcgtctacgagatggcgtacgggaggacgccgttccgggggcggagccggaaggagacgttccgcaacgtgctcctccgggagccggagttctccgccgactcgcggcggcggtggccggagctcaccgacctcatcgcgaggctgctcgacaaggagcccacgaagaggctcggcttcgccggcggcgccgacgaggtccgtgcccacccgttcttcgccggagtcgcgtgggacttgctcggcgagctctcccggccgccgtacatcccgccgccggccgacgacattgccgcgtgcgaggggttcagcgtggtagagtatttcaacaagcttcacgagccttcgccggagccggaggaggaggagttgacggagttcttgccggagttctgacgtccggtctccggtgttccactcgaactacagtatttctctctttttttcactttcacctcaaaaaaaatcattaattatgtgatcctgtggtgaaaggggtaaactaaaattgagtagaagagattgtactgtaaaattgtgacatggtaagggtaggtttgtgaaataagggtaactatttcggtaggggactgtaaaatccgaatccttttctgctcactagaggctagggtgactgaaaatactgtacttcacaagggttaatccctgcagtctaattgactacggtacagtgttcgatttgttggtctcagacgcccgagcggaagcattttcgatcagatagttgtatgtgtttcgataaaaaaaattcagataattgtagttattgattctctctgcatgatgacacaaggacgattccaaaattttcgtgggatgtaattcctatttttgaattacatctttcagtaataacattgtgccaacaaaatacagaatctaattactgaataattgagtcgacaataaatggcacaaaatggcacaatgttgctgctgatctatgacatattgacatctgacagaggagttactataccagcagaggaaatatgccattttcccgatctgtcaggattcgatattcggaaaagatgtcccatgaattaagcagtgttgatttattagattaatcattaaaccccgtctcaatgtttgaccatgtacgtgcactaa

SEQ ID NO: 3988 - DNA, 1501 bp, Oryza sativa
ctccctgctctctttttggctgaatcttggagacaattttctagccattagatcgaaggagacgaccgaggttaagataaggcccatcctaatatagtagtttcattctatttaaatagggtgttatgttagtatttttttaatgatgtggtaagaaatataataaagtgagagatgagatcgatgagtttcatctaaataaaaccatgtccaaattgttccgacgtgccaagaggtcagaggataaaaccatgtccaaattgtttataatatatagtttcttgcatgtattacctatgaaacaacaaaaataaaaccatgtgtttttcaatcatcaattacatgactcgttgcttatatggcacctttggaaatataaaagatggaaatataaaaatagtatatttcactgggaataactttcaaatactcctacctttgttcaaattttgtcggacactatacagtaatcgcgtttatcgaaaaaaaggggattgctatatggcattcgaatgaaatttgaggatgaaatcttacagattttggaccattggatccatgccaagattcgtgcatcggcttctctcctccaactccggcgggttagggtttggggttggggtgagggtaggaggggggttgggggagggggaagaggggggtttccttggggcttagagggatggccgtgggtggcggagaactggcggtgggcggtggactccggcgagcggcgaggtggcggcggcatcgccaaagccgcggggatggaggagggcggtgagccggcgtcggcggcgggtcaaagcaagcgtgggattaggaggtggcggccagaggtaacggatccggcggggcgggggcacctcgtcatcgtcgccatgaggacaaagtgaggggggaaggggagggggagggggcttgcagggccgttgactttttccggccagccggcgaggcgggcggcagcgcggtgggggtggcggtggcggtggtggcggcggatcgcgtgtgggacgggaggaggagggtggcagcatgatctggaaccggggaaggaggaataggagttagggtttaaggggctgcgcgaatcttaaagcacatccaatggttcaaaattcaaatgataggaggtgagattttatgtcatatgatatatagacagaaaaaaaaggccgtgcggtattcgatgactgagccggttttgaaaccctaggccagtatatgctccgaagatcgtctctttgacagaaccgatgagaattgagaaaacgccaaagctgtgccggagataacaatagtataaatcttgaagtggcgttgccactttgtttcattaatctctgcaggttaaacaagacaaaaacaacaaattaattaggcaaccgtctcgcgggtttagcccggccccctactaccagcttattatatctcgcctccacgtcctcgtcgctcacaacgcgacacactcccaagcacacacacagagcgcgcgcgc

SEQ ID NO: 3989 - DNA, 1501 bp, Oryza sativa
cacctccgccgttccgcttccccggcccgaatcatcatcccccaatctagttcgtgtgcgctgttgtgcggtgtgggatttcgcggtgtcgtattggattcgatattgggttggttggttggcctcgtttgctgttttgattgttgattttcttctcctctaataactgcacgcgctgatcgtttctgtacctgcgacatggatgagatgtccgcatttttttttgttcgtaattggggaggggaagctagccgtatagccgattgttagtatgttttgatccgcatttgcgcattgatcggagatgatagttttctcatgtcacctttctgtttttttttcctttacttctttcgcgcatatgattggcttgaattctcctgcactagcggttacctgataaaaaaaaattctgcgcgtacggagcatcggaatgtgaatttggggaccatcggtggcatccgaaatttgtcaatatatatacactagtatgtgttaatcttgaacttttacatggtgaattgctctagccatttgctccatccatccaaagtagtatcactgcacttgcctagtatttagctgcttcgtgtggtgattggtgaatgtgggcaatgactaggaggacttggggttatttggtatggaatccagtactggatagctcactgtcactggtggccagtatgcatattcatcatggattgtggttagctttttccaaatctgcggcttgtcagatctgcctgtattatagttattgtacagctttatgtctggggctctttcgcgccgttgggacctcaaattctccaatgcaatccaagtcgcatgatggtccaagaccagcgtgccccactgccatgtgcttaacaaccaccttcttcctgagatcgactggacaaggaagcataattgtactgaattctcgtgttattacgtcggtttaaggtgaaaaatcttgcttgagatgcttctttaaggtggagattctgcttagctgtacagctgttgagacaagctggagatcagttattcatttgatgtcctatcacttgttcaatgttatgaagttatgaacatgggcttcttagcgttttactctgggtgcagtgtaagttatttatcttctctgaacttgtactgcacttgtagtacattttcttgatctcttcagttaaagcaatttatgtacaagctgttttgtgcgtgactttttcctgtcataatcattatgttgcagggtcggaccacccttgaaagctcttttgctatcttgctcattgacctgatcaagttgctagacctttgctcttgttactaactttcttggtgttatatacaggtatcaagtttctagtgcactaaacaacctttgagatgggtactgtagagaatatggaagggagagaagagcgttcgactgatgtggaacgggatggtaaacaaggaaaagaagttgaatcggactatgaaccagctagagactctgtttcatctc

SEQ ID NO: 3990 - DNA, 1501 bp, Oryza sativa
ttttatcgaaacacatacaactatctgatcgaaaatgcttccgctcgggcgtctgagaccaacaaatcgaacactgtaccgtagtcaattagactgcagggattaacccttgtgaagtacagtattttcagtcaccctagcctctagtgagcagaaaaggattcggattttacagtcccctaccgaaatagttacccttatttcacaaacctacccttaccatgtcacaattttacagtacaatctcttctactcaattttagtttacccctttcaccacaggatcacataattaatgattttttttgaggtgaaagtgaaaaaaagagagaaatactgtagttcgagtggaacaccggagaccggacgtcagaactccggcaagaactccgtcaactcctcctcctccggctccggcgaaggctcgtgaagcttgttgaaatactctaccacgctgaacccctcgcacgcggcaatgtcgtcggccggcggcgggatgtacggcggccgggagagctcgccgagcaagtcccacgcgactccggcgaagaacgggtgggcacggacctcgtcggcgccgccggcgaagccgagcctcttcgtgggctccttgtcgagcagcctcgcgatgaggtcggtgagctccggccaccgccgccgcgagtcggcggagaactccggctcccggaggagcacgttgcggaacgtctccttccggctccgcccccggaacggcgtcctcccgtacgccatctcgtagacgagcacgccgagcgcccaccagtcgacggcgaactcgtgcccctcgccccgcaccacctccggcgccacgtactcctccgtgcccacgaacgagaatgacctctcgcacgcggcggcggcgccgccgctcgcgctcgcggccgagcagaagctcgcctgcttcttgccgcggcttaccggcgacaccctcgccgacttcgccttcttgaggtggtcggcggcgccgccgccgccgtcgcttctcttgaggaaccaggccaggttgtgggtgtactgcccgggcgacgacgtcgatgtcgtcgcggccaccgacgactcacttctcgcgaagattcgcctcagctggctccggccatgtccctgcagctgcggcggcggcgacgacgtggccgagcacgacgacgacgaggtggaggtggacgcggagggggagacgggcgggagcagccgggagaggtcgaagtcggtcagcgtgacgtggccgtcggcgcggaggaggacgttctcgggcttgaggtcgcggtacgcaatcccggcggcgtggagctcggcgagcgcggagacgagctcggcgacgtagaacctgatggccgcgggggagaagacgcggtcgggctgcgcgtggcggagctcgttgaggtccccgccatggcagtacggcacggcccacgccacgaggtcgcccgtctcggcgcgcccgagcagcgacgggaggtgcgggtgcgcgagcccggacagc

SEQ ID NO: 3991 - DNA, 1501 bp, Oryza sativa
tatagcactgaaataataattagctgtaaatataagtatctattatattattaaaacagttttgaaaggaggcaccacgtttgccgtgggggttagaaatttccacattaatcggagaaaaaagaagaaaacgaaaagtagagtccaagtagaaatacaatttaaaaatatctgaaattcggaattaaaaataagcaatattgaaagaagtttccaaataagaacccaatatgagattaataaaaaatcaaaataaaaataaaataaaatctaaaattagaaaagaaaagaagagtccaagtagaaatacaatttagaaatagctgaaattcggaattaaaaataagcaatattgaaagaagtttccatataagaacccaatacgagattagtcaaaattcaaaataaaaacaaaaattagaaaagaaaaggataatccaagtaggaatgcaatttaaaaatagctaaaatacggaattaaaaataaggaatattaaaagaagagttcatataagaactcaaaacgagattaattaaaattcggaattaaaataaaaataaaatctgaaattagaaaaaaaaagagttcaagtagaaatacaatttaaaattagctgaaattcggaattaaaaataagcaatattgaaagaaggatgatataagaacccaatacgacattaattaaaattcagaataaaaaataaaataatatccaaaattagaaaaactaacagagagttcggaatacaattttgaaacaactaaaattgaaaataaaaaataagaatattaaaataacacaatatggtattaattaaaatttggaaaaaataaattctcaaattagaaaaagaaaaataagatttcaattatgaatacagtttataaataactaaaatttgggataaaataaagactattgaaagaaaaaaccatctaaaacacatgacaagataaattaagtaacagacctataaaagagtagagtggtgacgattgatacgacatataaaaactgttaataaaacaccaaatataatcctaatgatgattaaaaggagggacgacatgtaggccgtgaagcaaacgagcaaggcgattgccgggacttctagaaagtaaaaaaaataaaccccattgataataatattcgatttttaaaatctcaatgacaataaaaaggagaagcagcgggcggggtgtataggagtatagttgtagagccaccgacggttgacaagacttctagaaaataaaaaatgaattccaacgatagttatgttcgaattttagaatcacaatgacaataaatagtaggcggcggacgggccgtagaggagcatagtgacatcgtttgatgggacttctaaaaattataaaaaatgaaacccaaccagataataaactctaaaaactataaggtccaatttttaaaggttcggaacttcttaaaaagtaaaaaaaaaccaatgataatcatgtttgattttaaaatctcaa

SEQ ID NO: 3992 - DNA, 1501 bp, Oryza sativa
acatttctatcggattatccgataggccgtttgtcagataatccaaaattatcaacaaatgtaaccactctatatattgcatataatataagttggttcatccaatgacctaatttatcaattaacctagatttattagcctaaggctttcattgtctcgtgtcacacttgcgtagctatatttttatattatagacataatgtatttatgttgttcagcacttaagtacataattattacaatgggtcatttattaactattgtattattgttccttgtattgctaactcgatgttgtattgattgcatatacatgtaacacccgataaatttaatccgtttccgaaccgattccacaccagctccgcaccatttccgacatccgaaacaatccgctccgcattcgcatccgcatccgtacactatccgcacccgctccgaatccgcttaaaaaatatggtttaggatatggtatgaaggccatccgtccgaatccgctccattttcacccattttttctcaatttttagcacgttttttaaactgctaaatgatatttcttacaaaactttctactttaaaatatcaaaatgactttctcgtcttatgctgacttcatcttcattttaatatatctcaaacaccacgatagagttactactaaataaaagactcctttgacttaaattactgggcggattaggattattacggcggatgattgacttggttgtagatacaaattgaatattataaaattaatttagtataaataacttaaatcaaacagtctaaataatgcaacagaaaaacaatttgtttcaataatgagttatatctgttttaataattcggtaaataagatgaaaagcagctgaaccatcacggcagtaagccagtaaacgtggcgttttgatagcgaggcgttagttcgctgatcacccaatcaccattcggtcttccattcactcacctgtcaccacccgtccacccccgcgtgctgatgcgacgctgtcacaaggcacacgtatgcagagcccgagcgcgacgggggcgctagggctagcggcttgcgtgcgcatggcgtcagcgtgaccgccgccggccgcaacagctgcagcagctggcacagcgtttcgaaaggaaacactttttctgttgagagcgcgagctatgcggcgagcttttatatatatttccccgtagcggagagaggaaaaaacgccaagaaaccatctgtcgcttttgaccccgggaagcagcagcagcagcagcggcggcggcgtatcggggcgtaacggaatcgaggtgtgttgccgctatataaagaggaagaaaataggccccaaaccaaaccaccataccctactacaaaccataggcatcgccggcaagggaggtcggaggaagaagaaagggtcgtcgaggtgttcttgaattctgaatttctgatcaagtcgatcgttcgccggcgacggcaaaggtggtaactggtagtac

SEQ ID NO: 3993 - DNA, 1501 bp, Oryza sativa
ctatcatttaatatatggtattataatttttttaataactactcccccatatcataatataacaacctatccgattatatgttgctatgttatgggatcaatgaaatataatacttaaacaaaaaagtatgaattacctcccgaactatcgcggtcgtccgaattaccccctgaaccataaaccggatattcttcacccccaactatgcaaaccggacgaattacccccctcgactcaatccgcggtggttttggtctacgtggcatacacgtggcatcctagtcagcgtttttctaataaaaaattagtgaaacccgcctatcatactctcccacctgtctctcttccccactttcctctcaatctctctctcttcccctattcctctcaatctctctctgtctcatatgtacgacgagttggtggccggcgctagatgcggcggcggggaaggaggggggggcgaagagcgccgtcgccctcgcgcaccaccgggagcagctccagctccacgcgcgccacgggcacgtccgccgcccgcgcccgcagctgcctccgcagtcacctccgttccgccgcctgcccctgtgcgtcgcgcccgtagtcgcctctgctcggctatcgccgcgataccgccgcccgccccagtgctccgcgcccgccgccgccgtccaccgtccgccgcctgccctcgtgctccgcgcccgcagccgccgtccgccgtccgtcgccgccccgtgcgccgcgccggccaccaactcgctggccacatctgatacagagagagattgagaggaagagggaaagattgagagattaagaggaaagtggggaagagagaggtgggagagtatgacaggcaggtcccaccatttttttattagaaaaatgctgactgggatgccacgtgtatgccacgtagaccaaaactaccgcggattgggtcgagggaggggggtaattcatctggtttgtatagttgggggtgaagaatgtccgattttgtggtttagggggtaattcggacgaccgtgatagttcgggagggtaattcgtactttttccatacttaaaacctataaatagttatatttaggaacagggagtatatggtatatgccagcacagattagattacagaaggataataataataatctctatgctgtgaggggccaacggattaaaaagcacgacgaatccagcgggcaacgagccgatgactggttcgcgcgcgcgcggcggtgagccggtgacgacacacggcgccgctggacgcgacgcgatgcggggcaaaccaacccacgcggcggtaaagcgtgcagaaaacgccccagagaaaaaaaaaaggtagaaaaaaacaaaacggcaaaagcaatcgaaggagagaatggcaaggtgagctccttggttgtttcacactcccaacctcctcgtcccccttcccctcgttttcccccaaattccgctcctaaaccctccctctcctctcactccggc

SEQ ID NO: 3994 - DNA, 1501 bp, Oryza sativa
tgccgagaggaaaaagaagaccaacgacgatggaatggggtcagtagttgatttggcctgtgacaacggataggagcagtggtgagaagaagcgagggagagagaaaaacgagagagctagaggataagtgtcatcttactattattttaattcgctaagataaaaatcttatgctcttcaatttaaatatttatcgagataaaaagcatcgaatgcgaaaaaaatataaaactttcataaaagaaaatataatacaagataataaatgacctcaacctataaagagagtgtgtaataccccttacaaagtgttgtggttccaatttacactcgttaggcttacaaatatcagtttatttgtttgtcacgcaaattttcgtctgtcgccttatgtgcaaaggcaacagtatttttcgcccatccattattcccatgctacaatcatcgggcccacatgttataagcatcatttacatgccacacatgtagagtagactaattgtccaagaacaaatttgcttttgtggtcatagaacacatcattgatgcttatgatcaggcttagttgcttcgatattttttttaagatcaaacagtactcatcccactactacccggttgcaacgcacgggcattttgctagtattagttaatatacttaacactaatgatagtaattaggaaagattctggagatttttttactaatagattgaaaatattttatgttagatttgaaaacttttgatttaagttttaaattttaaagtcaaattttaaaaacttcaactcagattcgaaaactttcaacttgagaatcgagattagaaaactttcaactcgagaatcgagattcgaaaactttcaagttcagattgaaaattttgaaaactttcaatttgagatttgaaaacttttaactcgagattcaaaaaatttcaaatcaagatttgaaaattttcaaatcgagattcaaaaactttcaagttgagatttaaaagctttcaagttcagattttaaaattttcaaatcaaaatttataaactttcaaactcaaaacatgctaaagataaaaaaaatcagaaaaaagtgggaaagaaaaggaaaaaaatggtaaaaaaaggaaaaaagagcaaggaggcgcgcgcgctggcacagcggcgctgggtcttctaggcccgaaacgcgcgcgcgtattagcgtttccgctttagacccgcaaccaaaatacccagcccactaagcctgacccgccccggcccggcctggaaggtccccgagcactgacgcgggcacggggcccactgccgacgtgccaatcctggatcccacacgctcacgcgagcagagcacgaccgatctcgtctcgtctcatacaaaccccgcccgcatccgcacccggatctgccaccgccgcggcttccctccccccctcctcccgatccacccctcccgccgccgccaccgccaccgccgccgccgccggccggcgagagaga

SEQ ID NO: 3995 - DNA, 1501 bp, Oryza sativa
atgccgagaggaaaaagaagaccaacgacgatggaatggggtcagtagttgatttggcctgtgacaacggataggagcagtggtgagaagaagcgagggagagagaaaaacgagagagctagaggataagtgtcatcttactattattttaattcgctaagataaaaatcttatgctcttcaatttaaatatttatcgagataaaaagcatcgaatgcgaaaaaaatataaaactttcataaaagaaaatataatacaagataataaatgacctcaacctataaagagagtgtgtaataccccttacaaagtgttgtggttccaatttacactcgttaggcttacaaatatcagtttatttgtttgtcacgcaaattttcgtctgtcgccttatgtgcaaaggcaacagtatttttcgcccatccattattcccatgctacaatcatcgggcccacatgttataagcatcatttacatgccacacatgtagagtagactaattgtccaagaacaaatttgcttttgtggtcatagaacacatcattgatgcttatgatcaggcttagttgcttcgatattttttttaagatcaaacagtactcatcccactactacccggtgcaacgcacgggcattttgctagtattagttaatatacttaacactaatgatagtaattaggaaagattctggagatttttttactaatagattgaaaatattttatgttagatttgaaaacttttgatttaagttttaaattttaaagtcaaattttaaaaacttcaactcagattcgaaaactttcaacttgagaatcgagattagaaaactttcaactcgagaatcgagattcgaaaactttcaagttcagattgaaaattttgaaaactttcaatttgagatttgaaaacttttaactcgagattcaaaaaatttcaaatcaagatttgaaaattttcaaatcgagattcaaaaactttcaagttgagatttaaaagctttcaagttcagattttaaaattttcaaatcaaaatttataaactttcaaactcaaaacatgctaaagataaaaaaaatcagaaaaaagtgggaaagaaaaggaaaaaaatggtaaaaaaaggaaaaaagagcaaggaggcgcgcgcgctggcacagcggcgctgggtcttctaggcccgaaacgcgcgcgcgtattagcgtttccgctttagacccgcaaccaaaatacccagcccactaagcctgacccgccccggcccggcctggaaggtccccgagcactgacgcgggcacggggcccactgccgacgtgccaatcctggatcccacacgctcacgcgagcagagcacgaccgatctcgtctcgtctcatacaaaccccgcccgcatccgcacccggatctgccaccgccgcggcttccctccccccctcctcccgatccacccctcccgccgccgccaccgccaccgccgccgccgccggccggcgagagaga

SEQ ID NO: 3996 - DNA, 1501 bp, Oryza sativa
cgcaggttgggtcgggttgccgttgccgggttggggtgtgttcggcacccagttttccgacaactctccatcgttttccacgcgcacgctttttaaactattaaatatatttttttaaaaaaagtttttatataaaagttatttaaaaaatcaaattaattaattttttaaaaaatattagctaatacttaattagttatgtgctaatggatcgctctgttttccgtgcatactattccagttcccaaccgaggtgtggctggcagtttgggttgggttggatgtgaccggcggcgcggaggaagcccgacacgtggagcttgcctaattttctctgctctttttcactttttagtttttgtggggtatattttgccgtttggatgttttgctcggagaaaggctttacgtgttggtgctggtttgggtggccggcaagtttggttttgtttttttttctttttagtgtgcacctcgacgccggtcacgagtcacgacaccgtgtgtgcggcacacgcgtcaattgcaagccgagcgtgcaagcttggatcgattttacagtcagatccacgtcatgtgccacgtacgcccgcaactatccatcatcactgcccgcgagaagcaatcaacaatgatatcctgacccttttgtaacataaacagaggtagaggcctactctatttgggctcgttgtgttgcttatgctaatacttatctgtacttttttttaagtaataatagtagtagtagaagtaaaatttgtatatacatgtctttaacgattaaaaataaatacggtaaaataatatacaataaaaaaactctaaaattgatattaacgtataaacataagcctaaacgaaatggtagcattggatttgctcgtgtgtgtatatgacattaagtatagaaaggagcaggggcaagacatctattgattattctaaggttgtgttcgcgggagaaggttgagtcattagcacataattaattaagtattaactaaaaacttgaaaatacatcaatatatttttaaaggagttttttatatattttttaaaagatgcaccttttaacaattcatgaaacgtgcgtacggaacacgagagagtaaacgtgcgtacgaaaaaggagagagtaagagttggaaaattagagaaaagaacacaccctaatttgtgtcaacaatagtagtcttagatcaaattgttttcagctacttcatcaaattaaattattacagtgaattatttgctccacatctctttagaaaatatattttctaaaaaaaattgttctacttagattacttagtaccacatatttttaagctattttctatgtttatttttagaaatatttaattcaactcgacaattcgatagataatttgttttaattggatgataccagtgtggtttctttgggcataagcctttggctataactaaatggctagaggcctaaatccgacatatcatcattttcatcatcatcata

SEQ ID NO: 3997 - DNA, 1501 bp, Oryza sativa
caacatctatatttttctttaacataggaggtccatcaaagtacccagttagtatagaagattgctaaattgatagatatacacacagatagatagatagatagatagatagatattccctccattttatattataaattgttttgacttttttctagtcaaacttcttttaagtttccccgcaaaaagaaaaaacgctttaagtttgatcaagtttatagaaaaaaatatagtaatattttcaacacaaaataaacatattatcaaaatatattcaataaaactaatttggtattttagatgttactattttttttataaatttagtcaaacttaaacaatattgactaaaaaatcaaaacgacttatatgtaaagagtatatattatctttattagcaccacgacatgcctctcatgatatagaggatatatagaaaaagaaaaaaaaacaacctgtcttctctcaatggagataaccatggtgcgaaaaaaacaagactcaatagtcttgtcgaactaataatcctttgtatttgtatatgggcctagtcaatctgaattaattcatactagtagaaaactctttctatgctgttccgtctgtctcgtgccttccgaagagttttctatgccgtctttatgtcagacgatgatgagttgataacgtgaaagcctctaaacaaaagcccttaattacgcgtgcagctgactgatgtcacaacaatccgagaattattctcaaacctacttcctccctttgaacacggtacagcgaatactcttcttcgaaatgtctcaaatttgtctccttttctaaccaaaccagcatataaaagataaaactacaaaataatcacacgggatttatcgttaacaagtagccatcacgagggataatcctcccagcttgtggctaagaaaaaacacccgaccaaccagtttaatttagttcagaattctgaccgaattttgacgagaccacggccggacacgcacgtgcacatggaattcacgaggattagatcgaatttacatctttccggcgtgggagtggatgtgcggcaaagcgagaaaccgtcaaattgaaatgaccaaagcggtcacgtctcgaattctaaacgaaattcaaccgagtttattctcgtttttgacgcatgtgttgcttgccctcggcatcttggcggctctgtcagagattgaattcggcagttcgttggatattttggtcagcttttgacattttcaggtgctgctccctctatatattcagatagaactcgctgcagggatatgcttagttattggcttattgcagaaaggagcaaaaactagggagtgggagaaagaaagggttttggattctgtctgaattcagagattgatcgagatgaacacttttacacttttcagggatgaggtgcagaaagcttcagagaaggtatatatatgcagtaattatttcattgattcagagatgattttttctatgcttcagagct

SEQ ID NO: 3998 - DNA, 1501 bp, Oryza sativa
gtcaagtcaatccttcgccggtaagtattcgaacgtggcctcccgccactcaaatagatcttgcccgccctctctcagcctctgccacctttgcctcatccaaatctcgagctcctccatggcgatgacggtgcccgagctcatccgctcctcctagccctataaataggaccccaatcccttccttgtccatcatcgatcatcaacaaccatagccccacaaccccgaagctctgcttcaccaatccatctcatcaaccaccctcgcctgtcggtcgaacaccttgtgcgcgatcgactccacccctctccatccatcttccgccctaaataacccttagaacacctatattctaccatgttctagcgtattaggccctaaccgaagctctgcgtcgagttttacctcgccgcaccaagccaagcaccgccgcccctgcgctactctgttcttctccgccgcgaagtttttccggccgcaatccgtcgtttcaatcgatctcggtgagttcttccgtttcaaccatctacatactacctagagtccatttttgcaatcggtttgcactatcttgccaccctctgagctgccgacgtgagcacggccgccgcctatggaggcgctagtcggcaactatgctccgcgccttgccaaaggttggcaagctgccggaatccctctagacacctcgtagatgctctagaacccctcccctagccatgtctaactctcatcactctggtcgccatcacagcctaaccgtgccaccgccgctctagccgctaggccgtccacacaccaaattagttccatcgccgccgctcgccgtcgccggagatccctagctccctcccctcctcggccgcaaccactttctccctctagtgccgccgcaatcctaaaccctagcgccgccggcccgatttggggaacggccggaggtagaagaagaaaagagagagagagactgacaggtgggacccacatagtgccatttcacatttatttgattttcaaactttagaagaccatatcttttaaaatatagatccaatttcattaaaacttggaccaatattcttctaaaatcatcctctatctactagacccctttttgctatttttacattttattttatttactctatttttcttatttttggattttatttaaactcctttttgaatttgaattttatatgtctaaccctaggtcttgaggattcctctgacactctagataatatcaatcaatctcaggacatcgagcaaggcaagttaccatatacatgttgatcatttcagcctatattttacaaattatttatttatagccttctattcaatattctattttctatgcataaattaatcatagaaacccagataatttagtattgcttattttgtttacaatctggttaaaataccctatacttagattgggacaatacgtaagatttggatgatttccgggtggctagtattgtctcaatcgat

SEQ ID NO: 3999 - DNA, 1501 bp, Oryza sativa
tcaccaaaacctgcacattaattggagaggaatagaacattattggagtactgatccattctcattatcgccatggtttcataaaccaaattatgataattcgaactgataatccaatgatcaattatcattgttgtcaaatctctaaatatatggacaattgaatgcaacagtagatataatatatgccgttagatcatggataagtatcagtaaaagaatggagaatggtccaagattgttcaagaaacttccatgagttaattgagcaatagtcaatgtcctaccacttttgcatcttatccctaacaattcttatacacgttggttgagtctaaacttagtacaagaagatatacaacataatagatctctattttaacttggcatataaaagtttatgatccaacacatcttccaaatttagatacgctaccttttgatttatctaaaattgtattggactacgcataaaattactttaaaaaaatttcgtaaactctaattcaaatggttaatataattcttttattttaagtgctagacgcatcttctaacttcaggttttaacatataaatgaaaccatattaggcggctcatgattagctttatctttaagctacattgcctttacatgggtggatgagaggtaaccaaatatagttgagagacgactctaatcgcctccaagtcaccagtttattctgctggggtgataggctgtaatatagaacaatacacctccacgctagtcaccaatttattccgctggggtgatatgctgtaatgtagcacagtatgcctccacatcactgcacatgctaaactggtcgaaaggccaacccaacattaccctaaatttatggcattatgcaatatatatatatatatatatatatatatatatatatatatatatatatatgctaaattgttaatattgcacttgccattaattccgtattgcattcgccattccttatcactataaattaacattacaaaatttataagtagtacaacatcttttaatttgggatagtacaacttattttaataaatgattttaatgttgatttcgtcatatcctaattcttacttttaattggatgatcaaaataaacttatatgagggccaacaaaatatatgagggccatgcaatggtgagtatgatgataatgtagcaacgatgatgattaagaggtgtgcatgattagtgatgtacgagttctcaaaaacaattatgagtgtgcatgtcttccatgcatgcatgtaataaaaaaacaaaatgttcatgttcttaaacctattgctaattttattccaccattgacttttaaattttcattaaccataattctaaatttagattgctaattgttatcataaattttagcaaacttattatcaagtacaacacataaatacattttaaaaagtataccttaggaaaatctttcttggacttcatcgagaattagacggttgggaagaaacca

SEQ ID NO: 4000 - DNA, 1501 bp, Oryza sativa
aggaagcccaggaaaagtctactttatctaccctcgctacagtaccttcttcctcctccagccgagccgtacagagccgagccgtgtgcgtgcgccgccgcttccttcgcaaaatccgtcgcatcctgtgctccgtttccaaaattggttgcaaaaacggattcccctcgatctcctctaccttatccctaagaaacccctttgaatatcgttgtatatcgcgtgaattcgacgcggtttcgagctccgtttttccggcgaactcggataaaccctcgtttttctctcgccaaatcccgttgtttttgatccaatctcttcgcacgaatcctataaatagcagcccctcgacctcctcttccgtttccccctctttcccgaattttttccctaaccctagccgcctccccgcgagctccctctctctccacctccggtcgcctctccagccgtcgtgcgccgtcgccccgcccgtcgccggtcagccccgtcacctccctcggcttcgcaagggtgagagctaccccggccacccgttcctttgcgccaaacccccgctggaagtggtcgtcaccgtgaagccgatctaatctatctccggccgcgctgttcgtcgtcgtctatcgtcgccttcggtcgccgttgcttccattggattcgtagctgtgaggagaagctcgtccacccctccgttgccgccgcccatcgccggaaagccgtcgccattgtcaacccaaggttgccgccctttggagctcgtcgccggccatctccctcgccgtttgtcgttgcgtaagtggtggtaagggttgccttgatctcctctcttccggtgccctccgtttgcgtcattgtaccgtggttcgctggtaaccgccgttcccgggctcgccagtgtcgatcctgcgtggcagccatgtcatcgctgacaaccgcgccatcttggccatccaaaattaatataaatttgtcatctcttttcaatgacatattattcctttttaataaatgtcatctaccaaatatgatctaatcttttccggaggatgttttaatcttttgtctcagctataaatcatttgtaaattgtttaatcaatttggaatagtcttttctttaataggtttaattggaattaaatcttgtaaaattcatatctaattcatacgaactcggaaggaggtcgttcaagtctcataattcatctaaattcaagctctatctatttatgaactttaattgtactatttatttggtttttattagtgtttttctcgttttgcattctaggtttagttttccgttgtttcggaggatcattcgttcgttggagaagttcctgaagatgaattgaagacgcttgtttgcaaggcaagtcacacaaatcccaaacaacactttgagcatgttgaacccgtttaaagttaatgttttatttcaacttatgaattattttcgaatgccatcgggtggtgagtctttcccaattaattaacggctg

SEQ ID NO: 4001 - DNA, 1501 bp, Oryza sativa
aaaaaattatgtatatcgttgctcagaaatccatgcacatgttatcgcatgggtcatttggggatgactagggatcggtcgcccgatccaaatctttaaaaatcggcatgacgtcaacgccgatttacgtgtaaaacaaattcaaactgatttttctcttaaattatttatccaaatcatgatccgattgcaccattaaattcgttgcaattaaatcttctaaataagaccacacatggatatattctgatgaaatattttttagcttattattgattttttttaatgttgcacgatgttccaccaggtatatcggaattgtttcaataagtagatcgaaaatgtttcactcgtttaaatcgggtgttgtttcaccttatataaaaacaatgtttcagcaaatagcgaaagaatgttttagttcactgcaacatttgatccatacatagtgaaacattgtgagtatactaaacgaaacattttttaatggaacaaaaaaataaaacgaattcccttaataaagggtttccaaaatatgtgggttttttgttgcaatagagtatctcagatcactgtaactttagatctataaatagtgaaacatcatgagtacactaggtgaaacatttttggttgaacaaaaaataaaacgaattcccttaatagcgggtttccaaaatacgtgggtttttatgttgtaacagcgcgttccataatatcaaaatccaatgcaacatttgatccgtacatagtaaaacattatgagtagactagctgaaacattgtaaaactactggttgaaacatcaaaagagaccatatgcaacattaaaaaaaatcaataaaaaactaaaatattttttttatcaaaatataatcatgtgtggtcttgttgtaaagatttaattgtaacgaatttagtgatgcaatcagatcgtacattagctaaatagtttatgagaaaaaatcttttgaagaaatgagagatgaaagcacgtagggaaagattctttgcatgcaaatggcagaccatgcagcgtctgatttttcttccctcccatcggacgcccgacaactagcattctccgggtcattaccgcagaaagattgagaaattaacccaatcctaccctattgtactattgtactgcttccttgccagcttgaactgaatcgaaactataattccacgagcgtaatttctactccctccgtcccaaaaagactcaattcctaagtttccgtatccaacgtttaattatccgttttatatgaaatttttttataattagtatttttatcgttgttaaatgataaaacatgaataatactttatacgtgatttatctttttaattttttttataatttttttaaataagatgaacggttaaaggtcgtaactatcgatctgagacacgtccccatgatcgtccatccgtgcgctcgtgcgtacgagattggaagtgcttttgtttttttattatctatacctttttttta

SEQ ID NO: 4002 - DNA, 1501 bp, Oryza sativa
  unsure (1)..(1501): unsure at all n locations
gcattttttggggggggtacttctggcataattgataataagtggtggaggtttgtgaagataagagttggaaacacagatggaaagagaagagttgtgttttatatatatatatatatatatatatatatatatatatatatatatatatatataggacgactcttctgtacacccaagtgtatatactcccctttgttaatggatgatccaatagcatctaatagggccatggtgaatctgatctgttttaaaacaatgcattttcttttctttagttttaatgcacaactaactgatcgagtgcatgcattacaaattttaaatgcacagaactgatccaaacacgtggattagtactagtgtatacgtactaattttttaatagcagtagcattgtatactacgtactccagtagttgtgtttacatagtagtagtacgtataaatactgctttgtaaccactatatgtataatatctttagctagggaatgatatactttttcttgtagaagtttatactacttttattatttttctttttttagaagtatatactttcttgtagaagtatgtactactttttcttaagaatggtatatatactggtataaggagtatgcatgtactgattgtttttccagtatatactgattttttaatccagtatatactaaaattttcaagtatccaatattatattaaatcaattagttaaggattatgtactgttttttcaagtatctaatatataatatattgataggttaggaagtatgtaccgttttttatttagtcagtaggtatatactgtttagtatagtaacagtagtatataggagtcactaatacagatccttccatctgtgacggcccataacaagactggaatttgcgggccgtcacaaggaagtaatctcaatcgggccaaagtttcgcccgattgagatatggtcgcacagccatggtatatcggcacaaaactaaagcccgtcacggatgacacttatctgtgacgggctatagttgaggcccgattgagatgagggttccatatctcaatcgggccctaaaagaagcccgtccagatgagggtcatctgtgacgggctccaactagaggcccgattgagataagtttattgcccgtcacagatgacactcttttttgacggtcttttattacggcccgatagagataacttgtatgcccgtcacggttgattgtnttagggccgttacagatatttgttgcacagtataaataccccccaccacctagtgtaactgtatcccactgttcactattttggtgggaggctgtagggggcgattttttgtcctttttccaaggaaaacagaaattaaattcccaaaagtgatcaaaatggatcaatcaagtgagtaatataaatcattaattgagcaatttcatcacgtcttacttttgcaatactgatcttataatatgtgcctctaatttgtttttttttgtagcaa

SEQ ID NO: 4003 - DNA, 1501 bp, Oryza sativa
  unsure (1)..(1501): unsure at all n locations
ttacactaggtggtggggggtatttatactgtgcaacaaatatctgtaacggccctaanacaatcaaccgtgacgggcatacaagttatctctatcgggccgtaataaaagaccgtcaaaaaagagtgtcatctgtgacgggcaataaacttatctcaatcgggcctctagttggagcccgtcacagatgaccctcatctggacgggcttcttttagggcccgattgagatatggaaccctcatctcaatcgggcctcaactatagcccgtcacagataagtgtcatccgtgacgggctttagttttgtgccgatataccatggctgtgcgaccatatctcaatcgggcgaaactttggcccgattgagattacttccttgtgacggcccgcaaattccagtcttgttatgggccgtcacagatggaaggatctgtattagtgactcctatatactactgttactatactaaacagtatatacctactgactaaataaaaaacggtacatacttcctaacctatcaatatattatatattagatacttgaaaaaacagtacataatccttaactaattgatttaatataatattggatacttgaaaattttagtatatactggattaaaaaatcagtatatactggaaaaacaatcagtacatgcatactccttataccagtatatataccattcttaagaaaaagtagtacatacttctacaagaaagtatatacttctaaaaaaagaaaaataataaaagtagtataaacttctacaagaaaaagtatatcattccctagctaaagatattatacatatagtggttacaaagcagtatttatacgtactactactatgtaaacacaactactggagtacgtagtatacaatgctactgctattaaaaaattagtacgtatacactagtactaatccacgtgtttggatcagttctgtgcatttaaaatttgtaatgcatgcactcgatcagttagttgtgcattaaaactaaagaaaagaaaatgcattgttttaaaacagatcagattcaccatggccctattagatgctattggatcatccattaacaaaggggagtatatacacttgggtgtacagaagagtcgtcctatatatatatatatatatatatatatatatatatatatatatatatatatataaaacacaactcttctctttccatctgtgtttccaactcttatcttcacaaacctccaccacttattatcaattatgccagaagtaccccccccaaaaaatgccagaagtacactattaccacttatcacccatacgttttgaaacaaccacaacgttaatcaaatagggatatgttaatgagacatctctgggggaacagggaatttaagatcaacatgggagcgtggagtaggttgggtccaaaagggggaactccaacatattcagcatggctttcaagggggacatgattagaaatccaaatacccaatagt

SEQ ID NO: 4004 - DNA, 1501 bp, Oryza sativa
cgcgaacgcggcggcgtcgtcgaggccggagccgaggcgggcggactcgaggtggaggtgcttcgcgccggcgaacaggcggaggaacgcgctgagcttggcgagctccgacgacgacgtgacctcctcgccgcagatgtctatcttgcagtaggcgacggtcgtcagcgaagcgccgccgtggatggtgaggaaggtgtcgtccggcacggagcccctgtactcgaacgcttggaggcgcggcggccccggcgaggcgtcgacggcgacggtgcgcagggcgtggcagcagcggagggccagcctgcggaggccggcgacggtggtgagcgcggtcaccgtggcgcaggcctcgagcgtcaggtcggcgaggcgcgggcagccggagatgaggcgctgcacgtcgctcccggcgtcggagacgcgggcgaggagcagcgtctcgagggacggcagggcgatggccgccggcggcgcgagcaggcagtggccgagcgacagcgagcgcagcgccgcgcaggagaagagcccgctcgggacggcgtgcaccgccggggtgtagtcgtatcccctcgtggacttctcgtcggaggagatgacgtcttcgtcgtcgtcgtcgtcgtcatcctcatcacagccctgcggactacagctccgacgcggcggcggcggcgacagcaacggcgagcgcgggatatacatatacggtggactcagacccagattggcatcttcgatggacgcatatcgcacgggggacctcgacctcgaccgccaccgccgccgccgtttgcggctcgcatcttcgtcgtcgtcgtcatcgtcggtgtcctggtctgcgtgatccgcgctcgcgccgcggcggcggcggagagagtaggccttgtcgcagagcggctcgcggtggaggcggaggtcgaggtcgaggccaacggcggggtcggcctggttgacggcgtacgcgatccactgatccaccagggaggcgtcacttctgcagtacccgacggtggagacgtggagggcgcgcaggggcgggacggcggcgcggcggtggcgggcgaggagggcggcgctgacgacgttggtgaagggcggcggctggttggggtcgggcggcgggccccacccggggctgtacctggcgagctcgtagtggtcgacgacgggggggtcgggctccacgagggagacggtgtggacggcggcgaacgtgtggcgccaccgcgacgagagcaccgccgcgcgcgccgcctccttcgccgggaggaacgacaggatgtggccgatcacgccgtcgctcagcgcgctcagccggtcgccgccgccgccggaggtgggcatcgtctggggttggtccagatccatcttgacgcggacggtttcgtttgatggcgagatatttcaggatttttcgggggatgaaccgagacggtttgttgttaggtcaaagaaaaaaaagaaaaagagggacatatactcggattcggagtgtgctcca

SEQ ID NO: 4005 - DNA, 1501 bp, Oryza sativa
actgacctactgtacaccactacagcgtgtggttgtagctagctagctagctccattcatcgccgatatactaccagacaggaacattttggccagcgactgaccaaaaaagttttgcaacttaattaagctgccaccaatatatatactagtactccccgcgagcaaatcacttttcaattactgaaagattaaccaaccaaacaaacacactcatgcagtaatatatactactgcgctaatcacttgtaccacaaatttcatggagcattgatgctgatgcgttcgtgcgtgcttagaagcttcttgtgagttgtgacagcgcacacaacacgtacactacggtgtagttagtagtagtagtatatatatacacacactatcaagaaacatatatataagcactttttgttaataacttcatgttcgagacgcctacataaacatcctctgcaagaatgcccccaacttgtgtgctgatatatctaatataaaagtatgcaatgcatgattcagattaaattcaatataatcccatggcgtcagcttgatactgctcccatgcatcatgcatctcaccactaggccaacctgacacgacgcacaagacaaaaccttcgcctcacaggctcgtcagtgcacccatgtggtggtctggccgcagctggcgcagcagctgctatgaacttgctcgatcactctgtcactcactcactcacccgttattacatggttacaacttggtcatcagctagctaatcacgagtacttaattaacaacttttatttaacggatgtttcaccatggtctttactgtagtagttactaatctatgtatattaccagcaactattaatatgagaaaaaagctctcttatgtagtaactataaatcaatggttaagatttctttcagtcctcaagtgtccgttggaggatatttttcaaactgaaaacattgatttatttgaatttctaaacaacttctatttatatacttttttaaaacacaccgaaaaacgtgttgatgagaaataagaaagttaaaagaaattttatcccaaatcacacactcttcgtctaagagcatgtacaatagtagactataagctgactataaacatattttaagcatataaaagaaaagagataagagcagcgggctatagatttatagccagctacagcacggaccacaagatgcatgtgtgtatcatacgtgggaacagacattaattatgcataacatgtttattgataactattatataaattaactattaaattgactatagttgatttgtagcctacaattggcagtactattaaacttgctctagttagcttcacagttcactgtagcgtctagaagaggaacaggtggattattaattagcaaaagataatcagaaaacggaagccgagaagagcagagcccctataaatactcgcgagctcctctgctcggagcacacacaaccaccactcaccaccaacatgg

SEQ ID NO: 4006 - DNA, 1501 bp, Oryza sativa
tctccaatttcaatcaaattttaaactttgggccaatctaaacacagcataattctacaactctatttgtcttaaaatatactgtctgtattttaatatataatacattttttataacgtttgactattcattttattcaaattttttatgcaaatatgaaaatatttatgtcatacttaaaatcacaataaaataaatgataattacataatttttttataagacgaatgatcaaacgttagataaaaaattaacgacattataaagatattataaaatattttaatactacgaatctcaaagtttaccagagttgatagttgtagattgtgcttccttatttttattttcttcggaaaatgagggagtacaatgcaagtaaataagtgggggtgttaatgaggggtaattagcgtacgcgatcatgtagaggttccagaggacggagtaggagtggtagtccttggtggggtcgaaccagaggtagatcctctgctcccggtcccccttcccgccggagaagacgttcgtctgcaggatgtacggctcccccgtcctgttccccaggaactcgaagtcgatctcgtcgtgctccgagttctgcgacgacagctgcaaattccccaatgcaaaaaaaccacacatcatcgatctccgatcaagaagcagaaggggaagaggatcagggagcaatggcggcggcgtacgtagaaggcggtgacggtgccggcggagtcgccggcgacgagcttgatgtgcatgctgaagtggccgaagaggtaggagccccgggtctggaagccggtgccggtggacttgtcgaggtagagctgcacctcgcgcccgccgtccacgtagtggatgtggtcctccgcccacgtcggcacgtagttcttctcgaacgccacgtccaccggcttccgcggcgccgccgcctcgccgccacccagcagcagcaccgacattgccaccaccatcgccgccgccgtcgtcgtcgccatgttggtggtgagtggtggttgtgtgtgctccgagcagaggagctcgcgagtatttataggggctctgctcttctcggcttccgttttctgattatcttttgctaattaataatccacctgttcctcttctagacgctacagtgaactgtgaagctaactagagcaagtttaatagtactgccaattgtaggctacaaatcaactatagtcaatttaatagttaatttatataatagttatcaataaacatgttatgcataattaatgtctgttcccacgtatgatacacacatgcatcttgtggtccgtgctgtagctggctataaatctatagcccgctgctcttatctcttttcttttatatgcttaaaatatgtttatagtcagcttatagtctactattgtacatgctcttagacgaagagtgtgtgatttgggataaaatttcttttaactttcttatttctcatcaacacgtttttcggtgtgttttaaaaaa

SEQ ID NO: 4007 - DNA, 1495 bp, Oryza sativa
aatattagttttgaagatcatttcaagtttgaccatatcttatattatgtttcaattttaatttttaaaatatttatcattattattttattatattgggattagatgttacgtgactgaatcttatcttatatagtgaaagcagcaagccttcttatacgaggatgtgctatatcatcaaaaatatgttagccgtctgataaagagcttggataaataatggtctttggatcgaagagagcatgtattaaaaaaaatcataaatgggctaaatatatggaattttttttggaggtttctggcatctcctactaaacatatgatacatacaaaaagaaaggaaataaagagaagaaagatgatgcttctagtgattcctcttataaacatatactccatcagttttacaatgtaagactttctagcattgctcacatttatttagatgttaatgaatctaaacatatatatgtgcctagattcattaacctctatatgaatgtgggcaatgctagaaagtcttataacctgaaacggaggtattagtagctatatttatagttggctagaacaatagatacttcataaacaaattaactttttatcaaaaccttattaagagctaaggtaaactaatagaccatatacaataaacaggatcaaaagtcgcgcaaaacgcgattatgtggttagtttttagtgaattttgtcaccccttgagtgggaattcaatggttctctttactccttcctattgattattaataaaagagtaaattttagataaccccaaatatacaaaactaatgggttttggcacgtgatacataacccctagctattataactataaagtttcacaaaccacattattaattattttatctaatttataagttatttattcatcatataaatattatatctaatcgtgtatataaagctttttaaaatttcaaaacaagagtatatcaatttagttaacggtgtgaattagtaaaacttcaaccacaatggttgtgattatgtttctcgtgccaaatctgttcgctcatatcataatagatatgaaatttactcattttattataaggttttcgtggttttgaactcctgatgtactaatgggttccaccgtatataagatccaatggcgttgatattcgtgatcaagatctgacggtgatggatgcattgtaagtttgtaactacacaaaatttatttccaggtggcgtctcctcattggccagcttatggcgcgcaacggggaagaaaccgacttcctttcccgcgcttttagccgttgccccccaatcccaccgctactttaacggagggggaattaatcaatagcgctcaaatttacatctcaccccctaaaaaaacatataataacaccgaaagcatcaaacgatctgcacagcgcaacggacaacggcagttttccctaaaaccccctccagacaaataaattcgcactcctgcccttcttcc

SEQ ID NO: 4008 - DNA, 1501 bp, Oryza sativa
atgtaacacaggggagtgcagaaatcctgttattttcactcaatctggtaatctgctctaattcttttgctattctttgccttggccatgtactggattgaaattgaagatatttatttgagcatatatattatttttgttcagggttacaggattgaaattcaagtatacaagattgcatataactgaaggattggagtggtcaatgtctagcattcaagcgtgcaagacctactgagctgtgtcaccattgcattgcatctgatctaagttggcgctcttggtttaaattgttgagtggtgtcaatgctaaacttttatgccgaataagagttaagaatcttttaccaactttttacgctggggcacttcttggatgccctaatcttatattcgtttagtgccttgaatgaaaactagagcaatgctaggcttagtttgttgcgtgatgtagtagatggagatgtgtttatagcacggaaataataaaatcattttccatatgttctctattaaggaaatattaattctactatttatatattttgcctatatttatattcctgaatatataatttataatttaagggcaatggtaagttatatatgatatatgtatctctataccacccatcagtcatcatgtatacttagatacacatatttgatccgcattactaaccattaccgtagcgttagcacgggcaaattacttgttaaataagacaagtctatgttgatccaactagtggaaatcaaacatgcaaacctttgcactcctctcatcctggaacactaaccgtacttattttcctgatgcaactaattgcaattataagttatatataacccacgaattacattgctaccggcacgatggctgaatattgttgcaagtttgcaaccacagagcaaagatccccaagcaaacaaatccaaatccgacgaactactcgagcacgatatgaaagccttttggctgtccaagcggggttacggaggacggcgagcggcgctgggcggaggaaaagggagagagatagttgcagtggcgtcgccggcggtgggtcgggaggaagagaaaggcgaggccggtgttgggggggcgggggggggtgacgaaacgggtttggcaccggcactgtgcgggttgattttgttttgaatattaatgactttaggatccatacttattataaattatctagttctaaaataaatgtttgaaattcatttttaatagttaatttatagttaattcattcgtttgcatcttcgaatagttttttcgcgaacgcatcttccaatagttattacaaattcacttagcaaataaataaataaataaataaacagactacacagatgaataatataagtagttagcagacgatatatgcccttccctctacttctctcttccacattgaatcttacatggtgttcacaagaggtcagtacagttcgcaattttaccatgcaaatttgtacagtttaacaa

SEQ ID NO: 4009 - DNA, 1501 bp, Oryza sativa
gcttagggcatccacaatgtgagccactcctagagtgtcctcactaactgaggacactcgtagggggaacttgtctcgcaatggagggtatccctggatgggcttctcaaaatctgaaacaacccgataagggtactacatctcacaatgggtgtcctggctcaaggtagcccagtacaaaaattccacccatacccctcatcagaccactagcccagcaacctcttccttttctctttctcgcattttctcttctcctccgcccactgtctccttctcttccgatctctccccctctctctcagtcgaatgaggcgcggtggcgaacggcaagcgccgcgtgaggtggacgatggcgacgggcgcgcggcgtggccgacggcgacgacgtgcgcggtggccgacgacgacgagcgcgcgggctggccgatgacatcaattgccagatccccttccctccgccgcggggtcgtcgccgtcgccgtcgagggtcgtcgccgtcggagtggcggcggagtggggcttgccggatctggcctcgagcagcgacggcggcggcttgccggcgaggtcagcgcccggtcgccctcctcccgctcccctctctccctccagccgtcgccgtcgccgtcgccgaccccggactccgccaccccgtgctgcctcacgggtcgcctcgctgacaactccaccctcaactccgacacccccggcacccccgcccagcgccgcctcacgggtcgcctcgccgacaactggctcgccctcctcttcaaggctgccgagcttctcctcgccgtcgcgatggcgtctggtggagcggatcgacgagcaggcggcgctgtgggagagaggcgagggtaggagggggatttggggggagcggcgaggagacgggagcctgcagtgggtctcctcccaggggcgagggtcgtgtctctgcgaaaagcagttgctccttgcaaagagccgtgtccccctgcttggcgccgcgttcctagctggggagacgactcacgctgaaaaggggacgggagggaaacggccgtttgcgagggcacgagtcgacggcacccattgtggatggccttattagtagtagtgtcggtcctatcattgtgtagcagtaactctttggccactgtaacaggtgtaaggctgtatttttttttggaggggttggaaagcccctccccttcgcatacaaaatgggacaatagattaacgtatggttaattaagtattagtttaaaaaacttaataagattaatatgatttttacagcaacttttttatagaattttttttataaaaatataccgtttagtagtttgggaagcgtccgcgtgataaacaacagagtgaggttaagaagcaaacatgacctaagtgtgccctatttttacaatggattggaaaaggagaatctggttccctacgttatccatatctttttatattatttttcgtccttttaatccgtcaagtctatagatggcca

SEQ ID NO: 4010 - DNA, 1501 bp, Oryza sativa
cattttcttttctttagttttaatgcacaactaactgatcgagtgcatgcattacaaattttaaatgcacagaactgatccaaacacgtggattagtactagtgtatacgtactaattttttaatagcagtagcattgtatactacgtactccagtagttgtgtttacatagtagtagtacgtataaatactgctttgtaaccactatatgtataatatctttagctagggaatgatatactttttcttgtagaagtttatactacttttattatttttctttttttagaagtatatactttcttgtagaagtatgtactactttttcttaagaatggtatatatactggtataaggagtatgcatgtactgattgtttttccagtatatactgattttttaatccagtatatactaaaattttcaagtatccaatattatattaaatcaattagttaaggattatgtactgttttttcaagtatctaatatataatatattgataggttaggaagtatgtaccgttttttatttagtcagtaggtatatactgtttagtatagtaacagtagtatatacctctttttatttactaggtatgaactgttttttaatttactagcagtatgtactgtttttatctgtatatactgatttttttatccagtatatactatatttttcaagtatctattattgtattaaatcgatcggttaaggattatgaactgtttttccaagtatccaatatataataaattgatcggctagggagtatataccgttttttatttagtcaataggtatatactgtttagtatagtagcagtagtatataggagtcactaatacagatccttccatctgtgacggcccataacaagactggaatttgcgggccgtcacaaggaagtaatctcaatcgggccaaagtttcgcccgattgagatatggtcgcacagccatggtatatcggcacaaaactaaagcccgtcacggatgacacttatctgtgacgggctatagttgaggcccgattgagatgagggttccatatctcaatcgggccctaaaagaagcccgtcacagatgagggtcatctgtgacgggctccaactagaggcccgattgagataagtttattgcccgtcacagatgacactcttttttgacggtcttttattaaggcccgatagagataacttgtatgcccgtcacggttgattgttttagggccgttacagatatttgttgcacagtataaataccccccaccacctagtgtaactgtatcccactgttcactattttggtgggaggctgtagggggcgattttttgtcctttttccaaggaaaacagaaattaaattcccaaaagtgatcaaaatggatcaatcaagtgagtaatataaatcattaattgagcaatttcatcacgtcttacttttgcaatactgatcttataatatgtgcctctaatttgtttttttttgtagcaa

SEQ ID NO: 4011 - DNA, 1006 bp, Oryza sativa
tgtataataatttattttattagtcataacacattttcagatagtaaatgatttcaaatcgaaatatggtcaacaacaaaattgatcctctcatcaagatctacaacttttattttagtcatttatctatataactttgtttccaacagcttgaaattgattttgacaatatgacaaatataagcatcatttgtaaatactaaatgatttcaaatggaaatatggtcaacaacaaagttgatcctctcatcaagatctacaacttttattttggttacttcttcatctgacaaagtgatagttatattattcacaaaaatcatatttctctcatctggtttataaatatcaacacagatatgtcaattttgtaaacattggtactatcactttgtcggatgaagaagtgaccaaaataaatgttgtagatcttgattagctgtacaagttagctgtctatggctttcccatttaaagtcatgtaatatttacaaatgctgtttatatttgtcatattgtcaaaaccaattttaagctgttagaaacaaagttatatagataaatgaccaaaataaaagttgtagatcttgatgagaggatcaattttgttgttgaccatatttcgatttgaaatcatttactatccgaaaatgtgttatgactaataaaatgaattattatacagcagctatatattttgtactcacaaatataaagacttatctgggaaatggaaaaatagtcatcggtgacgggccttagttcaagcccgatagagattaatctatctctatcgggcattatcttagggcctgtcacagatgagtcatccgtgacgggcctgaatgtcatctcaatcgggcattagtatggagcctgtcaccgatgagtcatctgtgacgggctctacggcaaagcccgattgagatgactcatcactctaatataactagggtttctcagatcggatcgaaaatttttctaagtcccgctacagtttcccgcc

SEQ ID NO: 4012 - DNA, 1501 bp, Oryza sativa
tagattctctcctctaccttcctacataattaactatgctctatctgccaccgacgttggatttttcaaagattttctacttcccacagttgttggctgcttaccgatgatcctacagaatgtttctattgttagccttgctggtgctgcagttgcctcaaccacaggatctgagaagtctcggatatactcctacttgtttccagtacttggtatcatgtctagcattctcatttcgtggaggattaagcaatattcttctgcccttgttattcctgaagagcttaaaaattcatctactaatggaaaggctaatgtggatgacaaggcagtgtctgaaaataccaactctggggaaactaggaaaaggaggtgaccatcacaatttcttgcatattactgtgaggagctactacgaattatcaaacatttagagtagatgcagatcaagattattccacattggtcaatgactatagtaaactatgttgtctgtttcatgccattgttttgggggcatttagcagatgcgcagtcagctactgtcttgtttctgccatcaagcttttctttttctgacacatgcagatgtttcaccttgcaaacatggtagaagttcatatgctgtacatctaagttgggtagttacggtggtctaggattttcttgttaaattatatctaaggaaaccggttttgatttccttccctacttgtactgaacccatatatgacttggtagaattcagtgttctaatggaccagaattcagaactgtttctgctgttgcaatgtagaacagctgtatcacacctttttatatatatatactcttctttagccacaatccaaagcaaattatgcagtgaactccaagaatgttgcacaggatactcagtcttctgactttggttgcactcctgtctcaacacagtatttaacccatgttctgcttcactgtatttttgtccaacaattccatgacatgaagctctccactgtcctgtgttgttaccttcttctccttggtctctttgctccagaaatcatatcagatagccctcctcttcaggatgtatgccctatggcaccccagggtgagaggaaactcttcatgaatggtttcttctgcaagagcccaagcaccataatggcctctgatttcaagacattgctgctcaaccatgccggggacctggacaacatggtccggtcatcggcgaacatcatcaccgccaccgagttccctggcctgaacacccttggcatttcaatggcgcggaccgacatcgcggtcagcggggcggtgcttccccattcccacccaagagcttcagagatgatgtttgttcacagtggaagtgtggtggcaggcttctttgacaccaaggggaagctgtttcagaagacccttgctgagggggatgtcttcatcttccccagaggtctggtccatttcatcatgaactatggttttggccttgcgacaactttttcggtac

SEQ ID NO: 4013 - DNA, 1501 bp, Oryza sativa
agttgcctcaaccacaggatctgagaagtctcggatatactcctacttgtttccagtacttggtatcatgtctagcattctcatttcgtggaggattaagcaatattcttctgcccttgttattcctgaagagcttaaaaattcatctactaatggaaaggctaatgtggatgacaaggcagtgtctgaaaataccaactctggggaaactaggaaaaggaggtgaccatcacaatttcttgcatattactgtgaggagctactacgaattatcaaacatttagagtagatgcagatcaagattattccacattggtcaatgactatagtaaactatgttgtctgtttcatgccattgttttgggggcatttagcagatgcgcagtcagctactgtcttgtttctgccatcaagcttttctttttctgacacatgcagatgtttcaccttgcaaacatggtagaagttcatatgctgtacatctaagttgggtagttacggtggtctaggattttcttgttaaattatatctaaggaaaccggttttgatttccttccctacttgtactgaacccatatatgacttggtagaattcagtgttctaatggaccagaattcagaactgtttctgctgttgcaatgtagaacagctgtatcacacctttttatatatatatactcttctttagccacaatccaaagcaaattatgcagtgaactccaagaatgttgcacaggatactcagtcttctgactttggttgcactcctgtctcaacacagtatttaacccatgttctgcttcactgtatttttgtccaacaattccatgacatgaagctctccactgtcctgtgttgttaccttcttctccttggtctctttgctccagaaatcatatcagatagccctcctcttcaggatgtatgccctatggcaccccagggtgagaggaaactcttcatgaatggtttcttctgcaagagcccaagcaccataatggcctctgatttcaagacattgctgctcaaccatgccggggacctggacaacatggtccggtcatcggcgaacatcatcaccgccaccgagttccctggcctgaacacccttggcatttcaatggcgcggaccgacatcgcggtcagcggggcggtgcttccccattcccacccaagagcttcagagatgatgtttgttcacagtggaagtgtggtggcaggcttctttgacaccaaggggaagctgtttcagaagacccttgctgagggggatgtcttcatcttccccagaggtctggtccatttcatcatgaactatggttttggccttgcgacaactttttcggtactcaacagtcagaaccctggtgttgttgggatcacccatgcgatgtttgcgccagattcagaggtagctgaagggctgatggccaggatgttgagtttcagagatatgggaatggatgacagtagtagtgttgattcaccatggttttact

SEQ ID NO: 4014 - DNA, 1501 bp, Oryza sativa
agagcttaaaaattcatctactaatggaaaggctaatgtggatgacaaggcagtgtctgaaaataccaactctggggaaactaggaaaaggaggtgaccatcacaatttcttgcatattactgtgaggagctactacgaattatcaaacatttagagtagatgcagatcaagattattccacattggtcaatgactatagtaaactatgttgtctgtttcatgccattgttttgggggcatttagcagatgcgcagtcagctactgtcttgtttctgccatcaagcttttctttttctgacacatgcagatgtttcaccttgcaaacatggtagaagttcatatgctgtacatctaagttgggtagttacggtggtctaggattttcttgttaaattatatctaaggaaaccggttttgatttccttccctacttgtactgaacccatatatgacttggtagaattcagtgttctaatggaccagaattcagaactgtttctgctgttgcaatgtagaacagctgtatcacacctttttatatatatatactcttctttagccacaatccaaagcaaattatgcagtgaactccaagaatgttgcacaggatactcagtcttctgactttggttgcactcctgtctcaacacagtatttaacccatgttctgcttcactgtatttttgtccaacaattccatgacatgaagctctccactgtcctgtgttgttaccttcttctccttggtctctttgctccagaaatcatatcagatagccctcctcttcaggatgtatgccctatggcaccccagggtgagaggaaactcttcatgaatggtttcttctgcaagagcccaagcaccataatggcctctgatttcaagacattgctgctcaaccatgccggggacctggacaacatggtccggtcatcggcgaacatcatcaccgccaccgagttccctggcctgaacacccttggcatttcaatggcgcggaccgacatcgcggtcagcggggcggtgcttccccattcccacccaagagcttcagagatgatgtttgttcacagtggaagtgtggtggcaggcttctttgacaccaaggggaagctgtttcagaagacccttgctgagggggatgtcttcatcttccccagaggtctggtccatttcatcatgaactatggttttggccttgcgacaactttttcggtactcaacagtcagaaccctggtgttgttgggatcacccatgcgatgtttgcgccagattcagaggtagctgaagggctgatggccaggatgttgagtttcagagatatgggaatggatgacagtagtagtgttgattcaccatggttttactgatcatattgggttattcaatatagtagtagatacaacatggatgaaattgctagatggatgatgttttctagtttctatctgacgatttcagtcagtttggtgtataacagtgtttgtactatgtgat

SEQ ID NO: 4015 - DNA, 1501 bp, Oryza sativa
aaatcaatgtagtggtcgccttgcatctttgtgcctaatgatgggccaacgggagaaaagaaatgggccatggcttggcccaaccacgcaataagtgagcgcacgcctgggattgacggccgatggaaccatattacacggctggaattatctcttggatgatatctaacggctgcattccctcgatgacgtggcttattcctgtagctgctttatagcaataatgataggtagtgggtaccaattactccctccattccaaattgatctacatatagtttttttgaggttatttctaaatgatcttacatatttgtgttcattcattaggtctatttgttatttgtgtattggagtaaatggacattgatgcatgcatccatgcacacaagcatttataacccacatgcaatatcttgatttgctattggctaggaaatagtggggatggtgcatgtattgagtttgttgctagagtaaatatagcatgagagagttattagcttttctgggtcttgatgtacctttgaaatatgtagatcaatttggaatggagggagtatataggaagaaaatatatgattaccccataagccttgttcggtttgaaggagattaaggggaaataatttcacaccacaaaaatggtgattaactgaacatatcccaagttaatgcagtccccaaccttttcttttcctattcgaatttctcattctaggagtggtcctaagatggagggtagatgccataggatggagttcgttgttggtgcctcgcaccatggccatcgtcgtcctccttcaagtaccgcaatggggaggtctagttccatcgatggagcacacacgtcgctggtgcctcggtccttagtcgttgccgccatccttcaagcacctagcgaggagcttcagatctagagatagggcccatcgacgatgcctcgctccacggtcacagctgtagtccttcaagcaccacaacgaggagctccaaatccagggatggagcccgtcgttggtgcctcgctccatggccatcatcctcgtcctccaagcaccgcaacagggagactcagttccaaggacagagcctgtcgctggtgcctcggtcattggccgttgccgccatccttcgagcacctagagaggagctctcgatctagggacatgggtgcctcgctccatggctagcgcaatccttcgagcaccacaacagggaactccaaatttagggacggagctcgtcgttggcgcctcgctacatggctcctgttgttgttctccgagcactaagtgggtagcttcaactctaggcgagttggacatcaccaacctcttgccatcgactagttagcggtgatgtcctcctcccctaggctcttctccacgctccctcaacattgacggcaacgtcatgccccttgatgtcactgcagttgctttcccggcctcaccatctgatgcccggcgctagggaggtggcggtgcacaacacgagt

SEQ ID NO: 4016 - DNA, 1501 bp, Oryza sativa
aagccgacgctggttgagaaggtcgtccacgagctcctccggcaggtggacgccgtcgacgaacgctggaccttcaagctggcggttgatggatgggatccagaagtcctcgactagctgcttgagggcggcgaggtcgcggcgcccttggaggaacccagcgcggcagagacggcgagcctcgtcggcgtcgtcgagcagcgtcaggcgaagtgttgccgcgtccgccccatccgcgatgctcagtagccgacgcaccctgccttgtacgtcgtcggcggcgtcgtggctctccagcgccacctccggagccgacgagccgccgatgagcatgtcggcgtagatgctgcccaccagctccctcaacttgttcctgtcgtcgcagagcacgtcgtatctctccaacagctgtgaaaacttgtcgagcccgagaacacaccatcccagtgcgtctcgccgggcaaccaatccatcaaacagtttgcgtgcgtcctggagtggattggatccggtcaccacgacgatcacggaagtccccggatgtgccgccgcctgagctgctagctcgaatgccccctggcgagtggagatgtagtttacgatacgggggtggggcggaagaaaggccggcggcggcggcggcgacggcgcagcggccatgggagcgagggaaagtggcagaaaacggatcgatcgaatgctgcgtgagctggaagagaggcccgcctgtctgctactattcgatgggccgggcccaacaaggaaggttatataggaccagcccaggcgaggttgggtctcctgcctcgtgtttgcatcgcaattgcttttgttatttttcccccctgctttatatctaatgatgtattcgacaaattcctatcaatgagaaatttgctgtatatgccatgttgcattcaacgtctatatatgcgattaaatattcgaaatgtcgcagctgatattttacacggatacacgatacgttgtattttcagaaacatgcatgcatacggggatatgactatatattcaataataaatacaaattttaaaataatataaaagaaagaataaaatgctatgtttttaaatataaagagctggctattcaatttttatcaataggaaaataaccctgtgtgtaagaaaacatattatcttcatagaaaatataactataaagtgtattagtccccccgggctgataatattagtcgttttggataaggataaagtcaaactttaaaatctttgactacaaataatttctaaaatatttatcttaaaaatatgaaaaccacatgtgtagattagtcttaaaaagtacttcaataaaatcatatatttgttgaaatttatatatattttgtaataaaaaatagttgtcaaagttacattttgaagaccgtgcccttgtccaaaacgacaagtattattaactcggagggattaatttttctacgatctttaatattttttcacatcacagtactgttaa

SEQ ID NO: 4017 - DNA, 1501 bp, Oryza sativa
atcatttcgcctccctctgtatcatcactccgctccaccccccacgtagaacatctggcgccaactccttctcgtcatgcccatgcggtgaaatcagtttcgtggtaagagtccgtctcaaagttatcgcctttttttcacccctccgtcctctctggttccgattcggtattgatttggattgcttatttatacaagaagggaaaaaaaaccaaggccactcctagctttggcatcgatcggcccggttgtttggggatcttgcgctcagtagcgaagccaccagtatggcgaggtatggcggccgccatacctgcccaccggctgatcgcctcatcgcatcggctgttcgcctcctctcgtcgacagttgactcgtctcctgccgcgtgccgcccgatctccgactccaggtccaggacaccgccggacgccgttgccacgctggacgccgccacagtaatcactccgagacaccagttggttccatctctcgcacattagcaactatatcctgttgaatcagacaatcagttgttacgagtagtaatgttaaactagctcgtaatatctgtagttacccagattgcgccatggaagaggaagaaccatctaataatcgccgacgccgactgcgcccaatttcagaagctacccagattgggaaaaaaataaaaggtgagaatttaatctacccttgttggtactgttatttattcactttaacgtatctcttattttaaatttttatgtttgttagttgtcagtataaagagattttttagcagtagcactgctaatatatcaggaggagatggaaatgaaaatatagaagcaagagatgataatgaaattcagtccattattttattatatatgtatgttttcttatacaaactagagtactagactagtacttagtccgtagtaagttcgccataggtgaatttttatcctggcttcgccactgcttgcgctgcttctgtttgtatctagaggggatcgatcgaatacttgggagactcaaatccacaaatttcgtcagcattgcgtgctgctgctgcaatactgtggtgagtagatgtttaaagctcccatcttttctctctcttgttttctttctgttctgacatcagtagcacccatccaacgctaataatggcctattacaatttacagtttattaacttccagttgactgcagatcagtgtttttttggtctaatggctaagcgaatgaatccatgtcatgggaaactggtccccaagaacaaaagagccatattacagtttgatgacattcctgaggtaaatactagtagaatctagtgtcaatttccattctatgtacgttatataggtccacttatactgactgtgctgtttttctttttatgaatgtgagtatggagttctgtatatatatatatatatatatatattcaactgacttcttcttgatgtataggatgtggtgttcttgataatccggttgctttcgc

SEQ ID NO: 4018 - DNA, 1501 bp, Oryza sativa
gcgatgtccttggcttggtgaccatcaacccatggtgtcatccattagcctcatcacaattagacctattcctttgcacatctcaaaggggaacattagtaccaacaaatcggttgtcatcctccacttggtgactaaccggttgcatatgaaagatatggatatgtttgttgagtattcattaacatcgcaaagtgtcatatactcgtatgcaagctcaaatgcaaagatccaatataaataataggtgaacaacgtggatctaaaacatgcacaataaatgtataggatttgctccccctaaatatatgcatacaaataaatatacaagagagacaagtgtatgcataagttatgaagaactaatagggtttatcctatacacatggagaaggcatgtagcaatgataaagataaacaaaaaacacataccttcatgatctccatgttctcaatgtaaaggagactaaataagataagactcaagtaaacattagtctcacacttatataacaataacatggaaatcatatatatgaacctatcaaaaaggatgagataagaagtgatacatatcgctttatctccacgaatttcatccttgtcatgattaaggtccatcaccaaagaatgcatatctaccacatcttattatcgggaaataaccttgttgaaaacttatgtaaaagagagattaatcccataaatatcggtttatcatctatcaccaaagcaacaattacacaaattatttaattcaagatctttcaatcttttctctcttttgtgatagataataatccgatataaacaatatggagagatgagatgaaagatgatttcaaatcaagatagaaatcttaaataaacaaaatatagagtaacctccccctcaagatgtgcatacatatggatataaaggaacacatatgcacataatcaatcaagatcaatgagggagctcacactatattttggatccacaggagagacaaagttagaatatgtgaagtttaatacatacctctcatcatttttactttcatatccaaatgagattagtcaaacaaaagctcataaaaatgttagtatcatattgtcggtgacatggggccgggggtatcgtgactagaggcttgggtagccgcggtcacccacgtggcctgaccccctcgggggggtcgggcccgagggtgacgtggccacccctccctctgtctccccgaggggtcgggccgctcccgtttcggccccgagggctggggcgccccgcccccctgtggtcttggcgccacgtgtgtgcgttaggtgagccgaccgggctcacctaaccgcatttatagcaggttggacgagcgcgccacgccgcatttaatgcggcacagcgcacgcttatccggtccgtgaccggtcgcggtgtgtgaccggtcacagaccggtcagatcgcgggttaggtggcaacaggcggcctgtcacacgcctcgcctcgtcccatcggaa

SEQ ID NO: 4019 - DNA, 1501 bp, Oryza sativa
ggttgcactaagcactcctccttccactaagggtatctcttcccttttggaggtgagatccgaccttcacaaacttctcccggccaaccataagtagatcggtggctcgggagcgacacctagccgcctaggagtcctcaacctccaagagtaacaaatgaagcaaagaactcccggagatgatgaaagtgctcacaaatcttcacgaagtcaacaacaagcactcccacaaactcgaatccacaactctcacacacacaccaaatccaaatcgaacacgggtgagagggaaaacaagaaaacaaggctcaaaagtgctagagaaagagcaagccaagggcacaaatgattggaatggaaccagcagccctcacaagtgaggggagggggctatttatagccacagcccagattctgtccgttatgcacaataattcagattttcggatattccgaaagattttcggacatgtccgaaaattccagctcagcaccaacaacaaagttaacgaaggatttttcggacattccgaaaacttttcggacaagtccgaaaatttctagtaccaacaacatcgttctggatgttctcggaaaagtccaaaaataactttcggacaagtccaaaaatatacagaagcgaaattgactctactgatgattttcggaaaatccaaaaatcagattcggacaagtccgaaaatatacaaaaccacttttgctttcgcagtctttttcggaaagtccgaaaatcactttcggacatatccgaaaatttccagaagcgaaaatctggttctgtgtgttttcggaaagtccgaaaatgagtttcggaaaactccgaaaaaatccagaacacaccaaactgaggagaaacactttttaaaaatagattttgagcactttgatcactcctcgtatgtcaatgcatcatccctcttaatagtgcggctttcctattaactcaaggaaacgaaaacgtacaaaataccatttgctcatttgccgcattacatcacatcaacgtattcggcgggatatgtattacgctaactcattgaggacaaaacaaccttcacatttgcttaaataaaaatgttagtcctctctaatcgcattgtaattaatcaccaaaatcattaggggcctagatgcactttcaatatcaatcaaatacatgaaatataaagctaaatcaggtaagatcggttgaaaccccgatactaccctaatcggcaaccaaaagcaggctagagattgagattctaagacaacttataagatcaaactcaactgatgcagctataagtatgaaaagaaggacaatatctagacaatcaagccgttggatatttcatagagcggtagatatcctatataatctaagtcaacaatagtatttaacctgatcggctgccttttagcaacagatgttagccgatttgagggttagataacaatattgcctgagattatatagaatatctgataactcaacgaa

SEQ ID NO: 4020 - DNA, 1091 bp, Oryza sativa
gtcggatatacatgccatgtgggtatggggtgtgcatagtctccacagtagcccctgagacctttacagacgacgaaataatcttctcttgtaatcttcaagatgataatccgagtgcttcaactattcctgccttgggctacctagtacttgaatcaaagactgtgaagggctaaaataaaaaaaaaaatcgggtgcatcgattagatgcacctaattaggtgtagcccccgactatgtgattagttgtatattaaacatccatccgagtgaatttataactgaattaccaaagcaatgatatagctaagcatatgaggcacttgataaacattcagccgactgctttagcttgagtatgctcaaaaggcataggtagatccgagtgaaaacactctaaagatctgttaatcaacatatatgattaaaaatccgagtaaaactcttaaaggatttatcaaatgttgtataaaaaatgataaatggcaagtataaatagcctaagctacgacccacgccattatcaaatgaagcatataacatgccgagagaatgaccattagtcaccttaataaaacccaaacaactttgtagcctaaaaaggccaacaaaattagtataacacttttctgttgggcacctttttatttgcatcgtagtaattcccaagaattatctaactgcgtcaaaaaggattttaacggcactaggctattctgtcgtgagcaatttttaccaaagaaaaaatatacgccaaaatccctaaggatcacaactagccacgccgataataaaaatgggctgaaaatactaagaaggcccaggcccattagcatcttccgataccccagcgaaaaaaccgctgaacaaaacgccgcttcgtcttccccgccgagatctcctccactctccctatccttcgctatagtgtagcaaccacgccggcgaaaattagggctagcaaatccacatcaatccacctctcccgaagcttcgtgggcttgcgaaaatcatctgcgcaattgccgcttcaattttcctttcattcgctgccgcccttgctccatatcccatcacccatctcgcatcca

SEQ ID NO: 4021 - DNA, 1501 bp, Oryza sativa
ttctatttaaattattcatgaaatgatattccattgattaaaaatacttccttggctcaaataaatcccagaaatatctaggaactatagaaacaagagaagtatttaacaaaattttatctagcccacttttatattgagatttaacaaattaaaattagatcttctcttttaggcttttaagatcatttctaataattccttttaaacaacaatttataatttaaggatttttaaacaagaaaagcacttaacataattataattagctcattaattgattaactaattactgaactgttctttgtatcatttaggaattgagctctgaaaaatccgagaaaatttcagagagtataattaatcatggagaatttattaaaatttaaatccattcatgctttaaatttaggaaattttatttcccacatttaacttcacttgtaaattaatgaacatttaatataaattctattaataatttattaaataatttataaatcctaaaatgaaaaaaatcaagctgtgacatagagcctcttataattcagctcaagcttggaagtgtgtgttgaattgagtgaagtgaggtctatttatagggcagttatgacggttgtgagaaggagaaaagtccgaactgccatgcaaccgtcattaggagagcatctggagcgtccatgccaaaccccaggatcaacggtgattaggggggtttggccgaacctgggttgggccctcctggcctggccttcggtcggtggactccctggaccctcctatgttcatttctcggagttttgggctgattcactggtattttgatgaagttcacaacacatccttgtagggatacacatttctcctcactttagtctgattttcctctcaacttagggtttatcatctgcatacaaatatataccaacacttgtggaatatgtgagattaagcacctataattatgttggatgttttattatccgaactttatgcggatgttggtggtatagaattggcatttaacaatcgccaacagcagacaagtatggcccaaataaatgggccgtcgtgcggcccattcattcactgacccagtccgaccgaaggcggtttattgtccggttcataacaaaactggccggttcaagcggtctgattgtctgaagcggttcaattgcatgtccggtctttctattcgaccgaaccgtgccaaactctggttccagttgaatcgccggtccggtccagttttttccactacgcccacgcgcgtcaaccacagtttcgcatagcatcgtggccctaccgctgccacatgcccgcacaccaccttgtagccttggccatgcctggtgcagtgcgacattgtgcgttcgcatgagagcggggctcatccacgtcgcaccacccaccatcctcactcccttgtacagttgtaccaccccacctcttcccttcgcctagaactagaagccatcaccactccccccctgcgcta

SEQ ID NO: 4022 - DNA, 1501 bp, Oryza sativa
ctatgcgaaactgtggttgacgcgcgtgggcgtagtggaaaaaactggaccggaccggcgattcaactggaaccagagtttggcacggttcggtcgaatagaaagaccggacatgcaattgaaccgcttcagacaatcagaccgcttgaaccggccagttttgttatgaaccggacaataaaccgccttcggtcggactgggtcagtgaatgaatgggccgcacgacggcccatttatttgggccatacttgtctgctgttggcgattgttaaatgccaattctataccaccaacatccgcataaagttcggataataaaacatccaacataattataggtgcttaatctcacatattccacaagtgttggtatatatttgtatgcagatgataaaccctaagttgagaggaaaatcagactaaagtgaggagaaatgtgtatccctacaaggatgtgttgtgaacttcatcaaaataccagtgaatcagcccaaaactccgagaaatgaacataggagggtccagggagtccaccgaccgaaggccaggccaggagggcccaacccaggttcggccaaacccccctaatcaccgttgatcctggggtttggcatggacgctccagatgctctcctaatgacggttgcatggcagttcggacttttctccttctcacaaccgtcataactgccctataaatagacctcacttcactcaattcaacacacacttccaagcttgagctgaattataagaggctctatgtcacagcttgatttttttcattttaggatttataaattatttaataaattattaatagaatttatattaaatgttcattaatttacaagtgaagttaaatgtgggaaataaaatttcctaaatttaaagcatgaatggatttaaattttaataaattctccatgattaattatactctctgaaattttctcggatttttcagagctcaattcctaaatgatacaaagaacagttcagtaattagttaatcaattaatgagctaattataattatgttaagtgcttttcttgtttaaaaatccttaaattataaattgttgtttaaaaggaattattagaaatgatcttaaaagcctaaaagagaagatctaattttaatttgttaaatctcaatataaaagtgggctagataaaattttgttaaatacttctcttgtttctatagttcctagatatttctgggatttatttgagccaaggaagtatttttaatcaatggaatatcatttcatgaataatttaaatagaaaaaggttttaaaatctcccttttggctttgggccgaaagtcggcccaagtctctctctctccctctcctcggcctgcttgcgtccggcccagccggcccagtccgccgtccctccctcctctctctctcggtgccgacctgtcagtcgtcttcaacctccggccgctcctagccgcgccacaagccgccgatctccttccaaatcc

SEQ ID NO: 4023 - DNA, 1501 bp, Oryza sativa
attcttatgtatgaatcaaaaggcttcgttcaaatgatttgtgcacggttggcaccaatgtatatttgatcggagactgtattagcatttgaagtggtaaggggtgtgttattttaagcccgaggtcccgtcttcaatccccaacgcgatatcattttttttaaaatatattgtctctctctccaaatcttcttttttttaagctcaagctgaatcatgttttttttgggtggttgggcagcgtggcctaaactaatcatgtgcggggtataaactgatttagtaatttagtgttataagtgtcgttatatgtttatgtaaacttgatcaaattttcaacaattttgacttaagaaaagacaaaatgacttgtaatattaagggaagggagtaaattggcatttcgtcacccatgaagggatcttttggaatatagagattctacgtgattctcacgaatttgactttcaaacccacgcaaaaaattagttatacacctagacacctcgtagtatatatgctatgggaattctgtcctgatttccaatcgataatggacctgttcggctggctggtacagccactgtatgcagccgttgctgctgcaactgtagactcaacttactgtttgtgttggctgcacaatacaaaaaatgaatgggtcagatgttgaatctaccggtgacgtagcagcccacatagtgaaattcagcccatttatcccgcggtccaaagcttccagaagaaggtggccactgtcgcgtagcgtcctcactcctcaggaagccatcgccaccacgcgaggtgttaaatatgtgatccgaattttgggcccacaatatattcggattagtttcctagtaagacttcatgtatatcctattaggtgtctttctattatcctctatatatactcttgtaagccgtacgggaaggggtgacgttcccattgttatttccctatgtttgtaatcatttactctacagtgatcattgccggtcagcgcccgtggtttttttccgcaagggttttccacgtaaaattcgtgtctccgttatacatctattttcataacaagtggtatcagagcattggagatcaatctacaccacaccgccgccgccgcctgtttcgctttcgtcgtcgccgaatcaatctgttcggtgcagtaccccgtcgagtccgagtcgcgccgtcctcacacacccgcgcgagaaaagcagaagctgcagcaaccgcacagccgtgaggaggaaaaagggccggcctactgcaactgtagggcacgcgacccgaggaagtcagggactacatcgttcctgttgagaaggaatttcttggcgatttttttttgctaagcgcaccaaagcttgtgtaccaggaaatctacatacttcgctttgtgcacacaggaagtgcacacaggaagtgcacccaggtttcgcgtttttgctaggtttaccctaatttctttctagcaaatttcaggattaattccca

SEQ ID NO: 4024 - DNA, 1430 bp, Oryza sativa
ggctgtaactatatgtctatatcaaatgcaatagaaatctgagaacgttgtgaatcttggtatgaactttgctctgttctttgttcgatattgctctgatatgaacaggagtaacagagtttctgttggtcttggatgtaaattgcatcagacatagtggatttaccttgtatcatgatgttaatcacagcagcaggatttcacattgcataaaatttatcaacctttctgccttagttcaattgatacaaccttgattcctggaagactggaagctttgttgtatcttcagtctgtcagtgccaagcaggctcttcaaattttgcatcagcagaccaacataagcatccatattgttcagtctttgattctgaaccatcgacctccaaaacgcctgcatatttgtcattccccggttttcagagaagcccaaacctctgcacgaaccctgtaaaatcatttgcatcagcagtcaagcctcgataatttatacttgatgtggcttgattctgaaacagtataatccaaaatggcaaaactcctgcatactatcccatttcttagtttccagatgagctagaaaccggcagcaggagtaatgttaaacatttgcattagcagtcaactcagaatactgatactgaaaccaacagttaaacacagctagctgcaagctgcagagctttttttcgtggcttctgctgacaagcacacggccaacacttaggccctgtttagttcccaacacaaaaattttcacgttatcatatcaaatgtttggatatatgtatagagtattaaatataggaaaaaaaaattacatagattgcgtgtaaattgcgagacgaatattttaagcctaattgtgccatgatttaacaatgtggtgctacagtaaacatttgctaatgacggattaattaaacttaataaattcgtctcacagtttcccagcgaattctgtaatttattttgttatttatgtgtgtccgtatatccgatgtgataataaatttgtaagatttcatcccaaatttctgtcgaatgccatatcgcaatttcgattaaaaaaaccatataaaatttgggtgttgaaaaacagctgaaataaaaaataaaagtgtctttcccttccaaagtcgctatgtctatccatcctcagaaattaggaaccaagaaacataacaaaacacagcacaggcacagctttcaccccccaactcgttagctgacgccggtcgcggtggagaaatactgacggcgtcgcagccgccgctcacccgcaccccacgaggccgaggcggcgtggtatggctccttcgctttccaaacaaccctataaatatcttgcagaaggttccagaagaaggccgttggatcatagcgtcgtcagcaagccacctccacctccacctccacctccaaaacaa

SEQ ID NO: 4025 - DNA, 1501 bp, Oryza sativa
gtcattccaacagccttaatctgagcatagaaataccagttgttcttccaattaagggaacttagcagtaaaagaatagtcctctgacaactatcacaaccaaattttaggagagagatcgatcactcctcagaacatgatgacgtatgtatctttatacaagttctgaaaataatcagttcagggaaatgactcatgaacttagtatagcagttgcagtgttagtgattgaaactcagaggaaatgcagaaaataagacataaattgatcagcagtaaataatgtaactaaaaaaattcataactgtggatgagcatgtacatgtgattcaagacaatgtaatggtgattggaattcaacgaggtattcaaatgatcttattctgacgtacctcagcgaccatgaaacagagcttattgacagtagaaatattttggaaagcgtcaaggaattcttgggttccgaagacgcaatcgaatgagatgtacgcatcctcgagcttggggagcgcctctgtgattcggcagccgaagtcgacacccatcggcatggtgacactgagctcccggaggttgggcgctctgatggcccacgggtccaccacgaccgcgccatccatggtacccaggtttgacaactcgagcacggcgaggttctctgacgcgaggatgaggtgttcgagctgcgtgccggcacgggcgtacgggagggtgacacccacgaggtagaggcgctcgaggttggggaagcccggaaagcccggcggcatgtcgcatttctcgaggcggaggctgacgagttcggcgcaggagaagagggcgggtccgggaaggtgcggcagatcgtcaaacgagaacttcaggctgagatcctggacgcccttccgcgccatggcgggcgggcggcgcggtagacgttgcgcgtggcgacgcgggcgcggaagccgcggatgggcgccgcgcaccgccacagggcgcgggaggaggagaccgaggcggggaactcgatgcggaggttggcgacggactcccaccggcggcgccacgcgcgggagaggcaggaggtgcggaccagcttgtcgaaggggagcagcacgaggatgcggtcgttgaggatgtccgacgggagcgccatcagcatgtccgtgcgcgtccccgtcgtcgccggcggcggcggcggaggcggcgcctcggccgctactcgctggcgcttggggggcgacgagtaggcgaagcccgaggtcgccattgttttggcgtggaggtggaggtggaggtggcggtgcgggcggtggcttgctgacgacgatatgacccaacggccttcttctagaacctattccaagatatttatttggttgttgagcacaggagaaagtttatttttgaatcctgaacaattgggttcgcatttataatccgtcaatgtttcatgttcgatagttacatgttttaacgtgatgttttaacgtgtgtctttactgtgtttacctgtcttttc

SEQ ID NO: 4026 - DNA, 1501 bp, Oryza sativa
tagacccatattttttttagaaaatcatgagctgcaactaggagttcgatagcctcaagttagcatgcaagtttttttaaagagatcttatacgactccttgtgtatttacaaaagcgaataaacttaaaaacaaactcaaatacggatatgtattttcaaaatgtaaacgaagttaaaaccaactcatacacggatgacatactaaagtaccggcaaaaatatcttcaatttttataatagtagagattagtaagcttttgtataaccaaaattagtattattcaatttgaactactttgagcgaaaattcgtatcgaaccaaatattcgaggtcagcaatatttcggatggataaaaattagcctgaatctaaacaaccatttattacggataggccctttctaggattgttgttgtgttctctcatgtttctttctgccaattctctttgcctttattttgtttggtaaacaatgcttaagaaacagacaaaagtaatgtttgagaaattattgggtatgaacttcaaggctgctagttgatggcttggtttcttgtaggcaaatgggcatacgtggtcgtgtaaccgtgtttaattagatgacacttttgtgacgtactgtctctacatgaatataattatttttgggttatttaataaagattaaggttgataaaactttgtacctcactttaaatgagtgatgattagagatgagaaggtgattgaggtaagataaaaaaattaaataatactgattgataggataagtagttctctaagaattcttgtatttatgattaaattttaaatgcttgaaatacttatatttatagatagaaagggtattttatctataccattaacatgtcaaagacaattctgagaaacatcacgaattagggttgtgtatatgtaagtactaaaatgctacttgttggtatgattagccttcttgctggcttgttttgtctattttccttgttggttctgtcataagacatacaaccataagtttatttttaaaaaataaaaataaaaataaattaaaatgagaaataaggtgatgagacatatccccaaccccctttattattgactagcattgaaccacatagttttttaaactagcaattctaataaaactacactatttatagtggaataagagacccttgaccaccgattcgagtgtagtaccatcacgcatgtgcgtatcaaaggctattaaaacttcttacaatttctggggaagtgggggacaaaatacaaaattgcaaataccaagtataactgcaaaatgcatagagagcagacaattgctaatactataagcatctttttgagttgtttattggggaagtttggtctgtacgcagttgaatgcccttatatatcaaatattccgtacttattttggaccagtcaaacttttttttggcaagtccattgtttattttatcacattctggtgaagtggtcaacacaatacagctga

SEQ ID NO: 4027 - DNA, 1501 bp, Oryza sativa
ggttgcgcgcaggagccacgcgtaggaggagagaggctgcgcggtgcggcggcttggtagggcggccgggaggcggcgcagaggggaggaatcggggcggcgccgggcagaggagggagggagggaagggagtggcgccgggaggagaaggtcagggcgccgattggagggggcgccagcggcggcgtcggctccgcttgggcaatggccgagcgcatcggcgcggcgcggcgatcggcgcccgaggggaaaggggtggctacacggcggcgcacatctaggcgcaacaacggtttgggggtggatgaagacaagtagacgacgacaatggcggcttcagtaccggaggcggaggtggttgcgggcgcgcgcaggcgggggaagcaattgcacgggggacggccggcgggcgcaagcggcgggggaggagcggcgtgcgggcgggcgctggcggcgggggaagcagcggcccgtgcggtgccgctccactgccttctccatcctcctcgagctcatcctctctcgcccatgcccctgccaccgctggcaaggagaacagctcgccgccgccggcgaggtcgaggacgaagtggaccgctgctggccgccctgagagagagaggaggaggaggaggaggaggaagggagcggcgatcctgctgctcgtcaccgtcaggttccccgccggcgtcatgcggcgggtcatgaagcggcggcgcaagagccgaggccgccgcagggggcggtggggctgcaggagggccgccccggacgagtcgctgtcggggagtgccaaggcgatgaccgcggccgcgtcaacgttcgatatgatggacgacaaggcggcgtcggcggcggagtgggggcgcggctaaactgacgcggccgaggcggcgtcggagctggagctcgagatgatgcgctcccggttctacagcagcggcttctagcggagcccctcctccgcctccggctccagctcccgcgcctcctccctacgccggaagatgacgacgatgaggctggcgtcctccgccctacgccggaagatgacgacgatgaggctggcgtcctccgcttggctccgccgccccgccggcttcgggtgccgccactccgcccgcgtgtccgctcatcgctgccccactccgtcccaccagcttcgcgtggcgatggtgactcagcaacgaagaccaaggtcaaagcgccacggtggacaaaaccagcgccacgtaggataaaaccatgtgaaatactgccttgggaccacttgtgactggttttagtaaattaagggaccctcgatatctggttttgcagtttgaggacgtttttttatctcggtgacaagttgagggaccttcggtgtactttttccttcttctgtgctatgtgttgttgggctgggctgtaatttgttgtgtttgaagcccatccaaatttcgttacgaatccaagcaatattaaaggccctgttttaaaagagttggaggtgctacaa

SEQ ID NO: 4028 - DNA, 1501 bp, Oryza sativa
acataagtatcatttatgagttgttttatcactaaaaatattttaagcatgctttatatcttatgcatttgtataaaatttttaaataagacgaatgaccaaacacatgttaaaaatcaacggcatcatctataaaaaaaacagagggagtatttattttctccactatttttttttctaggccagcctgcaaaacctgcattgcgatggcaacttgcaaaaccaggccagcgtcctctctgtccttgcaattagcaaaatgtaacaatgcttgaattgaattttcttcgcttgatttattcgaatacctagcttccactgaagtactaaacagtcaaattaaccacatgccggtcagcatacgtatttacaaactttaacagaacaacacaaacatgctcgtcttacggtcaaactcttcgtggttacgcttgcgaagccgaaagagggccgcatggttaaatatgcgaaagaaactcggtgtagaaaccataaactacgctctacggtaatacggtattcttcaccttttttttattttcaaattcttttaaaatgcatctcatatataaatgcgtaccactcataagtgctcactgagagcatgtttttttcttccactccaaactataaattcctcttttttttttctagcatcattttcaaactatttgaaaagaattatataaaaatttctttaaaaaatcaaataaatctaattttctggtttgtaatagtcaatacttaaattaattaatcatacgtctcaaaatgatttaaattatatgtttaaattcaatttttagaatttgaatttttcaacgaatatgtgtttgggtgtgtttagttcacgtcaaaattggaagtttggttgaaattggaacgatatgattgaaaagttgaaagtttatgtgtgtagaaaagttttgatgtgatggaaaagttaaaagttttaaaaaaaagtttggaactaaacaagcccttaatgagttatctcgtttgtgtgctgctgaggccctgtttagatgggactaaaacttttaagtccctatcacatcggatgtttgaaaattaattataaatattaaacgtagactattaataaaactcatccataatcttggactaatttgcgagacgaatctaatgagcctaattaatccatgattagcctatgtgatgctacagtaaacattctctaattatagattaattaggcttaaaaaatttgtctcgtgaattatcttttatttatgtaattagttttgtaagtagtctatatttaatactctaaattaatgtctagagacagggagtccctggacgtaaacaccacctgagaatctcgtccctcagcaaaaactaggccctcgcgggcgcaaggaagctcgcggactggctacctttagtcaagactcaagaccgagtccacaggtctccgggtgtttacttataaatttgttttctttgtacagttttctcctgtaccctcgtcgatttg

SEQ ID NO: 4029 - DNA, 1501 bp, Oryza sativa
tattaccatgcattctgcagccatgtagtgcctgctgatgcaaaacataataataagatctgaatgaagcatccaaatatgtgatgatggtggacaaaactacatgtacaatgggttaattagcttgatgatgttgatctgtgtgtgagtgactacctatgatgtcggtcattgtgtgtgtgggggggggggggcacttagctaacacagtgagggaggtctgctgctgctgctgctgctgcttcctcaaatacaaccgaagccttcgtattatggaaccatgcgggaggtgacagttgggcgattgagatgaagcaaccgtggcgacaagggattgggttggagagtaggggcgaagaggatgtagcggcgctagtggcggggactataggaggaggaggtggagatgggaggaggcggcggggtgagcaggaagaggcgatagtaggggaaagggaggggaggcgctggtggtggggaagagggaggaggaggatgcgtcggtgcgggaaaagaggtgaggcagaccgggggtggtgaattgggacgtcgacgagaggagccgcggcagtggtgtgacgacgagaagacgagagaggggatcacatgcttttttttttctttaaaaccataaggacataggaggacctcattgtgaaataggtttctcgaaagaccaaaaagatatttcaccaatataaggatttgacggcttatatcgtgtggatgggaaatcggacggacagtgatttgttgatgacgtggccgctgtaactttgcaagaaactttacttctttcactattttatattcatctaaaatagcttaacaaaaattcacataattaattaatttgactaaattaattaattacattacctttttattttatcgtttgttaattgaagttatttggtttttattcgagttttggaagtggagctctatttcatgaattcacccaaatcctaagaatcgtaaatccaaaaaattctccaaattttgagtttgttagaaaaatcttaattctcaatagaaaaatcctttcttacttccttcatcacatcttcctttctttttccttttctttccggctccgcccgttgcctcctaatatccttgcttctctttctctgtgtgtgtctctctccctcgttctctatccgtgcatgggctgaagcctagtgtactgctcctctccacctcgtccagcacttgggtccaccccaagccgacatgttcccatgtgccaccgtctacccccgcatggctacgtcatttctgcttcttcaaactctacttaagtgcctagccagacgttttctcctccaattcccctgactaaccactttctctcccccatcaattctttctccaccaataccaaaaatcaaatcaccttgatgagctgaatcaatttttttaactgctaatgtggcaacagttgatacgtaataaatatttaggatcacaacctttatctcagtcttattggaaagca

SEQ ID NO: 4030 - DNA, 1501 bp, Oryza sativa
ttgtaagaagttttaatagcctttgatacgcacatgcgtgatggtactacactcgaatcggtggtcaagggtctcttattccactataaatagtgtagttttattagaattgctagtttaaaaaactatgtggttcaatgctagtcaataataaagggggttggggatatgtctcatcaccttatttctcattttaatttatttttatttttattttttaaaaataaacttatggttgtatgtcttatgacagaaccaacaaggaaaatagacaaaacaagccagcaagaaggctaatcataccaacaagtagcattttagtacttacatatacacaaccctaattcgtgatgtttctcagaattgtctttgacatgttaatggtatagataaaataccctttctatctataaatataagtatttcaagcatttaaaatttaatcataaatacaagaattcttagagaactacttatcctatcaatcagtattatttaatttttttatcttacctcaatcaccttctcatctctaatcatcactcatttaaagtgaggtacaaagttttatcaaccttaatctttattaaataacccaaaaataattatattcatgtagagacagtacgtcacaaaagtgtcatctaattaaacacggttacacgaccacgtatgcccatttgcctacaagaaaccaagccatcaactagcagccttgaagttcatacccaataatttctcaaacattacttttgtctgtttcttaagcattgtttaccaaacaaaataaaggcaaagagaattggcagaaagaaacatgagagaacacaacaacaatcctagaaagggcctatccgtaataaatggttgtttagattcaggctaatttttatccatccgaaatattgctgacctcgaatatttggttcgatacgaattttcgctcaaagtagttcaaattgaataatactaattttggttatacaaaagcttactaatctctactattataaaaattgaagatatttttgccggtactttagtatgtcatccgtgtatgagttggttttaacttcgtttacattttgaaaatacatatccgtatttgagtttgtttttaagtttattcgcttttgtaaatacacaaggagtcgtataagatctctttaaaaaaacttgcatgctaacttgaggctatcgaactcctagttgcagctcatgattttctaaaaaaaatatgggtctaagagaattctcacagtgaaatttcaactcaactaaatcataaaatatagtaagattaaaataactttccccgttgcaatgtatttgttttttttctaatatttaaaaaatataactggctcgaaaccaaataagctctcgctaaataggaagaaaccaattgcaataaataaattagtccaatgcaataccaccttcgtctccatttttaacccaccctctctctctctcctctcatttttctctcccacaaagg

SEQ ID NO: 4031 - DNA, 1501 bp, Oryza sativa
ccccactccgccgccgacgccgccttgtcgtccatcatatcgaacgttgacgcggccgcggtcatcgccttggcactccccgacagcgactcgtccggggcggccctcctgcagccccaccgccccctgcggcggcctcggctcttgcgccgccgcttcatgacccgccgcatgacgccggcggggaacctgacggtgacgagcagcaggatcgccgctcccttcctcctcctcctcctcctcctctctctctcagggcggccagcagcggtccacttcgtcctcgacctcgccggcggcggcgagctgttctccttgccagcggtggcaggggcatgggcgagagaggatgagctcgaggaggatggagaaggcagtggagcggcaccgcacgggccgctgcttcccccgccgccagcgcccgcccgcacgccgctcctcccccgccgcttgcgcccgccggccgtcccccgtgcaattgcttcccccgcctgcgcgcgcccgcaaccacctccgcctccggtactgaagccgccattgtcgtcgtctacttgtcttcatccacccccaaaccgttgttgcgcctagatgtgcgccgccgtgtagccacccctttcccctcgggcgccgatcgccgcgccgcgccgatgcgctcggccattgcccaagcggagccgacgccgccgctggcgccccctccaatcggcgccctgaccttctcctcccggcgccactcccttccctccctccctcctctgcccggcgccgccccgattcctcccctctgcgccgcctcccggccgccctaccaagccgccgcaccgcgcagcctctctcctcctacgcgtggctcctgcgcgcaaccgcgccgccaccaggctctctctccctgccgccaagctctcccccttccacgctgtcggccccctcttccccaccgccgccggccatcacctgcgtcgccggcgcccatcctttgctgcgcgcgcgtgacagcgtgcgtgaggaggaaaaaaaggcagagagagaaagagaacggcaaagagaagaaaccgtgagaaagagacaaaattaaaagagaaaggaaagaaaaaggaagtgggacccccctgactcctcctccctgtgaagccatgaagggagagagatgtgacgtggcaacttgacacgtggggcccacgctgactcagctgtcacgtaggctaaaaccgggctcaaaaccatcgaaggacctattatcaccggttttggtaagttaagggaccttcgatatctggttttgcggttcgaggacgttttttaatctcggtgataagttgagggaccttcagtgtactttttccacagaagaaagtggaacgaaagcccaaccaaattattatccaggcccagccaacggcgaccacaaaccgagcagataagcccatccacagatcgggtggctcccgtttgccgcctaacggcaacctccccacccaaaaccaaacgccgtcacctctca

SEQ ID NO: 4032 - DNA, 1501 bp, Oryza sativa
tgcgacagaggagtggtggcacgatggtcgcgcaatggtgctttaatgtcccaagacgacgatgggactggaaatggaatggtgacaatgttgcgatgaagctcaccgaacagcggcggctttgatttgtatggcgctcaggattgccaagcgtaagcatgttggtaggagagcgaagtagagaggcgacgacaatagcacatgaaagagcagtggggattcaccaccgatgatgacgttgaggtggtggctgtcttggaaacaagacaacgatgatgtggtttgtgatcaagaccgagaaatggctgcatgatgctcgtgcgatgatggtacaaattcatgagacggtggtgctggcggatggcagctgcagtcagaggagatggaagtggagacgccgacacaggagttgtcgacaccaaggagcagtggcggcttgacggaagatggcactagatctagggaagatgaagccggcctcaaccatggtgctcacaggcagtgggtgaagctcctatggatggcgagatggctcgagctcttggacatagtagaggtggcactctcaacaaggttgcaggagaaaatgatgatcggcctgtgccctctcaggctgcgacggcggtgctggctcaatctccactctccagggtagcgcctcgtgctctccaagcgatgatgagcagtggcagtaacgacatgggcgatggtgtgatcgtcgaacaaaagggagatgaaggaggtgtgtagcaggtatttatagaggagaagaggagagacgaacaaccaggagatggagaggtggcggcagaaattagagaaatggttttggcaaattgaagagcattcaattttttgcattgaagaggagaaattgatggcgaagctagtgatttgtagagaattgtaagaggaggctgcttgagcaggagctcagtgtgcttgacttgtgtgtcaaggtgtagaggtggctggaaaattgaaaaatggatccatctcatcaattttattcagtttttatcatttaaaagagatatattgattagagagaggaagggattaattaatgggagggaggaattggaagagacggcactgcttaatggatgagcatgacgtggtttcttgagggaggaggaaggtgagtagcctggagatgaaaactcacttttttttaagataatggaagttttattaagactctgtcaaatatactaagatgatacattccaactgagcctacccccggcctctgcataaaatgcacacagccaataaaaggataaaattaaaccctcatcacgaaacatagatattagtgactatcaatctgtagactagatcgccacccatgctcctgggtaaaaacatctcgtgccacctggtccaaatgtcgagataccaccgcaatagtatcccgcaatcccggtttgtggaggatagcccaggtacgtagccaccgggtaactagagtaataacctgtaaaggagaagacactaa

SEQ ID NO: 4033 - DNA, 1501 bp, Oryza sativa
gttgtactcattcttgctctatctttccccccttcactaagaaaaactttggagaagaagtcctaggtggggagtcctggcttataccccatttgagcgcctgtgaagatggagccgtaggcccgctagtccgctgttgtttattttttattgtcaggcctgaagtgcctttgaaataatgtaaatattaacgatataataaagatgtgtcttttgtatcatgtttgtgtggtgtacccggctttttctgggacggggattaatacactagcgttcagaaaaagacactttttccgggcgcgacaaatacctaaccaggacgcccattttttacaatctatcacgcagagtgaaattgtattgaaaaccaaacatatccttgtgattaccgcgtttacaaaatttgtggaaacaggttagtccaatgaaattgatgcatcaaatctctatattacccattttattcgaataggtttgtagttgaaatggggtaaaaaagggtgacaatggtgtctccatagtggatactaaactggtgatacaaggaacaatcacacgagctcgtgcctattcacctcattatcaggaagtttcgttcttaaggttacaatatcatgatttctttaaaggggtacaactataaataaactcttgcgataattcacgggggaaagattgcttgtgataatattattgtgcttaagaacgaaggagatggacactatggtaaaaaaaaacgaaggagatgcacactgtaaaaaatgatggtacaatacagaaggttccaatttggcctgccacgcagacccaagttgaaaaggttgcccattgattcaaggcttcgtttgggtgccatgaaaaggtattttcgatttatcctcaaaactaaatttaatctagtgaaccgcacttgcaaaaacagtgcctacattattctgtaaacgagtactatgatcaaacctgcatacatgccatatggactatacgatactatttcttgcgcttattctcgtgattctcctgtggccatctccagttatgtatcaataagacagttatacttttcccctaaacaaaaggacaaaccacgttcatctatgaggagattgatcattctcttgattggtgaacaacagacaatattattatcatttctttacaattacaggcttgataagctgatcaaacaattggcttgcaatttgcctcacaggcttgcaagctagggtagcatacattttgtggagattatgggtaccccatacccacacggcatggttatccgactagttataggggataacttatatgtatggaatatgtaacagatcatgacttgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatg

SEQ ID NO: 4034 - DNA, 1501 bp, Oryza sativa
ctctagattttgctgctagttgggacaaatgtttaccttacgcagaattctcatataacaatagttatcaagccagtttaatgtcaccacatgaagccttatatggaagaaaatgtcgaataccattgatatggacagaaaccggagaaagaagtatattcggaacggaccttttaaaagaagctgaagaaaaagttcgacttattaaagacagacttaaagtagctcaatctcgacaaaagagttatgcagactctagacagagagagttaacttttgacattggagattatgtatacccaaaggtttcatctttactagggataaagagatttaaggtaaaaagataaactagcccctcgatatattgaaccctatcaaataattgctaaacatggagaagtagcctatcaattggctttatctggctacttatcagacgtataccctacatttcatgtctcgcaatcaaagaaatgttgacgcattccagaagaagaaatatcagtaagtactgttgaactgaataaagatttaacttatccagaatatcctatcaactgaataaagatttaacttatccagaatatcctatcagaattttagatgaagtacatagaacaactcgtactaaggcaataagaatgtttaaagttcaatggaatcatcatacagaggatgaagcaacttgggaacgggaatattatttacaattggaattcccgtatctattcgaagactcctaagcaaatctcgggacgagatttctttaaggagggtaggtttgtaacatccttaaattttaaactaatatttgactgcatcatgctggttttaatcttagactagcaaaatcaaaattttctttaaaagttctctttttattcttgattttggttcaagtattacccctagaattcccttaacctagtttaccaataaaccataaattgttgccctatcttaaaccttagtgaatttagcaaatttccttcaaattccaaaacttagaaactttctctagattacccttctattagtgagacattgttatagtgcataatatttgcaaaactcttccaaagatctctagataaattcaaaatattcaaaattcctaaatagttcttttgggccgaaatccttttctctcccttccagcccttctctctgtcttggcccaaatcagcccacagtcaaaccgcgtcgtcttcctcctcctctcctgggcgccgctggattgagcgccaacgcccacagccaacgccgtgccgtgtccatctaccgccgcccacaactctctgccgccgccgtcgtcttgccttagacgctaagaaatcgccgcccaacgtcagcgccacctcatgccactgacgtcagccgccgaaccgaaccgacatgcccagccaatcaccgaacgaagccggcgccgctttcttccgctccactccaccggcgccgtgtttcccttctccctctcctttgcaaaccgacctcctcc

SEQ ID NO: 4035 - DNA, 1501 bp, Oryza sativa
  unsure (1)..(1501): unsure at all n locations
tttaaaaaatcccaaaattcaaacggaaggctataagtttaccaacaaagatgtcaggaaaattttaaacacaaactataattgtacactagaagcttcagcaatttatgcagacactactaaaaaaacgtgtttgggtgccggttggcaaccanccatatgtgctggatttcccaaccagcacccaacaaacggcaccttcgagtctcctcaaaggtgatggtttaaaaaccaacacatttaaggttcccggaatgaaaaaataaacggctcaatgcactggctcaaatcgagccgatgcaccaagtgctccaccctgcttcgcccccgaaatcgcaccccccccaaaaaaaataaaaaataaaaaatcaatcatcaacaacacaacacacaacatcatctaaaaacgaagacacaacaacatcatctaaaaagcaagcccctgccgctgcctcggctggatctgttcgcgggagccaccgccagatccgccgcgggagaagcttgggacggagggggaggagagggggtagaggatcactggatctgcccagcggaaacgccactgccttcacctccgccggatccggccacgggagcaccgatgccgccgccgctgtcgctggataagcttggtggcaaagggatgggagagggagtagaggaccgccggatccacccgtcgaaaatgccattgttgcgtcctccaccggatccgcccatgtgagccgccgacgccaccgccaccaccggatcggctgcgggaggagcttgggggcggagggggactgggagggggtagaggacagccagatccggacagtgggagccgtcgacgccatcgcttccatcagatgtaccgccggtgagggatgtgagagggaaaggaggcggggaccagagagagagaggaggggatggcgggtgggggacagtgacagagataaaaagaggcgcgggtatatgggtggatataaggataaggactgggaccgattggctcgtctcggatttttggtgttggattattaaaatccagtataatatattataggtgtcggttgttttaaaaaaaatggcactatagtatttatgtcggtcctttttttttcaccctgcaggaatagaaaaagtctataggtgccagttttagatattccggtatttatagtgatgtatatactttatgtgtttatgtagtagtgagacttaggggtcaaaatttaccaaccgggactaaagatggatctcaaccgggactaaagatgggcatctttagtcccggattgctactcccggttggaaacccgggactaaagggggttcccaaccgggagtaaaaaaggtttctccaccagtggtagtgtgaaactggaatactgaaacaattgaaacttcaggatataactgcggtttcgtactatagtctatatatgattaagaatcaatccatatgttaggatacacgtgtgtgtatatatatatatatatatatacatat

SEQ ID NO: 4036 - DNA, 1501 bp, Oryza sativa
actcactcttagctcctaagagcaatgtcaatagtgtcacccgctaatggctgtaaaaatgactacatcagtctcttatagatattactaaaagctaatatatataataagtagatttacattgactattatttatttttttaatctttagctagcttccccatctaattttttaattttattgccgttgtttcgtccaaccattactgaatcgtgtcagctcgcgtggacccacaatcgcatgtcccaatcaaagctagcctggtgttgctacacttgcgttgggacgtgtgagtagccggtgataatttagtcgcagactcacgctctctctcctgtctagctcattgacaaatccgatgtggcagttttattgctggctaaacaggtttattatactttctctaatgcatataatcgtaggttgcccatggtacatgtaggtactaggtctaattaatatctaacaacacaaattctaattaatacctaacaataccgataccgatggatactagcatatctatatgtaccaggcgtgacacatatgggtatatccgatactcagctaccaagtctgaaactgatatatactgtaatggtacctacgataccaaacataattcatatgggtattatatttgaaacacgtgggtatcatgtttgatacctatatatactatatatgatatctatcagtatcagacatggtatatataggtatcaagtataatacttaccaaccttgatacaataatactataagataataggtctgactaagtatcaagtatgatacaagataatattagagacgataatatgggtatctggtccaatatcttcgatgttacattattatcatctatgcaccgtatggtctctgtgctctaggaagagattttaaattaattaaactaaaaatagtaaatagaacaaacaagtgtttcccttgttttgtgcacccgacagaatttatttgtagcaattgagctcatatatagctcactagctcaatggacacaagccaaaaggcccagagttataaaatccatctattaatctaatgaactaactaaaaaattcacactcacagtctaaaattttctcagattaatcgaagaaaggaaaaaaaaagggtttgagtaggtacacaattcaaagcatctgaaattcggagtaaaaaataaaaacaagagtcaacctggaaatacacactgcaggaaaacccttcattagtcccggtttgcaacccctttcgtcccgggttgcaatccgggactaacgatgctagcgccaatgttttttttctttttttattgtttatttgctgcttgcattttgattttcccaaatcgagttgctccctacgtatccctaaatcaaagtaacaacatctcaaatcatatatttacatcacaaattctcaaaaaaaaatcacgaattctaaaagaaatacattacagatccaatgaaagacaaattctaaaaaaaaaagaaa

SEQ ID NO: 4037 - DNA, 1501 bp, Oryza sativa
cctccgcacggcccatcactctgtctctccacggcccatgtcctcgcctcctcccgcgtgctgcttgctcactcacagccaccatgcacttctttagtgtgttggccaatagaccaggcccaccctgcgcccgatagcggacgcgcggccgtcccctacctgcccaccgcccgttcgacgatgcgagtgtgtgtcggccaccgagccatgcacgaccacgtctcctcccacgcatgcaaggctccatcctaggggtagcaatgcagccacattcggcccccagaccttagggcaacacattcacatcagtggtgccggcgcattagcagccatctgtcttgccattctcccttctccgatgagctcccgttcccattccttcctccttcctctccttcccgaaaataccacaaccaaccatcactgtcccgagcctaatccccacccccaaataatcgccgctggcgaccaaaccccgccaccaccgaaccacttccccctcttgctgcctgccatcccccgtaccctcttatccaatccaaactgtccatcttcatcgtcgaccctccctcattccattatcgtgctctgtttcccctcccacgacgccgttcgctgtaaaaccgccagccgccatcggtcgtcgatacagtcctaggtcaacgcggacccagaccaccgatgcggcgtggttagccatgcgctgcctcactcactgttaacaacgaaattttgtatcagattcggagaagaaggaacaagatcgaagtggatttgatgaagaattgagttgagatcaaagttggaccgcgcattggctggcatcgttattgatggtcgttacaaaccaaattcgacggtcaatataactaaaataaaggagaattagctatgcttgcaatgcatatttgttttaaaataatatatttctatttgtacttggattctatctatctatagataaagagatacaaaatggaggagagccggcagcaaaacactcgaacaatcaatcagacgctgtcaagaattagacttgtggggaaatgggccagaaactcagaattgacatgatcaaataggcccataactcactgatttggattgaggagccaaagaggagatggcctgctgaacagggggcctgttgggccagcccatgttcagccgaaccataggcccccttagcaccgctggatgaagggttttgatctgacggtggggatttactcccaatggcagttggagggtattactaacctttccaactgccacaaccgttattcttcagctataaaagggcttcacctctaccactccttcacacactcaagcaagctcaattatctcttctacactttagtttagtattctagtgttaagtggagtagaatagaatagctcccggagtcatcggagtcttcggaggaattttggtatggttgtaatagctttccttctttcttttgtaagactttaacaattgatgaaatattcttat

SEQ ID NO: 4038 - DNA, 1501 bp, Oryza sativa
gacaagaagtataatgacactcttgtggatggggcatggttcccctagcttgggatgacgacttcttggaatggtgactatcgtcttgaaagcagatgtacaagtcaagcatgaagtacttgacagttgacatggatgataatcctaaacacctgattgatacaaaatggacgtaaagaacccaactactctacgatcgcagaggaatggagaacctggaacgaagtaagggccctttgaatcaaaaggatttatattaaaattttatattattcaaattttataaaaaaaaatattatttgacactatgatctaaaggattcaagctttacaaatcttataaaattcctatggaataactcattgcatgtagattttggaggaaacttagcaaaagctccgatctcttggaaaattttctgagcctatctctccgatccaattcttctgtttttccaaacgatcatttctatgtttttcctgtgttttgcaatcatctgttttacacttgtattcctatcagaatcctatattttttctattcctccgtttttttcaatcttatgatccaaaggctaatagttagagacttagaaggctagaatagagtgtagagacatggggcatgcattggtcataaactcataatgtaagagtaagactacgatgcaagatcttttagtgcatgactaactccgttgggcgtccaatagggttcgaggacgtcagcaagccgggcgtcgttggcaacaagttggagttagcttgaccacaagaatgaccgaatcgactccatggtgtggcggaggacggtgaggaagcggtgggaatgaggccagagaggtggagtttgtcgaatccttcgccacatccggcgccacctacggcggagtagcttggtgaaggtgcggaccaggttgaccgccttctgctattgctgatgcggcagcggatgtaccgcggtcgccatttgtacgtccatctagtggcctctcgtagctagcgggaggatttctcctcctcaacatccgaccgaaggggcaattccgtctcatcatcgggtggaggagcgaaaatctatttgggaatgaataaaacggcgaaaatgacaaagtgacagtaggcacacgcttcatgttgacattttatcgaatcgtgttctgagaataatattccaacgaaatcacgttttaagcgtgtccaaatgtccaattttttctcgacgacggtagcactgccctagagactgcccattttcgagctggaactggaagtggaggaattggctcgccctccccccttccccttgaacccccacccccgccgcgcctgcactccgctggtacgcccacgcccacggtctcgtctccccgaccaccacaatccctacccttttcaaaaagaggagagaggggatcggaggagaatttctccacttcacccccaacaagcatcccgaccaccaccaccccccgctaccccaggagagattcacccgcaa

SEQ ID NO: 4039 - DNA, 1501 bp, Oryza sativa
agcactcctccttctactaaggggtatctctgtccttgcggagatgagatccggccttcacaaacttctcccggccaaccacacgcagagcggtggctcgggagtgacacctagccgtctaggagtcctcaacctccaagagtaaaagacaccacacaactcttggtcaaaccctagtgctcaagatcgagtgaaacacacactaggccctcaaacaccaaatccacaaccacatggatccaccacacaaagaacgaggagggagaaagagctcaaagatccaaagcaccttagcaccaagctcaacccaaagtgaatgagaatgaatgagttgggtaaccctagaaaagggttaggtgaggggtatttatagattcccccaaaatgtggccgttgagagagaatcttttcatcccacctcggaaagtccaaggtgacatcagatagtccgatgttttgacccccaagcaagccacagatagagaacgaaattctggagaatttcgggcaatccgatcgatcggatagtccgatgtcatatcggatattccgttatttttgaagcaagaatttcatcctcttacagagactcaagttccattgaatttcggagtctctgggtcatcggatactctgatcacatcggataatctgatttcaaaatcactcaagaggaaaaaaacaattcaaaacagagagtgaagttctgagaaatttcagatagtccgatgtatcagacaatccgaccttatatcggatagtccgatattttttcgccaacactcagaccaaagacagagagcaaagttctatgaaatttcggatagtctgagcatcggatagtccgatcaggatcggatagtctcacaagaataaaacaagaacacttcaaacaaaggattttgagcactagtgttctaccaattatatgcatgtggtatccctcttaatagtacggcatcctaatactcaagaacacaagatatacatggattagaagacgattaccacaaaacatgctgcaatgcttttaaactcaagttccactcctttttatccttgcattcatctcaacaaaaagcattagtgaacctctaattgtgttgtcattaacaccaaaacaattgaggggtcctagatgcactttcagcagtgaagcttgaactgtaggcggagagggaggagtcggcgcttgagcaggagatgcgggtgatgacctcactagagttggggaaggtggactagtgttgacgcgaaaaacacacactagcctaggagatctgcttagctctagtgtaggtccaaaggttgatgagatgcgggcgtgccagtcagtttgatcctgcaactgacaagatatgtaaacaatagatcaaagagccgatcggttggcaagcaaatggagtgattccgaccgatgtcgatacaagccgatagcaatagggtttttgaactatcggctataattttgatgtagaatccgacacttgaagcaaatagc

SEQ ID NO: 4040 - DNA, 1501 bp, Oryza sativa
tttttatgtggttggcgcactgatcgatcgtctgggctgggtcaattttacaaaacggtcacctacagtttagtgccggtttttcctctagaaccggtacatatagtttttaaaggcacatgttttttatttttctcagcgtgtggcggtaaaaaacggcccttaggtgatggttttaaattaaggggcacctataagaccggtccctatgagggtttttatagcagtattaccttgtaagtggtggtcataagcaaatcaactagcctctcttgtgtcaagcttccacagactgagcggctcgatcggctcgtctccaccctactagatcaaatacgtaccatacatatgcaactattattaaatgtacttacagttattaagaggtggagtaatgtggaccgttgatcaagagaggggtaaggtatggaataaaaatatattgtaaccaatggtagaggagtaattaactagtgaaatattgccattatcgccgaattgaataccttgctccgttgatcggtactgtacgcttgtcgaaacaagatttcggcaatactaaaaggggtggctatcaagctggaaaagtggatgggtttagagacaaggaattttatacaggttcaggccttcttaatcaagaagtaataccctactcctgtccggggattgatccgccgagtgtattattgattatatgatatgggtgaaagtcgtgcccctagaggcacccggacccctccttatataggggaaggagtccgtattacaaaatacagtccatatccctaacggaatatgtagttacagataaaatacaatcgtaaccaactaggatctcggatatttccttgacatacaagtttagaatttaaccctagtccttttaaagacattctatctatacacggcaccccatacccagtcagactatacatgccgtgtaggtatggggtatccataaactccacagtagcccctgagacctttacagtcgacgaaacaatctcttctcgtagcacagaatgataatccgagtactccgacttcttctgccctgatctcccgagtaccaaaaatcaaagactgtgaaggtctaaaaatagaaaaaaccgggtgcatcgactagatgcacataattaggtgtagcccccgactacgtgattagttaaaaaactaaacatatagtcaagatgcaaactacattcaaccgagtggtttgacaaccgaatatcatatagtaaagcatatgcggcgttcaataaaacatccagccgactgcttttagctttaatataccaaaaatggagatatgaaaaggcctgagtgaaaaacactctaaagatccataaattcacacacttgataagaatccgagtaaaaactcttaaaaagatccatcaaacgtgatgtaaatgtgataacacaacaagtgatgagtctaaatagcctaggctatgactctcaccataaaaataagcatataacatgccgagtgaat

SEQ ID NO: 4041 - DNA, 1501 bp, Oryza sativa
ggcgagggccggatcggccaccgtgcataggcggcggcgtagaagaaaagaggatagagagagagagagtgatgaggacatcaacaccatcgatacatccccgcctccacaagctcaactcatcctcttctttataccacggagacgtgtgcactcttgttttactcaggaatgatggagaggatccaacggggagaggatttgcgtggggtggactcggactgcagcacagtgccaacttctgatggccgccacgacttcgtgcgaactctaatttgggcgtgcaattgcttcatggaaagcttatcaagtctagtttcaaatggaacaacccatgtccatatctgatttggagcggccataatcatcgttttactactgagtccttttctgtccacggtgctgcgtcacctcattgggcccaatgggctgtgtatcaagttgggcccattaggggcgcgttctagggttagagcacgaccccagcacccctgtggttgttctccccctcttcttatacctttagccgccgccaagaacaattgggttttgtttagatcaaagtacagcgtcgccagattagatcgctactttgccgagttaatcctgtgatcggttagatcgccagattgcttgttactgaaccccacttgtgctaagcctctacttccccggtttcgagcacttgtgcgcactagtgcttgggacgagcaatcctccgggactccgctcgcctgagtagggcgatcaaggttttcgggagcgcgtctacgcgcgactgctcttggcactgcattctcttcgtcaaggtcttcttcctctacatcacaatgtctagcaccggcaccgatgctactaaatgagaaggaaacaacgctactggacgaggctaaattgagaaggtcaaaatcaacggtggcaataccaataactcatcatcctctagaacattctctgggtatatcattattttcttcttagtgttaaacatgttcttagatgatactattactgtttttagcatgttcatgattagcactatcactagaccatttcgttattcacatgtcatatttattatcttgtttttatggattaaaatatgtcgaattataaccaatatttccaactgttcatagttggcttatagtgtactactatccttgctcttactcaaataaatagatgtcatctctcacagttaaataattttatctttcccaatcactacaaggaaaaaacctagaggtgtttaactaatactgtagaggcattttttttctaatgcctctttaacattgtaggggtattataaaatcacatgtggcttatataaatcgcctttacaaacagataggtattttataaaatgcctttattctctgtggcacttgtggttttgctatgactagttgagatgtatgttgaattagtctcttttccagtgtatcaaattctagaaattttcacttcttacattatcggaagagatcgaaagtta

SEQ ID NO: 4042 - DNA, 1501 bp, Oryza sativa
tccccctttgcagtatcatggtgatacttcggggcatggcgacatgtgtggaatcgtgtcttgtgggtacagttgtacacctctggccagagtaaaactattcgaatagccgtgcccacggttatgggcgatcaaccagattcaccgtgattagtctcacccctagtttagcttaatgaactggtgtagttcaagtggttggttgggccttttgcaacgtggtgtagcgttggacagtgtttggttaatattgattaattactacaactgttttactgctttcaactactgcttttaaatgctagctttatgcaaaagaacctctagcctcctttggttatatcctgcatcatacctcctcttccggtatgacttgctgagtacagtgggtagtactcagtcttgctctcttttcccccaccccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtaggtcaacaattgtcgtttgtgtaccctggctggtcctggacagggatttaatgcacattcagcttagaaattctggttcgagaatttctgggcgtgacaagttggtatcagagccgaccttgaccgtaggacaagccaactggaaaccctaagagccctctgaacccctttttcatctgcatatgcctttttgcacttggattttgttttggaaaaatttggagttttgcctctttggtttgcgggaaaaatcttggtcgttctttcggatcggatttttttttaaaaaaaaaattagctcagtctagggctttagaaaaattttagttggagtttattcgacagtcagtcgggaatttattgggggttatgcattaggtcgtgtctatattcgatgggggcaatgttgcgcatcattttccatgcaactagtctatgcattaatttattgtttagttgcattagtgtctttatttgggttcatgaaaaatgttctatgcataaaaatcatcatgttcagttattcgtttgagtcatttgttgcttcgtttaatttggatttgagcatgaattggttcctatcccttgtctactttagatgtcagtcctatccctcgtttgcaagcgccgccccgagcttcagagtcgccgcccttagctttatcgccttcttagtctatttgcttgctagttttcgtgtttaggtttgttgcttgtgggttagtcggcggtcgatatcatgtgtcagtggtatgactgcctcaattaggagttgcgtgcccctttttcagtgttttaatcaagattaagataattgcacttaaattcataagcaagattagtttctgagccccctgtttttcttccttttctcatatttctacctatccccttcaga

SEQ ID NO: 4043 - DNA, 1501 bp, Oryza sativa
tagtccttatatgatcggacattttaccccattctttttcaatgacattggtggagaaagcgtgtgtagtcccggttcgtaaccccctttagtcccggtttccaaaccgggactaccaatccgggactaaagatagatctttagtcccgggtgaaataaccgggactaaagctcgatctttagtcccggttggtaacaccaaccgggactaaagatcgagctgacctttttttttttttgcatggccctgttgctgcatggtttatatatatatatatatatatatataaaccatgcatatatatgtttcaatacatatatatgcatatatatatatatatatattatattatatttatatatgtttcaatacatatgtacatgcataatatatatgtatttatacatatatatgttatgcaaatgcatatgtatatatatatatatgaccaaaatatatatttacattatagaaaatgtgtacacatgcatatagaaacatagtcatgtattaattacaatccattatatgtcctatctagctacgatttcgatgtagtagtagtcgctatctcagaagctaaggacatatgaattgtatttccgtcgtagtagaattcacccttgggatcaaggatttgttcattgatgaatcccatgagttgttcttgaaccgccgcgataaattccttgtgtgtgatcaggttatccctcatgcgaataaactatatgaatgtatgaaattgattagtaattaaacaacaaatcgatacgtaatgaaattttgaatttatttgtacgtacatcgagctctcttgtggtgatgatttggtctacaaggcagtggcaatactcgcacacgtagtagccgcacaagttagttccctgcttttgctttgcgcactataaataaatgacaaacgacgagagatctaattaatgtacacttgtatgtatttgaatcggagaaatataaatgtagagtatgtgtactcacaggaaatttgaacttccgcctaagtctttctctccatttgccgcggaccaaatgacggagccgataccaagccctacatggagtttaaagctatgatttgtagtagcaattaactataacaagattcttaattaacataggaacttatgacagtacctgtctataagttcgaaaaccttgtcaaacgtagactctttttatccgttgagtcatatacgttgacggtgcaggcctccaggtcgaagagtaaaagcacccagttgaatcagcaatgtgcgtgggatgcattacatatgaaacacttagcatgttcgtacgagaatgaaatttggtatagaaagacagtaaaattaaactaactctgtgttgtacggcaacagtatgaacgtcttgtaatgctgcgccttcaggagatggatgagattaagatacgtactttctgtttctattgtagacatgggtcatcgtcgattcatgtatacatgggtcatcgccttcaacagt

SEQ ID NO: 4044 - DNA, 1501 bp, Oryza sativa
ttccgacatccgatcaaacatatgatgtgacaccgaaaaattttcttttcatcgacgtttgaaaaaggatgtactctctgaaggagagagaaagagagggggggaggcaactatgctctatttttttcccaaaagaaactgtacgctgtttttcgtgaggtacacagtagcaggtaaatactttacttacgaacttgtgcatcacgtgtattgatttggattgtcttatcagccgctacatccatcttaaaatgtactagctatttgtagcataataccttgttccaaaataaaattatttctccacctatctcatcttctcaaccaatcacaaccattctctttcatatactttttcttcttaaccaatcacacacttcctcaaaaacattcacacatatttttttaatatacgtgccaaaaaaatacttacattttagcacaaaggtagtacttcattagagattatcaacatggatgatttgctctatatatttataagaatatgttttcttgaaaatacattcttttacttatattacttattatgcaccttttggcaaggcttatagaatgagctacttcatcgattttcgtgtgaacgttttccgaatcattaaacggttcgtattttataaaataagtttcatatagaagtacttaaaaatctagtttacacaatttttgatatttgtagtagtagctaatagagttaatacttagggtatgttcggaacccctggttcccagcactaagtgctcgcacggaaaacagagtagcgattagcaggtgattaattaagtatttgctatttttttcaaaaatatattaatttgattttttaagcaactttcgtatagaaactttttgcaaaaaacacaccgtttagcagtttaaaaagcgtgcacgcgaaaaacgagggagatgggttggtaggaggggctgccgaacacagccttaattagttattcatgttttgtgtgcccacgctaagcttaagcccagcctcacattcgaacggtgatatatatccttataatatgtatgtttgtaataaggtagtatctgttaaatagattttttaaaactctggtatataattagtactccctctaccctaattgtaagccttatattttttaatatggtcttgaataacatattttgaccaatattttattttattatatgatcccaacaaatataaaattagcatcatatgaaagtattttaaaatataatagtgatataatatacataatatttatttaagtataaatatagttagtatgattattaattaaaagctatcgagtttaatttttctttaaaagtaggcgccctgtagattgagatggagggagtaactttatcatacggctcttatcctagcttgctgtcgtgcaccaaagccaatgacaggttgactttccgttgaaacatgacaccgatctagtcccagggtgacattgaccttaggctccatgtgtccatgtcatt

SEQ ID NO: 4045 - DNA, 1501 bp, Oryza sativa
ttttactttttaaaagttctgaacctttaaaagttggacttatagtttcattttttataatttttagaagtcctatcaaacgatgccactatgcccctctacagcatgttcgccgcctacttctttattgttattgtgattctaaaaatcgaacataactatcgttggaatttattttttattttctagaagtcccgtcaaccgtcggtggctctgaaactatactcttatacaccccgcccgctgcttctcctttttattgtcattgagattttaaaaatcgaatacaattatcaatgcggtttgtttttttactgtctaagaagtctcggcaaccgccttactcgtttgcttcacggcctgcctgacgtctctcctttttaatcgtcattaggattctatttgatgttttattaacaatttttatatgtcgtatcaaccgccaccactccactcctttataggcctcttacttaatttatctcgtcatatgttttagatggtcttttctttcaataatatttatttttatcaaaaattttagttatttataaattgtattcctaattgaaatcttatttttctttttctaatttcagtattttttttaaaaaaatagttaataccaatatgttcttttaatgtttttattttttattttaaatttcagttgtttcaaaattatattcctaattgaactctcttttagtttttccaattttagatattatttttatttttattctaaattttaattaatctcgtattgggttcttacgtggattcttcgttcaatattgcttatttttaatttcgaatttaaactaattttaaattgtattcctacttgaactctatttattttcttttgctaattttggatttattttatttttattccaaattttgattaatctcgtattgggttcttatatggactcttctttcaatattgcttatttttaattccgaatttcaactatttttaaactgtattcctacttggactctcctttccttttataattttggattttattttatttttatttcaaattttgattaatctcgtattaggttgttatatggaaacttctttcaatattgcttagttttaattccgaatttcagctatttttagattgtatttctacttggactctccttttctttttttttctttttctccgattgatgtgggaattttttgcccccacagcgaacgtggtgcctcctttcaaagctgttttaataactatttttagattgtatttctacttggactctcattttctttttttttctctgattaatgtgggaattattagcccccaaaagcgaacgtggtgcctcctttcaaagctgttttaataatagaatagatagatagatgtgtaatgtgtcctctcagcctatttttcagaagaaaaaaaacatcctatccggtctgactaaccctggttcttctgctggtttatatgcttaagtggtcttaaccagt

SEQ ID NO: 4046 - DNA, 1501 bp, Oryza sativa
accagggttagtcagaccggataggatgttttttttcttctgaaaaataggctgagaggacacattacacatctatctatctattctattattaaaacagctttgaaaggaggcaccacgttcgcttttgggggctaataattcccacattaatcagagaaaaaaaaagaaaatgagagtccaagtagaaatacaatctaaaaatagttattaaaacagctttgaaaggaggcaccacgttcgctgtgggggcaaaaaattcccacatcaatcggagaaaaagaaaaaaaaagaaaaggagagtccaagtagaaatacaatctaaaaatagctgaaattcggaattaaaactaagcaatattgaaagaagtttccatataacaacctaatacgagattaatcaaaatttgaaataaaaataaaataaaatccaaaattataaaaggaaaggagagtccaagtaggaatacagtttaaaaatagttgaaattcggaattaaaaataagcaatattgaaagaagagtccatataagaacccaatacgagattaatcaaaatttggaataaaaataaaataaatccaaaattagcaaaagaaaataaatagagttcaagtaggaatacaatttaaaattagtttaaattcgaaattaaaaataagcaatattgaacgaagaatccacgtaagaacccaatacgagattaattaaaatttagaataaaaataaaaataatatctaaaattggaaaaactaaaagagagttcaattaggaatataattttgaaacaactgaaatttaaaataaaaaataaaaacattaaaagaacatattggtattaactatttttttaaaaaaaatactgaaattagaaaaagaaaaataagatttcaattaggaatacaatttataaataactaaaatttttgataaaaataaatattattgaaagaaaagaccatctaaaacatatgacgagataaattaagtaagaggcctataaaggagtggagtggtggcggttgatacgacatataaaaattgttaataaaacatcaaatagaatcctaatgacgattaaaaaggagagacgtcaggcaggccgtgaagcaaacgagtaaggcggttgccgagacttcttagacagtaaaaaaacaaaccgcattgataattgtattcgatttttaaaatctcaatgacaataaaaaggagaagcagcgggcggggtgtataagagtatagtttcagagccaccgacggttgacgggacttctagaaaataaaaaataaattccaacgatagttatgttcgatttttagaatcacaataacaataaagaagtaggcggcgaacatgctgtagaggggcatagtggcatcgtttgataggacttctaaaaattataaaaaatgaaactataagtccaacttttaaaggttcagaacttttaaaaagtaaaaaaaaaacaatgataatcatgttcgattttaaaatctcaa

SEQ ID NO: 4047 - DNA, 1458 bp, Oryza sativa
aaaataagcaatattgaaagaagtttccatataagaacccaatacgagattaatcaaaattcgaaataaaaataaaataaaatccaaaattagggaaaaaaaagagagtccaagtagaaatacaatttaaaaataggtgaaattcagaattaaaaataagtaacgttgaaagaagtttccatgtaacaacccaatacgagattaatcaaaattcgaaataaaaataaaataaaatccgaaattagaaaaggaaaggggagtccaagtaggaatacaatttaaaaatagctgaaattcagaattaaaaataagtaatattgaaagaagtttccatataagaacccaatacgagattaatcaaaattcaaaataaaaataaaataaaatctaaaattagaaaaggaaatgagagtccaagtaggaatacaatttaaaaatagatgaaattaggtattaacaataaggaatattaaaagaagagttcatataagaacccaatacgagattaattaaaatttggaataaaaataaataaatccaaaattagcaaaagaaaataaaataagagttcaagtaggaatacaatttaaaattagtttaaattcgaaattaaaaataagcaatattgaacgaagaatccacgtaagaacccaatacgagattaattaaaatttagaataaaaataaaaataatatctaaaattggaaaaactaaaagagagttcaattaggaatataatttcgaaacaactgaaatttaaaataaaaaataaaaacattaaaagaacatattggtattaactatttttttaaaaagaatactgaaattagaaaaagaaaaataagatttcaattaggaatacaatttataaataactaaaatttttgataaaaataaatattattgaaagaaaagaccatctaaaacatatgacgagataaattaagtaagaggcctataaaggagtggagtggtggcggttgatacgacatataaaaattgttaataaaacatcaaatagaatcctaatgacgattaaaaaggagagacgtcaggcaggccgtgaagcaaacgagtaaggcggttgccgagacttcttagacagtaaaaaaacaaaccgcattgataattgtattcgatttttaaaatctcaatgacaataaaaaggagaagcagcgggcggggtgtataagagtatagtttcagagccaccgacggttgacgggacttctagaaaataaaaaataaattccaacgatagttatgttcgatttttagaatcacaataacaataaagaagtaggcggcgaacatgctgtagaggggcatagtggcatcgtttgataggacttctaaaaattataaaaaatgaaactataagtccaacttttaaaggttcagaacttttaaaaagtaaaaaaaaacaatgataatcatgttcgattttaaaatctcaa

SEQ ID NO: 4048 - DNA, 412 bp, Oryza sativa
ccacggggccgagtcacctgcggggacccgaccctacgagggcgagggtgggttaagtttctgacccgcgggggaggcaggggcggggctccgcatttttgcggggaggggacgggggagacagttcacccgcgagtgacccgcgaggccccggggggtgtatattaaccctttaaatgtagctcataggaggcccaaaagagcccaacccaataaaatagagataaaatgaaaaggaaccctagccttatcctcaccagtgtcttcccaactcccctcccggctcccgtacgcatcacccacaggcggaggcggcgctaggggcaagggcacacgagcacacggcgcacttctctggatctcgccggcaccggtcgccctctcccctcccctccagccttccgagtcctgt

SEQ ID NO: 4049 - DNA, 1501 bp, Oryza sativa
taatcaaattaatcattgttttgataatttaccttgaaggttactaccgctatattgttgtgttaatccaagttgattaatataataaagcatatagatcattagctatttataaagaataatcgatcttaaagattatgcgatcaagaaaatcgtgtgttgtactttttttcccttagtgagtttttacttgaatatttctcacgcaaggttttttaacgaggcaacaagtgcaatataattagcgtggatgatgtactcttttctcctatcctttcctcccactgggtttttgaatggagtttttaatgagatatgtgtatagcgcggtattcgcccagggggagtgttatgaaactattatcttctgccagagataaatataggctcataccaaatatatagaaacgtatcctaacaggactcttcctattatgggtatatatacagagagagagagggcttgagaggttggttgatgtatacacatatgagaaatcaataaagttgtgatgcctctccctatatccatgttcattgtttatctactatatgattgtgtgcatgagatcatcgttttctactccgatcagcgaatagaccactggttatttaacactttaattctgctgttgctatatttttgcctccgacgttgctgaccgatctgatctagccgatcgaatccgatcgcgctagtacgtgataaacgaattgactagaggaatagaaaaaccaatcagaggcaatatcctttcgatctactacacatggttacctagtaaaaaataaatcaaagcagattcaattgcatcggctgttctgggaagctttagattaattctcaattttttgctaagtccacatggttgattaccaaaagaccaaacattcctggccatcgtttcgctgtggaataagcgaaatgacatatttgcaaacgaaaagtaatttttaaataaaacttttatatacgtcttcttagcgatctaaaagcaaacgctgaaaaataaacttcgataaaaaaaaactttaaaatcagctctaaatttaatattgaaaatttaaattttagttgataagcataagcataagcgaaaagatgaccccattattgctaggtgcacttgccgattataataagtaactcaaaaccgtatattaatatatttggttaattaaaatattccgactatgattcctatactctcctctctttactgagaaacgcgaactaaaaaaagtgaaataggggtaccccataggtatttgatcttgcttcctgccccccttttttcatggaaaaaggaaagatgaatttctccattcattgaaccctagttcgggactgacggggctcgaacccacagcttccgccttgacagggcggtgctctgaccaattgaactacaatccccgcggggcgtatggcatacttattcttaaatggaaccataagaataagaatattcgcctgtcctactctaagaaatagacgaat

SEQ ID NO: 4050 - DNA, 1446 bp, Oryza sativa
cttcctcctcgagtctgcacttggcgagattagacatagtgctagatccctcttgttggcctccgtagacatcatattgggtttgtctagacttatctctaatatcgatatccggtggcttgccttggcgtgtgttggcttgtgtattggtctatgttgatcttggtcttgtggaatgttccctctccttctagtgttctatttatacccataggtgtttccttgtccaagtagaactagatagaacaatatgaatataatccggataaccccgacacccatcttttcccgttgttttctttacgagccgaacaacagcaggccacaacgctttggctgcgccacctagcttcctcccctcaactccgactataggctggacgttggcttcaatccccatcaccaccggccttcgcggcgcagcctcctcgatgccgatgacagtgctgcccagcttccttagcaccacacaacctttttctcctcctttctgactccggcgccaagctcgctgccgtcaacctccagcacgacatccactccacgccggacgccagcctcaatcccatcaccgtcgacctccacgcgcggcctcctcgacgtcgctgactgcgccgtccagtctcctcgatgcctcctccacatgtttttcaagttcttcaggtcagttcattcgttgacgcaagcacctccagttcagtccgttcttcactgatagtgtttgattgcctcgttccaacgcgaagaaaaccaaaaaaagggtcggagtggattgattcttccccgtgcttttcccatggaattaacagtgtaggaaatcttcctgcgattttcctttgattggtttttgtggtctgaatggtaggaaaaggaaaaaaaaaatctatcaatagtattccttcaaaaatctcatgaaactattgtaatctgaatgagtccaacgacatatagccgattgttcaaaaccctatcaacatcggatggtatcggcatcagctagcattgctatatcggcttattggcccatcgactatttgatcttcaatttatgcatcttatcagttgtaggatcaaagtgacttaaacaaaacaagactaaaacactaagtaaaggacctaaacattacataaaaagcacctaaatatgtgcgtcatgatttaacttgaaattaaagacttgaacatgtcaatttagagtatgtatggccaagaagtgaacatccgaagttatattctgtttaagtggatattttcgtattgttaaattatttttgcaactatacaattatgcgtaaaaccacgtgcacaaacacgtgaatgtacactggaggaagacgacaaccgacatcggcagcacgggaccggaggtcaccgacacacagtggcacgacagcgtagtaagatgaggacaataggagggagagattagaaagcggatcctcacca

SEQ ID NO: 4051 - DNA, 1501 bp, Oryza sativa
tggcagaagataatagtttcataacactccccctgggcgaataccgcgctatacacatatctcattaaaaactccattcaaaaacccagtgggaggaaaggataggagaaaagagtacatcatccacgctaattatattgcacttgttgcctcgttaaaaaaccttgcgtgagaaatattcaagtaaaaactcactaagggaaaaaaagtacaacacacgattttcttgatcgcataatctttaagatcgattattctttataaatagctaatgatctatatgctttattatattaatcaacttggattaacacaacaatatagcggtagtaaccttcaaggtaaattatcaaaacaatgattaatttgattaattcttggtaaatcaaatttaagacttccaagtcttaagtatgataatcaatgtttagcatatatgctccccctcaataagacatccgttgaaacttccatgttccaatgtcataaccacatttttattaatgtgtaaaacaatgataataaaattaccacaatgtttaatctttcgtttacttatttcataagttctactatgaacatgagaaataaatcaacgtataggagcaatatgtataaccacttattcaaatgtgcaatacaaacaaagtttaatccttacggaggattatgggaaaataagttgcaacgatacacatatgcggtatgtataaactgcatatcatttatttattcatgccttttgccagcgatatatatagcggaatttaatacatttatagcaggagaatatcagtcttttccatgaccaaatgaatcgtcgcttttcaccacttcatttcctattaagtctaaacttccatgttcacatagacttatttagcgactatggttcaatctcattgctttcttcaatagacccaatatgagtgctactatgcaactctaccatggactttggttccggatccggattctcattaattagagaaatattagcaatcatagaagcgatgttgtcgacaactattcttttctccacatactcattccttgaggttaattcattataaaccatatcttagtcatttcccaaacataagatgtatggttgtccgcatcccagaattagatagatgtgtgcactttaattccgggttttcatcttcatgatgaacctcttcatgaggcaattcaccttcatggtgattactctacaagagttgtaaggagttattaatgggtacattaacaatagtcgttagatcttagaatccgcatgcatccccgtagattttagaacattgactaacatgtcactctgcatttgtggatatactattcaaaacccggggtataccactggtagcagaaagtttactacaagtaaacataacttctgattactcctttaattcataattatctggcaagctcccgcttctggcttacaggagaataaactaaaccttcgagtttagtttggtttgtgcgttattct

SEQ ID NO: 4052 - DNA, 1501 bp, Oryza sativa
acaaaagagaaagggctcctataacttgatcgacaggacccaaccaactaaactattgattttggcaaagctagaccttttgaggaaaacagatacagataacgaaaggaagctattagtttttcttgtactcgactcggcttttctttactgaccgcttgcgtaaggaaagttgacaataggaaaaccaggtgagaagttttagagctagcgtgccctacttcaataaggtattacctcgccgagggggtaggattggattcattcacttgcattcctgctagcactacaaaaagctccggtcttaacgcccttacggaagcagtgcagcctttcctcgggttcgtagagtcgggtttcccgtttacccacaacggaggagctgcccccaccaaccaaagcaggtaggcggccacggttcataacgcttggtcccacgctgactcagccaccacatagaccaaaacctgggtcaaaaccaccgaaagatctcgggtgaccggttctgtatagttaagggaccctatatatctggttttgcggttcgaggacgttttttatctcactgacaagttgagagatattgggtgtactttttcctaaatcaacatttcatgagggaaaaagtacaccgaaggtccctcaacttatcatccagttacaaaatcatcccccaaccgcaaaaccggatataacgcatctccaaacttacaaaaccagtacaaattaggtccctcagtggttttgaccttggttttgtccgatgtggctgctgagtcagcgtgggacccacgtggactccacatgttagtatgccacgtcagcaggtacctgtttcccctcctctcccttcctcctctctctctctcacactcttctctctgggaaggccggccaacggtgcggaggaggtcgccgggcgaggaggtccgacggccggccggcgatgcggcggcggcggcgacgcggcggcggagacacgggagaaggggaggcggcggcggcaggcgtgcgcacctcctcgagctgctcctcctcctccccggctactcccacgacgccgactacctcaccgcccttcccaatccctatctcatcgccgagctatccacctacgggtccgtcgccgatgctgtcctccgggccccgccaccttcctccgccccgcagcctcgccaccctcagtctgcccgacgcggtggaggtggtctgcgtgctgaaacaggtggaggagaggcggctgtcctgcatacttgcattattttttacggtaaatctccctgagctcccatctgaacctgacaccgaaatggcatcaaagctgttggaattgtgaaggtgatcgacaggcccacgcatgtttcttctcgctgtaaacctcatcccaggaggtttgtttgtcaccaatccatcctgtaaaagagatcaccacaaaaacagaggaaagtcagatcctacatccattgttcagttccataatctcacccttatcaagcaaaaa

SEQ ID NO: 4053 - DNA, 1501 bp, Oryza sativa
caggtaggcggccacggttcataacgcttggtcccacgctgactcagccaccacatagaccaaaacctgggtcaaaaccaccgaaagatctcgggtgaccggttctgtatagttaagggaccctatatatctggttttgcggttcgaggacgttttttatctcactgacaagttgagagatattgggtgtactttttcctaaatcaacatttcatgagggaaaaagtacaccgaaggtccctcaacttatcatccagttacaaaatcatcccccaaccgcaaaaccggatataacgcatctccaaacttacaaaaccagtacaaattaggtccctcagtggttttgaccttggttttgtccgatgtggctgctgagtcagcgtgggacccacgtggactccacatgttagtatgccacgtcagcaggtacctgtttcccctcctctcccttcctcctctctctctctcacactcttctctctgggaaggccggccaacggtgcggaggaggtcgccgggcgaggaggtccgacggccggccggcgatgcggcggcggcggcgacgcggcggcggagacacgggagaaggggaggcggcggcggcaggcgtgcgcacctcctcgagctgctcctcctcctccccggctactcccacgacgccgactacctcaccgcccttcccaatccctatctcatcgccgagctatccacctacgggtccgtcgccgatgctgtcctccgggccccgccaccttcctccgccccgcagcctcgccaccctcagtctgcccgacgcggtggaggtggtctgcgtgctgaaacaggtggaggagaggcggctgtcctgcatacttgcattattttttacggtaaatctccctgagctcccatctgaacctgacaccgaaatggcatcaaagctgttggaattgtgaaggtgatcgacaggcccacgcatgtttcttctcgctgtaaacctcatcccaggaggtttgtttgtcaccaatccatcctgtaaaagagatcaccacaaaaacagaggaaagtcagatcctacatccattgttcagttccataatctcacccttatcaagcaaaaatgaaacaatatgattcaagttcagcaagagaaattctgatcccaaacagttcggcacaaaaaaattctgatctcaaacaaaaaatatcacacagcaacacaaaaagaatgacacagtacgattcaagtttagcaagagaaattctgatctcgaacagttcagcatgaaaattgctgatctaaaaaaaaaaaacatgacacagcaacaaaaacttcccaaatgatcaatcacaaaaatgtaagctccctttcccctatatttctttagcaatcttctttgcatgccaaaagccttctttcttatccatcaccaaaacgaaacaaagcaatgcaatgatgatgcactgaaaagaaaaggctctcaacaacccggagcaggtgctgcgcaggatggagcaggag

SEQ ID NO: 4054 - DNA, 746 bp, Oryza sativa
cagaagagagctcccccggatactagctgatgctgagcggcatagtggtgtgcactgctggtggcagtttaagttttctttgtttctcgatgcaaatggcacatgcacttcaccacgtcttctgcatttcatgactgtttctaaccggaagaaattttataagtgccatgtcttgactgacgatcatagtgactgaatttgctaaccaactgagaaaattcagaagagggcagtacaactctacgagtacactagtacactgctgcttaggtcaaagtaagacgtgattcaactgagaaattcgatttggctcggccaactggttgcaaaactcaggtctcatatgttggttcagatgcaaactgatgggttgtctgggatcagattctcaggatcctcgtttttatttttccacaagtactagcgtgtacgattaacctatcatcctgaattactgatgagcactagtagaaaacctactggcattgtagccagggccggtcctatgattttgagggtcctaggcgaattcatcacgatgggtcctctaagctatataaaaaattttatgatatatatagacactaattaattttacttgcaaaacaaatacatccatatattaaatcttaacatgtctggtaattatcgaaaaataaagttgatcaaatttgtaccttggaactaatatcactaccttaatgaagaatagaatcgcatcatatccattatttctcatgaaaaga

SEQ ID NO: 4055 - DNA, 1501 bp, Oryza sativa
ttccccgtgatcccgtcttcctttccccccatttttccctctctctctcgcattcaaacggacggatttgcccccgcaaatctcgccggcgccattgatggcggccggacctcccgcgcctattccttcccctccggccgccctctcccccttccaaccctatataaaccctccccgtgcctcctccgtccgtttccgcctctcgccgcccttcctcctcgccggattcgagctcgcgacgtcgccctctctctccaccgttgccgccgagctccggtccgccgccgtcgccgccccggaccgtctcccgccccggcgtctcctcctccggcttcgccgcaccgccggcgaccccgtccaccccctcgccgagtccgccaaccgccggaacgccgaccctgtcgacccgagccgcgccggcgccttcctccgctccggccgcctttttcgtcgtcgccgtcgacctagggtgagccgtggaccgccgcctcttttcccccattccttcccctctctcggccgccgctccgccgtgcctatggccgccgccggtgaccatcggggcgcgggcgccgccgccacccgccggccgcgccgccgtggccgccttcgggcgcaccgagcggctgacgcgtggggcccacggcgccggccggtgcgagcccaggtgcgcccggtccaccgtggaccgtgaggctgccgcgtgggccccactcccgtggacccggtccgcgcgccccctccccctcggctgacgcaataaactttttttttaaattaaaatttaaatgaagaaattcgtaaatattcacttaaagagcatataaacttcaaatagccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaggttgaagccgacgtttgggaaagcgagcaaggcaagtcacatcatccttgaacatattgaatcccagtttataaaattatgttgctttaaattattgcattatcgctttatttaaattcccgcgttatcactgttttatctagccatgcctatttagctttgttatgaccttattattgttattgttattatttccttgttcaccctagaataaacaaaaccccaactagtggacactctactcatggtaccactagtatgattttaggtagatgcttcgctatttaattaggtaacattaggtggttttacaactctagactttgggatattctcatcacctggacactatggaattgttggattattgtggaattggattcacaccgctccttctattcaaaatccccaaaatggttttaggctgggctcggggtgcatggttttgatagtagcacctcggccatataaggaccggt

SEQ ID NO: 4056 - DNA, 1501 bp, Oryza sativa
ttgaacaggttgcacaacttgttgcctgggtggtgtttgttgaatcagctgctgctgagttggatcaaccgtattccaagtaggtaaatatatagatgcaacctgatcctgcgttagctgggtcacatttggtccagcatggtgtggttgctctcttaccaacaattgaggattgatcaattggcccagagctaaaagttgcgcagcaaacgtgggagccgatgctggtgtcgtcggctgcggtggcgacggaatgggaggagctgcctgaatagacggctgagcatcagtgatcaaaggccgataatttgggaagacacctccttgtaaatacactgggcctgcagcctgatgctcagctattgaaccatcggctattgacttcatcatatttgacaaagtgttaaccaacaccccggactgatcgatcaaagcattgtgaacagcatagtcaacccggtcttggaaattgttaaaaaagtcttgtgccacttcactattctgattaagattccctccttgtggcccctgagcaccgtcactctgaactccatgaactccttgagacatgtcaccttgatttcctaaagagccatcggtagcacctttgatactcggctgagctgagccgtctggagcttgttttccttctccatctttagaagaaccggtcccaggatcatcagcaaccactcctatcttgtacttttgaacaagtgtccccttgcgggtctgcataaatgagttcaaaaactgatcccgtgtttgctgcaacgttgcttcaaactctttcttctgttcgggtgtgaacttttctggatcgattggcatgacgttcttttcaatgatgtcatccaatcccgactttgacgccttgtttttagcagaacctgggctagatggtggtggaggttgtttctcggccatgagggagaggttgtctgacttcttgagtgtcctaccgggcgtgccaaaagcgtgttgacagaaaacacgagacctgggagatctgcttaactccagtgcaggtccaaagctcgccttcgaatgtataagcgtgccagttgatttgatcctacaatcaacaagaaacaaagacaaacaaaccgtagttaaatctataaatgatagccgatcggctgtttgccaatgacatatcatttatctctgagccgatgtcgtatgtgaatcgatcggcgatcatcaataagtaacaaaacaccaaatctactagatcggctgtagatatcaataatatataatctttatatcaatatacacttaaatcaagtgattggagtagatcggtcaccataccgagacagtataaatcacttaaatcaaaatatatattaataacgagattatatatatgtttgtagcatggctgatcaaatagatctagcatgtatcggctaatactccgatactgctttatattaagatattgaagcagataaaatactcaagcagatgcttaatatacttagatgtgacaaga

SEQ ID NO: 4057 - DNA, 472 bp, Oryza sativa
attcaatatgttcaaggatgatgtgacttgccttgctcgctttcccaaccgtcggcttcaacttccacgaagagtggatcttccgaaggtgcagcgtctacacgatcaacggaaaagaaaaggcttttactctaataaactccatataacaagcaggaacaaagcacaaaaatgggttcttgacttcttaaggaaaaattagagacttgaacggtccaattccgagttcaaatggccaagttatggctatttgaagtttatatgctctttaagtgaatatttacgaatttcttcatttaaattttaatttaaaaaaaaagtttattgcgtcagccgagggggagggggcgcgcggaccgggtccacgggagtggggcccacgcggcagcctcacggtccacggtggaccgggcgcacctgggctcgcaccggccggcgccgtgagcgccacgcgtcagccgctcggtgcgcc

SEQ ID NO: 4058 - DNA, 1501 bp, Oryza sativa
tcattctccttataacttttaaaaattagagctaatagtttttagagtttattgtctcgttagatttcatttttatgatttttagaagttccctcgaacgctgacatgtcccgtgctcattagcgtcaatgttaaatatagtgcacatcattaatttttttacaatataataaataaatgatacagtaaaaaagtttttgcaaatgagttcataattcttgtatctctctctatcccttgccctccctccccacgctgtcagccgattaatccctcaccacgccattggttaggcatcaccacccacgctgtcagtcctctaacccttttttgagaggagttttggtgattaatgacaacggttgttggaactaatctttgctgtgagtttgtccaggcatcaagcaataaggttgatggctcatatgtaaggatcaactgataggattgtggatggatgacaagaaagatgatacctcacacattagaaatcaaagagagtcaaatgttgatatataatgagaatgcttggtgagatcccatcatgaattgatggacatgtttgtcacgcgccgattttctattgcaattaattaagataattaatgagggaattaaaatctcttttaaaaatcatggctacaaatatttttgtaatattattttccatgccctatagtactctctgaaatttctcatgaattttcagagctcaagaagtaattttaataaaacaaacttcatttaattaattaaataaaaagaaaacaaactaaaattctccttccttgttcttgggctgtttccggcccaagtctgcctttcctccctcagctcactcgctcatccttatctcttctctcacaggccgagcccctctcctctccctccgacagcccatgcctccttggcccgttcgcccccccctctccctcaaagtccacaccgcctccttcctctctccctatcgccgaaaggtgggaccgtgggcccgaggggcgctgatatgcgatcagccgcgcgcgcgcggttagtcgcccccctctagtctccctcatatgtactatatacatcatatgtatatactatatatacacacatacgtgtatatgtgtgtgtctatatatatatataggacactcatatggggcaccatggtatgaaatacacaaactaacctaaatttttcaaattgtgagtatatatctagttataagtattcgatttatacctatacctagaaacaaaacaactcaaatttaactttatttcacaatccaatattacatacctaactaattatatatttggatgctatatacctagaatcaaattctaataaaaacatgtttaaattcagttcaaacttgctttgaactagttagtaaagtagttaatgttaatacctaaacattttaaaaagttttatactcatttgaattgggtatatacacaatttgaatcatggagcccgggcaccatggagcaccaaacaaattta

SEQ ID NO: 4059 - DNA, 1501 bp, Oryza sativa
actacgtgcatcttgcatgctgatccgtgcatgcattgaacgtagagtggatcacacacccatacgcatgtgctttcttggttcatcggctggttgcaatctgcactagtgcatgtgcatgcgtcggcggcttgtacgcgaagcttgcgcgcgagcggcccaggcgccacatctccgtgcgtgactgcgtggacacagcaatctccggcacgagtgccggacgtgcaggcgcctgaccgcggtgcctcgcgcggcggcgcaggcggtagatcagcaagccgacggcggacatgcaaaacaatagatcaatctgtggttagatacgagatcatatagttgtaccgatacatatgcatatgcattagtgaattgaatttggataggtccatatgcgtgggcatgcatgttttgtgcttggcatatggctgctgcaactgcgatctgcgcatgtgtcagatggcttgggggctccagtgccgacgaccggcggggctgctgctccgggctgcctcggtgcgcggctacgtacagaggccatcgtctcggccgacggcagacacatgtataaacacaatagatcaatctaattattacgaaaacaaattgatctagtaaaaacgcttatcggatcagcggaacgagtgaactcgtgctgataacgtgttaaataactagtggcatattcgctgatccggagtagaaaacgacgatctcatgcacacaatcatatagtaaataaacaatgaacacagatatagagagaggcatcacagctttattgctttcttatatatagatacatcaaccaacctctcaagccctctctctctctcagtatatatacccataataggaagagtcttattagtatacgtttacatatatttggtatgagtctatatttatctctggcagaagataatagtttcgtaacataaacgaacctacgaaagcaatccgtcttcgatacacacggtgcttaatttggataacaggcaaaaagattcaatgatgaccagataacgtcgccgccgaataaattattcaagcgataaaacgaatgcagcagcaataatcactgaatcgttttcctctttaaagaggaccattaggttacagcagtaccatactcctaagtggccatgcttgaaaaaaccgatccccaaaaccgattgggttggaattaatagatagaccttattctatttaaaaattaattttacagaaaatcgaaaaagcccatctcataggataatatgcagagggagtttagtaacacattgcctattttccctgttcgtccacaatcgctcgcgtgctgcgcgccatacctgatcgtccacaatcgctcgcgtgccctcctcggtacatatttaacatgtttcgcatattcgatctgttcatgctttacagtctaatctatatttatagatcgtatgatatgattattctagtttacatatgcaatatcatgattatttatgaaataaattaaatcatt

SEQ ID NO: 4060 - DNA, 1501 bp, Oryza sativa
acttcttccaaaaattctttgctaactactccctcaattccattttaagtgcaaatattagatttcatgcacaactttaattattcgtcttatttaaaaaaaatatgattagtatttttattattattagatgataaaacacgaataatactttatgcgtgagttatgtttttatttttccaaaaaaattaaataagatggacgattaaaattgggcacggaaaatcatggctgcacttaaaatggaactgagggagtaactgctgtatgcacaataaattttaattttagatcgtgccaaaatctcctgacctttctcatgcaagttgttcctcctacgttatgagcctcactacagtcctccttactggtagtagaaactaatctgaaccattgatcttatttaatcaaaggattcagatgtatttatactactacccagttaggtcttgttcggtttggaggggatcgaagaagactggagggccttgtttggttaatccccatgagggagggattgtagtggatttattccacacctattgtggtgtggaattattcccctatcaatcccctccaattctcttcaatccctttcaaattgaacaaggccttattagtagtagaaacctggagggacattgttctcaaggcgccctccttgccctctcggtgttgccatcgtgctagtcgtgccattgtcggccctggtctcttgcactgacgacaatagtcgttcatgcagtcttcgcgtgcacgtttggtggctatgttcgtgtgcccttgtggccgccacattgttccgcatgcgtgcattcgtgtggcattcgtgtgaggcccgcttgtctcccacttgttacggttgacgcgtagggtctcactcagttctctccgtggatcatctctgggaacctggtccatggtaatctagctatttgatccatgggtctctgctgcagacctgcagtcgttcgattctctctctccttgagcgataatgcattacacataatataacggtataataataataataataataataataataataataattaaacaacttggaaatatccgctttaactgaattgcacctaaaattcggatgttcgtttctcggccatacgagctcctaattgatcggtttagattgtttaatttttttttcataacttcaagaatccgtttctgttgttttattttgttgttttaatgtattgttatcgtttctttcttagagttgtatagctctgttttgttgctcgtgtagttgtcgtcatttctgaagttcccaaggtgcatatcaagttgtcagaagacctgctcccttacttggattcaacacataatagctgaacaaggtggcaagaaagcaaaaggaaccagtctatcaatgcgcgtggtccatcaatatgttgaatttataagcacataatgatttaatttatttcataaataatcatgatattgcatatgtaaactagaataatcatatcat

SEQ ID NO: 4061 - DNA, 1501 bp, Oryza sativa
ccagagttcataaaatatccttttcaatccccctttgagtcaacatacccaacctttagaatttatcaatctaccaccaatcctgttcgtgtagaaattcccatctacatatacttccaagtccagatctatactcccacaaatatattcccttgaaatcccgttcctccaaattatccatttaagattccacagtctacttgggccaatattttcccgattgacccgactctttgttatatcccattaaccatttgtatccttggggttaaaccaatataactcccttcttgttgtaatttattttggatcagacctctatctaaacctatccccagaaacctttatttccttttaatcgatccaaaatatcctgtgatcaggttcctattttgatccatccaccaatttgattcctatgacttgatcacattcttggcacaagaataatattatcatgattgctcttgtgctaagaagaatatttttccctcttccaaattaatcccctattagccacaaatatttctccaaatcctccctaaaacctaggtatccaaatcttctttaaattcaaattctatccaaatctcctttaaatcctagccaaaccaaaccattcaaattccatccaaaaattagaaaaacatttatttcaatctgggccaaaatcccatcttttcttcccttcggcccattggcccagccgagccccgccccccgcccgaattttttttatttataattttttttattaaaagttttacaaaaataattttccattttgaaaattgacggaagtagtcgcctaccgccctctgggagggcgatttttaaaaatcgccctctcagagggcggcgaaaatgacgtggcagacggccgttcgctctcgggcgacggccgtcaacgaaatttgcaggcggcccccttgccgctctccgctagggcgattttgtactgtgcggggggccgcctgcaaatgggcggcggggggggcatggaattttgcaggcggcccccttgccgccctgggggagggcgatttttgcctctccctctataaagcccagtccctcctctgtgaaatttcattatattcactaaaaatccaaaaaaaacgaaagagagagaggggagggcagcagaaggggagcggcgaagccctgctggttcgctcaattcatcacaagtatgctcccatacatcttttgcatttgtactaatatgttatgtttgagtatatatgttgcgttttagttttagttccatatattttagcacatctgtagcacacagcacatatgtgtagatccagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaa

SEQ ID NO: 4062 - DNA, 1501 bp, Oryza sativa
actccagttgtgagtaatattcaaaaaaatactcactccttactatgaaaaaaactgttatatcaaaataatattactaaatttgtcatgaatgtattttcatgtattataatttttttatatatattattagaaattaacggtcaagtatgttcttttgatatcgtgtccatgtcttctatgtcctacttaggcttcgtcattaagtgagcttatccaggcacacgaagtgatacagattattaccatacgattaattgagtattaaatattacaaaactaaaaatgaatttattttttaaaaaacaacttttatatatataaaggatttgaataacatgcaccttgtaatgcagcatttagccgctcgagaaatgtgctcgctacaaataagggagtatctaatcctatatacacgttagaacgcgctcttaaatttattacttcgataataaaacacatattatgtagtttagaatatacttggtcaatcctagcctaaaatatcaattgtatgtcctgactgatccctatgtttgtaagttttatatataagccactatccactaatcgccaagtcatatttcatattacttatgaggtatctatctaataagcacgtgtgttatcaagcacaaatataaagggcaatactaagtgcataacggtcaacaaatgatactccctccatcccataatataagacatggacgcatttcaagattcaaactttaaaacatttgaccaacacttagtataatataaaataaattttattagttaaaaattatatcattagattgagatttaaatttacattcatatggttataattttgttgctacaaatcttatagtatatgagaaattataagttaaaaattagttttggagactgtgccaactttgaccacaccttatattatgggatagagggagtagttaaatagaggacgcaaccaatccaccgcaaataatagttgactataaatagattgcggctatgagtaatagtgttcctacactcatataaacgcttataagatgtcacatgaccctctaataagagagaatataagaaataaaataataaaaggcaaaacatctatccatcgatttacactcaaaatcggtgatccattattttcaacaaataaattagatctatgacagtagttcctctatcctaaaggctgtctaatcttcccttacatacatacacaactcctatgtacatgcgtatgcaacgtatataaaaagaaaaaaaaggagtgtggatatgatatgtcccatttggtagttttctttttcttaccagctataaggtttttcccaaattgagcatacgcgtagcgaccactccaagcgaggtggtaaaagaagccacgccatggcgccgcctcacgccacccgttgctcaccctcttgccatcaatttttttgaagtattcttttgtaccaatgatgtaaaaggctcacatgagctcttataaatgcatgcg

SEQ ID NO: 4063 - DNA, 1501 bp, Oryza sativa
cggagcgggcgcggcgacacgcggggaagaagcgggagagggggaaaggaggcagacgcagcggcgggcggcgcggagagggggagagaggcggccgagacggcgggagcagcgggcagggcagagggtggcgcggagagggggagaggaggcaagcgcgccggcggacggcatgcggggacgacgacgaggaaagggggagaaataagtcgatggccgacgacagtggaggcgggtgagcatggcgccgggctgctcacccttgctgaccaggccccccgctccgccgcacttgcccgccgccctccacccaccgctccttcgcctgctgcgctcatggaggtcaaccaacacgatgacgacgcaggcaatgaagagctggagcatgatgagcgccaccgatatcgcccgccgtccacggctagcttcgctcgccagtcactctgctatcagctctcgctcaccgctccgcttgccgctctcgtccgctacttccgccgtcccgaccgcctctcttcccctctccgcgccgccctccgccccgcccgcggctccagtagtatccgccgcctctctcccccaatccgcgccgcccatagatgcgcccgcctcctctccccctctttgcactaccctccgcccggcccgccactcccgccatcccggccgcctctctcccccaatccgcgccattcgccggcgggccggcctcctctcctcctctccgcgccaccctctgcccccggccgccccgtgccgccacgcctgctccgccccggcaaccgcgcgcactgcccgccgccggcctccctcaccgaagaaaagcagagagaagtgagaaaagagtagaggagaagaagagaggagagggtggctgacatgtgggcccccgtattttttttaatatttttggatgactaggagtgtgttcggcaacctaggttcccaacctctctccctcatattttgtacgcacgcttttcaaactactaaacggtgtgttttttgcaaaaagtttctatacgaaagttgcttaaaaaatcacattgatccatttttgaaaaaaataatttgctaatacttaattaatcacgtgttaatgtaccgccccgttttctatgtgggagggatttgctcccatccagaagtaacgaacacagcctaggatgccacgtcagtgaaaccacccatatatacttccatgggacctcctttaaacagtttgagtgaatttaggggtacatatttctggtgttgtggttaagggatctcaaaataattttgctgttaagttgaggtaccctctggtgaacttattccataatgggaccagcacacgaaaccggcggctcatattgcggtcgtgggatttttgtccctcttgctaacctctcgatgcaccgttgaatcctcgccttccactcgcgggaggctcttatcgccaaaaaccctctcctccccggcggcagcttcgtggcggcgggttcgatgaggccgtcgc

SEQ ID NO: 4064 - DNA, 1501 bp, Oryza sativa
ggtacctaaaatgaacctattcctcatttatatatcgtgatggaccagtttggtagcggtccaatatcgtggcctatccaacagggtggcccatggacccatactggcagcggaagctccgaactgtctccagattggtggcaatcccttgccgcgtgtccacctgccctttcatcgacaccaacaaatttcccttgagccctctccgccgccaccatcaaccgcgtccctcgtgacctcgtctcgtcggttcgtcgctctctccgcgagaaaacgggggcacagtacactttaccggctagtttcgatcgatcacgcacgcggagcgcgggcgggatcaaaaccctaatacggcccgcccccgcctcgatctccgtccaatgcgctcgccgccgccgccgccatgagcctctcctccctctcccgcgccctcgcccggtccgcgcgctcctcccggcagcgccaggtgagtgcccgagccgcaccccctccccttcccctctccgattggtgtggcttcttcctgcgcgtcctcgccctaatggctcgggcggcgtgtgcggatgtcgttgccgtagggttctctgctcggggggcatggcgggctccgtgcttcgtcgccgccgctgccctgcggcgagttgggttttctgcgcagctatgtgacgtcagttatcgggaatcgggcagcggtggcctccggggcagggaagggtggggactggaggttcctgcttgctagccggcagttccggcggctattctccgacaagtcgaagaaaagtaagctttctggctggttaggtggtttttggggatatctggtgactctgttaatatttaacgttgccttttttattcagaccacgggaagcattcggaggaggagaataaaggtaaaggggatgagagtgacaagtccgactcaaagagtaagtgcttattttaacctgcattcctcgctcttgtgttggatatggtttattaaggtgttgagctttgcaaaatattttgaaagagagtagacttttacataccagtggcgacttaaccttccgagtgctgccctaaaatcatgctatatcataacttgtgatttctagttttagtatactgataatagaaaacaatgttaagaagatgatatgcagagcttttgtaagtggcaatacatgttaaacagagtggggctagttgatgttttattttattgcacaaatacccctaacagtatgtaagtatcatgtatagctgaaaatgctaatatttgagttttagtgcctcataaactgcccgctcacctttaagggagaggtactagcatgagtattgtggaatacgacaacatgagcctttagcccaaagcaagttggttgcgtacaatttgtaaagtttgatgcatccgtatatagcattatactgcaaaccacatacttaatgtggtcatttctggtgtgcagagcaatccagttcaggtgatcaatggaatttcgaggagagc

SEQ ID NO: 4065 - DNA, 1501 bp, Oryza sativa
tgaggttccaaataacgtttaattgttgtgcatgtttaaaatgttgctatctgaatttgtgacatgtttattggactctcctcaggctgccggtggagcagagcagagatgaagatggcctacaacaggtctggtcttgactctgactgccagcgtctagataaatagtactgcggcagcttattgatctcaacactcaacatccaactacccctgaattggaaaaaaattctctcgtgcggagccccaatcctcagcgcgtgaggcaccatcctagatggatgccacctgtattctcaccaattttaaagcaccggaaaaaagtaaagcaatttggatttttttttcttagcgtataccctccgtattccagtagtgccctacgaacttgtatcgtattctctaccctaatcacgtcattagtgttcctcgttcctcagagccgtaatccagctattcgcccttccgttccggccatcaccgcgcgtgtagttcgccgcccttccgccgtcgccgtcgccgtggccgtcgccgtcgtcatcaccgttgctgtcaatgtagatgaatccccgtggcggcgccttcgtcggtgctgttgcctgcccatccgccggtggtgacgatcctccgaggccgcccaccacaaacaccacgatatcgatgaatgcaactgccagcacaaccttgaccacaaccatatggcatcgatattctcgacgatggcgcattcgtcgatgctcaatgaactggagattagattttgaagaagctgtgattcctaagtagacattgtacttatcatataagtagaaaacaataacattaactattgtttctaatttgtaagctattgcaacctttatttcttcctggaagcaatttgcagtgattcgatatactcaaacacgttatttctttctagtatatttttctttggagcttcgtgtcttgtaaacgggctgccatgcattgttgattggtccatggttgatcaggggcctcggaggatcgtcatcgccggtggatgagcaggatgcggcaccggtgaaggcgccgccgcggggattcatctacattgactacgacggccatggccacggccacggccacggtgacgatggaagggcggcgaactacacgcgcggcgatggccggaacggaagggcgaatagctggattacggctccgacgaacgaggaacgctaacgacgtgattagggcagagaatacgatacaagttcgtagggcaccactggaatacggagcgtatacgctaagaaaaaaaaaatccaaattgctttacttttttccggtgcttcaatattggtgagaatacaggtggcacctatctagaatggtgcctcacgcgctgaggattggggctccgccccagagaattttttttcccctgaattagtagtccactagtccttaacgaatactcctacatgcatgtgtaaagattaggggttatcctcgagcgcattatgctataatacga

SEQ ID NO: 4066 - DNA, 1501 bp, Oryza sativa
ccttccctaaatatttgacacctccttccctaaatatttgacaccgttgattttttttaaacatgtttgatcatttgtcttattcaaaaacttttgtgaaatatgtaaaactatatgtatacataaaagtatatttaataataaatcaaatgataggaaagaaattaataattacttaaaatttttgaataagacgaacggtcaaacatatttaaaaaagtcaacggcgtcaaacattttaggatggagagagtatattcctacatatctgcaaatttttaaagtggagctgtatatagattaggatacacgaaaaagtttttttttcgcgcgtaagttctttgttccaaagagagttatagacacaaaccaagaatatacaatatttttttttccaaaagagttagacacaaagcaataatatacaagaagttgaacgtatagctatatatatatatatatacaaatatagaatgtaagagttggagactctccctacgcatgtaaaatgaaacaactcattaacaaataattaaataaatacatttcataaaatttaagaataaattaatatatttcataaaatttaagagtaaattaatatatttttaaaacaagttttctatttttttaaaaaaatatcatttaacaatttaaaaaatatgcgcgtgtgaaaaacaagtgagtataacttgggaacatgccttcgccaaacgtacgtacctgtacaaatgttgtgttagaaagttctaactcctgtctcattgggatatacgagaaatacaagtgttggttgagtgaactctatgtgaggggtgtatatctaacaaaattgtattattcatctctaaacttgtttggttgtatcatctagatccctgaactcttaacatatatttcaatttcccgaacttgctaaaatgtggcacccaattctaaaacgtcacagtgccttaggatcctacatgacacttacgaagcatgtaaaaaaattcataatgacattcaagaaaataggggatattctcgagatatcaaaggagtcactaatacgatggtattgtttggtttaagttcttagcaaattttatagtacgatttgtaagtggaaggttatggtcctctttagcacaactttggatctagagcaattttacggttcttgaggaggtaccatgaggtaccactttttctattataaatttggtatctcttggtatctagttattatgaggtaccaaattttacactaaatttttagtaccttatggtacctccttaggtacagtagatttgctcttggatctaagattttacagagcaaggttgttttctaactttggatccgtgattatgttgttaatatcttaataaatcattttgttcatattttgtatgttatttaaaattttaatctactataacttgacatatatgtaactaccaaattattattgtatatttataaatgcatgatgataaaatcctatcttaattatca

SEQ ID NO: 4067 - DNA, 1501 bp, Oryza sativa
ggggacaagagcactaccagagtctagaaagcaggggtaactgactgatgaggagtggacaggcgtgaaggcttatatggtggagtcgaaagcgggcaacacgtgaaaaagccaagcatttgtcagtaaaattatctgacaaacctgcttgttttgcctcgagggttggaaagttgcaggcggataaacaaagtgcctaattgccaacactactacatggattagattcagccttggttagcatcaccatcacgagctcatgagatgtcgtcagtgctgctgctgctgcgtgagctcttgtgcgcgcattttacaagcccattgtggccaaagcacagatcgggaggaggctgcttacagtaagataatggaggaaaagccttgaaagacggtgcgaatcgttggcggtgtatgcggacaaatgtgcgcccgagaccgcggaaagctcgctagctccgccgctgcacgcctgcagcgcatcccgcgcatcctccgttctccctcggtccctcgagtttttcagttaccgggggacttcagtagagttaattgggatcactttccgggctgactgcattgttggttgggcttccggcgaaattctctactccgtcacgggcctaatgtctggcccagatcgttttcgacggggaaaaagtacaccgaaggtccctcaacttgtcatcgggatacaaaatcgtcccccaactgtaaaaccagatatccgacatcccttaactatacaaaaccagtcacaatatgtctctcggcggtttttatcccggttttatcctacgtgactgctgtctcagcgtgggacccacgtgggccccacatgtcagcctcttaatatttctctctcttgccctttccactctcctttccacgggcgaccggcgtgcgcgcttgcgcgggacggagaggctgggcacggcgcggccggcggcggcggcaggggaggagctgggcgcgagggcggtcgctggggagccgcgctatcctcgcctcctgcgcgcacacgccgcacacacgcgctccgcggcgtgcgcctcgccgcgcccccgccgcctaccgcgcgtttggcgcgctcgcggctgccactggcgagcaaggcgaagtggccaggctcggctactgactacagatttccaaggagagagtacactctcatgctagctttgcttaaattaggccttgccatggtggtgatgtggttaattagctggctgagcaagctaacctcttcgagcatggggtaaatgtaaatcttgcccttgagccgctgcagctcgcccccgtccatggactggatctgcgtcggcgcggtccacgacgacgagcctccgccaccgacggcgtcttcttgcgcctgcttgggtgccttgcttgccgacgatgggctggtggtgctcttcatggggaggctgcagaactcctgcaagagctgctgcgtcgggaggaggaacctttagccgcggagatgccacgcgccttgctgcag

SEQ ID NO: 4068 - DNA, 1501 bp, Oryza sativa
cctaacttgcatgaaatgagcaatacctgataggtagtcacaagaatcagaacacctacctatcagtaaattcgcaacctggtatacaatgctgctaaacttcttctcttcagatcttagggctgctaaagttcatataggaagcttttggagctggggcataagctatttaatttaactgcaaaccaacttatcagatttcagttcacacgctacgaaactagccaaatgatcagcaaggagtacgtggtaggccaccctatatggttagataaaaaaagggataattgagcatatgccaccctaaatggttggtttatgtcctcaacagaaatttaacggtggaaaatcctgaccaatcagctaaagggtggacatgtgttcaatttgtcttcagggaatagtaacagcaagcgcaactagagtccgcgtcattagcaggaaagaggagtgagaatcaaaaacaggggtagacaaccaggccacctccaagctggccagctcattcctcacgcttaccacctatctatcaatctccagaaccctgactccaagacttcaggtccttgataaacaaaataccaggcaaatgcatgtcttcaaattcttctgcaccttaccttaatacaaaagacacacaaatcgattccccagtaatcctcagttcctcacaccaattccccagtaatgctagccccaattggacttcagttcaaacacaaactgacctgattagaacaactatgaacatgctgctgttcgttttggaacaagtaggtttcataggtctctctacacatgatattatttcgttaaaactaataaagaaactagacaaattgctactgcttttgcccctataaaattctctacccatcacattcccgtagtacacattctaaaatggggaaaatagtaacagaagaacaaaaattgagcaaaatgaagcgagcaatgggtaacatccggatctcataccagaggtagtagtaagagatgcagatttaggagcaccaaccgtatacaccaccaattgacagcccttgccgttgacaatgctgatgacgactcactatcagcgccaccccgcagtgctggaggtgacgacagtctcgtcggcggcgtccgcacgttctcggcagcatctggcgccatcgcgtccggcggcggcgccatgacgtcgctatcagcaccgccccgaccgaacatttccttgggcagtagaaccttcgagacggcaaacaccgcaacgggattttggtcgaacaccgtgcgggtgatcgaagcctgcacgatgccggtgtcgatggcgacggagccattgacgcgtgtgatgtttagcgtgaactggccggcctcgaagcgctcggtggcgagcgtgggctgcacggggttcacgatggactcgagggagccgagcggatagtacgagtgcagcacgtggaagcgaagcacggtggccttgcgatctgcggggagggactggaggcggtcggtggcg

SEQ ID NO: 4069 - DNA, 1501 bp, Oryza sativa
aaatgaagcgagcaatgggtaacatccggatctcataccagaggtagtagtaagagatgcagatttaggagcaccaaccgtatacaccaccaattgacagcccttgccgttgacaatgctgatgacgactcactatcagcgccaccccgcagtgctggaggtgacgacagtctcgtcggcggcgtccgcacgttctcggcagcatctggcgccatcgcgtccggcggcggcgccatgacgtcgctatcagcaccgccccgaccgaacatttccttgggcagtagaaccttcgagacggcaaacaccgcaacgggattttggtcgaacaccgtgcgggtgatcgaagcctgcacgatgccggtgtcgatggcgacggagccattgacgcgtgtgatgtttagcgtgaactggccggcctcgaagcgctcggtggcgagcgtgggctgcacggggttcacgatggactcgagggagccgagcggatagtacgagtgcagcacgtggaagcgaagcacggtggccttgcgatctgcggggagggactggaggcggtcggtggcggggaggtcggcgaaggcgtcgtcggtgggcacgaagacggtgatgccggcgccgcgctcgtctgccgtgaactcgtccgcgacgcccgatgcctccagcatggaggcagcaacgttgaacccccgcgcgtccgcgaggacgtgggtgatgttgacgccaccggccgggcggctgtcggaggccgcgacgtcgagcccggaggggacgatgaggccacccaccgcgagcacgctgaggttgtaaggcacagcggtgacggcgccgaggacagtggcgctcgaccccgggaaaggcgccggcgaccggaccacgacggtggagtttcccccgacggtgaggttgacggcgccgagatcggagggcgcgcgcccggtggtctggaacagcgtcgtcacgagcttcccggaggcggggaggcgcgcgaggtcagaaggggagaggtactcaagcaggacgtggtaccgcagcacatcggcgatgtcggcgccggaggccgccgcgaacgccgagggcgagcgcggcaggttgttgttcggcacggccagcagcgtcagcgacgaccgcgccgccagctccccggccaccgggctcgactccagaagccgcgcgaagtcggcgaagctggggaaagccgcgagcgcggccgtcacgttcaccccggccgcccgggacggcagcacggcgagaactagaagcagcaccaccccgagcgcgaggccgcctggcaccggaagggctcccgctccgccccgcatctcgccagcggggggagcaactggggtggtgggtgggggactgaggagtaagcgaggagaagaggtgcccgaggaggaaggagacggggaagaaaaatattttgcgcgtgattttggttttagattacggggatttttttgctgtcgaaatgcgatagtttacgcctttctttaaacggtggact

SEQ ID NO: 4070 - DNA, 1501 bp, Oryza sativa
aaaagcacttcgatcgacggacaattattttgtcaatcaccatcagcaacctacatatatagtggtagtagtatagcaagctaggcatgcagtttaatttcgtcaatgtccattctgatataccttcaaagttcaccataatcatatcgctaagcggtaacatcacttcctgatatgctcgtcccttgttttcacctacagtacaatgaacctaggctttttattttttatgtatatataatatatgctcaacaatggctaagttgcatgatcacttgacatggatcccaagatatatatctatccagtaggtgcaacctgcatggttggtgtagtctagggtggcttctttccttgtactattcccaacggggagaaggatgcttgacccaaccagaccgagcgctgcaacatttttcttcgtattatattgactcgaacagaagcatgatcaacagtaagatggcatcgccaaatgcatctcgcagttcgtaccttttcagacacttcttccctgttgtttgtttatttggaatgctcaaagcatataccttaaaggcttttataaaattgcaaacttagtatatacttcatccgtcccacaatataagagattttgagtatatgtaacatatcctgaagtactacgaatctggacaacctaaagtcttttacattttagatggaggaagtaatatagtatataggaagtggattttgatccctcgagaggatatcctctcgttgtttgcaatgccattcaaatggttatgaaaaatttgaaaaaatttgagatgatgtattaacatgtgatatatcactccacaaacatgcaagtaaaaattcaacttctatatcttgcaacgaaattaacaaatttaactctaaatatacgttaactagctacggtttaatttgatttttttcgttacttataaaattaaatactactagtaaaacaaattgaacaaaaaccagtcattggttggtaggttccttatggtataacccattcaactaatttcaagccctagttacggctctaatgtttatcacatgacaacgctatattgttgtatctatcgtatattattaagataggaagaaaagtaaccaccacacttttactctaggtccagaaattaacgcttagtagaaggaaaagaagaaaaatatgcactatttgataatgatagatctagattataacggctaatcaatatagttggatactactactgtatttgtgaaaatataagcaatatttgcatgtcaaatccagttgtattttgaatataaaatctatagctacataaaaaattgcccgggaaattctactagttaatatatgtagaataaaaataagttatatagttcttaaccaaagaatacgaatatataatagctcatctgaaacgacatgctttattcagaagcaaaatgtgatatattatttgttattttgttagtagcatcgtggaaatccatacccattactttt

SEQ ID NO: 4071 - DNA, 1501 bp, Oryza sativa
aagtagaaatacaatataaaaatagatgaaattcaaaattaaaaataagcaatattgaaagaagtttccatataagaacccaatacgagattaatcaaaattcgaaataaaaataaaataaaatccaaaattagggaaaaaaaaagagagtccaagtagaaatacaatttaaaaataggtgaaattcagaattaaaaataagtaacgttgaaagaagtttccatgtaacaacccaatacgagattaatcaaaattcgaaataaaaataaaataaaatccgaaattagaaaaggaaaggggagtccaagtaggaatacaatttaaaaatagctgaaattcagaattaaaaataagtaatattgaaagaagtttccatataagaacccaatacgagattaatcaaaattcaaaataaaaataaaataaaatctaaaattagaaaaggaaatgagagtccaagtaggaatacaatttaaaaatagatgaaattaggtattaaaaataaggaatattaaaagaagagttcatataagaacccaatacgagattaattaaaatttggaataaaaataaataaatccaaaattagcaaaagaaaataaaataagagttcaagtaggaatacaatttaaaattagtttaaattcgaaattaaaaataagcaatattgaacgaagaatccacgtaagaacccaatacgagattaattaaaatttagaataaaaataaaaataatatctaaaattggaaaaactaaaagagagttcaattaggaatataattttgaaacaactgaaatttaaaataaaaaataaaaacattaaaagaacatattggtattaactatttttttaaaaaaaatactgaaattagaaaaagaaaaataagatttcaattaggaatacaatttataaataactaaaatttttgataaaaataaatattattgaaagaaaagaccatctaaaacatatgacgagataaattaagtaagaggcctataaaggagtggagtggtggcggttgatacgacatataaaaattgttaataaaacatcaaatagaatcctaatgacgattaaaaaggagagacgtcaggcaggccgtgaagcaaacgagtaaggcggttgccgagacttcttagacagtaaaaaaacaaaccgcattgataattgtattcgatttttaaaatctcaatgacaataaaaaggagaagcagcgggcggggtgtataagagtatagtttcagagccaccgacggttgacgggacttctagaaaataaaaaataaattccaacgatagttatgttcgatttttagaatcacaataacaataaagaagtaggcggcgaacatgctgtagaggggcatagtggcatcgtttgataggacttctaaaaattataaaaaatgaaactataagtccaacttttaaaggttcagaacttttaaaaagtaaaaaaaaaacaatgataatcatgttcgattttaaaatctcaa

SEQ ID NO: 4072 - DNA, 1501 bp, Oryza sativa
acctgggtaagctggagcacgtactcatacgtgacggaccagctcggtgtgagccctacgcctacgcgagcgcatgcaatgcaactgagtagtacgccctcgcaccgtcgcacggcgtcggtgcgtgcaaggcacagccttggagagttggggttgtggtgtggccgaggctggggacttggggtctcccgttgcgtgcgccaccacgtacgtacgtacgcacgcacagtacgcgggcggcgcacggcgcggttaaatgcaacaccggccgtacacgcgcacagtacgcacccacacacaaaaaagttccatttacgacgcggtcagcttgcatatgatcccaccacagttcttcccagatctaacgcggaatgcgcgacacgaggacagcctccactgctgctgcatgcggctgcgtcgacgacgtgtcagtcaccttttccacggatcccagtagtagtacagtagtacgtagcatctactgtagactgtttgtactgtacattggctacgctggcacggtgagggtgacacagtggtggcggagcgccgtttacccagtcggcgcgggcgcccgtgcagagcaggtggctatactatgctcgtccgtctcaaaaatatgaccctaaataagaaattaagaatgagacataactcaaaaaaattaagaacgagacataatccaagacaatgaatctatatacgaatatatctagattcgttatcttaggttatatcacattcttatctagattgattttgaggatgtttagactgtaatcaaaacaataccaaaattttggtaattgataatattattaaaattttggcagaactttttatctatttatcaatatttagtacaaagactaaatgtatgtacatatttaacagttttataaaaattggtatgatttaaaataagatcaatctaaatatttttttgggaggaagtatgcaagaggagacgccacctgggccgagcgacagtgcaacagctcacccccgcccgcaacacgcacccgcgtccgtcgcggtgccgtggcgtggaacgatcccccctctcggatccacacgcttcgcgcctcgtctcgccacgacacgccacacgtacgccgagtcctcgccttcgcccgcgtcgcgtgctcgccttcccctcgcctcctcgcctcccctgtgtggagcagttactgcgagcgagccggaccaaccactctgctctctctctctttctctctcgacgcctcgtcggggccaggaggcggagacagcaacggctcaccgcccggtgtcgcgggggaccccacgcgccagcgagacaggccctccacccaccgcggggcccacgccggtcgctgtctcctctcccttcctcctccgccgcatcatttcttcttcccctcgcttcgaagccaaacccgagctccggggaaaccactagtagccacttgagcttcttcttcgccactgaggggaaggggaagagggatcggagggatgg

SEQ ID NO: 4073 - DNA, 1501 bp, Oryza sativa
attgaattaaaaggtaacctcccccctcaacaatttagtttaagtttcaattaacttcatttataaatgaactagtaactcctttgataagtactactcctatcaagcattggtcccctcctcttgtttaagtccattccaattaaaccttgtgcatctcttgaaaaaaaagagaagaaaaccggactttttttctcctctggcagataagcatttaggcccccatcgtttggcttacttcctaataagccaataggaaataaaaataaatttgtagctaaaacttttataaatatgttcttggtgacttaaaagctaatgttgaaaaagaaactacattgaaaatatatcaaaatcaatctcaaaattaagcttgaaaatttaaaatttggctttttctttagctgattaggctatccaatgtgagccttactctctagaagccgattgaaagaaaaagaaccttccaaaaggacgacaaacaaaaacgcacaaataccaaagtactccagtacagtgtatacatacacgaaataaaaaaaaaggccacgtcgtatcgtagacgagataaaatcttatcccactcgccatccgtggccgagcaatcgacacgtgtcccgtctaccgtgggccccatccagccccgcccgcgcgcctacctgaaccttccagaaggccgaagcgcgaaaaatcgaccgaaccttctcgccccttccgacccccaattgccccatccccatcccatcatccccccgccgagaacccaatcccgcggcctcgcctcatcctggccatccgtgccacctcggtgggttccgatacaacggcgtggatgcgcccgccgcgggggcgagagatatctatcactgcggccgggcccacctgcaccgccggcgccagcttggctttctcggtacgagtggtgggtcgcatcgaattcataggccatgttttagttccacacaacctatcacatcgaacgctaaaacacctatataaaatagtattaaatataagcttaaaaaaaaactaattacataggttgtgactaatttatgagataaatcttttaaatctaattgctccataatttgataacgtgacactacagtaaatatttgctaataacaaattaattaggcttaataaatttgtctctctatttacttatagattctgtaattaattttttattagtacccaaacgtacagtcaacgatataatacccgatatacacgaaaaaacaaaactttacacaactgaatcttaacacccacatacgtgcgttttctctttaaaatcgttttttcttttggtgctttttttccctcttttttatttgtttctctcttgctttgcttctcctcctcccgttggagtataaattttcctaatccgcaaacgaagtttccagaagacttccggtccgtaccttcgttttcacacgcgaaaactgcctttcttccggcatctggaagctactactactacggtcggtcc

SEQ ID NO: 4074 - DNA, 1501 bp, Oryza sativa
cctgggtaagctggagcacgtactcatacgtgacggaccagctcggtgtgagccctacgcctacgcgagcgcatgcaatgcaactgagtagtacgccctcgcaccgtcgcacggcgtcggtgcgtgcaaggcacagccttggagagttggggttgtggtgtggccgaggctggggacttggggtctcccgttgcgtgcgccaccacgtacgtacgtacgcacgcacagtacgcgggcggcgcacggcgcggttaaatgcaacaccggccgtacacgcgcacagtacgcacccacacacaaaaaagttccatttacgacgcggtcagcttgcatatgatcccaccacagttcttcccagatctaacgcggaatgcgcgacacgaggacagcctccactgctgctgcatgcggctgcgtcgacgacgtgtcagtcaccttttccacggatcccagtagtagtacagtagtacgtagcatctactgtagactgtttgtactgtacattggctacgctggcacggtgagggtgacacagtggtggcggagcgccgtttacccagtcggcgcgggcgcccgtgcagagcaggtggctatactatgctcgtccgtctcaaaaatatgaccctaaataagaaattaagaatgagacataactcaaaaaaattaagaacgagacataatccaagacaatgaatctatatacgaatatatctagattcgttatcttaggttatatcacattcttatctagattgattttgaggatgtttagactgtaatcaaaacaataccaaaattttggtaattgataatattattaaaattttggcagaactttttatctatttatcaatatttagtacaaagactaaatgtatgtacatatttaacagttttataaaaattggtatgatttaaaataagatcaatctaaatatttttttgggaggaagtatgcaagaggagacgccacctgggccgagcgacagtgcaacagctcacccccgcccgcaacacgcacccgcgtccgtcgcggtgccgtggcgtggaacgatcccccctctcggatccacacgcttcgcgcctcgtctcgccacgacacgccacacgtacgccgagtcctcgccttcgcccgcgtcgcgtgctcgccttcccctcgcctcctcgcctcccctgtgtggagcagttactgcgagcgagccggaccaaccactctgctctctctctctttctctctcgacgcctcgtcggggccaggaggcggagacagcaacggctcaccgcccggtgtcgcgggggaccccacgcgccagcgagacaggccctccacccaccgcggggcccacgccggtcgctgtctcctctcccttcctcctccgccgcatcatttcttcttcccctcgcttcgaagccaaacccgagctccggggaaaccactagtagccacttgagcttcttcttcgccactgaggggaaggggaagagggatcggaggagatgg

SEQ ID NO: 4075 - DNA, 1501 bp, Oryza sativa
ggtcctatatagtacataggatagattgccttctggtttgttaaacagagaaacggttgtcttatgctgtgttggctggtcgatttccctttcgaagtcagctagttgaaattaggaaattcatctgtatacttggggcgcttcaatgtctaatctttcctatttatgattttgactattatcaccagtttatcacatgaatgcaattaattcaggtacttaaatcgtttggtgatttctcctaaagtgacgtggatactatgatggtgagctactgagctaccatggaatttgctatggtctaatggaacttaaggggacggaagatatattatgaatacaagactgcattaaattagaagtaaaccttgatcttgacatcagcctggaatattatgtatataagcatatatgagatgcagagtatctttaggacgtaacagtgacttgtagcgagcgatcgtatgatgtagtccatatgtttattttgaaagatatgtgagaataatttgagatcattttctcatatttcttctttgatggctgtactaccctcagtctttggattgttccaagcatgggagctttttaaattaacgagtcacgcctgcccagataagtcccaaaagctatgtatccaaatcatttagtccaaatcatttagtcgttgtgcatcagtaatcaagtcaaagatgctattggtttcaaactcccagtacaacacgtccatggatgaagatgagagtgcaagaccctgtttgttccactgagtttcatctctaggaattccatacaaatctttgttttaattattactagtattacgtaaatcatgtgttccagatatgtagtaaattgatgtactaccatgcgtggtgctcatcttttgaatgatctgcaacttatctggagttgacacctaatcgcatctaaagttgaatatccaaattgaaactgcgtgcttggagtctttcagtctcttattggagtgtatcaagcatccactgagaaaagcctctgtatattctaactcatccaaggtaatgtcacacgagtaagtgataagcaatccacgtggacaacggcttgatgacagaacccttgcattcacatcacagggtgtacaagtggctacaattctgtgactaggtgaagagttttttttatatattgctagtccattatatttgctttgctttgccctttgccttcactgatggggtctttgttcttgacaggattgcaatttgcttataatatgttgggctcatgagttgtcacatttgagtggaacccatatcggttagatggaagcaatgctaaccaccctcaagataacacgacaagcgcctgtgatattctggagctagcaagctcaactcaatattttttcctctccatttttctttttcagagtttcatactcttggctgcttggctagtgcccatcgaacatagaatttgtgttcaacgattctgatcgtcactgtgtctgaacagt

SEQ ID NO: 4076 - DNA, 204 bp, Oryza sativa
cccccccccccccccccccccccggggcgcgccacggcgggaggcaaaagaaatcccacgagatatccccgtctccgcacggcaccgccacgtacgtacttacgctgcctgcgctcgtgcgtataagagcaagtttaatagcagagttaaatgttagctccaaattatttataggtaatataataatctatttatataatagtt

SEQ ID NO: 4077 - DNA, 1501 bp, Oryza sativa
cgcgaacccaaccggcgaccggcgaccaatcccctccgagactgtctccaatctccggtcctcctccatggctagcgtaggcgcgtagcatctatttatgctctcagattcagagtcctaccactcgtacacacgccggtcagcaacatcacatgcatgctagcaagaggttttcgttagcctacgccctacggagtagtagtagccgtatcacattacatgcgcgctgcggcacacaattgaagtcttcgagttgatctgccggtagatctagctaagctggagtcactttacacttgcatttgcatctgcattgaactgcactgcattgcattgcagttgcactccgtctatctagctagctagccacgcatatgtgtactgcgtgcagatggatccccatttaagcgtctgcgcctccgccaccaccatccccatggccacccttcaatgcggccgtgcattcaatggctcgccccgcggttaggtgcccgtcgatcaccgcggctgatcaagtgatcattgcctcattggccactgatccatccatcgatcggtcggacgcccaacggcccgcgcaggcgccaatttatggtcgaccggctccgtgctcctcgcggccgagcgaccgaaccggtcaccaatcacaaggcaccacaaactatggtgatcaatggatcgactcaccactcgcaaggcaccacaaactctgatcctgatcaatggatcgatgcagaagtcctcgtcgtaggtagtgttcccttcaaactttcaacttttccatcacatcaaatatttagacacatgcatagagcattaaatatagatgaaaaaaccaattacacagtttgcatgtaaattgcgagacgaatcttttaatcctaattacaccatgatttgacaatgtagtgctacagtaaacatttactaatgacggattaattagacttaataaatttgtctcgtagtttacaggcggaatctgtaatttgttttgttattggtttacatttaatattttaaatgtgtattggtatgcgtcaatttttttttttgccaagacaactaagcacggccttagtatatgcgagtgtagcgtacatgcatgtgtgtacgtaggatcggagttgttgcgtgacttgcgtcctgctgctgcatcgttcatgtacactggtacatgcagagagagagagagagagagagagagagagagagagagagagagagagagagagctcgcgcttggtggtagcagctaggagtagcagcgtagcaggaccggtgcgcgacctgcaataaattggcatccatctcgactgtgctccgaccagttctataaaaacctcggtctctccctgctgcactctgccatcctcattgcttgctccatgtggagtcacttagcgcagtgtagctagccatcaccgggcattctcatcggatccatacagccctagctagcagctgtacgtacattacagagtttgttgccagaggaaaa

SEQ ID NO: 4078 - DNA, 1501 bp, Oryza sativa
gctcttacttaaatcaaaattaacccacgatgctgtcccaaactacctaagagtttcagatgtactccaactgataaatattatcgaaaattctaaaaataaataaacacgttactttcattagtattatacgttcatgtaaaattttattttcaaacaaaattgctgtagtagagaaagaagagtatcagtggtattactattagagcctgtttaattcccaattaaaaatttttacgctgtcacatcgaatgtttgtatatatatagagtattaaatgtagacaaaaaatatataaaattacatagttcgccatgaaattgcgagacgaatcttttaagcctaattgcgccatgatttaacaatatgatgctacagtaaatatttgctaatgacagattaattaggcttaataaattcatctcgcatattcctggcgggatctgtaatttgttttgttattaggctacatttaatacttttaaatatgtgtccgcatatccgatgtgacatgtaggggcaaatttttttctaactaaatagacccttagttgatttacaaattccacgtgcaccgaagtgggcgtagctcaaaagttgtgtggtagaatcaatccactcaggttcaaatacatactcgatatgagtattcacatttacagttatttattctttcagtgatagatagcgtatccatggacaacgagacgactcatagggggttggatgtatgtgttttttttatatttatgtatgtttattcatttagtggtagacatatgtagtcgatagtgagacgactcatatgggtcgaatgcacatatgtgttcatagagatgagtgatacgacttatagagctgtttaatttttcagtggtagacaacatatatatatacaggtaataaggcaattcatagagatcggatgtgtatgtatttataggggtaagtgagaagactcatggatatcgatctgcgggtgtattcataggggtgagcgaccgcacgtttgagggtgtgtacagtgtactgcgttgtaaaagaaaaatccacgtgcacagttaacagctcaattaattaatcgcccacaccgaagcgcgcaccacgaaaggcagcgccagcgccagcgaggctgacctgacccggacggacggaccctgccgtgtggggcccggatcccagcgcggaacaccataatttagcagcagcgccagcgtcccgagccttggctccacccggtatcccaacccgagggaattgcggaatccaacaccaccaaatcccccaaattaactccacgccaaggaaacaaaacgcccccccaattccagacgccaacgcgaggtcgacgaaggccacgtctccgactccggctcgatttccaccccccccaaatcctcctccggcgagcggccggccgcgagacaccccggactctcccgcgcggcgattcttcggtaccccgatcggaggaggaggcggcggggagggaggaggagga

SEQ ID NO: 4079 - DNA, 1501 bp, Oryza sativa
agaccctgtttagatgagactaaaactgttaagtccctatcacatcggatgtttggaaactaattataaatattaaacgtagactattaataaaacccatccataatcttggactaattcgcgagacaaatctattgagcctaattaatccatgattagcttatgtgatgctacagtaaacattctctaattatggattaattaggcttaaaaaaattatctcggaaattagcttttatttatgtaattagtttcgtaagtagtctatatttaatactctaaattagtgtctaaatatagagactaaagttaagtccctcgatccaaacaccacctcaaacacctccaaaaacactcaaaacagaaagtgacaggattacagttctcatagctaaacttcagacattcagctatccatcaatctccattggcagcacgtcaggagacttcagcacttgaatattatgctccataattcgatcacaccacacctgcagcatactgtgctcctattcattttacaggaccatccatctctgaatctgcgcaatcattttatacaagattgtctagggtgattttaacacaatgatttggaaaacaaagccattcctagtaagccacaaaacacaagccccaacaaccttattactgactaagagtaccccacacgatgttgtgggtttgtttgtgattatgcatatttatgttcatggtaaaatgaggatgcgggtacagtaactaaattttactatcgacgtacaatatcacaatagatcttttacctatcaatggaagcatatgaccattgatggatgagatatcatcagcaaaatggaatttttgaagcatggcatctttgcaactgaattttattactctcaccattgatcagcatggatccaggcctagggcagctagagctcaagccctagttctgggatccaaaccccatgcaaattccatattaattttagaaagaatgcttgaatttatagagagctaggacaaggtaatagaactaagccctggtgtggcttcaagctgtctccgcccctgaaattgatctcaacgttaactcatggttctgatgtttttttcttgaacgtttttggtagtatgactaagccttggaaggtttttatgtgtaccttggaagtgcttttgctgtacagaaagaaaaggagattatgaggagggttttagaggaaattaacgtgttctttatatgcactgcaaacggcttgtcaaactgttgtggttaattactgacaattggcaagagtcgcaacatattttgcttcaatttttttccggacaacactgttgttttggcttctttacctttttacggacaacagtgttggtttggctgctttgccttgacagttaatcacgtagcaaacttcctcaacaaaggcagttgcaattcatatatctaatggtcattatcccttttcctttgatccaagagcttctactttttttaatggtgtgtctt

SEQ ID NO: 4080 - DNA, 1501 bp, Oryza sativa
tcgcctcatatttaatttatctttcacaacgcttttgcagttttaatgtatttttactggcacaaacgtacaagcaaatatcaggttgcaaaattattttctattaaccaaatgggccagctgcaaacctacaagttgcaatagagtgtgttcgtttgaatcgtcaagtcctcgttttcttgcaaggttaggacgcgcaagactgtactacgcaggatgttggcctgctgccttgccctgtcgtgtcgtacagtacatagcatgttgcgaaactttctcttgaattgcccctacgcgttgttagtacattattattattttttcggtttgaaacatcggatgtatcgttattttgcttaggtcataaggtcattacaactgccaggttccagcagtcgaaaaatcgggtggcagacgacttttgtttgctaaaatacaacatattgaggatcagccgatcatgatgttttgctgcgattgcaagataatgatcgccggatgtttagctgcgattccaagataatgatggccgcttgcttgcacgttggcttctaatctaatgtaaagtacaggattaatcttcctgacgacgataatgtgcacgtcgcagcgttcattaacggaaaaatagcatgatatccaatgggtaaattgatccgtatataaatacgacggcatttgcaaaaccagaaaaacagttatacaagaaatacaattatactcaattctaaaataccttttaatccctttagtgtagtagcaaattcggcatgagacaaattcggttcctagtcatctatcatccaatgcaaattgccgcggtcccagcgaaacaagacctttttttaattttaaaaaaacagcgacccagagttgacttagctttaggcaccgtttattcttcgaattatctcatcgaactcatccctggttcttaaccgccgctaatgccaacatatctcctccctccccgctcgactcgactgtctccgtctcaccggcaatccggcggcaatggacggcgtcggcctcggcgtgcacaggcggtgggacacgtcggggagcgggtcgcagtacagcttcaggacgtcggtaagcagcgtcgcggagatatccaccgaggtgggggtggaagtgagcccgccgccgccgccgctggcggcggcggcggacaaggtgtttgtcgcagtcgccgcggacgtgaagtacggcaagagcgccttgcagtggacgctgcagaacctggccaaggatggcgccaaggtcgtgattgctcatgtccactgccccgcgcagatgatccccatgagtaagcctccagtcctcaatcatttgtttgatgatctgcgtcacaggagagagatttaagattggataccttttaatttcggtaatttagcgacgagtttggttatttggatcccgcttccgttttgaatctatggttagcagtttaataatggatatgattcgttgacattggcgacttgaaagccgaatg

SEQ ID NO: 4081 - DNA, 1501 bp, Oryza sativa; identical to SEQ ID NO: 693

SEQ ID NO: 4082 - DNA, 1501 bp, Oryza sativa
catggataggatgttttactacgcacctggatacatgcacttggatttatatttatagaatgtgctcttagatacataacaaaaatccttatgttttatctgttaaaaaatccttatatttgtggacatagctttatagaaagaaaatatttatttttgaaggaatggaaatcattattttaaattacccactttcgaatttcgatgactgcctgtcggcacctattgttaactgtagccctagggcatagcgcatttgcaattaacctactaattattaattttggatttcagaattaaaaaataatctactaaattgagagctcaaatgggtggaatttcatatatacaagttgtaggatagcgaaatccaaagagtccatacagtagtaaaaattaaaaatctattaaacattgtgtttaatataaattcttaatacgatatagggttctaataatttgagccaactaactaatggccatatctttttattgatgtgagagctttctcggagtgtccaattaatataaatatatatgactattggtttatcaactgctgataaaatgtaaatttaaaacttaacctagagttgatttgagggttttcatcatgatctattttccagctttagcttttaaatagctatgacatgtatataaaatttttactcgtaagttattattagatgcttcatttattttctacgacttatcatatcaatgtttcaattcatcttgctccattatttgtcctctttcatcctacttgacgcacatgtaccaactaccggtcacacaagttggccaagggcacactactgcaacaacaacaacgacatctctctctgtgttcatactaatgaagggttgcagtaaaataccggaccacgattttttacatctaggtgaatatgtatatctatatatagcttacatgtggctcacataatgtaaaaaagtcttaagaaattggtaacgtagaatatatataatgcagtaagtttatatacatacatgaaagactagatttattgtacattcggagaaacaaaagataaaattcagtagtgaacagttcctataagatataaatataccttttttttttctgtaagtgtgatcaaacttagatatgcgtattgcttataggacatacacatattttatcacacctgtttaactagaatgtcaatccgcgtgcaggcatcttcgttaatatcgtacaaagtactatacaatcatttttgttaattttgagtatgtatgtttgcataattgcgtgatattttcaaaataatgaaaaactcaaataatagaaatctccaagccaaatggaaagtaaaaagtccaaaatcaaagttgaggaatatatataatgtgaatctcccgctacaagattacagtgggagattcacattttatatatatatatatatatatatatatatatatatatatatatatatatatatatatatatatatatatatatatatga

SEQ ID NO: 4083 - DNA, 837 bp, Oryza sativa
cattttctaggcggttggtaaatcctttatgagtttatttactcggattttacaccacatatgccatatatttccaggtatggtgaaaccatgtgtcttctagggacttaagcacatgtgttaaagcagtgtgcgcatggcgtatgcccaatactttggaaatttctttattcacaatatacaagcttctttatagctattttgctatatcactcatcatattttacaaagcagttggtatatcactcggatcatgttatttggaggcttcacaccgcatatgctatatattgatatcaagtcacttggttgattacgattatcaaaaccactcggttgggtggattatttattccttgactatatgcctggtttgctcaattaaccacattgtcgggggctacacctattaggtgcatctagtcggtgcacctgactttattttccagccctccacagtcttcagatttggtaaaaggtctcgggagaccatgacaaagatgattgaagcactctgctttggagtgatctggttcgagagaagactatcttttcgactgcaaggtctcaggggctatctgggatattatgggtaccccatacccatatggcatggttatccgactagtcataggggataacttatatctatggaatatgtaataaatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggca

SEQ ID NO: 4084 - DNA, 1501 bp, Oryza sativa
ctgccaccatcattgatgagattggtaggaagagtgaggagggggaagcgggagagaggaggaggatgaggggagaggagaggggaggagatgggggggggggggagagggagtggatgtgttgaggagaagagatgggagtggattagaggatgatggatttgactttcaaagagaatattatttttgtatgcgagcctcttaagggatcacatgtgaaaatgcattatcgcatgcggtcccttaagaggcccgcctgcggtatacaatacgtctattatcgcagacaggcctcataaggggccacaagccataatgcattttcatatgcgactccttaaactgtcctatcgggtgcaatttttgcaggtgagggtagttacctgcaacttagaaggggtcttatccggaaaaatcgattatatagtagtaccagctcgtcaatttcaccggcgcgcagctcccaacggctattaacattgtcgatttgcagcaacaacaattggtcccaacagccatcgaaacaacaactcgggtgaccgccctatccacatgcacttctccggtgccaactctcccataagcaacagtggtgtgggtggaaggagggcaacagcggcgtggcaaactacccgaagatgacgagccagtcttttctaagcaataacggggagagagagtttacacgtgcacgtcattaactccgtttaacaatggcattgatgactcagcatgctgataggtgggtttggacatctgccatccgtttagggggtgaagatttataatatttagtattagtatatatagggatgtcaatcaaactcaatgtaaagttgatggacaatacttatttctctaatctactatcatcgctagtggcctcaaggctggacaaggaattttataggccaaatttgttttttatttttttaagtatgtgttcaaatgaatttaaattttaaattcaaagtaaaccttcaaatgaaactttaaaaatatcaagtcaaaatttgaaagtttcaacacaaattttgaagcttttgacacaaaattttaaaagtttcacgtcaaatttagaagtcttaattcaagttttgaaactttcaactcacttctggaatttatataatttcaattcttatttcaaaactttcaactcacatttttatattctattataaaactttaaaactttcaactcaaattgtgaaaaatttcagctcaaatttataactttcaatttaactatcaagttgcattttaaaacttccaattcactatttaattattattttattcaagaaaatacatttgccactgaactcctaagatattagcgctaagtgctatgatgagcggcgtggaagcacgtgctttacttcgcttctcggtgcagctgcgcgcaatagaacccccaaacatgtaatgccattattcaatcgggcgaattcatcctgagctcatgaattagttataatcaaacagtcaactgcacaat

SEQ ID NO: 4085 - DNA, 1501 bp, Oryza sativa
gcttctgcgcgctacaaaagtgcacacgatacacacccacgcacttaaagaaaagaaaccaaaagaagctcaaagactatatatccgaagactagatctttacccatgtatcaggataaagaaattctctacttttaaacattatacttgtgtttttacccctgttaatactcgtggtaatccaatatcttctaaatcatccttcattttcatttatttcaccctataatatactaactgcatcttttctcttctatctaccgtataattcactaaactacagtcatagagaccttattcataaaatccgacatcctaaattcttcaaaaccaacgccttggatcatcccacgtttccctctcacgccgcccacctgaaaatcacgttgcctctgcccctcctctctctctctcagcagaaaataccccccccaccctcatgccaatcgccctagaaccgtcgctgtcaccgatccatcaatgcgccatccttggctgtcgtctccacgcctactcctgaatcctcgtcttctcctcgatccaccgtcactactagaaaaatcatttttaatagtgttacacttttattttcactggcgggtttaataaaaatgtgcttgtgaaaataattgagtgggattgcgaaaatccattttcgttgacagttacttaaaagaagtctgcttgcaaaaatagaggtctttttacaagcggacctcttaaataaccgctagcggcagccaagaccgattgcaaaaaaattatttcactatattaacagacgcacaccgcatttcctctctgcttctcacactccgcctcctcccttctccctctcctcttactcctcctcggtgagcagcggcgctctaggcaccggggtcttctcctctccttggtggcattctctgcgcggcaagcttgggaagaggccagatccgccaccatgaggcgtcggcagccgcgcggggaagagggcggtggcggcagcggctctcggcggcagcggcgtgggggagggggcgatggggagcggatccggcgcctcctccctccccaccggcggcggtgaggtggtgatgacgagaggctggcggcggcacggatttgtcgagctcgactagttttttttttctgcctgttgttccatatgatccagatgatgcagatgttttgtgcatgttgtgatgtttgatctgtgctaatgatgattttgtattttgtgtttgaatttggaaatgagcagccatatgcatatgaattgaatttgaatctagatctctagatgtggatttgaattttgaaaatgaatcaatgggcttttctccaaatcttcgctggcggcttggcagcaacatggttttttttgccccaaattagattttcgctgacggccgatttaacacagccaccagcgaaaatgaatttttgctagcggctgatgtaagatgaccgctagcaaagatccatttttgctggtggctggcttaagatgaccatc

SEQ ID NO: 4086 - DNA, 1501 bp, Oryza sativa
cctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacctaataaatcgacccaatgcactgtagtacaggtgggttggttgggcctgttcaacgtggtgtagcgttgatcagtggagattttaatgttacttaaattactcaacagttttactgtttgctaaataaaatgttttacaaccgcctttatgcaaatagccacaaaccgtccttgtgttccctttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttgggactgtttattacttgtcgttttgtgtaccctggctggtcctggacagggatttaatacacaaaatagtctggaaattttgggctaaatttctgggcgtgacatgtcgtacccggttttgcggttcagggacgaaaatcagactggacgacaaatagagggacctaagtgaacttattccaacaaagaaaggggagaatctatataaattggcaaaatttgctacaggacatctaaaaaaacgtgtaattagttagaagacaccgcaagaacgcgtttttgctgtaggcaccaaaaaaatagtaattagctaatggatacccgtgtgattattttattatatcgggaagaattgaagagagaaataactgtgtaattatgtttctaccctttgatttttttcttttccttttttttcttcattatctttttctccctctctcattctttctctttttctctctctacacccaaccaccactacgttctctccttccgctccttccgggaggacgaggtcaggcgcctcatccgctccatctccgccgagagcagcggcggcaccgccgccttcaaccttgcccgtcgtcgccgccgcttcgcccgttgtcgcggggctccaaatccacctgtgtagctcaaaaccaaagctggtcctggggttttgggggcctagggcaaaaacttatatggagtcccct

SEQ ID NO: 4087 - DNA, 1501 bp, Oryza sativa
attcggacccacaacagaatttcgggggacataaatgaggctcctctattcctaagtagtgaaactgaaacctgtggtcctatgcatatgctcaatggtgtggtcttgcaaaagttgcaatttcttttctttttctttttttttgcgaggatcaaaagttgcaatttcaagttaagtttccattagaacttatatatccagacgccaatggcctcctgttcccgtaggcactgcgtcgagcacctggtgtgcgtgcagatgaacagagccaaggaagcaggatgggagcgtatacgtacagctgggtaatatggcagacggtgccgctgttgtaggaacagtcgcacttgatgccggggttgttcttggggttgccgtcgaggtcggtgctgccgtcgacggggacgccgcggcatggctcgccgctcatcctccacagcggcgacgtcgtcttgccccatctccccaggatcgcctccagcgccgccactgcaccgaatgtatagtaccagagtaataataagtacaataattaagcttcgcattgcattgatatcaagactaattacgtgtatatatatatatatagcagcatgatttgattacgtgctttgattataccttcgattggatcagttgttgccgcttgctgggcatgaacagcggcgatcagccatgaggagcacatcacgagcaacacccacaccagcttaccactaacaccacccatctctctctctctttctgctgccgaaacaacacggaagcttgttaaatatatagatggtgtgtttgtacgatgcaactatatgcaaagggaggctctgtattttagggcgctcatacgtactctctacgtctcataaaacaccaatctaaaataggacgagacataatttagtacaacgaatttggatactctctctgtctgaaaataattacagccctatagttcaacacttattttggaacgtagtgagtaaaaatatgtccaaattcgttgaattagattatgtatcatctcattataagttggattttttggacggagtgagtagatgagataatccaaatagttcttatcatcactaccttattactaggaaaaatgtctatatttgacgctctttcggattcgtagtactcaaattgtctaattagctattaggtttgctatattttagaatggatatagtatttgtcatcacttcttaataagaattttattaagcagatgaaaatatttgactataacaatgtgagtatctaagcatcaaaacattgtaaactacaaggtcacaaatatgcgcaaaagcctgcttacggtttatatttatagtgtgaaattgaatatgatttgtgaaaaaaaatgaaactttcttatcattatattttataacagtgtttattatcctataactaaaagaaaatcaacggtagaaaatatgaacaggcctataaaaattagccatggagcatctctagcaaactaccaatagtc

SEQ ID NO: 4088 - DNA, 1501 bp, Oryza sativa
tatctcgtcgaccaccgcgcgtcactccctcctctcccaccggtgccgcgccgctgccaactcttccgtctcccaccggcgccgcgcgtcgctccctcctcacccgtcggccgccgcgcgccgcccctcctcactcacgcctggagagaggacaaaggagaggggagagagatgaaggggagtcggggagagagaggaggaagaagaggaggggcgaggatgacatgtgggtcccgtgtgggcccccaccattttttattaatttgcgtgtgaaactgacatgtgggtctcatgagttttattattttttctagatcgaattgccacgtaagcgccacgtcagatgaagaccgagtcaaattagccacgtaggcgccacgtcagccaaaaccacccttaaacccgtcgagggacttaatttacaccggttttgatagtcgagggagggacgaaaatcgaattcgttgacaagttaagggacctcagacgaacttattccattcaaacgagacattgaaagcccaatagttttagaaataagtctattttacctcttttaattcttgctcctgattgaatcgcatccctcgaccacaatttcggtattgccgattgggagatgagattcaataaagagcaagagttaagggatgtaaatatacttatctatagttttatccaagatgctttgcacacgtcacatgaaacccactcccacaaagaaaacgtaaaaaatagcccaactcgaatcaatccacgtctccaccgttcatctaggcccacgccgtcggaaaaggcgaaggataaagcatccaccctggtagtggtaggccccacaccgtcagcggcacacgcgctcagctcctcccagcggccggcctcacggctcacctgacctgtcacctgaatcacctcggctcactctgctcggcgtctccatccaccctggtggtagtcaagcactcaagctagtgtaacggcgagtctaccgccgcgttgcccgacgcggccatgccgccgccgcccgaagacgacgggtcctcctccgcgcggacgccgctcataccccccacacctcctcctcccggccgagcggtggcgcggctccaccctctcccgctcctcgttgcggcggccttcgccgcatcgtaccacctcctcgtcgcgcccgcgccgtcgtactaccgctcgctcttcctctccctcggatccaacgacaccgcggcagcccacctccacgcgctcaccctccgcccccacctcgcgggcaccgaggccaacgcccgcgccgccgagcacgtcgtctccgcgctctcctccctctccttccccacccgcgtcgtgccctactccgtcctcctcgcctacccggtccaccgctccctctccctctcggcgccaggccacgccaccaccccctttgcgctggtgcaggacacataccccggtgatccctatgccgcggtctccgcggaggccgtccccaccttcctcgcctacg

SEQ ID NO: 4089 - DNA, 1501 bp, Oryza sativa
cccacatcggcgtcgtgggatcccccacccccttgaacgtgctcccgacctgcacaccggtgggcggcatccatggaccatccgggaaggcctcccccgccgcgtagtccttggcatcggtgtatatgaccgccgccgccgcgccagctttccgggcgtttatcacgatgtcgccgcggtacaccttgccgtagcgcgcgaggacgaccttcccggtgacgtctacgccgcgggcggcgaggtaggcgaaatcctccgggcggccgtagttagcgtagacggcctcggcggcgaccgagccggacgcggcgtaggcgaggaaggtggggacggcctccgcggagaccgcggcatagggatcaccggggtatgtgtcctgcaccagcgcaaagggggtggtggcgtggcctggcgccgagagggagagggagcggtggaccgggtaggcgaggaggacggagtagggcacgacgcgggtggggaaggagagggaggagagcgcggagacgacgtgctcggcggcgcgggcgttggcctcggtgcccgcgaggtgggggcggagggtgagcgcgtggaggtgggctgccgcggtgtcgttggatccgagggagaggaagagcgagcggtagtacgacggcgcgggcgcgacgaggaggtggtacgatgcggcgaaggccgccgcaacgaggagcgggagagggtggagccgcgccaccgctcggccgggaggaggaggtgtggggggtatgagcggcgtccgcgcggaggaggacccgtcgtcttcgggcggcggcggcatggccgcgtcgggcaacgcggcggtagactcgccgttacactagcttgagtgcttgactaccaccagggtggatggagacgccgagcagagtgagccgaggtgattcaggtgacaggtcaggtgagccgtgaggccggccgctgggaggagctgagcgcgtgtgccgctgacggtgtggggcctaccactaccagggtggatgctttatccttcgccttttccgacggcgtgggcctagatgaacggtggagacgtggattgattcgagttgggctattttttacgttttctttgtgggagtgggtttcatgtgacgtgtgcaaagcatcttggataaaactatagataagtatatttacatcccttaactcttgctctttattgaatctcatctcccaatcggcaataccgaaattgtggtcgagggatgcgattcaatcaggagcaagaattaaaagaggtaaaatagacttatttctaaaactattgggctttcaatgtctcgtttgaatggaataagttcgtctgaggtcccttaacttgtcaacgaattcgattttcgtccctccctcgactatcaaaaccggtgtaaattaagtccctcgacgggtttaagggtggttttggctgacgtggcgcctacgtggctaatttgactcggtcttcatctgacgtggcgcttacgtggcaattcgatctaga

SEQ ID NO: 4090 - DNA, 869 bp, Oryza sativa
ccggtttttttaaaagaaccgacacctataatataaatataggtgccggttctacttagaaaaaaccgaccggtcgacgtccttatccactcgcatctcttgatcggtcgctctacctcatccactcgctcctctcactcctcactccatccactcgcatccccctcccctctcgccctctcccgcctcctcctccttctcctggcagcgatgcgctgacagcggcagcgatcgcaaggaggcagcggcagtggccccttctccagcggcggctacccccttctccttgcagcggtaccttctcccggtagcggtggcggctgcaaggagacagcggcggcggccgcaaggaggcagtggtggaggtccccttctcattgcagcggcggtggccccttcttctggtagatatcatgccaacgtcagcgagatgtcagcatgaaacctaggcacagatgccatgcttcttccatgttctcatgttgaaaattcatgccaattatttctatcacactcaatgacgattgcggcggcgaagcctgcaattaacactacatattgccttgtgcaggtgatatcatcaccaattcaccattagctatcttacttgcctcctataaataccctcagccggaagggttattcgtatgcatcaaaaacacacaacgctaactcatcacgagtttgatacacatagtaatcctacgtaatcaagcttagattgtgttaatcaactcaatactgcaaaaaatcgtttttgcaggcggtcaaattagggtaaattaagtgactgtaagctttgttaaacgccatggatttgatgaagagtaatccgcttcaggggagcccatggagcttgttgaacttgc

SEQ ID NO: 4091 - DNA, 1501 bp, Oryza sativa
gaaagttttcaaatctgggttgaaagttttcaaatatgggttaaaagtttcaaatttgagttgaaagtttttcaaatttgagatgaaaagttgaaagttttcaaaatctgacttgaatttttttttcaaatttcgagttgaaagtttttcaaaattggacttcacgtatagatttcttatcaatctattagtaaaaagaaaaccttccagaaaaggaaaatattgctaattaccatcattaccgctaattacgatgctgcagggcgttgaggggggtacggctgcgtgctacttccgtagccagcgcgcgcgtaaaataggaatccccaagttaatgagaaaagcttataaacccattgacgatgatcaacttccattagaagattataagatgttactagaacatataaaccgttttatgaaactaaggagtggcagggaacaagattgctctattttttaactcgatggagataaatattattataccaatagaagataaaggacttatttgatacatgtaaactaagcataattttattgtcaacaaagaaatttttaactgtttactttctactaccaacactttgaagtcaatataaaaaaaatatgtaacgtgagagaattaacaggggaaaacatacatgtagttctaccactaatataggtgattatgcacattgaagatagtgcctatgtactccacctcatttcttacacttagaacaagtttacttataaagccataattctaaaaattaatacgtcatatgtaaccaatttaacaatctttccataaaatagttacatataaatatatactcatacacatatggttttaacccatgatatattaactctgtagctcacttttttctctcgctccttcacctaagcacaaatataatgtgacaatttttagagcccacttgcatcactaactgtactcgttcttagccaatttcagttccgcaaatttctgtttcatcagacactacgtgcttgtgtagttcccaacttttttattcaaacttctaacttttccatcatatcaaaactttcctacacacataaacttttaacttttttcttcaaactttcaattttgacgtggaactaaacctaaatcgtatctcgttatctagtgttagtttataattttggtagtttgaccgaagacaaacatacatcctccaaacatctagaggagagtaatttatagaggggagaatagtagaagtagctgattaaggtcctccaagcgaaatcggagtcgagtcttgcaagtggcagcatatttttgagatagaaaaacttgaaatgatgtacacagccagattttacacggtggccgccgcgctaaatccttttcccttcccgtagaactaacacagtactccgctccgcgtctagccgcgggtgacgtcagcaccaccaccatctgcttccccctccctccctccctcccgtctcctcccccattccatcgcatccgcataca

SEQ ID NO: 4092 - DNA, 1501 bp, Oryza sativa
agtcttggttttttaacaattggaaggaactgttggtgcctgtttctctgtctacttttcttttgctggggctcaaagtaagcatcagtgggcctattctaattccccatcgttctctcagattttatctccacattttgtttgaactttgaggggcacaaaaagatatattgttctatctttcccctccttgtctggttacataagataatttcttttgaaatattaggataagttttcacttaaagctgatggtattcttcacctacaaagctgttaatcaatagccaaagaagagattggtgtaaagttactagttttatttgtaggttttaacttcagttcctagtagatattaattgaactacaatttagtatttattggaacagaatgagagcattatttttctacatttgtgcaaaatacctcgttggttgtactaaatcatcaaataggggtgttactagtttactcagcccgctcgaaactggaaatcaatgagtttaggcagtgattaccttagcttctagttgagcatgccagaaaacagactaccaccgattttgaatggtaaattcaaaactgggaatgaacagccctacttcaaaaacattttgaggagttaatgtaacactaccatctgcagactccattcagcctaccatctacagactccattcagccttccaggccctgtggttggctggtaacagaattatgtccaaaccattgttctgttatgagttccccaattgtagggatttcatcttatttaatggtagaacaatcacgtgtatgattaatttacttctgaaccatgacttttttccatgtgatacattaggaacataactacctttgggcagttgatcagttgatgcagtgacatatactattatgaagagtgtgatccatatcagaaccgttaatggtttcttcatgcatatgcatacttacacatcatacatcttataaagagctacagcctacaggtatctgtatctattcaagtcattctccaaaatatggataacaaatatggatagcttatgcacaccgtggcaatcaaatcacctgtgcatgcaagatgccaacctttgctatccagaagttagaatatctgcactttttcttatgttccctctactatataaactcatcccatgttcgactttgtatatccatagctcccacaagtcatatgttcatcattaagtgtgttccaacctgtaacggcttcactttgtcacatatttcctcattcattcatataaatggattattctaatttgcgtcgccaagctgcatccatgaaaaagagcctctttgatcaggctagtatcctattctctggagttcttttttttccctttcaacagtaatcttatgtgtgctcagggtgtgtcgaccatattaggtcttatgctggaagtgtccacatctgatcccattttcagtattctactgctctttcatgtaattctttgacagatgtgctga

SEQ ID NO: 4093 - DNA, 1501 bp, Oryza sativa
gtcgaaaaatcaacgacactgtatattaaaaaatagaggtaatatgatgtcagttgccaaagatcgatgttctaattgttgtctttagtattatccataaaaggtagctgtctcaagtgttgaacatactcatttacttagtcctacataaatcgtgcacatgttgacttcgtaaaataatacacacggctgtgttagatagtgcagaaatgctgagctagttagttgcacgggaaccaaaacagattgttaacgtatgattaattaagcatgaacttaaaagaaataaatactaactattatttacttgcaaaataaataaatttatttttgaaacagcttctatataaaaagtttttcacaaaacacaccatttaatagatcggccgggaaacatgcttatgataaatgaggaagtagcccactcaataaacggttaaaaacacaatctaattaagcaagaacagtatgaatgttattttttctttttttcttccttcattagtataacatattttgaaacagaaactgtatgctttaatttcacaatattaattagcccaagcctatggattgctcaaaatcaaggggtacaccaaacagataaagacaataagaaagactaaacatatcttgacacgatttctacgtatatgtaagcatgctttgctttcgtcaaaatgtcacgccccgaactagtcccgaccggaactagcccgtgacgctccaaattaacctgttaatcgataccagtcctaggaaacagtgctggtatcacaggaagacagaatatcacagcaacagaggtctctttaatatagagaaggagtacagtcatattgggctgcagacagatcccgagctcacaactgcattacaaaaggaaagcggaagccaagagttggaccaaacaacacaggcgcgacttgggaactaggccgaaaccctaaaactcaacgtagccggcttgctcctggaagaactcctcgtcagcgggatccgcttcatcttcttcagcaactgggggggagttatttatatagagcaagggtgagtacgggagtactcagcaagccatgggaaataagtgtttaatgcaggcttcaaggaaaggctgttgtttttgcaattgattttatttgaactcttttctgaaaacaactaagtgagtgcttctcaaacgacacggatgagacagtgcgtctcgtccggtcggagtatgtgcaaatgtatcagtctttagaattgatcaagattggcacccggccaacaactttcaaacggccacccgggccaacaactttcaaacggccacccgggcctagctgatcccatcagctgcagattttccaagcatcgatcccctttccacaacagcaatttcacaagcagtagtcaaacaaaactacgctaggaatcacctcacatccgcgcatgaccgtgggcacggctgttcgaacagtttgttaacctctgcagaggggggtacactttacccaca

SEQ ID NO: 4094 - DNA, 1501 bp, Oryza sativa
tcaatgttacattacgattcaacaacatttctgtggaggtaatataatacagtgaatcaccatgaaggcacggagaatacacacaccctccagattcctaaccaccggtgagtttcaaatccaaattgaatcgtccgatgcatgggtgagttcaatcgaagcaatcaacagaactacgaattgggggtaaatacagaaacactcgaagactaacctcgaggaagtcaacaacggcgtgggcgccgctggcgaatccaccgcccgtcgctgtagcgttcggcgccgccgcgggagggggcgcggctctagacgaggtcaccgtcgccgacgccggcggcggcgtctccgcccccgcgtctgctaatgggcaaggtagtactgtgggccggcatggacgaggcccaatatggtagcgatccatctcagtgtgggcctctagttaaatcaatgggccgtcaagattggacccacgtttcggccgtcaatttcttttgcgggctgaatgggctgaattctttcgtccagaagagatgggctagatttatatatgggctggattgtatcgaggataagaggtagtaggccgaatttgtttgtgggccaaattctctgatcccctccggcgccggcgccggcgccggcgaggcggagacggcggcctcgtggctgattgaacggaggcgctttatacttctcttcgccttgtcaaattcagttaaatgaatggaacagtattctgtcactgaaagagagatctacgattattctggccaattctggctagttaattagccatgcagatgttggagaattttcgttttagacaagaacaaacagatgcaggtgaattggtctatgcaaacatatactcctatatattgatcgattgtgtatttgtgttttgatgattgatagtgtttcgatccagaagatagtttattagtttggcttatgtctcaccgtgatcatctcttaacgcaagataaaattggttgttggaatcaactagtcagcatctgcgtgcacacggagaaagcaagcagattgctgcagtgttttggtttcttttgcaacttccaatgctctctacgtatctgacctaaacgacaaccagtgtaccactaaaatataaacttgactgtgtttttgtagggtatgtcctatgctggagtacaatggatggtcaaatgcctgggctcatagaacatggtatcgactatcgacaggctactttccctgaccatagggcatatatacctgcgcccaaccttacaacgtacacacatgtagtcaagcagaatcaaagaaaaggttgcgtttgattgtcccaatagtcatacgatgccaacctcttcttggacttgtactcacgaagcacacggcaacgctgctctgctttgataaaaccagtgaccaaatggcacagattgcatatttgcacagcaactttgtatggccttcttttttctttttttttacactcactttgtatggcctccag

SEQ ID NO: 4095 - DNA, 1501 bp, Oryza sativa
acctttagagttagagactaaatttaagttaggcacatatgctagagaagactccaacaatggcctaataattaaccctgcaactgcaaaaaaacatacttgttcactttaatagcacctaaagtttatcccatttccatttttgacacttctgtcaattctcaatctttttccgttcgccttgatctctattgacccagccacgcacgcaatatgacgtttctacccctcacaagtataagtaaaatgcatggcaatgaggggagaaacatcatatcgtgtgtatagctagatcaatagcaatcaaggcggacggaaaacgatcgagaattgatggaagtgttaaaaattggatcagggtgaactttggatgctattaaagtgaaccgatatctttcgatgctataaaaccaaaaacgcgaactttcgatgctatataaccaattttgcctaggttttttcccccaaatttttaatggagtaaaaccgtcaattttgaccttatcttttcttcttcttatctctatactccgtagtacatatacacgcaataatatatgcatgcaaactatattgaacagacgtcattacacatgcaagatgagctaattaaggttagtggatcgatacagctatgcgccctgcgtgcatccatgaactatacactatatatactacgtacgcatatgcatgaaagatacactttgtgtgttagcaagtgtatctaacatatactccctccttccctaaatgtttgacgccgttgacttttttaaacatgtttgaccactcgtcttattcaaaaacttttatgaaatatgtaaaactatatgtatatataaaagtatatttaacaataaatcaaatgatagaaaaagaattaataattacttaaattttttgaataagacgaacggtcaaatatgtttggaaaagtcaacggcgtcaaacatttagagatggagggagtattaccctgagtagacgattgactcattatataatgatgataatgatatgtgtgtgctagctagctattgttgatttgtcgtgttgtaatatatacactggatatatatcatactatacgcccataaaatttcgcccactgcacccttacatgcctagactgggtactcggtattgttctttatgcaagcttagctttctctctgcatgacctagatctatcgagatagctaaactatatacatatgaactttagaacttacatgtaatatttatattcaagtctactcataagatcaaagtcttcatgtcttcatgacaagccttgcatgcacagaagtcgtatattccacctaattctgcagtactctttcttgccctctgaagtagactttctagttatcctgtaattgactaaagaagctgcgtcttgcatgacagcttcaagttacacatgctgtctggtgctataaatacccacgaactcttcactcaacattcatctcatccttcacttcagtggctccatcca

SEQ ID NO: 4096 - DNA, 1501 bp, Oryza sativa
agttaaaaccagacataatattgcctaggacatcagatgatccgattttgttaattgagagacccgttctatctggtatttcggtgtaggatggattttagactcggcgataaattgagggacgaaagtaaacttattcgcccagggatacatatgttatgggcccagttttttctgtccgtccggagtacgagacacatatatgggctgattttgtcttcgaaatttgttttaacttgatgggccaaaactttgatgatcatatatactgtaagctaagaacggtcatatatctcactggctagcactagggctgtcaaaaaagcttgaggctcgcgagctgctcgagctcggctcgttctaggctcgattcgagctcggctcgagctccagacgagccgagcccgagcatctccctaagctcgcgagctttgtcgagccgagctcgagcttctaacgagcctagtaatatatcatttttattgttatttaataaattaggagatcaaatatgttatttgtatgtcttatattgacataatatatttattttattcttttttcctcttttattagtatgataaactagaaattaatttttttaaaggttatctttgaaatatatatatattttttacaagctcggtagtcgagctcggcttgatcgagctcgagccgagcctgtcggaaagctcgaacattttataggcttggctcgagctcggctcgagcttgtatcgagctcgagcctaggctgacgagctcgctcgagctcggctcgttgacagccctagctagcacactgctgcacaggaaggcatgcatcctagaccagaaaaagaaaaaaaaagaaaaggaaaacacgcacacatgccataataaagattataccatccatttataaaatttgcagaagaattcttgaaggggatctgggcatgcaccgatgcacgcgagcacgtcggcacacatcatgatcatctagctagctgcaagtatttgagaaaacccaatgcaatagagaatgaaatcgatcaagaccacaaatctgagagctatagcttggcagctagctgaacaattaatctaattttaaggtctcagcgccacatgatttgtgccaatcaactgcgctgcttctcctagtagcagtggtaattaagttagtaacaactctggctagttaatttagcgtttattttccgtcaaaatttttatattacgcacaagtctaatgcctggactaacttcactaggtttagtggattgacttgtacaatgtcaaactcatatgtagaagccagcttaataaggccaagtttagaagttgaacagatatgtatagtattccctaaccgggctattttctctctcgctgaggtttgcagattcgatatattactgagcaagtggcctcttgcactacagctttgcaaggtctccagcactataaataccaatgcaaagctaatctttcagtcatcatatccccttaacttca

SEQ ID NO: 4097 - DNA, 1501 bp, Oryza sativa
aagttttcaagaaaacagttactttgcaagaacgtaagttgaagagcactgctacacgtactaattttttcttactaaatttgtactaacaatcatatcaaccgtttgatttaagcagatggaagttataaaaaatctagatggactcatagcatgacatgtcagtgttagtaaaaatttagtaagaaaaagttagtacgtatagacttttcctaagttgaatggcccctcctgctaccaaataaaacaagaatgcacctttgatctttttgtttatccaaacctcaagcagcatccctgcgccaactccagcagcacacgcagcgccatagattgccaatgcagaaggcaaagatcgccgaggcagaaaatagcattcaggaacttgtctgattttcttcgggagacgctttttaacaactggttggcttgggtcggtgctcaccgaaccaccaactgttttccagtccacattcttcagcatatcttttgtgtcctcactgcccatcctgaaaacgcctgtatgcatcaatgttaatcagaaccaagctccaaacactatctgagaaagtgagtggcagctccaaacaccacgtcccactaggcccgaaaaccttaatccgcgaatgtctgaacgcggcaatgggggtttgggtttagggtttccgggggagaggaagtgggggatggattccatggtcttagagggatggcctgggaggcagaggaccggcggcggcggcggcggaggggcggggcgaggggatgtggaggaggaggaggaggaggaggcgcggagctgacctggatcgcctcaccgtcggggaggtcgagctcgtcggcgtcgtcaggaaggtcgccagcgttgttgcgtttttttctcgctgtgtggcgttggagaagcgagagagaaagagagaggaggaatgtgggccgtgggcctgggccgtctcagcagcagcgctgacaaactgtaacaaagaaggcataagttcactttaggtccctttatttgtctcttagtccgattttcgtccctgcagcacaaaaccagatacaacgcatccccaacttataaaacccgtgcaaataaggtccctcggcagtatagtccctggtttcgtttgacgtggcaaaaaaaaaaaaactaggacccacgtgtaagtgactgttcgactaaaaataaactatttatagtgggacccacgtctcctccccaatctcgctgtctcttgccgtctcctccttctcccaatgcggcgacccagcggcgggatccatgcggcggcggccaacctggcggcgggacgatgagcagtggccggcggggaaaaggggcagagcgcgccgacttggagacgcttcggcgacatcgtccacctcgacacgagcggtggacgcggcggatactcctcttcctcctcccctctcttggtcactggccagtggtcaccgctcgccggagaggaagacaaacttgtggtggtcgtcggccgattgg

SEQ ID NO: 4098 - DNA, 1501 bp, Oryza sativa
ttgctggttttcaaatacttctctgttcatcttttctgggggcacatctcgtgtactatctatttggcagaatcgatcgatcgatcgaatgctgcatatgcagccactgcatgcagagctcgaggtcaactcgaacactgcgacttgtcgctgattactccctcggtgtctgcacagccataattaaggcacgttaagtatacactttcagaggaaaaactaaacaaaaaaccccatgaggccctctcatcgatctcaccctgccaatgtggctaataattttccgggacttcgccgtcggcgacgcgttgaatccccaggtcgatgcactacacgccgtgtgcaaatccgcaatccatatgctggtcaacattgtgattaattaccacgatggactacttagcagaagataatctcaactcgaccgagttgctgcaccgacgaatgaaacattcatacgaatcgcttaacatctacgtacactttgatcgagctaggcagctggccaatgggtttatatataatctggctcgaatcaggactggcattacatacgtatacgaataattttgtaatttagcatgacgcaatacatacggatttttcacttgtttaacctcaactatgcatattcaagttagagggaagttaatagtgcaagagcaccgcttaattgtcactgtgaacttagcattacctgcataattaaggattgagatgcacaggcacactgttccagtaggagaaatttctaatcggtgtcatcagatgaagggaatcgaatctagtatagctcactaggcttcgaagaaaccaagcaacacagctagctaatctaattaactccacaccgaattatataaacttctgcatcaattaattgccaacaaaatatattaccacatcgaaagttcgcataagaaattcaggcatcttgatcgattcgaaagttcgcataggaaattcaggcatcttgatcgatgcagtcatgttggtcaacaaactcaacaatcaacagatgctatgcactacactactaagagcaagtttaatagtatagccaactacaagctctaaatcatatatagtcaatataatagccaattcatacaataattgcttactatactattaatacctggccctacctgtcatacacacattatgtcttggagtccgtgctgcagctggctacagatctgtagctcgctgctcttctctctcttcctttatctttttaaaatatgtttatagctagcttatagcatgctattgtttatatttttaaaatatatttatagctggcttatagcctgctattgtatctgctctaatccatgcatggttaatggttatcgaatctcctttaatttgatcgtcgcacatggcgccaagtcgatctcatgaagaggaaattaaatctcccgccatccgccgctcgctataaatacccgcgcaaacctatccgctgatcaccaccacctctctctctcgatcgcca

SEQ ID NO: 4099 - DNA, 1501 bp, Oryza sativa
ccagccctataaatacccaagcaatccatgggttatcatccatcccatctaagcatacttagctaagctcaaaaatggcggcaacaaagcttgtagctcttagcttcgttgtcctcatgagcattgggttagccaatgccgcaagggtgtctagattagccaatgctcaaggtcaaggctcgggtaccgggagtggtggtgggtacgtgaatggcggcggtgtagggaacgggaatggttatggagttagccagagcgggagcggaacccatgcgaatgctgggggagggggttggggtggaggtggctcgcagtacaatggtactggttttggttctggatcaggccaaggctcgagctcgggctcggtgagccagggtggtgggagtgcgagcgccggaggaggcggtggtggtgttgccggtggacaagctggaggtgttgatggatccggcggttatgggactggcactggcagcggaaccggatctgctgcggcagacggtggtgcttcccctacatcctccccgccatatgcaaatgccaatgcaactggcgatggtaacggcaacggtggtggccaaagcggtgggagcggaagcggtgggggtggtggatctggttacggtgatgccaacccttaaaattttcatttctatgtgccgaccaaagttacattggagcccacgttatcattaataatttcattcaccttgatatggtagtatttgttttgttttgattttatcctttgatgtattagggagcaactaataaagggctccatcatttctagtttgttgtacccttttttctcttttggaaggaattttaattagttaagttaatgtatcacttttagagttcaagggaatgccaaaagctgtcacagtgatctttgagtgctatatgtgatcaggtttatatgatgttgtctccgaatcttctttccatttgtgcacttgtatctccacttttattaagactacctccacatgctttacgactagatagattgtgaaccaggatcacctgaaatacctatagctgtgtattttatactacaacttgattagtttcgaaaaaataataggtttggtacagtggaaacaattaatgcatctcgtcacctcactatactggaagaaatagaactcctaaaaagccgatttttttatttatagtaattattaatccacagattaaatttatggtaaataggagttgctatttagcaaaataggatggacgctaattctaatagcgtccaaaaaaggacgttgctttccatagcgtccaggtctggacgtcgttcacctcagcgtccagctatgttgtgcagcctaactatcccaaagccatatccattctatatacgagaaatagaagcgaggaatccctgcagggagaactggtgcggcatcgaggattcgaggctagggcctagggcagttactggcttactgccgccgatccaacaggagactgggaagtgggaagc

SEQ ID NO: 4100 - DNA, 1501 bp, Oryza sativa
agttatatttgatagtttcttaatgaaaaacttttaaacataattacattaaaattagcatgtaaattatatagcaacagccacacgggcaacgtatctggatttgattccttccaagcacgcgcacgctaatatatttcctctcagtagcacaaatcttaaagcatatctgatggtggaaaattcaaaagttttgagaaaaataataatatgaaacttctttttagcaaaaccatttgcgttttcgttgtgtccaattgccaaaccagggtatttttctcatttatttcagccagtcgatcgggtatgtgaaaacatagtctcccattgtctcagcatcgcattctcctctttaaaaaaaaaaacagctgccagtggatacaaatttacacagtaaatcctcttcaaacgtatccggatccgccaagcgaaattgctcttccctcgatggtcagatgaagtgtacgtaaaatgatcacttaactgaatgcgagcacacactagcgcacactaccaaagaactcatcttttgtccaatgtcccaaaccacaaatattatagatgtattaagaataagtactaaaactctttagtaccagttctaaaagccaaagtccgaggaaatatctttagtctatgttaatgctaccaaccggaactaaacatgcatctttagtaccggttggtagcaccaatcaggactaatgctggtgaatctttagtccttattgatgtttatcaaccggtactaaaaatgttatcaattggcatcgtcggcagcgtcagcggtggcacggcacataacatcggccaagatatatagatagcgttcaatggatcgaccagcgcaccgaacagctcgcacaacgtacaataagaatgtattctggttaacccgcaaactcactaatagatcaaaataagtaaatacataacttattttagttaagtggttttcgttggtttaaccatttaacacacttatgtgcaactgattagaagtacagggatgccggccggctcaccgaccgctctaacgaagagttgtcagtgaattgaaccgtcggatcgaatgaattttacggatcagatcattcgtgccgatgagatcttttcctttacgatccgaacaccctccatgaatttcagatgctcatcgtcaacacctctcaatttggactaagctataggtttaagcgattcgaagtcaacatcacacatattttaattacggggtatagtaataagttttgtggcagtcaaacaagattggatccggccggttaattaaaaataagtatcactagctacagctagctacactcctagacctagtacattttcaccaactcgccatattctagacacttccatcaatgcattgcagtgatgccactaacataaaaataactatgaacacctccatccagccctataaatacccaagcaatccatgggttatcatccatcccatctaagcatacttagctaagctcaaaaa

SEQ ID NO: 4101 - DNA, 1501 bp, Oryza sativa
ctctagatttattaacatcaaaatgaatatgggctatgttagaaaagtcttacattgtaaaacggatgaagtaggaaccatctggcagtttttacttcgttgtggtatatatatgatgtgtgtcagtaactcagtaacagtagatatgcaagttaattacagacatctacgtcttctcgcctgctgaacaattaatgaaagtatgtctaaggttgtaatgcatattaatcaaaattgttcagagttttcaccagtggagtacacactgtacgtatcgatcgacctaatcaattaacagttaattagttactgatctggtaaactctatcagtgatgagtttttaattgtgcattggattaactgacgaaggaacctatcggaaatcggttcattcagctgtaactccataatggtgaatggatggtcaaattggtagggattgcggcatcgactcatctttcgtggggaatctccggaagacacatgatccaagtaatcaagccacgcctctactcatcgttcaatgtagcaacagagattaatttaaagcggaacccccgatgaattactattcgttaactgatgtgcctttagcattatatttgtttctttagcattatatatttttaaaggaacgttatatatgatgctacattaattgtgatgttgatttttttttccagaatttggtttagctaaatgggtcggtttagttgcaaagtttgaacccaaaaaaatcacatcgaacttttctacacacacaaacttccaacttttccgtcatattgttccaattttcttcaaactttcatttttggtgtggaactaaacacacccttggttggttcacaacttcctgttcctgaaaactggatctgctatcagatcactttattacatgccttttttcgccggccaatcagtttatatgcctatattttgctcgaaaaaactatattcagctaataatgaaatttagacttatattaggactatatatatatactcgcatgcgaactactagctaggctttacgttaccatccaccgataacccttaccgtaccgcacgataagcgtggttactacggtaacctcgcggttaggttaccggtggtttgagtaacaccctgctactatatagccagtatatatggaagtacaggatgtgcagtgcctagctagccattggaaagaggtgcagaaatagataccttaagcgatatacgagatgatgagcatcacacagacttaatttgtaagttttgtggcagtcaaacaagattggatccggcttactaaacacaagttttactagctatagctagctacactcatagacctatatttcgccaacacgccatccaaacacttggatcatgcatgcgtgctgcagtgcaagtgcaagactctatcgattgggcactataaatacctaagcaatccttgctttgccattcaacccattcccatcaaagttcttaactagttgagcccaaaa

SEQ ID NO: 4102 - DNA, 1501 bp, Oryza sativa
catacccgttcccttcttgctcgtcgccgctggttctacttctccccatctccgtcgtcaccggatccgcgccgctgccccctcgattggacgaggctgagatccaccatgcctgaccatcgtcaccacctgatccggtggaattgttgacccttcgtcaccggtccaatgccaatttgtcgatgaacactagccgagtcccaaagcaacgacaatgccagggagaggttcgccgagctcccgaggagagctcctcctctggggtgagagagaataggaagctggaggtgcgtgaggtagaagacgggaggttgacgtgagggcaattttgtccaatacgagtaaaaaacgtaggctagtggcatgtttcaaaatatatgcgaatggtaatggcactagaccaaatacgtgaattgtaatggcgtttttttcaaaaccatcaaatttataatggcatatatccaattaacccttttaagttatacttacttagattttatgaactttatagaaaaatatattaatatttcaaaacaaaacaaataaaatattaaaatatgttcaatgttagatgtaataaaactaatttagtgctatagatgttggtatatttttctacaaattaacttgataaaagttttgagaagtttaaaaagagccaaaacaacttatgatataaaatggagagagtgtagttgtgtgcgtgattataactgtaaatagaaccaatactatatatacgaactaaaaaatcataaaaatataagcaccgtactccctccatcctaaaatataaaggattttggatggatggtatattttctagcactatgaatctagacaggctccctatccaaatttgttgtactcgaaagtatcctattattcgtctaaaatccactatattttagaacactatattttaggacggatgagtagtaagaccaacagtacctatatcttcagttgctcgcgtactgatattcatgtcaaccaacactacggactccaaggtcgtcgcatctgcaagactgcagtgccaacttgttgtaaatgtcaaaccatgcgtcaattccgagggaaagaaaacgtcggtgcatgcgtaatccagctatgaaataacatatcgatatgatacaaaacacgttcaagcttttaatttggtgatttgaacggcatttgaacaaaagaaatacatgcatatgtagctacagcaagagcattactatatattagactttttgcttatatagcctcaagtacaacacaagttatagtatataattactactcgtgaatataataccacttgctgtttccaagcctccacttgtatcccctgatcgcttgattagggagatctagctagctagctccacattgtaacgtagcagtgtctactacaaagacagagggactgcatgggggtagtccataaacaccactataaatacatacatagtattcgacatcttgaatcgcgcactagtaaagctaacaa

SEQ ID NO: 4103 - DNA, 1501 bp, Oryza sativa
cagctatgacaactatgccatggcatattattttggtacaagacgtattatttggtacatatttattttagggccatatatgttggcacacatcattcacatagttcatttagataacagtcctatgggtgcccaccactataggcagatccagaaccgcttccagagccacttccatatccatggccacctgggccactctgccctccgccgccgccgccaccttgaccacctgcatgagcatagccaccaccgtagggcccgtatgaaccagcttggccgtaaccagatccagaaccagaaccataacctgatccaccattgtatccaccgccaccaccaccaccttgtccgccaccctgagcatatgctccaccatgaggaccgtagccaccagcctgaccatagccagagccagatccggaaccatatccagacccaccatttgccccaccacctccaccaccaccttgaccgcctccttgagcgtacgcaccaccatgggacccatatccaccagcctgaccataacctgaaccagatccagaaccatacccagatccaccgttttgtccacctccaccacctccaccgccaccacctccactagcatatgctccaccagagcctccagcttggccataccctgagccagagccagatccccacccagaaccattccctgacccaccaccacctccgcctcccccaccgcctcctccagcgctcacatacctagctacccttgtagcattggtcagtccaatgccaaggaggacgacgaagctaagagcaacaaacttgcttctagccattgttatctcacagatgtgaatctgaaggttgagatgagagtacgaagcgtgtgtctctatttatagtgctggaggccatacaaagtgagtgtaaaaaaaaagaaaaaagaaggccatacaaagttgctgtgcaaatatgcaatctgtgccatttggtcactggttttatcaaagcagagcagcgttgccgtgtgcttcgtgagtacaagtccaagaagaggttggcatcgtatgactattgggacaatcaaacgcaaccttttctttgattctgcttgactacatgtgtgtacgttgtaaggttgggcgcaggtatatatgccctatggtcagggaaagtagcctgtcgatagtcgataccatgttctatgagcccaggcatttgaccatccattgtactccagcataggacataccctacaaaaacacagtcaagtttatattttagtggtacactggttgtcgtttaggtcagatacgtagagagcattggaagttgcaaaagaaaccaaaacactgcagcaatctgcttgctttctccgtgtgcacgcagatgctgactagttgattccaacaaccaattttatcttgcgttaagagatgatcacggtgagacataagccaaactaataaactatcttctggatcgaaacactatcaatcatcaaaacacaaatacacaatcg

SEQ ID NO: 4104 - DNA, 1501 bp, Oryza sativa
cgagtgagatatagcaaaatcgatagcaaaatcgtaataaaaaatggtgtgacccacgtgggcccacacgtcatcctcactactctctatcccctctctctctctctccctcttctctttctccagccggcggagcgtggtgggcggcggccggagcggcggcagagcagagggatggaggaagagaggggcgaagcggggcgggcggcggccggaacggcggcggaacgtgggcggagcggcggccgtaccggtgcaccacgcgcatcaccccctcatagttccacatcagccctgacagtgatgccgcgccgaggtgtagcggcaggtgcctgcacaccaccgcagtttcccgccacagcaccgaccccgcagcacgccgtcgagccaccgcagctgcgcctcacagacggcaccgttgaacatcacgaaccgcctggccacgccggcaaggccgctcgggttgttcttgtccgtgttcgggttcctcttgtccaagaatctccccgctgccgcggccatcgggtggtcgcgcgaccatcccacggcgttgaagtcgtacgcgtcgaggaagcggtcaaactcggcgacgacggcctggacggccagcagcgacctgtccttggggcagaagccgtcgacgatgtcaccgaagttgacacaaaagcggacggcgccaccgccgccgtcattggatgcttgtggttgtgggcattccaggagcggacggctctctggaggacggtgaggctgtggcggtagtagcgggggacgccgaggaaggagcggccgtcggggatgtcagtgtgctgggcgtcggcgttcggcggctgaaccagcatcggtcgtcgttgccgaatgattgccaatcggccgacgaccaccacaagtttgtcttcctctccggcgagcggtgaccactggccagtgaccaagagaggggaggaggaagaggagtatccgccgcgtccaccgctcgtgtcgaggtggacgatgtcgccgaagcgtctccaagtcggcgcgctctgccccttttccccgccggccactgctcatcgtcccgccgccaggttggccgccgccgcatggatcccgccgctgggtcgccgcattgggagaaggaggagacggcaagagacagcgagattggggaggagacgtgggtcccactataaatagtttatttttagtcgaacagtcacttacacgtgggtcctagtttttttttttttgccacgtcaaacgaaaccagggactatactgccgagggaccttatttgcacgggttttataagttggggatgcgttgtatctggttttgtgctgcagggacgaaaatcggactaagagacaaataaagggacctaaagtgaacttatgccttctttgttacagtttgtcagcgctgctgctgagacggcccaggcccacggcccacattcctcctctctctttctctctcgcttctccaacgccacacagcgagaaaaaaacgcaacaa

SEQ ID NO: 4105 - DNA, 1501 bp, Oryza sativa
taactctaatagcgtccaggagcggacgctgttcacctcgatgtccacctctggacgttgttcatctcagcgtccactgcctggcaccgcctcccaacctatatcccacaaaatacagaaagaaaaaactacgtatacccatatatctcgtcgctaacacaaacaactggagtatttggtaggcgacgctcgcctcccaggcaggatcggactaagcggcagcccttgaaattttccgtttgtcgcctgccgccctcggcatctcgctgtaatgaaggcatgaagctttcgtttccgccattcacctgtgccgccgatggcaggcccaggctgggaacaggcacaatgagttcttgtgcgttaatcgttattgaaaagctcacgcactgcctcgcaactcagatgaaatacagatgtaactatttttgtgggtattcacatgaagtagaagaaaaaaataaaaattatacatcacactcctaaataagtccattcatataattgagtatttcggatttcagaatacgtgcatgcttccaaacttcacactacagaagaatatcacaacagtaccaaacaatagatcatatgactataggcgtgtaagtaattcagtactagtacacatagaaccaatcaaacagaaaagagtcatagaaggtctgaactctcatgaatacacatacatatgcttctaaactaaaacacatctttgagctacaacagcaccattaactgcaaccccaagcaaaaattataacttagatttccactactaatcctaaaattacttgtcgtttccaaaagaactgatagatatggttcttgtgtccttggcggatatcgccatatcaggctcccgacaaggtggggacggcagcggcttcccacttcccagtctcctgttggatcggcggcagtaagccagtaactgccctaggccctagcctcgaatcctcgatgccgcaccagttctccctgcagggattcctcgcttctatttctcgtatatagaatggatatggctttgggatagttaggctgcacaacatagctggacgctgaggtgaacgacgtccagacctggacgctatggaaagcaacgtccttttttggacgctattagaattagcgtccatcctattttgctaaatagcaactcctatttaccataaatttaatctgtggattaataattactataaataaaaaaatcggctttttaggagttctatttcttccagtatagtgaggtgacgagatgcattaattgtttccactgtaccaaacctattattttttcgaaactaatcaagttgtagtataaaatacacagctataggtatttcaggtgatcctggttcacaatctatctagtcgtaaagcatgtggaggtagtcttaataaaagtggagatacaagtgcacaaatggaaagaagattcggagacaacatcatataaacctgatcacatatagcactcaaagatcactgtgacagc

SEQ ID NO: 4106 - DNA, 1501 bp, Oryza sativa
atctagtcttaaggcatgtggagatagtcttaaagaagagggcgtgcatgtgtatacaaatctaaagatggtagcaacgtccggagacaacacacatgatccggatcattttagagcactactcaaaaagattgtcatttctcatagataatggatatttcattaagcaattactcagagatcatagtggcttatatagttttctcacttgtttgtgaactctaaagtgatacaataactaaaattcctcccaagaagaaaaagatacaacaactagaataatggagccctttttattaattagttgctctctgatacatcaaggataaaatctaaccaaatcaaatactacaatatcaggataaaaaaaaatcaaagatagtgtgggctccaatatatctttgattaactacataaaaagaaaaattttaagggtttgcgtcaccatatccagatccaccgccaccaccactaccactgccaccactttgaccaccaccgttcccattgccattgccacttgcatttgcatttgcataaggcggtggcgtgttaggggtaccattgtttgccacactagatccggatccattcccaccgccagtcccataaccaccggacccatcaactcctccagcttgtccaccgccattgccacctccacctccaccagcacttgcatgtcctccatagccagggtaataaccttcggccatctggccagagcttgagcccgccccggatccactgccaaatccagtaccattgtactgtgagccaccacctccccaacctcctcccccagcagttgcggtgactccgcttccgctctcactagacccataaccattaccatttcctacgccaccaccgttcacgtatccaccaccgttcccaccaccttgaccttgtccctctgcactagcgtatctaaccaccctggcagcattggctagcccaatgctcatgaggactacaaagctaagagctacaagctttgttgcagccattttgggctcaactagttaagaactttgatgggaatgggttgaatggcaaagcaaggattgcttaggtatttatagtgcccaatcgatagagtcttgcacttgcactgcagcacgcatgcatgatccaagtgtttggatggcgtgttggcgaaatataggtctatgagtgtagctagctatagctagtaaaacttgtgtttagtaagccggatccaatcttgtttgactgccacaaaacttacaaattaagtctgtgtgatgctcatcatctcgtatatcgcttaaggtatctatttctgcacctctttccaatggctagctaggcactgcacatcctgtacttccatatatactggctatatagtagcagggtgttactcaaaccaccggtaacctaaccgcgaggttaccgtagtaaccacgcttatcgtgcggtacggtaagggttatcggtggatggtaacgtaaagcctagctagtagttcgcatgc

SEQ ID NO: 4107 - DNA, 830 bp, Oryza sativa
tactccctccgtttcaaaatgtttgacaccgttgactttttagtacgtgtttgaccatttgtcttattaaaaaatttaagtaattatttattcttttcatatcatttgattcattgttaaatatactttcatgcacacatatagttttacatatttcacgattttttttaataagacgaacggtcaaacatgtgctaaaaagtcaacggtgtcaaatattttgaaacggagggagtactatcgaggtgatttaccactgctcgtgtgactattatatggaaattgtatactgcatatgcttttgtgatcaaagttatgttttcttgaagtagtaaagacttaagcaaaactattcatagatattttggttggctaaagttattcatagacacagattgtgagttcctgttcatatttatagtaggattaatttgcactaaaccatagaaaggatatgacttaacaaagaagaaaaaaaaaacaaagatgagaatttgttatgaagggtaaattttccatttatcaacttgagatatgaagatttgcatgttctcattttggcattttaactgatatgcaacggttttgttattaataacattataatccattttttaaatatagtgcaaatgataacaaggtcccaaagattacaaggcttggagcttttggagaatggagtacaaaatcaagaattggtcccaaatgatcattatgttgaaaaacagaacataacaaacgcagattggcgcacaaattgctatgagtattgtaagatgtatttgtttattcgcttcaaaacttgtgcttacagactaacttttaaaatt

SEQ ID NO: 4108 - DNA, 1501 bp, Oryza sativa
ttttcgcgagcttatcggtaaactcagggaatttgtatttaaattttggtttataaaatttgttcagaatctatcagctttccaccaaattttataaataccgtcgttccaccaaaccctgaaatggaaggccatcttgaaatcgtaaaccctgatctttgatactcctactacgtggtactcactatactagtatatctctgacccaggtgggccccatccaacccctccctcagtccctccctctagagcctggaccctgtttatcttcttctctctagctaccactaatctctcttcagtttttgtttggtttggtctgttctggtcaccgtctgcatgcatatggctcattcgatcgatcgaccggcgcggcgccaaagattcacccacgacgctctacctaccctgtctgctactgtcccatatatgctccctccgttttataatgtaagactttctagcattgcccatatacatataaatgttaatgaatctaaatacatacatatgtctagatgaatatggacaatgctagacaggggcgtactagctaggtggcaccgtggtccatggaccacctaaaaatttgaaattatagtatatgtgctagttaatatagtaaaaattatatagtggaccacccttttaattgacatattacatatagatgaaacacttttactttaaatcctagttacgccactgatgttagaaagtcttatattgtgaaacagaggaagtacatactacgtgtatcaacaccatgatgcacaccatgtcgatctgaacctttgaccatgtcggtcgagatgacatgacaaaacaatcctgtcacgctggtttgaatagtgtggcaatgttatttggtactatcatcgcgcatgtgtgtgagtcatagtatcataatgtcaaattcatagttactaggaatatcctaatacctatgtcagatttattatattaggatgttaaatttatagtgctcctagaatatgtacttatcagatttataatgttgaattaacttggtgtgtatttagttctttgggtgtaaagttttaagtatatgaatgcacatttgaagtattaaacgtagactaataacaaaacaaattacatattccgcctgtaaactgcgagacgaatttattaagcctaattaatccgcaaatgtttaatgtagcatcatattgtcaaatcatagcgtaattaggctcaaaagatccgtctcgcaatttacatataaactgtgcaattggttttttctcacatttaaattaatgccctatacatgtgtccaaatatttgatgtgacgtttttgactaaaatttaggccttgattccgaaatggagttactatttgatgcgttggtcccaaatacgctaaaccatgtttcttttttttttcgactggccatgggcaacgagtttcgatgattggcgtttccgtttagaaataaacacttttttgtgcttgcttgcgagcattggaatggc

SEQ ID NO: 4109 - DNA, 1501 bp, Oryza sativa
aagtaaacttaattattttgaggcaaatggaaggaaaaaaattattaatactaagttggtttatttcgttttaaaataaattaacctcataacatttactaatacgaagttggtttattctagaacggatggatggaatagaatgcagcggcggagacgaatttgctgtggtgctcggatgaggccggctggccgggcgcagaagatccgtgggctccgtgggtggtggtggtggccgcgcgtgcgtgcgccgcgcccacccgtcgcttctgtgggcgcgacgctgtgtggccgcatctgcgcgcgccctctctctctctctccggcgacgcgatgccggccggtggacggcggcttgtcgccgagactgaccaccccctgccacatgggccccaccacgtaggtgctcccacgtgggcacacgtgtacgtatgtgtgcattgtacatttgtactcgtatatacacacgtatatatgtagacaagatgcagtagaatgtgaacttttttctctcactctctagaggagagcatcctgcattagattatcgtaaacggattaatttttccacaaaaatgaacctgctttggaatacatatggtttttaaaaagaaattcttactaacgcagaatttttatagggaaaaaaatgcctgagaagaatcaagttgtcctaaaagaatccacctgtaatacaacttctactattacatagatttttttttacggaatcaacaccctagatcagttagaatattgttcttaaaattgaacctgcttgattttaaccaaaaaaaacttctttagaaaccaaacatttttctaggaaaaaaaggactgagaagaatcaattttcctaaaatatccacctacagcacaacatttacaatcacatagcaatcttttttttttcaaaaaaaaaaactaacacccaatatcaattagcagcagctcagtagaattcgaatgcttcatgcaattaatacaaaccaatgtaaaatacagagatcctagcattgtgcaacagtacaaaccaaggtaaaatacagagatccatatcaattatgaatattttgcaccacaatgacatgagcagagccgaaagggagtgtcccatggccattgccccaggggacatggtcccataaattatttcagacatggaaagagatgccccaccaaacaatataaactaaaccaagtcctactttaattaactagctaatcaatctccctccaaatccaatgcataatcacatacattagcataaacatatcacttggattgattggcaactgtgcactataaatacccccacccatgcctcattgcataccaaaccttcttccccaaaatctccagccacaaccagaagaaagaggcaccagtctgctcaacctatacatttttagagagagaagctgcaaagggtgtgttagagagagatggagatgtgcatggatgacaagtggaagctcaccaagaagggcagccgaaggt

SEQ ID NO: 4110 - DNA, 1501 bp, Oryza sativa
tttcgtgcaaactgagcaaactgcagggttatttgtgcgggtgagcaaactgtccgggaacttgcaatacaatgcctaaaagtaattacagacataacatacacaaacacatttcttgtgcctccttgagatggagaaatttagtggaaaaaattgaacagactactgtactgtaggtactgtagagaatttgatttagaaaccatggaatgtattagtctttcaaagagacacttgtcacagtttacatttctgtatggatggctcaaacagctaacgtaagctatttaattctttccacacaaattaacaactatctaccacaggatggccactgaaaaggcacatcgctctctttctcagaaaaaaagaaagaacaaacatcatcactaaacgaataaatttgttactaggcaaggcgacctcttgatgcatcagccagcccgacccgtttaggcccgtagctctaagagatcgatcactagtcccgccagcagacgagcatggtgacgcagcgacgcatgatgtagaacctggccctttgctccttcaccaggctcgccagccgccctggcacagaccgggatgggcctctcgaagcccggccctcctccaaccttcggctgcccttcttggtgagcttccacttgtcatccatgcacatctccatctctctctaacacaccctttgcagcttctctctctaaaaatgtataggttgagcagactggtgcctctttcttctggttgtggctggagattttggggaagaaggtttggtatgcaatgaggcatgggtgggggtatttatagtgcacagttgccaatcaatccaagtgatatgtttatgctaatgtatgtgattatgcattggatttggagggagattgattagctagttaattaaagtaggacttggtttagtttatattgtttggtggggcatctctttccatgtctgaaataatttatgggaccatgtcccctggggcaatggccatgggacactccctttcggctctgctcatgtcattgtggtgcaaaatattcataattgatatggatctctgtattttaccttggtttgtactgttgcacaatgctaggatctctgtattttacattggtttgtattaattgcatgaagcattcgaattctactgagctgctgctaattgatattgggtgttagtttttttttttgaaaaaaaaaagattgctatgtgattgtaaatgttgtgctgtaggtggatattttaggaaaattgattcttctcagtcctttttttcctagaaaaatgtttggtttctaaagaagttttttttggttaaaatcaagcaggttcaattttaagaacaatattctaactgatctagggtgttgattccgtaaaaaaaaatctatgtaatagtagaagttgtattacaggtggattcttttaggacaacttgattcttctcaggcatttttttccctataaaaattctgcgttagtaagaa

SEQ ID NO: 4111 - DNA, 1296 bp, Oryza sativa
atatagaagggaatatatattatgacatgttgtaaattgttatgtgacaaactggcaaatggcaatggccttttgttctccacagtcctattggttgtatgaagcatgaacatgcattagtataaagtagaatctagaatagtttatacaccttttaaattaagtggtgaacttgtggaattggatacactataatggaattggatacaccattttcaaagaaatgagttagggtcctcatacaataggagcttattaaggatgatgaaccaataaggttaaagaaatgagataaagagaagtctttctcatgtagcgacaacaattgaatggtcacatatacatactattggttgtatgaagcatgaacatgcattagtataaagtagaatctagaatagtttatacaccttttaaattaagtggtgaacttgtggaattggatacactataatggttaaatttgcacttcaatttatatatatgtgtgtgctctttatttttgttaacttaaactattgattgttcatatgtgctatactttatccagttgtttctatttgcatggtctaggtcacccatcgagtgtattttacccacctactcctttcataaaaaaaaacaacatagacaaggatatgatataatataggactggacatgttcgttgtcctatgttatatcaagtcattggttaggttttttttttacggagggagtaggtgtgggcaaggttggaaatttcggactttgatttctgaaatttcagtcattttggacccctccgttacgatattattttggccaaaatatttaaaaagttttaacttttcgtgaattttagtaatatttattcaaaaattcctaattttcggtctaccggtgacctccgatacaatcggtcaagccgaaaagttaaaccctaggtgtgggttgagggaaaaaaaacctataaccgtgtgatttgcgtcctcgagggaaaggctacttgattatgatcggtgtagaccaaggtttaatgtagtattggttaggctatttctatcggagaaaaccgataggactgaattttgtaaaattttagaatatttgaatataaaatttgattgaatctagtacatttcgtgagatccataaaaaataaaagaaaaggtctgcaaattttagatgcaacagttttttttaggggggggggggggttggtgggtctgatacacccgatcattgccatcggacagctcctagattaatcgttacccagcatgctaatgagtatgctatgctgctactccgaga

SEQ ID NO: 4112 - DNA, 1501 bp, Oryza sativa
gcgcacctgtccctcctcgccggacgccctcgacgcggcggcggcggcggcggcgacgtcgacggtggtggaggtgacgcgtcaatgatcggcggcggtggcggcgtgtcgccggcgcgttgcaccggcaatgtgacggccgggaggaagccgtcgcggcggacggcgacgtccggcgacggcgaggggaagaagaagagcacccacacgacgcaggacgccgggatgatcagcggcgcgaggcaccgccccgtcgcccggagcgccgccgccgatccatgcgagccatccatggcggcggcgggaaccgccctcgccggccgccgatcacgcatgcgtcgccggcgttgccggcgagccgctcatcgtacgtgttagctgttcgacaaactgatcgaattcaacgcgatttcttctttctaattgcagatcatcctccatcaatttccattttggattaaatctttttttccgtacatgatttcgtataggcgtttcatggtaaacacgtggttactggttagccacccaattttgattttatttttttattttcgaatggtcatgccgttgctgacgttttatatatataaaaagaagatatcccattttaagaagaaaatatgatcagaccttacacagttaatttattttattttattgatataatcgttgcagtttggagtgcttttctaaggtttgagacgcatgcaagcgtacgaattggcagtgctaattatgggatcattatgcatgatggttgggtgcaggttaggcatgtttcttgaaaccatttttgtgtttggattgcgttttggttatgaattcattcgttgtgacttgaatgatctatagtttgttattcagaatttacagggttttttttttcgatttggtctgtacgtcaaccgtcaactgctatataaaacttgtaagttaggttttaattaaaatttaaaattttggagattggttattgttccatggaaaagatgtgaagattattgcagtcataaaagtcagttgatatcttcagcaaagagatcatgaagagaccttgtttttattttagttttccaagtggaaatggtcagtaaaccaagcaattaaccaacatagtgtgtttgtaacgccacgtggcacagtagcagcaatatccgtgaattagaatgctcagattgagaatgtgaaatatgatatgcttgattcaaatccgttttgatgaattgacatggaaagcaactgatggttttaagatgaaattgaaagaaacatgcatggattcaatttgtccctgcaaaagtgtatacaggggtagtagtaatcagcatatgcatgcatggatagatgacgattacccccaatctgaaaaaaatgaaattactgtcaaactcaaaccaaagggttcaggttttaagctaacacattcaaacaagcactacagggagggatacagggattattggagtacattgctccatcataaccatatccagcaaat

SEQ ID NO: 4113 - DNA, 1501 bp, Oryza sativa
tgggttctggcggcaccgctagtgcatcgccatccactgctagtcgtcccttaaatccccaccccctccccgaaattcaatggctaatgtaattgactgatgttttttacaattaactgctgaacaacaaaggtaaaaatttaaacgctataaatcttatattgctggatgaagggagcaatatataataataaataaatatgagaaaattcgattggtagcataggtattgtccgagtaaaataatagcacaagaaacttgtttcttcgcctgaaagcacagctctgttagagatttctaaaatttagcacttccgtccactaaaaagaccaaaaagaaaacccttaggtcaatttcttcttcctcctccttccagtccctcactgcatacctcttcccctgttcatcgcttgcctcttgtctcttatgcatgaccgagacaccacgcataggcaaggtccaatttgtaaaatttaagtttttatcttacatgtgtatggtggttattgaagttgaaattgattagtttttaaggagtatatggtccttgcaatttttggtcatgctcacatcttcacctagcaataagccctagcagccgttgcaagcaagtcggccactgccagcgttgagctcgacggcttaaacaagctgctagctactcgtattccctaaccctcagccagtcgccatcttcaagcaaccaccagccatcgttgtcaacaacattgaaatagcagttgcggcgcatggtcgcgcaagcctgccgtcgtcgctattttcatggcgtgcgcagcctctagtccaagtgctctagcgcaagtgcccaacctagtcatgtgtaaatgcagagaataatatggacaaattgatctttctctgtccctactcatggcgaaaaactttgattagacctgtagttgtgacggaaatacaacggataaaataaaaacaagtggaatatacttctgatcgaaggtgggaattttgtgtgctattttttggataccgacatgttttctatgttatagatcgaattttctcaataaaaatataatacaagaggaagggtaatggaccaagtattgagaaataatttttctaataacatgaaaactacccatacgacgtatgtatcctcgagctacagatacgctggtccttggaattttttttaaaaaagaaatccaaacatttcagtaaaattcatctaaaatttcttccaaacacatcactccggcgccccctgatttctccgttcgctcgcgccgccttccgccggagtaagctctccgccgccgtgaactcgccgttcttcccgccgccgtcctcctccgcttcctcctcccctacagtggactggcgtggggtggagatcccccctatccatcccgaccgactcctttcccccggtgaggaagccctagctcgctccgaatccgctctcccaatcctcttcttcgcggtgaggtaatccaaacccgaattgctctgcggtga

SEQ ID NO: 4114 - DNA, 460 bp, Oryza sativa
taatattacccatatttatttatttatcgcacaaatgaattctttttagattaatttgagttattggccctaaggtgaacttatatatttttgaagactttggggtactattaaatttaatataacgacttgtcatgattaatacattagcagattggttaagtttagttgtatagcaatatattttacacggataggttcaatctatttattctataaatagtaaattgagactcggcacaatattaatctaattatttaattaaaacctcacaaaattttataaagcttaatttaattatacgaccattatttcatgtgaattggtttagctttatatagaccattagagtttagtaatatcccattaattactcctagtgaaactatgtcatagatagagttccattataaatggtcatcatttcatgtgtatttagacgtcatgacacgcaacaca

SEQ ID NO: 4115 - DNA, 1501 bp, Oryza sativa
tttcggcgccgtgcatggcgccgccggcgtatgatccccaagatgatgaggtggtggtcgcgcgtgcagacgacgcgtacatgttgcctgcagcctccacgccgccggtggcgacggcggcggcgagggccgccgcaaggatcacgacagcgcgcggcggcggcgatggcaggtcaagccgccgcatcacgcgcgccggccggcgatgagcaatttcgatggcccgtcgtcgttgcttgctactagctagcttccgttctggtttgctgctgtcctgccgcgactttgctgcgtgtgatatcactcctataaatagcgatggaagggctgatcgagcttcctgaatatggttccatcgtttcgctccggaggcaggccggagtgtagtggtaccctaccccaccctcccttacgataggagttttttttttctttatcttatctttttttatctgtttttttttcttgacccctggcaatggccttttgacagtgtgcgttgtgtaatcaaattttgttctctttttctaacatatatattgacgtgtaatctttttgcgccttcgcgaaaaaaatgtgtttattggtacggtttattaaaatgtatctctactattatgaaaattgaaaatattttcatcggaattttggtacgtcatccgtgtttgaatcggttttaattttatgtttctgtcaaatcatttcctttttttcttacgccgctatgacgcgcgcaaattaattgggccagcatcttttcacacgctccttgccgtacgcagtgattgggctcgcgacagagtctgttttccacacgcgcctttgtgcgccgctgtgattggacccgcaacaccctcgctctcgtgattttcaacatgtccgattgggcctgcgatgccctcgtgagtgtaatttgccttgccacatgtccgagtgggactgcgtcgccctcgccagcgattcaaaaattgaatgttttttttgtcaaaactatggtacgtaatccgtatccgattcccgtcacgcgtaacattcattgcaaagtcgcacccacgagcaaactgtgaaacagagaccgtacgatgtggataccaagctgtcggtgacatgggaccgggagtatcatgactagaggcttgggcagccgcggtcacccacgtggcctgaccccctcggggggtcgggcccgagggagacgtgcccaccccctcctctgtctccccgaggggtcgggccgctcctgtttcggcccctagggctggggcgccccgaccccctgtggtattggcgccacgtgtgtgggttaggtgggcacagcggcgctcaccaaaccacatttattgcggaatggacaagcgcgccacgccgcatttaatgcagcacggcgcacgcatatccggtccgtgaccggtcgcagtgtgtgaccggtcacagaccggtcagatcgcgggttaggtggcagcaggcggcctgtcacacgcctcgccccgtcccgtcgaaa

SEQ ID NO: 4116 - DNA, 1501 bp, Oryza sativa
cggtggcccccatcctcatgcgcccctcatgcgagtcaggcgaggcatcgatcggagacgaagaggaaggctggatctggaagagtggaagggaggcgactcggtgagtctcaccggtgcgcgcctgaggccctgagcgagtgagcgacggacggtggaggaggagatctggtgggcggtggagcgtcggaggcggatcggcggaggcggttgagcggtggcggctagggttagggttaggcggagaggcggagagcgagaggcgagaggggactggggaggggaggggcggcgacgcggcgttcgctgccttatatatgcgggcgcacgcggtgcggcctggctgtctgttgggctgggccgtgctcgtgcctaccgttggtacgggccgtggtcgtgccgaccgttgggccgtgccgtgccgggccggcccatcgtgccgacctcggtccgtgccgtgccgggccggcccaccgtgcccagccataggcccaggcacggcccaatagtcgtgccgggccggcacgggcccgactgctaccgggccgtgccgtgcttgggccgggccaaattcccgtgccgtgggccgggccatcgggcctcgggccatatggccaactatagccccagtcgaaaatagttgttttagttttatttctcctttcacaaatcatgtcatcaatatcatggcaatgtggcgctcatgtctccacatgccgcatctcaattaccttcccaaaggtaattgcccaagcataaagcattttgataaatatgagtatgcatgattctagaatagcatttctaagcaattgtcatagttgactagggactcatacgtaagcatggttacgaaggaataaggggtaaacaataatcaaggcatggcataatcacaagtaggatgtttatcattgcatgcaattttatttgtaaacaaaacaatttcgcaattgggatcaacatgttcaaagaatagtgatgacttgccttgctcaggataatccttattattgatataatcttgatcaaccttcacctcctggaagttgcagacgttgcctcacgactaaccgatgcacaaggtctataatacgcaagaaaaaccaatattcaaataacaaccaaatatgcacaacaaaatatactattcatgtctactaatggattccaatcacgctaggggctaaggtttcttaatctttctattgtcaacgtggcctatttaggagttaaccaacatagcatttataggatacatatatatttggctaatcggtggtttagtctatcaaatggctatggaaggattatggctaagcatgcatctatctacataggacggttatttactagaggttctgttgttagatggatttaggatcaatcaaataattacagtgaatcatttgtattatttattttatttatggaagctttactttaattatgaacatattttacttgtcacaataaattataaaaggttaataattatcca

SEQ ID NO: 4117 - DNA, 1501 bp, Oryza sativa
cgaaccagaaaagaaaatatgtgccaccaaatttggttctcgtagtcgtccgtctcataaacaggatccaattcagtacgcagttctcctagtcgttggaaactttaactgagagttgagcgtgttttctatgatgctacgcgaccatgcagtattgcagtcaagtcgtgcgaatacggtaagcgtttatatggaactaacgaagaactcgcggtttatattatacctggagcgatcggcggagagggcgcggcggaccgcgggaggcgtgcgactgatgccacggcgtctggcgccaggcgaccttgccgtcgctgccggcgctgatcttgcagccggacaccacgagctccagggaccacagctccggcttcttctgccacagcacgaacccgccaacctcgccgccgttcttgctgctcttcttcccgccgcggtgccctccgccgccgccgccgccgccgtcggcgtcgctgctgttgagctccgcggcggtcatcctcaccttccccatcgcgtacatgttcgtgaccttgttcagcgcccactccccgcccgacgccgcgatgtactgctgtattatgtacttggccgtggacgactcctgaaaggggacacgccataaatggatgagccaatcagcgcgcggcgatggacaaacgaaacggagaagaatccgatgatggcgatcgtacaatgggatcggccttgagctgttcgcagaggacggagcagggcgactgcttggcgtggtcgacggggagcggtatcagcggcgcgccgatgacgccgagcatgagctgcagctcgccgcggctcatggagcacggctctccggcgccgccggagcggtcggacgcgttcggccgcacccacgacttgacgttggtgcagccgaacctggagccgcgggagccgccaccgccgctgccgcgtgagaacatctcctccgggatgggcacctcgagcaccgtgtccagcgcgtcatcgcgctccaggttcgggcacagcttcctcatggagacagctctcctgttgcgcgagctccgatcgccttcggctgctgcttctgctcgctttggtgccgccgcgcggttccttttgtgttgcgttatgacgcctaccctgtctcggtgggtttgtaccggttttgatgagtcgtgcgggcagctggcaggtggggtccaagatttgctcttacattatttttgcccccccaaaatttggtcgtggccgcacgcactctgcgatcttgtttaacatttcttttctcaagagatatccttgtgctcatcgtccaaacagtaatatacacatatacgcacgatcatgcgttgccctttcctggtttcaactttcagcctttgtgccgttctgcagtgttcccacacactcactttatcagttaaacttgcatttaaccgattcttcgctgttgaagatgatactacgtacggagtgttgctgcacgagtagtcaattcgatggaagcatcgacacg

SEQ ID NO: 4118 - DNA, 1501 bp, Oryza sativa
cagctcagctgtgtaacctctaaaaatactagcaatacttttaatttggaccatatcttatctgccttcactgacacctcttatccagtacttatgcgtatctagatcgtgctaatcattgacgctccgtaataatgtctgtgatccggccatttgattggagagtatgcaaaatatgcatagtattacagacggatggatcggatcgaatcagtgtactgtaaatgatgagtaaccctggcctgattgatccgtggatctcccatgtcgagcggcagccgggcaatcacaatgatgagacccgatctcacagagtggtacgtggtgtccatggcctttcgatctccagcagcagcggcagcggcagaaacctggttggcacgtcggaggaaacggacaggatctccacccccacgaacgcgaatacaataatcccgcgcgacgcgacgcccgcacgcacggggcgggggcggagcggacgacgctagcgtccagccacagcgcagcgcagcgtggacggaaccccgacccgccgatcaagccgtccacccgcgccggcgccgcgaatggcgcggcccaaccaccgggagcgtgaggataaaccaagccgagacaccgggaatctggcgcgcggcgtgcacagcgaagcggcccgatatcaagcgacgatcatggcggcaacctaacacgggggcccgggtgcacggtgcgtgcgcgcgaacgtcaacagcctacgactacaactagtactgttcgcgatcccctcctcctaatcgtttgaagccagtgccgcgcacgtaggcgccctaccggttatggaaagggactcgcgggccgttcggaacggattagctagtcgtaactcgtacgtactcaggcgtcatgcctatggttcgtgacttgtacgtactgtgttacatctcactccacggatgcgcgatcaggatcgagagagaaaaaaaaaaggcaatcgatcaattgcttcccaacaactccaggttcccattatcaatctgaacgtgtcgatgcttccatcgaattgactactcgtgcagcaacactccgtacgtagtatcatcttcaacagcgaagaatcggttaaatgcaagtttaactgataaagtgagtgtgtgggaacactgcagaacggcacaaaggctgaaagttgaaaccaggaaagggcaacgcatgatcgtgcgtatatgtgtatattactgtttggacgatgagcacaaggatatctcttgagaaaagaaatgttaaacaagatcgcagagtgcgtgcggccacgaccaaattttgggggggcaaaaataatgtaagagcaaatcttggaccccacctgccagctgcccgcacgactcatcaaaaccggtacaaacccaccgagacagggtaggcgtcataacgcaacacaaaaggaaccgcgcggcggcaccaaagcgagcagaagcagcagccgaaggcgatcggagctcgcgcaacaggagagctgtctcca

SEQ ID NO: 4119 - DNA, 1501 bp, Oryza sativa
ggccgccagggagatgtcctcgacggtggtggtccggttcaggatgtcctcgacagtggcacctctgtccagttctgtagggcacgaattggagccacgggcagcagcgtggcgcatcatcggcagcaacgcttcaccggcacctgcgcatcaccggcaaaaaatgagaaggggcttcactgccagcaattactaggactccatcagcagtgagaggcagcatgacaacttcctacaggtcaggctcgatgtgtggcaggatgagtacctcaaggttcatggtcagtggtttgctattgtcacacatgtgcagcaggcacccaagggcagtcctgccactgcttcagtcagtaccggatcagaaactgagtaatggcaattgtgcctgaacaaaaggcgtcctcgtctgggactgtaatgcctgaacaaaaggctctgcaatggcaattgtgcctcctgtgtaatgaacttgtgtgtggagcattgtgtgtaaaatttattgaaaaattgtatctcagttgtttgtaccagaagactcatatcattgaaaattcatgctaattttttagtgattcagcaatggtgcctcctatgtaatgaacttgtgtgttttaatgattcaacaattgtgtgtgaaattgaaacactgaaacattgaaaaattgtatctcagttgcttctactagaatttttacaaggtgtttacaatcactaaaatactgaaacattcatgctgttttttccgagcactgatcagcactgaaactgagaaacattgaaaaacgtctcgctggcgtcgcgggcgaggactccatgccgactcgctagcgtgcggctgtgacttgagggccaggtcggcggcgactcgcgtaccacggcggcagccactcacgggtgacacgcggacgatggcggcagcgactcacgggcaactcgtggacgggacgggagaaacgaacaggcggcgtgcgcgctggggattagggggagggggtgatttgaaaaaagcaagattagtatggctaatggtgggcgcttaagtgcaaaattagcctacctctatccctacccatcagatggtgattatgtggtcttgattgagagtttgcaagtttgcacaccttccctggttttcacatgatacgttcccatttattttagcttaagattattataatctagattattgagctagattactgtaaactgaattataataagccgacataaaataaattgttagctgtttgtttatctggattattagctgtttgctagttgttatccacccaataattaaaaaaagcacatttaggccctctttttttaggcttataagccaacttataagtcgaaaagtctaagccaaaacaaacaagcagccttttcatttggcttttttgaagctataagccactctaacactattaagccaaaagctagattggagaagcttttttggcttatatgagatagatatatgactccaccactaaactta

SEQ ID NO: 4120 - DNA, 1501 bp, Oryza sativa; identical to SEQ ID NO: 4117

SEQ ID NO: 4121 - DNA, 1501 bp, Oryza sativa; identical to SEQ ID NO: 4118

SEQ ID NO: 4122 - DNA, 1501 bp, Oryza sativa
aggagtggcattcatgtttgaaaggtcacattctgcatgttcagggaaatagttcaaactttctaaaacataacatcataaagatagatttctttacaagcatggttttaaacgtatatgtttcatttcgacaatcatagtattatattgttggtgtatacggccggattcacaatgtttgacaatcatgtggagtcaatcagggtttcccaaaccgctggggccgagttaccgcgccccggcggtaagcacggctaccgcacggtaaccgtgaaaaatcatgcaaaatttatcaaaaatttaaattattttttaatttatttaaatttaaggaggttaccgcggtatttctattaccgtacctccgcggtaaggacggtcactgcgtggttaccgacggtaatgtaagccttagagtcaatacaggttactgtatatatagttccacgtggtcaggtgcacttcttaatttagaggtaaaaacacctatataatatgaatgaatttattatagggccttgtttagttggggaaaacttttgggtttgattgtcacatcggatatatggacacatttgaagtattaaaggtagtctaataacaaaataaaattacagattccgccaggaaactacgagacgaatttattaagcctaattattctgtcattagaaaatgtttaatgtagcaccatattataaaatcatgacagaattaggtttaaaagattcgtctcgtaatttacacgcaatttgtgtaatttgttttttttcctacatttaatactctatgtatatacaacgtaaaaatttttgttttggaagctaaacatcctaggtcttgatataattatgtgtcatgccaatcactgttgtacatatgtgaatctacggtgaagaacgagagaggcacctctagcttactgtagtaattgacctgccaatgcgagctttaaattcgagtgacaattcaccctgtacgcttcttgcaaacgacacattaatggtcatcttttcttccatgaatatagcccatttcttcatacattgcgtgcaacgtgcttatgaacttcgcgtgcgctgttctttgactacagaaataagcacttcgcgtgcgctgttctttgactacagaactggattcacgcatagacaaaggctcctgtggataagcaactagctccctatccaagtatccatcgttggaaaaactctccaatcaagttaggtcgaagttttcctctatagtccttaaggaaaaaaaaggggcaaatatcagtgcttcactacagataaaaaaaaaagcctgtgtgctcgaatattgcttgaaacaagttaattctgacgttttttgaacattttcacatttgtgaatatctttgcacagtaaacttgtttatcaaaataaaacaagagagaatcatatatagatggaccactaatttgtaatattaaagtacattaagggtgacggattaactattattgcccttttttttaga

SEQ ID NO: 4123 - DNA, 1501 bp, Oryza sativa
tgtgagacaagccattgcttctgtccaacattaaagacaagaacgagagggtatcatggaaggaacaaaaacaacgtaaaaactaataaattaatgcatagtgatgccaaaacctggctaaaccgcacgaacagtccgatgttgacagaatggttatccctcctatagcaatctaggatgtgataagtaagactcatcctatgagtacgaattagaatatactcaaagctcttgaacatactcaaagctccaaaataagccaaacggcttatttacaaaaaaataataatttatgaataaaacttttatatacgtgttcttagcgatttaaaatcaaaggctggaaaataaaattcgatgagaaaacttcaaaatcaaatccaaatttaagattgaaaatttaaattttagctgataaatataagcataagcgaaaatatggggctgtcaatgtaagttgccagtattgggagggaggaagtagcacacagaaacattgagaaggaactgtgaccagctcagttagtaaaaggtgcatgaattcttggccagctgccttcatgagatgtccctctcatggatcaacttatctaggattattaattttatccttaaagagacaactgacattgtgaaaaacaagaactacaatagatttccaaattgttttgatacttctgttgaagctcagatcatttactaacctggtaatatatccaccaagttaaaagagtggcgatgatacagtcaaacgcattgtttcatccatctactgagaaacctacgtgttctactcaattactctggtgaaacatacaaacatcgccgatttgtacggtttaacaagaaaaacaaagcccataaaccctacgcaatattttagccccgatttctctctccccgtgtttgctatacttgtgttcacaactaatgaagttggaaactaaatacaagcatccaaaatgagaaagacattagaacataattaattgacttttaattattttaaatttgaaaaaaatgatttatctaatattttaaagtaacttatatataaaaactttatccactaaatatattgtttagcatattgaaaaacatgctaacagaaactaaagtaaaatatgtatcatcagaaaagaatgccttagagtaggtacaatagcagactataagccaactataaatatattttattaaaaaaataaaagagaagagataagagcagcggactatagatttgtagtcagctatagtacggattccaaaacacatgtgtgtataacaggtggggctagatattgattgtgtagtatatatttatagataactattgtattaattagctattaaattaactatagatgatttgaagctaatagttggctataggattaaacttgctcttgctaccagtctacctgtgccggcttaattccctttcagctagcacagtgccgttccggcgcggggccagtgccaagaacggctcaagcctccc

SEQ ID NO: 4124 - DNA, 1501 bp, Oryza sativa
gaaacacaggaaagtcttcaaactgtcgtttgattagcacacaggaaaaacgtaggaaccttagacacatgaagaggaaaacatgaggtgagacctcatgcttatttttctccaaaattgctctagtaaggttcattccataggaatttcaaaggaattgataggaaacaatcctttctttcaaaggactctatagaattatttctcataggataaaatcctctagaatttctatggtttttcctttgaataaagggcctaaactttggcctttgttgctttgctaggctacccaccgccgcgtcacgcgagctcaccatgagtccacggtccatggggcaaaacaccggggcgggctcccccgaacaacggaaataatgggctgtacactcgccgactcgcgtgcgtgctggcgaatggcgatcgacagcggcagcggccagctttcagggtcgcaccctttttttcccttttcttttccctatccgagaaaggaagggaaaaaaattttcagagcaaacgtactcctcccgcattgctagtcgcaggcccagcgcagcgccacccccgccgccgctctgctctcctcccgtttccgcgtagcatcaccgtctctcagcgagcacaaaaagaaaaccaatccaaaaaaaccaaaaacaaaaaaaaaaaagcatgcaaatggaggggcatacattcgcgttgacacaacgaatctctttcttttcccctcccgccgttaacacagaaccgaaaatattccccccgtgcatccgccactaatgcgccatcaactggcggcacggcgactaccgaatttcgatttttctttctttcttcgctaaagaagacgctaattgcgatcgagttaacccggtgagagatcgtttgctttttgcacggaacgcggaggaggcgaaggcgaggagaggcgagatgagatgagatgccgtgcgttgtgggcgggcggccgccccgcgcttcgcttcaccctcaatcctttcctttctgtcgcggccaactcctcgccaccacgccgctttattctctaagaaccccctcccctcccctccccctcctcctcctccgtccatcgcagctactgcctccttcttcttcctcctgatcctctgctcatcgtagaaatcgcgatcgccatacttgaccttgcagagctctgtctctgtctctcgctctgattgaagtgttctgctgccatctctctcccgcttctgtctccgtgtgtgcatatatatatgctgtattggggacgttgcggcagcggttcttgggtacatggcctactcctcacggtcttgtgatcagtgcagtcacggtaatttctctgatcctaatgttcagccgttgccatcgtcgtcctcctcgtactttttgacgttcttgttcatgttggacacatggttggtttgcttgtgcactatgggtagattagatttcacgtactttttcagcagcagagagctattgttttcatggcaccagt

SEQ ID NO: 4125 - DNA, 1501 bp, Oryza sativa
tgggattgggattagaaaatgaatcaatggctaggatgaaataaggtggaggaaatgaatggctaggattcaaagttaccccttcataagtgggaaattatttccctttcctattatctaaacggtgccttaatttccctcctctgaatagcacagtggtatgatttatgcatgacagttagaaatgttcatctgatgtgattgcacggcgatcgatgttaggatcaaacagctaaaggtcgattcgaagctagaccaataatatggacctgtaccatcaccatttgcgccacgctcacgccatgaatgtttagatggggctaaaattttctagtccatgtcacattgaatgtttagatgctaatttaaagtattaaacatagactaataaaaaactaatttcataaatgagagctaatctgcgagacaaattttttaagcctaattaatccataattatgaaaagtttactgtagcatcacattgtcaaatcatagcgtaattagactcaaaagattcgtctcgcgaattagtccaagattatggaatgggttttgtaattagtgtatgtttaatactctaaattaatgtccaaacatccgatgtgacagaagtccctgtttcacaaacaagcccttagaataggacagcctaatggcaacaagaacgttctttcagagagagtggacatgatgtggcgagtctaacggataacagtctcatgtgtaaagaaacgcctaaaaaatcggctattttgccatggatgttgacgcatcgatcgattggtatgctaaattttttctctgaaagggatcaactgggatccatttttgtgttccccggagtatcatctttaggaaagctaaaagttcattttgctttacttgctgaaatcaacctcgttttagtctatctgacgttaattgcactgccgacagtagtttagcctgccttgtttgaagttcaatcaagacagcacatatatttcaagcaggcaacaaataaaaagttaaaatcttagtcaggcaagagacaacgaccagctactggtgccatgaaaacaatagctctctgctgctgaaaaagtacgtgaaatctaatctacccatagtgcacaagcaaaccaaccatgtgtccaacatgaacaagaacgtcaaaaagtacgaggaggacgacgatggcaacggctgaacattaggatcagagaaattaccgtgactgcactgatcacaagaccgtgaggagtaggccatgtacccaagaaccgctgccgcaacgtccccaatacagcatatatatatgcacacacggagacagaagcgggagagagatggcagcagaacacttcaatcagagcgagagacagagacagagctctgcaaggtcaagtatggcgatcgcgatttctacgatgagcagaggatcaggaggaagaagaaggaggcagtagctgcgatggacggaggaggaggagggggaggggaggggagggggttcttag
